United States Patent 10,233,495 (METHODS AND COMPOSITIONS FOR SCREENING AND TREATING DEVELOPMENTAL DISORDERS) - sequence listing, part 160

SEQ ID NO: 902 - DNA, 195043 bp, Homo sapiens
gaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccaggtgggtgcgcagcgcggcccgggccccacgatcctcctcctgctcctcctactcctcctcctcctcggatgccgtggcctctccctccccctctccctcgcccgtcctcttcgccctgcgctctgagcgcccgttgagtcgcgcggtgcttcccctcctgggggccgccgctcacctgggcgccgagtcctaccgggcgcctacgcccagagctcagggcaagggacagcagtcccggccgcaccctcccagagtcccgggagcgcttcgctccctggcacggcccctccccagcgccttagcggctgagcccagcccgggagtgggacctgggctataggagtcgaggctgcgtgcgcgcgtgccccgcgccataagcgctttgcacgggggccgtgtgccctctagcgggaaacgctggaatgggccgcctggagggagagccggtcccctcggtgtgcctggcagcgcagaagtgggtggtcgagcaagaggccgcgtgggaagttagcttcggcgttttggggcacagggcaagcgatgtagagtgcgcgccggttcatcttgattcagtcctgtgctacggagactcaagagcagcggcagggattcctaaaggtcagcgaagcagatgaaatctagtccagtgtcaggaatcagctctgccccaaacaagttctacaaacttttggcttaacagttctatttttcaagacctctgtgataaatatggataatttactttcccaagagatgtaagaaaacaaccgtttatctgaatttttgaacccaattgtttgctggttatctatataataaaatggcaattgaagctttctagaaacaaatcttgtatttcatcatcagaacacgagcatgaacaaaagctttaccttagatgtccctaggaagcgctgatgctttggacattaccttggacaaaagaggcatgtcgaataaatacttgtttatgagtgattggtaggtagctgataaaagaggggaggaaggagatgggggagaatttattttttgcctctgcaattcccaattattaattgatccagatgccttaagtcgcttcgagcgtacccccaacacacatttcatgaagcacttctgcagaattaattcactagtacttgataatactgtggctacagtaatactgtagaagtatttgtcccttgctggaagaaaacaaaccacatttgcttggtcttcttactggtatcactgatagcatttcagaacctgggttattggcagagaccttcagcagagttttgagcaaaacagaaattgaacagagagtaattgtttcaccactggccattcttgtgcttgcttctttaataagatcctgctgatcatattcacttcaattactgatcattgcccctcatgagggtgtattgaattttcccttatttttaccctatattttggggagagaccatagcactttattcaacaagataggaaattggggagctggattagttacctccctgcgtgactttgtctactgtcctttctaaggtcatcatagtacattacggagatttcagacctagctcaaatcgttgtaaagagttattttgggggctcttatcactgtttgtggttgtgttctcctgtctccctgctcattggcttcagaagaagtttctgtggtcctctgtagatggtctaatgaattaagaaggggccagcggtctgaagtagcatcctgttcaggtaataggtgtgcattttgtcaagggctcccagcagcagtaccgtaacacagcaacttgacaagttcagtgggggaggggcaggcatttctgtgccctccagatctcatctactaggtaggcagctgtcttgtgattagctacgctctcttgacacagagcaccagagcttccttggtggctctcatctgctttccagtggtacagcagtgattccctgtaaaccagctaagtcagtatctttaagtgacatttgcttaactgtcttccctgaaaaattggggtgaatttggctgtaggttagtttttagtatatttgtctctgttttccaccagattataatcttttttggggagggactttttacccccttcgaagcatcttgtgctttttaaaccagataagaatatgtattctttatttgattcagaaagaatggtcaacaacttgaaaccagctttatatagaagcacatggcattaaatacaatgcttcagaatcagtgtttctttccttctttgtcattttccttataatggtaagtgccagtgtagttttccttgtcttaggagaattcatacctgatgactataatggtttgtgagaaaaacccacactctaggtttcaggcattcccaaaggaacgacctatagatgccataactctagtattcacacttgccgtgccagcccaaattaggacttaggaggacaagtttctcttgtattgctcccatcttagtgcctgtcagttccaagtttcactcctttcttaaaacagccactgcaactgtctgtccttgatgatatgtatgcaatagccaagcctctcttcagctgttttaacattgcctcatgacagtcaggggagagataatggggtgggatctcagccactcagccccgctgtgtgctatattgtacgcataggcataaacacatctgttggagggaaattttcagggggaaaaggcttctttaactttcatatggcatgagtgactgatatgcgatacatacatggctatttcagagcatctgcacttttatacaattaactaaatgttgaattgcacactattggggctgcagatgttcaacacaattatctattccataataatagctctaataggtcccaagcccttggagtcattgattccttttctttgctcaaaataagcaagctaagaatagtcttgggtgctgtatcactgatccacgtaccaagagccctgtaacagcctgggtctccttggtgctggacctcccatatccagcctcttcatactgattcagctcaacagactttttctcttgaagcctgaattacaaaaccagagcttttttttttttttttttttgacggagtctcgctctgtcgccaggctggagtgcagtgggtgcaatctcggctcactgcaacctctgcctcctgggttcaagtgattcccctgcctcagacttttgagtagctgggactacaggtgtgcgccaccatgcccagctaatttttgtatttttagtagagacagggtttcaccatgttggccaggatggtgtcgatctcttgacctcgcaatccacatgcctcggcctcccaaagtgctgggattacgggcatgagccacggcgcttggccgctttttttttttttttttttaatttttggccaattggtatttgactctaagcttcctttgtgattctctgtcgatatgttgttcttactctgcacctctgcacggaattctgtcttttttctttttcctcttaaataacctgggaaaaattcactatcatgcctagccagattctagaactatcctgtctcccttcactcctggtaggaggggcatttgtgagtctgggtgatggaaacattgagaaacctagtatcccaaataggtagaagcaggctgtgtgtttccccaatgacatcacccacctgtttccctcactaagtggctctgcaggctgaagtgcttgtaaacattcttgcgtataaagtaccctgaccctaacggggcagcctgtgtttacagaacaagaggaatgtccagtgatctgtttcaacctggttacttgtaaccacctagcctatgtaattattaaaaacattaaagattattcacagaatgaaataggacttattttgcagaattaaaatagcaggaagagcggaagaaagttgtatattcagacatgaatacttctcatacccatgaaatggtcagataacactaatgaaaaagaggagaaaaaatatatatagagaaccaaaaaatattagacaaacatgaacactgaatacctactacatgccaggcactgtgctggacacttttatgtttattaatgagggacctgctatttattgaattcttaccatgttccaggcagtaaaacagatgtatattgtgtattttgtcatccgtcctttcgaaaataagaaaattccttgctattaggcagcaagatgccagatggcctagtccttagctcttcagccagattgcctgggtttaaatcctaattaggctgttccttaaatatgtagtcatgggaaagttacttaatctttctgtgcctaaatttcctttttctgcaatatggggataataatactattattattatcatgagggtttcatgaagcttaaaggaaataatccatgaaaagcactctgaacatcaaccaacatgtaataagtgcccagtaatattagctgtctttataaaactacttaagaaatgaattatctgtgtctttgcaaagatatttgatataatttccaaaatttaccttttatggtaaaaaatatccaaagctgacctcagattacagtggttataaatattaatatgtactacctgtaaaactagagaaaagtggataagagtgtcaaattccataactgcatatatacattatgaaaacagtactgaactcaatctaaatattgaaagtagagtgaggtgcaacataattttatctctggcagaaaaatgttgaggtttcaagctatgagaagattttgaaacatgactcttttttctggcaacacttaagagttgatgcttaaacctcactttattgtatagaatacataatcttctcttttgggactcgtataaattgcagcaattgaaaaacaaaagtgtgcaccaacctgcccctcactatctttttatcaagcataacagtatattgccagcaatgttcatagaattgagtgcaggtgtttctaaatataaacaaaataaggaatatattaaattcacatttctagttttttatttcctcctcagccttcctagaatggctataggtagtgtttaaagttctggaagtgtgatagattcttaccaaatcaatgttctgttagcattctccaagtaacaagttaaattggatttgaacagtactgatagtttatcatgttctgttaggatagatgaaaacaaaccaaatgccagtattttgggtgagtcactttatttgctcaaagacgcaaatgaatgaacttctggtagtttagttaaccctggagctccccctcttgacaaatagaaaaaacaaaaaaataaatcagatagtattagcttgaaaacggatttcttttacccagataaaaaatatgccactaaggtacatacaatgaagttttcttgaaggaactaatgatattttggatttctcctaattttgtgcatgtctgcacttgtgtgtgtccttgtgtatgttttaatgggttaaaaaaaaaagcgagctaccaaaataccaatagatgtcagtgtttgtcgctttagaaaaagtgaggtgttagaaaaaaagaagaaatggacagctttatttatttttggttttactaaacataaagctggctacttttcaacaattgactaataattcactgtatataaccctgtttacaaaagtacattttattaaggaaaatattccatgttctcatctttcttctaaatttttttaaaaaagcctctgcagtaaattcccaaaagaattcagaatgtaggcagaaaatatgttaattttttaaaattaggaaacaaaattatttgagaatgtcgttaacacattagatttcttttgcatttttaaactagaaattagatatgcactttcttatgttgccctgattatgactgataaagtgcatttttcagtccaagtcaagtgagatctgtggagttctgcctctacataagagcagagatgatcagaattctcttcattcttcctatgccccatgtcacctttttctggcctccagagggtgctccaggagcatcacactgctattccccaaagactgcttttttcttctctctctctctctttttttttttaagttactgcagtattctgggcaatctactggaagaacagagtcccgattccatacatgttagctgcctcaactggagtttgttttccagctggaccacatagccctaattcattaagtattctaaattagaatattttaaaacattattctgatgatgttgatgcagtggttagcttgcaaggggacatctgtcagattaattccctctaggaatttcccccaagagaatcaagcatctttaaataccttccaatcacgccttacaacagctccctcccactgaagtgcacatggtacccacaaagagatttagtgctatttaagagtttcactctggcattggaaaactataggtgaaagcatcaaagttggacaacagatctttactaacacatttgttttcatctcttcctatctctctgtttcctcaacccaggggcaacaaatgtttaggagccccactttgattgagtgcacatttttgaacacaggtttgagtgactaattcttgtggatcatgggctgattttatttatgtactttttttgagacggagtctcactgtgtcacccaggctggagtgcagtggtgccatctcgactcactgcaagctccgcctcccgggttcacgccattctcctgcctcagcctcccgagtagctgggactacaggcgcccaccaccacgcccggctgattttttgtatttctagtagagacggggtttcaccgtgttagccaggatggtctccatctcctgacctcgtgatccgcccgccttggcctcccaaagtgctgggattacaggcgtgagccaccgcgcccggcggggctgatattttaatatggtcacacaggccttgttatttatggtttacctgcttatgttaattccaccctgtacttgttatctttgacatgagttactctcaggatattactccccttccctttttaaagtgtaatattgttcccattgtttcttgctccaagaaatctgtcgttgatgggaatagtctttgactgccacagtgccccgaacctttcattccacagctttgatgggcagggagctgccttctctgggcagctgtggagttttactttcaatgatatgagagtcacagaatgttttattagattgaatcatatgaaattgtcagttttgtaggtcatacctggctgaatattgtccatgtcatacagtttaatatttggactttgaaaaagtaatttgactttacttattctttacatattctttaagtaataatgacaactttgaaaaagaattatgtacgtttttgataattaaataggattgaagtaatacataaaagaaatctgagctagggataattgaagcagtaacattttttacaaccaataaatcagctaaaatcatatccatattaaatgaatttagcataaaattagaatgacagagcaactagcattttcccttggtgagaaaagtagtaagtttccaccataaaatatgactcatttttatttgacctattagcagatagttgttattgcaccttatcttaaccaccattatttctacagagagattacagagcaatgagtaggaaatatggaagattgctgaataatcctggctttagttatggagtaatatgaaaaaaggaaaagaaaaccttttgttcactttcacagtactacatcaatgcaagctttttagtagttttaatgtatgaattttatcatcaggtgaaaatgcatctcattattagatggcctattttataaataaagttcaaatttcgatatagccagtttttaaaactgtatatgtttataactcatccctttgttgcatataatctcccaattttagagacttacattgcatttttaaaggatagcacagtctctttagcaatcccacagggaatctaaaaccagcctttacaaggagatgtcaaaattccaatttgcagtgatatttttgtcaaaacaagtaacgtgtgttattacgtatagtaagttaacacaatttttcatttgtgtatcaagtaggcattggtttttgttttttggtttttggttttttttgagactaagtcttgctctgtcacccaggctggagtgcagtggtgcgatctcagctcactgcaagctccccccactgggttcatgccattctcctgcctcagcctcccaagtagctgagactacaggcgcctgccaccacacccagctaatttttttcgtatttttagtagagacggtgtttcactgtgttagccaggatggtctcgatctcctgaccttgtgattaacccacctcggcctcccaaagtgctgggattacaggcatgagccactgcgcccagcaagtaggcattgtttttgtgtgtacgtatcaaatctgtttttatatcttttggtattttatctcttttctgccaacagggtgaaatggaagtacagtattgggattatgcacaacattttattgtttaaaattatagtattccttttccattctgttgtttcagttgtttaaaaataagtaacaaaagagaggggtctgtcttgaagcccatgagatggtagatctttagaaacagttataatagcagtcatattgaaactgattgtcatctatttctgggaaaaatattgaaggctggtatattgtccccagaaggattagatgaaatacagaaaatagattatgattataattttttttagtgaggtcaccttgctgtagagttggaaccttcccgggggattgctcatgcattatccattttgggaaagagtaatacttacaggcattatggaaatgagcgggtaggtttgtcaagaggaaaccaataatttgaatactgagttgaatggaaaatgaaatacatgattttccatatattaaattgaatagaaatgggagacttatgtcttgagggtttttcttttctttttttgaaacatgttgatgatattgtgtgttcccaagtgccctcaacctgacaggaaggagaaatgtcaatagaaatagttacttattatattttgatatttagaaaggaacagtggagttttaaatgttgtgcatatcatttatgccccatccaaaaggatagcgatccacttaaaagaaggcagaaaagacaaggaccgctatcgttctccaggaatcaacagaagctaagggagagcgtagagtatagtccctgtggcctctacggagtcatcgccttctcagactgaatccacacaaggccgccttgactgaaagagcctctacattggactgtgcatggcgtggggaaatgtgattacttgcaatatgctactgattacagaataaatattatgcattcggttttcactaaacttaaaaagcccagtgaaaaccccacttctgcatgtggtgaatgtggttatgctgtgtcaggtgaagacatgtttcagtgccttcgtttactttccattaagatatgctgatttccttctcccttatgaaatagaaaaggaaggacataaccatcctgctgctctgccctgagtgcaccagtataggaataaaactctgtaaacagagggtggtggcaaccatctaacagggacctgcatttggacctgtgtgtttgggagagccgcaaagtggctgtgcctctgatatcacaggactctatgaaagaggcaaccaaagaagacctgaggctcttcttgtcattttagatatgtgatttcataaagttactcttgaccttaatgcagatggccatttgggatttgtgtctgtgcatttcatccacagctggatggcatagttgctgagtaatcctgttgctctggagcaatgtaagttacagctgtggccaggcacgtggctcatgcctgtaatcccaacactttgggaagccaaagtgggagatctcttgaactcagggattcaagaccagcctgggcaacacaggagtcctcatctctactaaaaatccaaaaagttagccgggcaaggtggcatgtgcctgtggtccagctgttaaggagggtgagatgggaggatcacttgagcccaggaggttgaggctgtggtgggcaattatgatacaccactgcactccagtttaggtgacagtgtaagacttgtctcagcgaaaaaaaaaaaaaaaaaaaaagttaacaaccatatcaaaagaacaatttattcaccccccaaattgtcttggaattctcacattaatttacagagagaaataaccctttggaaaattcacaatgttttgctagtattagtatgtcatctcactctaaaatgtaaaaaaaaaaaaaaaaaatcactactcagaccttataagaatctggtttttgattatgaatacagcaattcttttttgaaaactcccttgacaaattaagccaatggtggacattctaataattgtcatattttatggtacatttgtaactaaaagcctcttctttgggtaatgactgatagtttcatggaagaagtcattctttttctggtcactctagaaaataagaaatgggaaatgattgtatgtgatatacatatgcatggttctaagtaccaaatttgcagattgcctgaaaatgttcttatgtactttttatggatacaggctttcttttcaattagattcaaaaagtatcaatacattattatactttaaattgactagagctaccttttaaatggtcagataggttttctttttaaagaattacttttgtgattactagccacctgaaatggtgtttcaaggccatgcatggtgcctcatacttgtattcccagcactttgaggggctgaggtgggagcatcgcttgagctcgagttcaagaccagcctgggcaacatggcaaaaatctgtctctacaaaaaaatacaaaaaaaaaaaagaaagaaaaagaaaaaccattagccaggcatggtgggatgcacctgtagtcccatctacttgggaggctgaggcagaaggatcacttgagctctcagaggttgcagtgagctggaatcgtgacaccacactccaggctgggtgacagagtgagaccctgtgtcaaaataaaataaaataagatataaatgaaatagtattttcaagacttggtataaatgcatagctgttaagctgtaaggacatcaataaatgttcataaataggtaactttctacattctatcaccttattttctataatacagaaaatatactttaaattattttatttatctgagtccttttattctttttgcttttttttttgtttgcaagaccaaagtcagagcaatttcaattctattttgagcattttattttggcactcatgtattttaattaaaaaaaataaataaaccattgtcctcagccagaagaattttctgctgagtggtcataaatgcagagtttagcatttcacatctctagaatgtaaaagccacaaagtcatatctgtcttttatgttgtcatatcaccaggtgccatcatggtgctgagaacatagtctttgtttttaagaatttattcagtaactgactgaatgaggaagtatggctagtttgcttaagacattgagttgtaggagttgatgggtagcagtttagttattatgctactgtcagttaataagaaagtatgagtgcaattcagcagtatcagtgatgcatggatttgttcctaaattgttatttttgtggttgaaatttgcactgtttattttgaagctctctgtgtaagtcataatcagtgcttaattattcagactaatgaattggaattagaggtttgctcagtccacaattcttgctaccattaaaatattttgttacatttgtttttgagtacatagaagcaactaagaaatggattaagatgctgcagttaatctttgtaaattactatggccattgcctggcacctaatgtttgctatgttaagagtttgttatatgaataaacgaccgctgttcctggtaggtaatgaaagtaatcttaaacaatattagtactgcctaaaaagtaaggtcttaaatataactacagtagtcctgagaaaaatcatagagtgttagaactgaaaaggttgtcttagaggtcatctgctcgaatctcatctttttagttgaggaaaaccacaaggtacaaacaacaagggcatcaatcctagcactagaacccagatctccagatttcagggtaaggattttaattattaccatgctatactttcagtctcaagatggcactatatatgaattcagcttcacttttatagtgctttgggtgttattatgcttccagataagagagatgtatttctgtgccattgaggaatagcttagagtacctatgattcataggaatttgaaggctgtaaatcaaccgaatctttatatctttttgttccttcttgcagtatcttgtacccaagtagcttcaataaattttgactgacaagatgaccataaaataagtagtcctaatgtcataacatggaaaaggagggtaatgggtgtgtgtgtgaatgtgaattagtatagtatagtaatgagctgcctcagcgctcttaaactttttttagcaccaatgcctttatgcaggaaactctgaaaacaagcaagagatctttgtgggctctctgtaaattatgtgcatgcaaaaaagcatcctcagtgcttgtcccttgacagctgctctgagaccactgagtcactcgcttgcatctgtgagccactgaccagtcactgattgcagtgacagtttatcactaacaacctgaattatctttgacccagagacccaggggtcaaaggcctcctagtccattattaaatttccagggcagtagttcagtttgcattaggggatttgtttatatttatttatttagggtttttggggggtggggggtggaggagcttgggggaatgagacctgcagttattttccccacattataagattatttagtcctttatttgtgggatttggcatcctaaaagaaaggaagactcaaagtattgtggttctggtctgggcctcacatgggtgtcctaaagatttctgggacccatttatgggaagaatgccactctacagattatagcagggaggagctttgccctcaggaagacacagatcctttgagggtggtagagactcctaaagtctgctgattcatacccagctggccccattaacaagagaattaaagagtggctagaaagggactgaagagttcactgggggcccatccaaaaagctgggggtacagacaactgctgattcccagccagtcatggattttattttgagacaggtctcgtttggtcgcccaggctggagtgcaatagtgtgatcatagctcactgtagcctgggactcctgggctctagtgatcctcccaccttaacctcccaagtagctgggactacaggcatataccaccatgctcggttattttttttttaattttgtagagatggggtcttgctatgctgcccaagctggtctagaacttctgggctcaaggagtccttccaccttggcctcccaaagtgctgggattataggcatgaaccactgtgcctggcttgccagtgatggattcaaagtcgcctctgggttgtaaccaggaagcatgcctgggccagactgagagggctgaaggatgacggcatggtttcagtgtgtgagtgtgcatgtatgtacgtgtgtgtgagaatgtgggtaagtgtgtgagcctgtaaaagtgtatcatgagtagctgtctcttgggaggagagggaatcaggaaccttggtcaaataacaccatgtactggcatggaaaggcactgttctgggcagcagtcaagaagacagaggaggactaactgtatatgatttgggcaatcatttaaagtatctgggatttatttccttgtctaataattagcaaggttgatgtagatgaggtataacaactttaggggtagaagaaagctatgattcaaagtcggcattttattagatcagtggtctctgatttggtgtgatgtgttcctggtatgttttcgcttagaacaaggttgtttaacccatggcccatgggcttcatgcatcctaggacagctttgaatgtggcccaacacaaatttgtaaactttcttaaaacattatgagcttttttgtgattattttttccagttcatcagctgtcattagtgttagtgtattttatatgtggcccaagataattcttcttccaatgtggcccagggaagccaaaatattggctcacttagagtctttagtagtgactatgtttttagaaagcctaaggtatttgaagaataatagtcacataaagtctaggcaaatagcaaatttgttttatgtaggaaacagcttatcttctatagaataacttttgatgggtgaaattgtagtgttaatttatcttagtgaacacctagaagatttgtttaggtatgtgaattgtttagtgaaaatgtagaagatggtaagtatatttgggaattactagtgcagaagccttttattaaattctcaatagaaactgggtactggttatgaattgtgatctctcagatacctttaacttagtcgtctctcatgagtatgtgatacaattgaagttgtgggatttaacctctgctgagcagcagaaagatatgaagcagtggaaaatacaggctaaacagagcctttcagaataatttttcctcagtggtttatgttcttcacattcagtttttattcttctccatccttaactttctatagctgatacttccattttggatataggctctgtttcatttccagaggtatctctttccctaaactcatcaagtactttttcaaccttgttgatcatcttaacagaagaatcgtaacattaagttgatttatgacaccatatctctgtagtaactctgaattgtcatcaagctattcattgaaaggatacctcttaaactttctattactaagatccccaaatgtatctattctcctctcgataaaatgagtattgtcttagacaagcagcagactgctttttaagtgaagtggattaagctgctgtgatcgtccctgtgaatgtgtatgataaatcattttgatggcctttttaaatcagagtcaccgagtcccacacagagaaacagagaatgctgtctgtcattattacaataataattaagcgttggctgataggatataaagtataaatcaaagatcttagaggaaatagatgaaagaaaagctttgtttctcaaaaacttaatctaaaagaagaaatattgagcaagcattgggtgcttcatgaatggcctaaaaatatatttaagtctatcacctggaggttcgttcatttattgccaggaaagaatcaatcccacttttttttctctttccctgtggctcaactccaggaaggtgttttaattgattggtgggaagattttaacacagacaaaacttataagctaagcatcattatttctagtacagtggcttcaccacattatagggtaataaagttaaaagctgccgattgtttcagaattattttcagaaatttacatcctctttattcctattaccttgagaaagagttcagagaatgggcttagtcagcatgcaattatggtattagataaagcatacagtttggtctaaaaccaagatgcagctagtctcatcagggtactttaatcaatcaagggttgttaagaaggtaggaatgtcagtctaacttcattcctttgaaggtgatcagcctttcttctctggaggctttgaagattttgtcctatggctgggcgtggtggctcacgcttataatcccagcactttgggaggctgaggcaggaggattacttgagctcaggagtttgaaaccagcctgggcaacatagaaaaacaccatcttcctctccccactaccaaaaaaaaaagttagccagttataatggtgcacatgtgtagtaccagctacttgggaggctgaggtgggaggattgctggagcccaggagtttgagggtacagtgaaccatgatcatatcactgcactgcagccagggtgacagagaaagacccagtctcaaaaaaaaattgttctccaacaaatcttttttgaagttatggcatttaaccctgcccaccattcccattcccctgtcagtttcactatcatgcattcctttttctttatcccactcaggaccattgggcttgtcaaacatataaattggctttcaggaaaattcttctccatatctcttaaaaatttcctgtatcccattctcttccctctttttggaattttctttttctataatttaaagatagagtcttgctgttttctaggctgctctcaaactcctgacctcaagcgatccttctactttggcctcccagtgttgggattataggtgtgaaccattatgcccggtctagaactttaactaaaagtacgttggaccttctttctctgaacactggttctttttacttccctcacgtttcccatcattttgtttcactctcccgctgtatctcttttgaagttatcttccccttcactcattgactcttcagctatgtgcggtctgctgccaaaaccatccatgaagtttttcatttcaaggactgttttcccccctaaacctagcagttttatttggtgccttttcaaaccttctatgttgtattttatattttcaaggtccctgtagatatttttcaggttgttatttatttcttttagcagagtaagcctagttgtttcataatttctgtgtggtaatttcagtttgtgttggttctcactctctatgccttggttccttctgtgcttgatggttggtctctgaccctgtgttggccattgctctgtaaaaattatctgtgtcattcctcaaggcatgggatagaagcacattcctgccgagaaggtaagtgttactgctgggtacttggaaacttaccgagttcgtggcttgaggttctgtggcctaccagcctgtgcacacctaggcatgtagaaacctgtcggtagactcagcttttccctctggctgaactcaggatcaagacaatgtgtctggccggacacggtggctcatgcctgtaatcccagcactttgggaggccaaggagacgggtggatcacctgaggtcaggagttcgtgaccagcctgaccaacatggcgaaaccccatctctactaaaaatacaaaaattagccgggcctggtggtgggtgccaataatcccagctacttgggaggctgaggcaagagaattgcttgaacctgggagggggaggttgcagtgagccgagatcacaccacttcactccagccacagaacatctcaaaaaaaaaaaaaaaaagacagcatgtctttagttctctggggctaaatgggtatgtttagatttggtgtagcttttttggggttctttactccttttggggtcccagcttaatgtgaagagggtctactctaagactccccacttcaggaagatcctggagcctctatccctttctccaggatgagcaaatgcacttgaagaaaaagtagttgctttgtccaggtattttgcgtctatctctaaggtttgagatttgccttagaatttgtccaaaaaatgatcttttttgtcaaattcttttaaggtgatgtttattatatttcattcagcacttttaattgtttccagccaggaggttcttgtgagaaacttaccttccaggaatggaagaggaatcattagtcattaaggagctaaaaatgttaggaaaatattaatgcttcagaaacaatttgttgatctgaagagtacctaagttagggattttcagaaagtagcattttgttttgttttgttttgttttgtttgagacatggtcttgctctgtggcccaggctgaaatgcagtggcgcgatctcagctcactacaacctccacaaacgattctgttgcctcagcctcctgagtagctgggattataagcaggcaccaccacacccggctaatttttgtatttttcgtagagacggggtttcaccatattggccaggctggtcttgaactcctggcctcaagtgcccacctcggcctcccaaagtgctgggattacaggcatgagccactgcacctggccagtagcattctttggatgaattgactctggttttgttagccttcagaatctaaggaagtttatatctggtcaattttgagaaagaagatctctaagaaatgcctcaagtggggaagggatggactttataaaccaaaatgtcaatgtgttaatcctaaatatctcaatgaaatggggcaaaatatggctaagaaaaatttgacaaggtgtaaatctcactgaatgcagttgctgtggttgctaccaagtttacaagagaagaaaccaggttttgccaatgcatcaaaaattagattaaaaaagaaatttctctggcctagtctgatgcttagccttcaagagtaaaatgatgtgttgttagatgacttgaccaaagtcccatagccaaggcagggagagtgttgcagcctggtggtccattatctgatgccactggatctatgtagatgagtttggaacttcactttctgccttgtctgggacgtaaaaactttgggtgcccctcacttcttttttatataaactgttgtgttttattgccctggcactcttaagttgctgtttcaccctagcagtgcctgcttcaagccatcaccaatgaaagtgcctttgaagtgtcttaaggcgtgtgcattgcctagacaaatagttggcagaagaggtcaacacaagcgtctttgctttggagtgtcaattgaagaaattgtttttccacttgaattggcagtgtgtgctcttactgctgttagagttctgggcagagaagtagatgtgataattatgaagggagaagggggaagaacagctgcagaatgcagggaagtgactggactccagtaatcatatttggcaggtcaagggtgagatttagcctgatgggatttggaccattccctgggctagaaagtagtgttaaaatcaactccaggtgtttccgttattcttaaggcctaagtattattaaagcagaaaataatatggttaggatatgaatgggaggggattggtcattcgctgcttgggaatcacttatttgcaatagagctcattctctcttgacagttgctcctacatgtctaaaatacaccataaatctcgaagtgctcgtttcaatattgaagtttcctccaagtgagctgttatcacttttgtcttcaagagaatgctaactcactgaatctctttgagctttttatgctttacactgtggattttggagtttgctttggtttttccactagttctttaagttaaatttaggtaaagaaatttaaaatcatcaggcttattcttaaaaactcaagtattatcaaatgatggatgatagagatatgctttgggaatatatccaagtacttcaaatgatagaagttagaacaccaggagacatttagtaagagattcttctgctgggtgaaatcaacatcaacatcacctggaaactcgtgggtagtgcaaatcccctggcctcaccccagagctcctggaatgaagctgtccgggatagggcccggcatcctgtgttttaataagctgtttgtgggattctaatgttcgccaaagttttaggatcatgcctgcagagaatcctgctcactatgaaagtttgcatgcctgagtaagtcaaaagagatctttgaaaatagtatctaggtttgagagacttgctgtgattgtataattttagcaaatgtgtcaaaacaaatttttacttgcaggcaatatcttgttagtacagagaaataaaacaaacaaacaaagattataaataagaacaaaagtaattcatccaagagccatgtgaaaatgaaaatccttgaaatggaaaaaaaaaaaaaagtttttcagactaccctgtggaagtagtaagttacattgaaaggccgaaatcagccaagatcattttttgttgttttgttttttgttttttgagacagcatctcgctctgtcactcaggctggagtgcagtggtacgattttgactcattgcaacctctgcctcccaaattcaagcaattctcctgcctcaggctcccaagtagctaagattacaggcgcacaccaccacacctggctaatttttgaattttttgcagagaggggttttgccatgttggccaggctggtcttgagctcttgacttcaactgatccgcccaccttggcctcccaaagtgctgggattacaggcatgagccaccgtgcctggccaggccaagatgattcttgaagtgtgtgtgctgtgcgtactgtgtgtgcatgtatacgtacatttctgatggttcactttagtgatactgtagttcagtttatctgggattgcctcagtagaaagctatactcttacttgtttaactttctgtctattttctcctttaaaaaagaaaagattatatagtagacttatacttggtatctgtctgaaaaaaattatatgaaaactgtctttattgccagggaagcacttgtactttcttttctcatttattcttttctgcactttaatattacagtttatttgcttctggctttctttcataatttatcagaaatacaggcttgtatagaaatcaccattttttaaataaaattttatttttattaaattattgtgagctcattgttttttaaaacaatcatacacaagtaaaacatttaccttgggggtgggcatcagttccttttcccatccgttttcatctctagttttctttcctaaaaacaagccctctcaacaattctagttaattctttttctgatagttatcttttttttttttttttttttgagatggagtcttgctctgtctcccaggctggagtgcagtggcgcgatcttggctcactgcaacctctgcctcctgggttcaaccagttctcctgcctcagcctcctgagtagctgggattacaggcacacaccatcacgcctggctaatttttgtatttttagtagagacgggatttttaccatgttggccaggctggtctcggactcctgacctcaggtgatccgcccaccttggcctcccaaagtgctgggattacaggcgtgagccactgctcctggcctctgatatttatctttatattttctatataacatgcatgttctgctgtttcttttttaaaaaccttttattttaggtcttataggaagcttgtgcattcatttattcaacacataattattaagtacctaatacattctgtacattgtgctaggttctggaaataaacagagaatagaacagacatgattcttatccatggagagcttatattctaaagatgctaggaagtacttttaaataaaactctgacttatatataaaaacttcagaaaagaaagggcctgcttttaaatattttttttggtgttgtccactacttgaacttcatcaagttcatcagaaaaaatttaaatggtatttctaaataagtggtttgctccactctatcattaagcttgttaagatgaataaaaatcagaatattttcaaatgtatgtaaatacatacattcagtgtatttcccagcttcagaaagtcctaatttctgaaagtccttgttatcaactcttgttttgaaaggaccctttctttaagataaagtgtcacatacattattttgtattgatacaaattattgatgattatggatattttaggtaatcaatactaagataattatgttaatatgaattatgattatagggtattggtaacagacaggagtgtaggtgaatgatatgaatttgcactgagtttgtcatgcccagaaagttaatctgagccaaatttctaaaaagtgccttccttattccatattatgtatgaaagaagagcatagtttatgtgtgaatatatgggcaacatgtatatagatgtccacatgaactgcgcctggttaggtcctagaaaagcctatggtgggaaaggtgggttaagaggattgaagttaggagtgaacttgttatagtcttcataaatatttttatagccagtaacataaaacaataaagacagtgctccaaattaaagatacagcaatgacatgacatctacatttgaaactagtaataatggatgccgggccctattactaatttctgcttagcattccttactcaccagaaatgttttaggatcttagttcctttgcagcttgggatgcttgtaaattcacttgttcttttataaataatgtgcatacaaggagattttcaacagcattttcttatcaaaggtctgggcctatagtcaaatagtcaatgccatcgtggttttacagcacccatgaggaggtgttgacgttcaggttttagcttcaggattttgacttgtgtcttcttcctgcttgggtcctgtctcttcccacctccccagctcagccttcatgtacgaattttagattcttttgccttcgtatcagccagcagaagctagttttttgttttgttttgtttttttcaaggcctaggtttccttttactcacatctttcttcaagctttatttgcaaacacctccattcctcttgccattacttttgcttcatgtctatttcaaaactctgtttcatctttttcttgttactaccaataggagtaaattgagtgacttgcaattaaggtacaacagaagcagaattttcaaagttactcaaaaggaataggtagaaaaattcccatggtaagacaactcagtaaataattacatacaggcagtgaccatatatgctcattttaagttacaaatatacacacatggccataaaaatagtcagagactgagctggaactcaatccgtaaactgattccaaaccccatgtaatttttatacacagtttattgctagctttttgtccttttatgttcacttttatgtcctatcttctctatattcctaagttgcccacattttaaaatctgcctgtcttctgactttttaccacaagtgtttttttctcatccacttttattattctcatttcctgttttcaaagaaacaattgcaacacattttagaaatgcttacgacataagtggcacactcctgaagtctttccaaaatctattttcctccatgtcttaatttttgaaatttatatacttagcttctttctgctaattcccacagaaaaactcagcacaattttataagcaatgtgaatgatcttagagccctcataggaataaattgcacagaatgttatcaatatatcataagtgaggtacaggattaattttctaagatatcatttaaaatttcttctattgttactatacacatttgatttattaagccaaaacttcattcctctaagaataataatcccgtcacagttctaatcctagcatagtgtcgtcttaactgcaatgtactatcctaactttcaattacatcttatttcagctttctttattatacagtagctaaaaatcattgatagttataaagaccataatgccataacctctcaaatttaaacaggatagaatattttatgttactaatacagcaacagaggcattttcctctgttgggtagatgcaattattcagattccaagtggttgagacattccataattatgtctctaattttacattctacaggcctcatttcctctgtctgataactgtcctcacccaagggtttctacaaagtcacagtttgggtgaatctgtcatctcattttttcaaagaaggaaatcatcatcaaataaaattatacacaccaaataaataaatatcaaataatatattaatctacaaatttgcgacatatttattttctgactttgaggttaatttcgccaccatttttcctaatctgtatatcctatccccacttgcaaacaatgttttgcctgaaccgagtaatggcaacatttatcgtaagtatatcttagcttcttctccttatctgaatggggttctagttcccttagcattctcagataacattctgaatattctactctgtatatccagtttgttcatagacctcaaaatgcagaccctgcatggattattcccattctgctgtctgtctttatgaaacctgccaatacttattgctagatgaaattctacagatgttccatgatgacttattgactcgataacagggatctgcaaacatttctgtagagacccaactctgcagttgtagcacaaaagtagccacagacaatttatgagcaaatgaatgcaagtgtgctccaataaaactttatttacaaaaacagatggtaggcaggatttggcttatgagccgtattttgctgacctctgctctataatattccttgaagagatactattatcccaatatcctgacataaaatatatatccttaccatttgctgtagcaatattcaatttttctttacctggcgttgcttatgttctccagccagttctgtcttttcattaggaatctgagttaggatttcttagaactatgtatttgggtaagtttatcaaaggcctttttatttttattttttattttattattattatactttaagttttagggtacatgtgcacaatgtgcaggtttgttacatatgtatacatgtgccgtgttggtgtgctgcacccattaactcgtcatttagcattaggtatatctcctaatgctatccctccccgctcctcccaccccacaacagtccccggtatgtgaaattccccttcctgtgcccatgtgttctcattgttcaattcccacctatgagtgagaacatgcagtgtttggttttttgtccttgcgatagtttgctgagaatgatgatttccagcttcatccatgtccctacaaaggacatgaactcatcattttttatggctgcatagtattccatggtgtgtatgtgccacattttcttaatccagtctatcattgttggacatttgggttggtgccaagtctttgctattgtgaatagtgctgcaataaacatacatgtgcgtgtgtctttatagcagcatgaccttttaaagatcttaggagcataatgctgtaacctctcaaatttaaacaggatagaagattttatacattactaatctggttgggtagatgcaattattcaaattccaagtgggtgagacattccgtaattatgtctctaattttacattctccaggcctcatttccctctctcatttcatcaggtcttcaaaaggcttttaataaacttacccaaatatataattctaagaaatctcaaattcagtgcttgatcagatcactgtgtggtatagtttgtatatttttccccacccaaatctcatgttgaattgtaatctccaatattgggggtggggtctggtaggaggtgactggatcatgggggtggatttctcatgaatggtttagcaccattccttggtgctgtcctcatgataatgactaagatctggtcattttaaagtgtgtggtctctctctctttctcttgcttgctcgctcctgctttcaccatgtgatgtcccccactactcctttgccttccgtcatgattgaaagctccctgaggcttcaccagaagcctggcagatgccagcatcaggcttcttgtaaagcctgtagaactgtgggccagttaaacctcttttcttgataaattacccagtctcagttattttttacagcaatgcaagaatggcctaacacaatgtgtaatctttgtttcatagagtttacactacagctttgccacctaactctcctatgttagtacatagaatttctgaaccttcaatcctgttcagaatgccagattgtgagagaatcagttatgcttcaaccttgaaagcatggagttctctgctttcagggaactccagatgactcaggaacagaagtaaaccctagacaaatctaaagccaaacatagaataaagctgaacagcagatcataaatcccattccttgctccctaggaatacctcttcttctaactccagcttcagatttttccccaggtttcacaattgacctttgtcttagtgtccatactggttggacatacccctctggcatagacattcatgataggcattgccattcttcatgatatgtcattcttggctacttcctctttttctaggatgcatgttttagctcacttcatgttcaattgccttgtggttggcctacttcttctttctcttctttcctacttttgtggttgctttatagttgactaattactagttcatcggctctgcttattgcctaatactataaaagttcccttcctggaagggttggggatgggaaagtgggggtgggtggtagtaaaattaactaaactttgtagtgggctggagatagggcatgagtaaaggaaaagttgtattttaggactgctcaactgcatggatatttatactttttaagacaagcaacattaacaaagtctggatcttaaagtagagatctacactggagataataatatccctgtgggcatttaatgctcatggttacctagaaaataagtataaagtaggaaattttgagagagtattcttgtaaagattaaatggtgacaccaatgtaaggcttgaatgttctaataagggtgaaacttggtctgggaatggcagttcttacaccttttataattcttaactgttattttttagatctggtcatttaaatctgaggacccagatatgctagtcttatagaaagcacaaatttaaaatgggttctttgtcttacatagctctaaagtttaggaaaaaagtatcttcaagcaaccttcataggaattctccaaaataaatgtgttcctgattaatatgtgttttattttttaaaatttatttttaattaatttttaaattgacaaaattgtatgtatttatggtatacaacgtgatgttttgaaatatgcatacactgtggaatggctaaagcaagctatttagcatacgtgtcatcatctcacataccatttgtttgtggtgaggacatttaaaatctactctcttagcaattttcaaataatgtaattattttaaatcagttgtttaaatattatgaaattactttcagcccttagagaatagtccatctcacatgacacataaaaatggaaggaggtgtctagctcaggagaaactttttggaatatttgattctctttccctcattttctcttctttttttgttttttaaaaaataatttttaaaccctgtattgactcctggctattattttgaatatgagtgctaacaatttgagccttgtagataactatcccaatgccaattgaaccataattttcatttgtctctttctacaagattctgaattttttcagaagtgaaattaagtctcaattccctataatttacccagggcaataaatcttaaacattttttcttaaaaaaacaaaacaaaacatttttactggaaagactttatggggtggacattaactctgtaaatgccatataacttttggagagggctgcccctggcacagtgtaatatttatgagaaagttgtgcccatactaaccacctgtatgagaatcgcctgcgatgcttttgtttaaaaggcagattcttttttccctatatttttctctttttaaaaaaataatttcgacttatattttatatttatatttatattattttaaaaaataatttcaacttatattttatattcaacctacgtatgcaagtttgtcatatgagtgatattgcgtggtgctgaggtttagggtacgaatgatcccatcacccagatactgagcatagtacccaatagttggtttttcaactcctgttccctccttccctccctgctctagtagtccccagtgtctgtttttgccatctttatgtctatgagtatttgatgtttagctcctacttataagtgagagcatggagtatttggttttctgttcctgcattaattcgcttaggataatggcctccagctgcatccctgttgctacacaggatgcagtttcattcctttttatggctacatgatattccacagtgtgtatatactacatttcctcaatgcagtccaccactgatgggcacctaggttgattccatgtaaaagagcatattgttaggcttttctctgaattactgaatcagagtctttcaatgggttccatgaatatttcatattcattttagtaaacttgctcaagtgacttatgtatacagttataggtttgggaacctctggcctggggaagttgtctgcaacaccactgacaggtccctgtcctgccacagacatttctgctgtaactccatgcttgcattttttgggaaaaacaaagcaagacaaaacaaaactcattttgcaaaatgacacacaaaataaagaggcttctggaaaaagtagggctaggtgaagagaattcaaaacttacgaaactataaactgaacaccaacaagaataacaatgaacctaataaaaaactagcatagttatggctctaacaacatttattctcaacaacttagttaaatcgttgtacccttaaaccttaacactttttttttttgtttttcgagaccttggttcttgaggacattttcttctagcagaaatcagtattaacttctttatccatctctctcttttttttaaactgttatgtaccatcattatagcacttcttacaaaaatgaggagctgtctttgtaacttcatctgtgccatcagcttttccagatagtttaacataaaaggaagatgaagtggttctggaagcaagaaaaccagccaccacttgcagtaaggaaggcaggtctatgggcctattagctcatggaggtttttgtttgcttgtttgtttgtttttgagatggagtctcacacagtcgcctggtctggagtgcagtggctccatctgagctcacggcaacctctccctcccaggttcaagcgattctctagcctcagcctcctgagtagctgggattacaggcacctgccaccacgcccggataattttttgtatttttagtagagacaagatttcagtatgttggccaggctggtctggaatgcctgacctcgtgatccacccgcctcagccttccaaagtgctgagatcacaggcatgagccaccgtgcccggccagatctttttaaataagatcttcatgtgttataatactaaggttgtctctttaatcacaaaaagccagtcctttattgcttcaaattgttcatgtgctgatatcatatgtctattgaggtctgacttactacattaacacacgctggcagaaccactgcagacattctctgtcctccttttttttttttgtcactaacatgataaaattcttaagggtttgaattctcagaggtactgtctgatggttaaatcacagaggtccactgcattgctgatagatttttttttcaccacagtgctgacaatacaattgttcaggaatggccttcatgaccataaggttggtttgacctaggttcttaattgtgatgtctctatagcttttaacttatttcaggatgatttcccccattgcaaatagataattgttcaatagatttgctgcagacttttggacctgatctatagttttcccttgggatatgtaagatatttgaggtacaccaaagtaatgcaagaaatatctttctttagagctagagtttagacaggaagtatgtcatagaactatggtgtgtccttcccaagtgagggatttcattagaccttgacttagaattgaatgtaatgttaatctgtaaaggcttgttgtgagggttttgcttaaatttttaggtttattaaatttttaggtttattaaaattcctaaatgatgatatttttatcagcaaagacaaaaatactgctacttaagtagtagtcactagaaaaataatttattttgttttgttaccttaactgtcagatttaagcacattcctaccaatatttgggtttgggctctgaaacccaaaacttttgaaagctttggaaaattttgtagaagttctttcttctgtcttttttttttttttttttttttggatactattgccactgggatgcaagcattcataaattatgtttaaatataaaaattaggtcggtaactctctgctcgtggattcctgaaacacaatgtacaaaaacccagaatagatcttcgtggctcactttagagcgtaacagcactgggaggtgatctgacttttcattttacacgcaagaaactgaggctggagagaaagaagggttgtctgggtcacaactgttgaggtcagcctctgggattgaacttcatttcctgaattcctcatggttttccacctccattcctcagcttctgtgatccctttggtatggggctgtttcttgaaccttgaataggagggtatggaggtgaagtgacatgtgagctaattcttttacctcactctggtttatctatttttatgtactaaggtcctgtgtattaattaatgagatgagttccacagttgctaatattagaaaatcaacacaattgatttctccttgggaactgtattagttttctattgctcctgtaacaaattaccacaaactttgaggcttaaagcaacatgagttcatgaatttattatcttagagttttaaatgttagaattctgtgaggagtgtcactgggctaaaattgaagtgttggcagggctgcaggaggctctaggagagaaatcattttcttgcctttttcggcttctagaggggcttcccttcctcttacttccaagccaacaacatgacatctctgagtattcctctttaactgcaccaagggaagataatctccttttaaagattcacaccgttagattgggtgaacctggataatatagtcagcccttcctatgcatgagttttgtagctgctgataaggaggtcatctgtaagcaacttgaacatctatggattttggtatctgcaggggatcctggagccaatcccccacagttagtgaggaatgaccatatagcataatttccccatgttagtatccttaatctcaaggtctcaatcatatctgtgaagtcccttttgctgtgtaaggtaacatattcacaggttctggggatcaggatttaggatctttgggagccattattctgcctgctacaggaatgaatttgtttccacttgtctcaactctaagtgggcagttatttaaaaactttgtattaatttagagagcttcataaaatgctaaaattttctgagaacctaagtgataatataagaagaatagctaccaacatttgttgagtgcttgcaatgtgacacacactgactgctatgtgctttaattgcaatatcttatctaatcattttagtagccctatgagataggttctatttcatttacattttagaaaatgtaaaatgaggcttagagaatttaaataatttgtccaaggtcaaacaactagcatatgggagactaagacttgaaattgggtttgtctgacccaggcttttaatcagcatattgcactgtttatatgtagctctgaagtggtaaaattgtaacatagtgtaatgcagtactgagaatataatatcttagtaatttttaataaataagtgttttagtaaggaaaataagttgttattaggaataaacactttctaaatgacatagtacccattgagcagtgttcaactgattaatattagttggttatatactgatttagtgatcagttctcaaagcctcaatttaaatagaaaaggagttatgtggaatttaagtggaaaggatatagctactttaacaattttttgtgctctcagattgtaaagaggaaggatttattttacaaataaattgcttgtgaaagaaatttaattggttaataaagtctctatctcttgccccctaaccagaatgtcaactccaggagaacaaggatcttggttttcatactcaattctatatgtccagtacttaaaacagtgagagcaatgtaactgatgcacaatgatatttgttgaatcaatgggtactgacaaattcctaagggaataaagccagttatctacatgaataaggcaggatctagatactagctgcatgccagaagaagaatatagagcgttctaatgtgtttggctaggaacagaccatatcatgggctaatatgatagagtaataaaggtagtgataaccctgataaattcaatatgtttttacataaatcctgtgcattaaactagtagctcacttgatatggagtgtttgaatcacagattgactttgctcattcgttcttccattcagtcaacattattgagcactgtgctagttattaggataaaagatgcattaaaagaataaagcccctaacttccaggagcctctgtctcctaagtgaaacaaacatgtgtaaagataaaataccttatattaaatggaataataatggttttatagaaacatggaagagggatacttaacttattattcaaaagagacacttattcgaaagacataaattgagtttagtcatcttgagttttagaagaaataatttttgatttatggagggattgcaaatataggacagagagttctcctataccctttattcagctcgtttaataatacatagctttgctatattgatcaaaactaagaaattaacattggtacaatactattagctaaactgcagaccttacttggattgaaccatcttacagccttttgtgctaaagggaaattgtgtatgaaagtgctttgtaaacagtaggctaaatagtggtagtctaagaagtgccatctggtgagcccagggtaggtcactgagggtgaaagttgcattctctgaagggagctttaaataatctaaccatgaactctattttattttattttattttattttgttttgttttatttatttttgagacagggtcttgctctgtcacccagactggagtgcagtggcatggtttcagttcactgaagcctaaacctcctgggctcaagtgctctgcccatctcagcctccggagtagctgggaccataggcacatgccaccacacctgggtaatttttgtattttttgtaaagatgatgttttaccatgttgcccaggctggtctcaaactcctgggctcaagtgatctgcctacctcagcctcccaaagggctgggattacaggcgtgagacacggcgcccagcctgagctctctatattttagtttcctttaataacatgatcagttccacccatgaatttaattaattccttatgagtttgctattaaaataaaatgagcggttattgatgcttattgtgtgtgtgacagtatcctattcaaagtatgggatacagttctttgattctctcactccatcctgtggaaggtaaacttaccttgcagatgaggatgaagttcacctaggtaatagatggacttggccaagccatgagactttaggtgggaaaactggaatcagaacctgagccaacctgacttcaaagcccaagttttctcctttgtgttgtctcctgagtcattttcctgtatagccccgctgaataagcattttccaaattatattttgtattgtgcaaaacttcacttccttttttattcaaagactatgtatttcatgcttcaaggttttctgagaactgcagtattctgcaaattctcaaaaaatgcttttgctctttctaagatttcatgactttaaagaacagttactttcttcctggccttcctggtgtcagtctgtatgattctataatgtttagtgtattcctttatattggctgccctttcctttgagcatttcggtaacttttcttgatagtttccagctactttttttttctttttgtctctcaagaatgaccaaaagtatatgtagtttttcagatatttgtcatgtaatttcgtgccatctagatttatataacctaacattttctggctttttcttagatatttatagatggtggtggttaaatcagagttaataatattaatttttaaaatatgcaaaatgcttttattgctctttttaattaggtttttacaactgtattgaaataggtgtggcaggtgctatttcccctcctttttctgctcaagatgattgagattcagagtaattttgtgactgcttcatcctgcagaccaaacaagtactttacctaagtttcctgtctccattctttttgatagggtctatcaagcttgtggcaaaagctcaagatgttatgtgtagagttcagtaatttaaattcatggacttataaactattaacaaagaatctaattaaccttctttctaagtaaaaacaaacaaaacaaaagatacttctagtagagtgccagtgtctttagggattcatggggaattaattaaattcatggttggtactgatcatgttattaaaggaaattaaaatctagagagctcatggttaaattgtttaaagctcccttcagataatgcaaatttcaccatcaatgccctaccctgggctcacccagaaggcatttcttagactaccactatttagcctactgtttacaaagtactttcatacatgatctcattgttcagcacgaaaaaagctgtacacaagttggtgcaatccaagtaaggtctccagtgtagctaatagtagggtaaggaaaacgatatgttgacatgctaagtgagcttcattttgacttctttcgtgtaacatgtttgagtctttgtgctgagaaaattgtattacattctgggagtcagtgggttgtgtcagaatgtgtgggaagcagctcactttcactttcaaaagattctttaaggaatttatgctttttgtaaaataggggagactatttggactctttcttattgggatttctttttgtgtgttttatgagaccaaagggcactgacttccatcatacggtttgactttggaggacagtacgggaaagtgcagcagccttgtagttatagtggccacagaatgtagtcacagaataatgtagcaccaggtttcttactgtcaacaatctgtttaatttgattttggttattttccacctcttcagcaaattcatgtcactgggaaccctaagataaggaatttgccttccctgatcttcctgtggggtagaagtaaaatgataagaattcaatcgttaggttgtccatggacctgcttaagagtgcaaggaggttttaaaggtccttagaaagtcaaatgtggaccctgctgaagaagggatgcagcgttgcttacttaaaactgtagtgaacagagaagagagaaatttaactttgatattgtaggcctcaacgagtaaagaaggctttcaatcctggcaggtactaaggttttagtatcattctctttaataagtcatctgtggacaaaaatgaaaaaatcagaaagccataattactaagaaaggagatctgactaaataacaaagaaacagattttagaagtcctgaaaggacacatttgtttcagaattagctctgctaaaatttttctttttcacagaaggaataagctttaaatggctatgtgaaaaatagattatagggaactaatgttcttagatcatgaatcagggactttgttcatttatatgcactgcttaaaagttttcacatagttatcattgtttaaaactaattataatcaattgctaactcatcttacctgggaatttatttagtttagaacatgtaagtaaatttctttaaataaaaaagagaattttagtggcatgaattaaatgtaattcaacttgagcaaagaagaaatggttataaagacaaatattaacatatcaaaatcatgttaatgtgctaactttacctaagcaataaacacatcagaacagaaaaaaacttgacaataagaaaataagtaaatatatttttaatttttagtaactagatgtttctcagtttttctgtttaacattttggaagtgaatatggctggtatgtataatgcataagaaaaaaatcctgttttatgacaatggaaaaaatcatatttataagcttatgtcatgtgaactttgctacacatcaattaggtaaaactgtactggatccattttaaccctgtgagttgattgctttcagtgaagcttgctggacatctttatgtccgagagtgagatgttcttataattaggggcagctgtggtgacagaatcaattaggcaggcctgctgaacacttaccttccagctgctggccgcggcgcagtgatttgctccagcattcattgtcacggtgtattgcctttacacctcgaaagaacaacattaatccattaagccacttttgttgctgtatcctcacgtgggggttatcacatcgcagtgaacacaggagtgagatacagcactgttcacccttgtggcatttggcatatgacagatagacagctgcatagttcaaaagaattattttaacaccaatcgcaagtattgccttgttttatttccccatcaattatccaagtagctcagaaaattcagcaattttgcatatctactgtatttctcagactgtcttttgcacgtggaataagtgcagaaataatgtcatgtggtgtatcccaggttttgtgaggaaaatatggaccctattgatagatcattaaataaaatctttagcacattgtctggtagttaagagccagggctctggagtcaaacttcctgggttcagatactgacttgatagtataccagccgtgtgactatagacaggttactttacctctctgtttctgtttcttcatctgtaagttggtgataatggcagtaatacatatctcctggagttatcataaaacttaaaaacgttaatgagcataaagctcttagaacaatgcctggcacatagtaggtactcaagtatcagctattattattcaaaggtgtttattgttgaaagtactatatatatatatatatatatatataatgtgtatatgtatacattacattctactatatatactatatataaatatactgtaaataaaaaggactttatttaacttcatctcataggctttggaaatacattatagttgttttaagatttttatctttagtccctaactgtgaagtacagggcaaggaactgtatagaaaagagagattgctaatttcaataaataactaatttcaattatcagggtgaaaaattatctcacctaataaacctgcattcattttcccttgtagaattttacagtattgtaaatttctcacagacaaatgtggagaggtgatttggtttacatagctcattataagaacaaaaaatttactgtagtggctatgaaatggagtgatctttcccagatttttaatctactgtccttctctccattttctgcctccacttcaaactttgtagaaaaactaggtatggtaaaaagtcctaggtttaagttttggttctgcaacttgttagacttacgacattaagttcccctatcagtttccatctcctcacctgtaaatggaaacaatcattaggtaccttacatgaaatacacaccagaactgttgcagatgaaaggagatttgaccaaatagtaattttgcggatatgtagtgacaacaaggcacattaacagttaagggagcaaaccagcatcttgtagaccatggtcaatcaatggagaagagcaactttgacttgagggcataggaggtatggtggctgacacttataatcccagcactttgggaggctagagcaagaggattccttgaagaggattgcttgaagtgtttgagaccagcctgggcaacatgaatctctgtatacaacaaaacaaaaagcccagcgtggtggtgtgtgcctgtgcctgtggtcccagctatgtgagaggctaaggcaggaggatcacttgagcttaagattctgaggctgcagtaagctgtgatcacataacaccactgcattctagcctgggtgacagagtgagactctgccgccaaaaaaaaaaaattaaagcagagaaggtaatgtgcttttcttgcaataatacaagaaccgtctgaccactctgggtagactctgaaattaggtgaaataaatgagctagcaaggaacatgaccagggtctcggctgaggcagggtccagtttgagagtcctccaacagtgatggccagataagagaaatacagaacatgaaaacttcaaagtaaagataatacgacttacttgacaattttccagttagatttacatgtcatttttgttagtgtctgatggcagagcggcataagagtcctagcccagtggcatgcagaacacaaacaatgtcacagggcctcacgattccaaataataaaaagtcatagagaagatagatggggcctctggaatcattttgtacctgggtttcttctttgtcagcatcttccagattcttcctcatcctttcagcagacacttgaagtcctactttgggttaggagagcctgagatcctgtatatcttccattcaataaattcagaaattttgatgtttaggtatagtatcaatccaaatggacacatacacagtcaggaaatagcctaaccctccaaatagagactgtgaccccctgctattaacttgctgacccttgtttgatttcgtagggataaattccttgaatggccctctgtttgtacatgtgggtttttttgttttgttttgttttgttttgttttgttttttgagacggactcttgccctgtcacccaggctggagtgcagtggtgtgcccactgcaatctctgcctccccagttcaaatgattctcgtgcctcggcctccctagtaactgggattacagatgtgtgccacaatgcttggctaatttttgtatttttagtagagatggcgtttcaccatgttggtcaggctggccttgaactcttgatctcaagtgatccatctgcctcggcctcccaaagagctgggattgcaggtatgagccaccagcgcccagccctctacatgttttttaagtgcagtcagttgagtatggttttcagatggagaatctgattaatcatcttcaatggccttagcataagcattctatttaactgagctgattgtggctcataccctcaaatcaaatatcttaaagaatcatactgtttcagtcatcgtgtagcagttaattgtgagaagtgaaacttggaggacatccgtatgtaaaatcccccaccaaaggaaaccaatatgtttgggaaatcaaaatgaagcactagtaagaagccaactctggctgtagtggcaccactgtgatgagtgttagcataaaatgctgaaatactgcccccaattttattcttttatgttgtataatgaaacgttctatgcatgttatgtgcttgcaaagaaattattcagtagttcatatacacatcgttggattacataaggagctggacatggaactgctagaatggaatttccagagtccagccatcttaaccctactttgaagcctattcccagtgtgtttgctggttggatttagtttgctgccagtggtaaagagagtcagcttgagaatatattataacaaaatactgaattttatggcaacttttatttcaaatgaaggtgccatcctccttcctcagtagtcagggacaaatagcagctccattccagctcacagggaaccctatttaacttgaatcaagaacattctgtctaagcctgattcagctagagcacagggcggggtgagcacaacatcaccacaggtggcaacaaataatgatcttgttgggcgattcgggatataacccaacatcacccactgcgtcagtagcagggcattaaaacctagctgcattccgaaataccattaccactagaatgtgctgccttttacacagctatatttacacatttgataagacaaactttcccttttatagccaaatttgtgagtgcagctcagaagagaagaccagatggaagagcacaaagtttatccactctgttgcaggactgtaatcaacttcgtgagatagtacaaggagagagaaatatgactgggggagttttggagactctccatagtaatttatctacttctaacatgactattaacaaaaggacatcctgcatagaggactgattaatggtattcgtgtggctttcattagctaacataattgtcagtcaccggttgtcactgtgggatctgcacatatgtgatggtgggctttttacacatttatgcagggaagacttagctgggatcatagctgaaagctcattgttacttgataacattttgcaggtttcctgtgtaatttgttcaatgtgttgaggctcttcagattagctgcacaaacgtggagagtaaagatatgagctagctttgcattgtcagatccttcagagaccagaaataacaacttacctagtgtcacatgccatcagcatatctctgcagcagacacatgctaaaatttgtttcctgttcttaacaatacagtacaatattcgatatagctgcacgaataatatttgaaaaataagggcacagtagatgatcaaaacaagaggattgcttagatgaatgaggttgtttttttggaaatttattttgcccttaccacaagtattttttcacccattaaattattagaataaatgaacatgttgcattgagtttttgtggtggtcagaatatgaaatataagtatttttggattacaaccacatttttcttccctaaattgtgtgacatagcaaataggaaaagcagaacacaaaagtagactttggaagtatactttgcatacctgcatgttttgagttagagtcagaggagtatatttgtgatcttttaagatatttgaaaacacttaaagcctgtaaagagaagtattcaaaagaagctcctgtgaaatgtgtggcattgctctgaaagcatttgcatgtctgttttaaaaggctgttctttgcactggactgtctgcctctgttgatgcatttctaaggatgtggatatgtttatattaatgtcaagcaagtttgaaatagatttaggcacagactgcttaaaacttgctctgttattaaattgtttcagggtgtggaactaccgcctctctagaaacacatagagagcaaaattatgaactgcggtagaccaaatacaattaaatcatgcttaagattctcggaacacctcctgcatttgaagcattaacttagccttgagcttgccttcaactaatttttaattaacagaccttttatgcttagataagactttcaagacaagtaaaaatttttttgcacttttaaaattcgagtacttacttaacaagaattgaccctaagtttaggaactaccattggccttataaagttattcctgggtattagaagatacttggtgaataggttttatttcagtgaaataaatgatattgtttcatgtgagtaaaccatatgcctgagaaacacgtgtacattgaaaatgaattctattaacagatagctatttatataatctctgacaaaaagaaaatttactctgttgaaaattgactcattatggatagatgaaaaaaagtcatacaaaccacatgggctcaaatattagtttgcacttttataagaatctgtgaaatattcagggctattccagtagtcctggaagacaaaaagtttgaaaaaatatccataaagacaaaaaaaggtttaaaatttttgccctgtgtccttgatacttgaatttgagctctgccctgagtgagcgagaacctttgtatggtccttgtctagaaggtaccactgacggcagaacatccataagtcaaggatgcaattgtgcagctctgttggtagtacacagatgtgtttcttcacttacgctatggaggattttgagttatcaacttaagagagctgttttctgaaaagctggatatcctcatgtcatagaagttaccccagaaggacgcagcagggacattattacacctggacttctagggatgcaaagttagagtagctgtgagcttttccacatctgatgattttggaactatgtgcaagagagagaaattcaggctggtcactagaggtatccttgaaccgcaaacatcgagaaatgttcatacatcagggtcagcttaagaggggatattttagctaagaaggaccttggatctgaaggtctctgcctcattgcattgtagatcatctcgtaaggcaaggaatgtaccactctgcatatggaccccaaaaggaaaggagaagtgttgacctgcccaatgagtgattggtttccttccatcaaaagaccatagtggggttggggccctgaagtcacgattgtgaggatgaaccatgagcatttcagtgcaataccgcttgcagaatttaaatgatttaaatgaatgtaatgttattattaattaaatttaacttataaattattaactcaaatatttacaagaatttctttcatgaatgcaaattaaccaagagtttaaaaatacttaatgacatgaacataaagaagaaacctccttgagagcggagggtgagaagaacgtgacgattgaaaaactgccagttgggtactatgcttattacttggacgatgaaatcatctgtgcagcaaacccctgcaacactcaatttacccatataaaaatctgcacatgtaccccctgcacctaatataaaagttaaaaagaaaaaaaagaaaaaagaacagactaatgcacacacgcacacacagacacacatacacacgtgcgtatttaatgaagcctaggtcttttatctaatggcagaaagatcagatgagaaaggcagaaaatcagagacagaccaaggctcccggtttttttttttttcctctgtatgtgttagcatgtatatgtgtaaatgtatttctgtttgctaaaccatctaaagtttagttgaagacatcatgacatttcacccctaaatgcttaagcagatattgtctaagaacaaggagattcctttgcgtaaccacaacgcagtgctcctgcttgagaaatttaactttgatacaatatttttattcagatttccccagtagtcccaataatatcctatacagctctttttcccttggagcaggatccaatcagtagctccacattagattgacttgccatgtctctttaatctcctttaatctagatcacatttacagtcttcttttgttattgatgacattgattttaaagcctacttcagttgttttatagaatatctctcattttgaatttgtcgtattgtttcctcatgtttgaaatcaaaacccctaatacagaaataaataaactaatgaagacagaaggtgaagaggaaggagagacgagctagagagagaaaagaaggaaagagaggggcaaactgattttatgataaaatgtttatcaaaggggaagaaaacaaagtctccatagatttatgctcagactatattgataagcaaatatatggagtggtaaggggggaaacatggtccttaaagagaaggtatctgaagtatagttgacactcagacaatgtaggcattaggggtgccaatcccctgtgtggccaaaaatttaagtataacttttgactccccccaaacctaactactaatagcagcctactgttgactggaagtcttatcgatcacacaaacagttgattaataaatatttttaacttatatgtattatatatggtattcttataatacagtaacataaagaaaatattacaaggaagagaaaatatatttattcatcaggtgaaagtggatcattataaaggtcttcatccttgtcatcttcatgttgagtaggctgaggaggaagaggaagaggcgggcattggtcttgctgtctcaggggcagcagagacagaagaaaattcatgtataaggcattttgcttagaggcaagggaataaaccttggaagttctggtgtgttcccaagttaaatgtaaaatccagaggggtgaagaattcaaactagttatttcagtttataataaattaatgaggcaatgtatttttttaatatgtgtaaaccagtttttggtgtcatgtagcaccggcagatttgtttctttaaaacccttcaccaggccattggctcacacctgtaatcccaacattctgggaggccaaggcaggcagattgtttgagcccaggatgtggagaccagcttgtctaacatggcgaaactctgtctctatgaaaaatacaacagttagccaggggtggtatcatgcacttctggttccagttactcaggaggctgaggtgggaggatcacttgagcccaataggtggaggttggagtgagccatgatcatgccactgcactccagcctgtgcaaccgagcaagatcctgtctaaataaataaataaataaatcccttcaccaggctcacaaaattaaaaatgatcttaaggagttaacagaaatatgtagacactatttcagataacatgagaatttagtctgttttaaaaaacctgcaaaacagagattcatgaaccacattttaaaaagacttctatgaaagctcttcagaaaaaaatattttcaaggtgtcaaaaaaaaaaaaaaaaaaaagaaccagacaaaatattcaggtatcaagggctaagaacagctaaaacatgttttctaatttgccagtggccagtgtgtcaactacattaaatggctgcttctccacctcatctcccagccaccaaataaataataaggggaatatgtagctgtaggggtactgctaagaaatcacagcattcaaatgatttttttctgaaatttattggaaacttcgtatgttcattcttgacatttttaggatttacttggcaagggcagaatcgtagaaaaacaaatagagttccctgagtaggaaaggtctccatttcctgttcatggttaggtgatcctgattactgtccttggagtcttgagccccttacccggtgaataattaggtacggaatcagggaggtatagactcatttgcctgggtttgttttctgggagtttctgtttaacattcctgaactggagcagaagtagattttgtagctggcttttctgagactcaggaaacagaattgtggaattctcaggttctgtgacatttgttgattattaaagtgaaattatgtgtgagaggaaaatttattcatctatgcttttaagaaatgtctatgataaacagaattagacatactatatagaattgcataacacaccaccacatgtccgtattacccagtttccacagttatcagcttcttggtaattgtttttcacctttatgcctatccatttcccaccaccatattattttgaagcaaatctcggatattgtaacattttatctgcaagtatttcggtacatatttttaagcagtcttgcttaaaataagaatggtatgtaggtgtttaatgtattctccaagctaatgcataatttaagtactcacagtctctgttgagactatttagatgcactaaatccaatcaaagagagaatttgttgtgagtagtggtcatctggaatggtccattcattgtgtatgggatagaaactctgtaggtccagtcaaagagtgatagcatcagagaatttctgtcttgaagaaaggagccattgttaagattgatgggttttctgtgttctttggtcccctctgatgacaggatagtgaaatgagccctagctccgagtacccacaaactttgtaaccatggataaagtcagccacttacttatctctgaaattaaacttcccgattttaaaaatggatgtgatgcttcctgcgcctattcacagtactgtgatacactgtgatttgggatgtgaacacgctttaaaaataatggcccggttacatattctcctttttattttttatttttttttaatttctttttgaaacagaatctcactctgtcacccaggctgaagtgcagtggtgggatcatggctcactgcagcattgacctcctgggctcaggtggtccttccccctcagcctcccaggtagccgggactacaggcacatgccaccatgccgagctaatttttgtattttcatagagatggagtttcaccatgttgcccaaactggactccaacttctgaggtcaagtgatcctcctgcctcagcctccgtaagttgggggattacaggcgtgaaccaccgtgcccagcctacatacgctcctttaacacaggcttttggttctttgaaattaccaacattcaggattcttaatggcatcagagaatataaagcttgaaactatctagaatttttttaaggaataattttctaatcttggttctctgcttctgagtatattttatttgggcattttatttttctccaagatgagatccattttcgctcatccattttgaaattgtttttctctctgttaataaaacctttggaatggtgccttgatcaggctaactccagattaaatgtttctctttgaaagattgcctggtgatcagagttgtttttcattctcttttcttcttttagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggtaagtataatgcataaaatagtagagactgcccccagcaataagataacatataaatgttatttagaccctaataagtgaatttactatcagaaacataatagataataagtgaaaagctgtttcattatataatgacaaaaaatcatgttatcacataggcaagaattcttgtggttcttacatcttattgatgaaggaaataaaggatggctggagaaagaactgtaggaagtaagaagagatggaagggaagaaggaagagagcattagtggtagatgctgtcatagtaatagatcctaaaattcaatttcttggccgggatggtggctcacaactgtaatcccagctctttgggaggccgaggagggcagatcacctgaagtcaggagttcgagaccagcctggccaacatggtgaaaccctgtctctactaaaaacacaaaaagtagctgggagtggtgggcgcctgtaatcccagctacttggaggctgagtcaggagaatcacttgaacccgggaggtggaggttgcagtaagccaagagcacgccaccgcactccagcctgggcaacagagcgagactccatctcaaaaaaaaaaaaaatgcaatttctttaaaataagacaaatgcatatgataatttagagtaccagtgccttacacagttaaaatcacaacttcattgtaaagctcagtgaatacttagatttatggaaagaattggaatgtaaccagttgaattcagactattttttaacaaggggttaatgatataattttatctaataagaatttttaactgacactgctgataaagcacatcatcattctagcagattttaaaattaggtaatcttaggtagcaagaattttacatgttcctaccctccccgaggaggtccatatttgacagggcttcatgtgattcctgtaacatcttggtggatgcattctgtatctactctaaaatgatactctgttatcatccctacactcttcattcttatttacttccttacttaagaatcatttcttctaatatcaaactacattttgaaatcagagaagagataagtggattagatttttgcttctaaagagtcctttaatcaacgtgacatgtataatagtggttccaaactcaaagatgatattttctgcactcacatctcacagggttccagtgaacccccaagtatggtaacagaagcaacagaacaatctcctatactttgattttataggacattaaccagaaagttgttacacattcatgagcaaagtgattacaatgagaattaaatttaatcttatcaaagattttgctctgatgactgtattttcttttctagtttctgtggttttattagctacatactttattaactacacgttgactctagttattgatcatgtcagatagatctatagctttggaagtataataaagtgtaaaagaaagggttgtatcactttctgcagcaggtggtacttcaaagatacaaaatataatactgtaaagagacatggcatttttatacctaatattactaattttttttacattattccaatatgtagcagttcagcagcacatggcaactatcttattttgcagattaggaaattgagggtcaaaaaagtgttctgctttgcctcaagtcatataactagtaagagactcagtgagagctgagtttatcattgttatacccattaaaaatgtaatatactgagaatgaaattaagtttcttcctgtagatcatagtggtaattaatggttcaagttagatttgaaataggtctgactctaagtctcatgtttaacagcatatgtgcatgaggggaggaggaaatacaatgaatgaattgaaaagataagtatgattcttacaaagaagtttaacaggacaaaaaaatactcctagattttggatggaatggattttggtgtttgcttttcatcagacaagttagtaaggaatgaagttatctctacatgcagggtaatgtctcatttatttctacgtggctgtcaaaggataccagtaatatttaagtgcccatgaaaggttttatgctaggactgtggagaaattaaagaggtatagggcattacaatctctgtgcccaggggcgggggtcataagattgtacagagattatctagttcagtcttatatgaaacatgggaaattttggaagttatgtattgaaacactgttagagcaggggaggaggaagggagggaggagaatttcatctagaagaaagcatctcacattgcagatattcaatctgatgctacctggagagaagcaaatgaagttcggtagataagatgagaaaatgaatttttttaaaaaagtgaactgactagaatgaataggctttagaaaaggtacatgtatacttaaagaggtaatttgttacctggcttcaatgacatataaaagtatcattagtattcagaaaagcattttcatattggcttcataggtccagacagctaagagcactgtctacatattaataaaatcccattataccagaaagggcaatagttagaaattacttcttttaaacaatagtcttgctggaaagaattaaatggggaaaaatgtattgaagtgatgcaaccataaatcactcgcagcaaagcagttaacatatttgatctaaaaataagacatactttgtatagagtggacagctacttgagaagcgatcatcttatcagtttttagaattgggtattttgtcatttctaaaattgtgtctttttataaagaagagcattgtcagcttttttaagattaaaggttccaactgaatctcaatttaattaacatttgcaaggtgttctattatttcaatttatccagtaaatataagtagaaggaatataattattgttatacccatttaaaacattaatatcctgaaaatgaaggaagctgagtttcttcctgtagatcatagtggtaatgaattgttaaacttagatttgaaataggtctgactctaagtcttgtgttttttcaacagacatttgtgattatgctacataaagttagaagtcagaacatagggctctggcatgcttaggataatgtctttaattaaaagattcttatttttcagatgcatttatatattactattaatgatttttaattactaagatattcagactattagtgttttgcagttgttagttggttacttgacttaaactttttcttaggctatgatcaaccaagcagaggtgaagtttagtttgaggtgtaagatttttctgggattctctttaattaaatactttgactctttcccaatccttagtcttggcttctttttcacacttcttataatcagattatgcatagcagccaacatatccttttaatctcttggtgtttagtggcacaatttcacagcaatatgcaatttctattattttgtaaaatcttacccttgttttgcccacggtcctactaaaaactacattcctacgtgttctttgtatgatttttgaattcccattgagcctttgtttatttggctaacccatgtgtggggccaatgaaaagaaatggaaactaccctcatgttatatgtctgcttatgtctttgttcttgttttctttgattggtggatgattttgatcaagaaaactggttaaaaagcttggcgtgtgacagattcatatgtaaggactggcagattgacctcatttaaatacctgttctatcttagctttattaaagactggcttcctattatttgtatgtttcacacacttttggacaccattaattttgcctcagctcttacatattttaattttgtttaaaattggctgtcattggttacattggacaaatattacaattatttcctctatttttactggttgctttttttgactttataatggaaaaagtttatgtgcatttcttttctcatattagctgagcaactctggcagatcacttgaactttatatataatgaaatctcaatgttcttatgtagaaaatgagaatcctcagtggcattccatatggtttatgtgaggcacttggtacagtgactggttctgttgcttaagaagcctctcttttagccaagcacagtggtgtgtacctgcagtccctgctactgaggatctcttgagcgcaggagttcaagaccagcctgggaaacatagcaagaccccgtctctatacttaaaaaaaaatcataatttcctctttcacttctttgtccttttcacgatgatcagttttacactatctgaagcagtgttggacacacacacacacacacacacacacacaaacactgtctatataattccttaggggtcagggaaccaaaactgtataaacagaagagttcttccctatatgtgtttaagttgccttagcctgtaactatggtagaataatcgagttaaaataaaactaaactaaataatagctaatggaaccttgaattcaccttgtaagtgagcacacagtaaaaaacacagtgtgctttctgatattaaaaaaatgaaaaggaaattaatattcagaactttttatcttcaaatcacttcacattaatttatttttacactgtactgttttttcttattctaaaagtaatgcatgcttattatgaaaatccaaatatttcaggaatatagaatgtaattactataataatagctaacacttattgggaagttactatattgaaaaaattattttaaacactttacacgaattaactcatttaatatttttagaaaataaaaatccattgaaacaccaaccttcctccagatccctagaaaactcatcaattaaagagcaaaaagttaaatttatgactataagggaatcaagtagtctttccaagctaatttccttcttatagacagagtatggtatcttacagaaaagaaaaaaagaagactgttgtatccatacttatcaaagccccaaatctttttgcaatatataattttcaaggaagatttggctcattctacactcttactacattctgtccttactctaggacacaaggctggatgaatcccatagttaaatgtatcattagaattcagagggatgtttatgctccttgaggtcagtggttttccaatgatgtctctgtagagtcctaaatttctattgaattgcaaaaaggattaccagtcactctgacctggaacactttctgtgtgatatttttgaatatgaggttctgatttaagctttcattttaaaacaggattttgttgtaaaaaatagttgaaaccactgatctaatttaatctttctctgcacagagatattcttgtaggaatgtgcttggcaggtggctatccagacttgaatctttccaaagagaaaacctaactctttcacaagacaccctatacatttttgaatgctcagaaaagtgcttctatgtaatatcattcaaaacatgtttcctttttcctgtaagacttagttttcctgtaagacttagcaatcccaaataatttccttttccatatgcatcctggaaatatatttaaatagctactcatatttcattcatagttgtctgccagtgggacctctgtttctttaacataatcctctctagtgataagatttctaggccctattcaattctgatcaccctcttctaaagtcctttaattatgtttttttatcatcaaatatcattccaaagtatatccaaagtataattcagcattctagatatgatctagccgatgaggaatgtattggggcttttatccaagttgattgatgctctgctttaatattaatttggctaaagagtacataaggttttttttgttattctttcttcttaaaaatagttttaaaaatgggttaataataagcatgtggctaattagaaatccttatttctgcatatattgtagtcaagggatatctcctcttgtatttatgtcaccagttttcgtacgtgaatgtacttgtgatgcttatctcgatcaaattgaatcttagtcttggcccattgatgttctgtcttaggattcccaagggtgttctccatagaaaagattccatggccacatgtcatggctgccttagaaattcacagtacagatttgcaaaaattcactgagatgcattgttgtaaagagacctatttaactttttttaatgcaacatttattttagcatagaaccattttttttaaatctctctttcttttaaagcctaacatttgattgcattactaggaatagtattccaggaaacagtgccaaggcctattaggagaagtttgattttaagacttatccctttaagattatgttaactgtaaatatgattaccatgttttcttatagttccatctagttcaatagttaaaatgttaattgcattgggtcaagaaaggggtctttacatacaaacacgattgttcctagatttgtataaataggaaagaaaggttgttcttgagggtgttgtaataatcttggagttgtaaattcttgggatgttgttgtaatcttatctcagaatttggggacttaagaaaagctacagttttcttactttagaaatttactccttctgtggcattgaaaatcaagatactatgccccaccctgatattgttcataatttatctattattgctagtggtttcatggttatacatgaaaattcttccagcaaaccatgctaaatgttgggctggaaaatcttacagtgcttatccatttttttcctcactatttttcaaaggtacctgtcatgaaggaaacttgtcatatatgatcaaagtagatatatagctgataatccatttaaaaaatcatacggtatttgaacgctccaaaattcagccccaaaattaatacagcctgcattgggtgatattctaatattgttttatttcgataattttaaaagttgtcatattttattgttaagacatatctatttgcaaagatacttgtcatcaaaaggcccattttggcttatagggatatacttcagggaagctttcctatgaataatgtctctggttgatgtgtgaatattctttaaatggcccttggtggtctccccattcctagatagataaggctgttaaattacatccactttttgtcaactttgttccgtggaccattattttcagaaaacattaacagatatgccttgtgaatgaaaaggattccatggtcaaaggagtttgagagaaaataaataatatatcccttttcggggagtcagagtacaacagcatattcaagatgctgagaaatcctgtgagattaaagataatgaaaagcctgtctttatttcacctaatattttccaaatttatttgaatgtggaacacattgctttgttacctcatgtttacctgttgacatcgagtcccgactagcgcagttaacttttctttttctttttctttgaccaagtctcactctgtcacccaggctggagtgcaatggtgtggtctcggctcactgcaacctctgcctcccggattcaaatgattctcccgccttagtctcctgagcagctgagactacaggctcatgccacacacctggctaatttttgtatttttagtagcgacagggtttcactattttggccaggcttgtcttgaactcctgacctcgtgatctgtcttcctcggcctcccaaagtgctgggattacaggcgtgagccactgctcccagccgtgaagttaacttttcaacccctatgttggtttgaccaccactgcccctggtctggaccacctctgatggtctttgccctctcattatggcatttttctttcctcccaaccagccttagaaatattaggttctgctgagtacttaagcaaacatccagatattttattcattcattcacacatttattcaataatgtctgaagagaaagcatagcctgatgtatgctccacgagactagcaagaagttgacattatagctacactctccaaagtatatgtcctaggtcaagagatgagacatactgaaggaactctcatgagaggcgtactcagggctgtcagaatttagacacgtgagagcagctccagctacatgaccaggaggggcttggtgaagcagttggcacctgacatggccctggaaggtcagctgagattttgatgcataggaatgcaggacccccattgtaggaagaaaaaatgacacagacaaaagcacagaggtggaagatcagggggtctacatgtggaactttgggtggttcaatcggatagactggaggatactagtaggaattatatttggaacaattgatttttctcagttaacattaatgtgtgacaagaagaccagaaaattcaccagaaaactagcaaagtataacgtgggagatttgcaaccagaaggattactgttgtttcttcctcctttgttttctcccttgtcgttatccccttaagagcccaataaatcacagttaccaggctagagcatagaaggattgctattattttttggagataggggtctcaccctgctgcccagactggagtgcagtgactcttcaccagcatgatcatggcacactacagccttgaattcttgggcccaagtgattctctcatgtcagcctcccaagtagctgggattccaggggcatgccaccacaccaggctttagaataattctttagaaagaattcagtaaactctgagccaatccctgctgttctgagttcttatatcttggagactgcttaaattataggttatgtgcaacagtaaaacacagacacagcaaatcacaatgctgcccatgttaaaaaaaaaaagtgaatgttgatgtaatattcagagttttataaaactatgtgataatgttgcccaaatatttattccagtattaagaacctttcatgtggtactatgctcccagcaatgagaatcttaaggaaagaaaaattcccttccttttggaattgataaatcctcttaattcaaaattaacattattcttgatgttactctactgagaagaagagtgcacagtatttttaaaatctattctaaccttcagtaagtgtccttaacagacttgtaggaaatgattttatacatttttctcttcctaaaccctagtggctgatggcatttggatatagaaaagtaagaaaatttaccaattgggtttaaaaatctaaagtataacacagttattggtgatggtaagggagtaaaaagaaaaactacagaagaattcctttaaactactgatttaggtgataaaattgagatgaaatccatggtacaacttaaatgtgatgcatcttacttttactctaggtaaaatcatgaggtcagatcaatgtaacggaagttgtattttaacatatgtataaggtggggagaggcagtttgagaactctgaaagcatagaaaagtatgtatttatatttgttggatttctgtgatatatactgacaccactttggtcctgatcttataggaagtcagaacttcgcattaacaaagcatcactggctgattctggagagtatatgtgcaaagtgatcagcaaattaggaaatgacagtgcctctgccaatatcaccatcgtggaatcaaacggtaagagatacctacggtattctgttcctcaatctgtaacaagagtaatcaaaacatgtggtaagactcataatagactggtgtgttaaatctcattgtgaacaaattaaaaacagagaaagaaaaccagatgtttcaaggatcttgtatgtctttcataaatttctgtactctatgagattatatagacctgaaatatacatatattttttacaaaaggattttaataaggccatgaatggcagagataggttgggttgctaaaatataggggctatactatttttttaagttggtcagtgagggcagtcaagtctttggctctctgaacaacagaatacagtcatatatatatacaggatatatatacacaatatgtatatatgcacacagaatatatgcatattatgtattatatatgcgttatatatgtatatatgtttacgtatatataacatatgtattatatatgtattatgtatgtattatatatgtattatatatattacatatataatatgcatacatatataatatgcatatattctgtgtgtgtgcagaatacagtcctgactcaattctggcaattttattcccattacatctggcattaggtagtagaaagttaaaccattaattttttttaggcctattaattttgaaattaggaccgtcttagaggcaataaatttcctactaggaagaggcttcatcttcagctttgttcagaatagtaccaggcaatacttgttaaacaaatgaatgacttagaggtaagaaatacaatccacctctgacaacttctgtgttattccaggaaattaaaagaaccaccccgatggctttgtgttttgtaatagcctgatactccatgatttgatggaatcatctataggagctgatgatgatgatgacctagcaatgcttctttaaaccttttagaataatcaaatgctattttaaaacctttagtgcttatttatttatttattgaattatggcacttaactattgcctttacaaaatttgtcatctgttatataaccaagcctaattgcatcttcttggtaggagatgagaaagattctgcatttcaaaggcaagcgctcttaaagtgataaggtaaaaatgccaggtcagcacaggcagagttaaagtaattttaagggttaattctatgggaggctgatgtagtttttgtcacttgattcttctgtaacatactaagaaagtgagaagggagataaaaatcagaaacagggctgggaaaattcaggttaatgcctcatcctctctggacttctcaaggatctgctccatcacagagtaatcaaagtttatcactttcattttaaatgtctccctccatagagagtaaaggagagcagggaaaaggagtttccattaccattaggagtcctgtttattacagtttaaaatgtaaaagccatttaaaatttatatgagtaaatatagcatcactttattttttaaccagggcaggttaagcaataatagtttgctagtattactttaccccacgtagaattctataggatgctacctgaaacacacattaaaaaattaattttaatgggctgttttttactttctactataaccattgtttgaagctcgttctccttagtttgtcactggcttggttcagtgtgtttcctcatagttaatggtattcaattgtgatttttgacacttggatttgattcgtgtagctataccacaaagtcccaggaaaataaaattaaagctagtgtcatagtctcactgagtgtctacagaagtatcatattgattattccatggtttctgatttacaggattaagcaatgaattatttactactatattattcctggcaaaaacccatagaattccttttttattaatttgggggtactgaaagtttgataatatggctttttacatttcttacataggaaaaacagctaattcattttttccacattaattcactgaagtcttggtctagtgatcaaatttgaatatgtagtgttgaccaattatagggtagagagatgaaactcgaggtgtttttgataatgagtcttttttacctggcaagaataaagagaagttcatggaatattttaagtaaatccttcttaaacaaccaacaaaaattctttcagaaataggttcctatggacttatgtaattaaagcctctgaagaatgagaatgaagagtctcaattgcaatgcaagttggccttctttttattctcttcttggaatgttaggaatagatcatccttatccaaccccttcattgtattaaaaaagaataaaagacagcatagaaaacagacttattcaggatcacagagatatttaacagcaaaaggagatatgaacccaggttttttttgttttttttttttttgtttttttttttttttgcttcattcctaccacagtgcagttccatctgtatctgaaatgttttttgtgtgtgttttcttttttgttttttgagacagggtttcactctgtcacccaggctagggtgcagaggtgtgatcttggctcactgcaacctctgactcctggactgaagggatcctcccacctcagccccctgagtagccaggtgcatgccattacgcctggctaattaaaaaaaaaaaattttgtttgagatggagtgttgctatgttgcccactctggaactcctaggttcaactatgttgcccactgtggaactcctgagttcaagaagtctacccaccttgaactcccaaagtgctgggattacaggtgtgagccgctgcgcccagccttactctgtatctgactatatgcttgcaaatgtttaagtgagattcttttgcttataaagaacagaagctgaaggaatggtatgaggcctaaggagtgagggattctatggcgaagaactagaacttcattataactcagcctcgaggagatggaattgtatgctgagcatctctgcgaatttaagcaatgcgagtttgtggcttttctctctggtgtttctacctttaatatgcttctgatagttttaacaaaagttacctaccttctcacctctcctactttcagactccgcctctttataattccaaactttgacctgtttcttgcccccacgtggccatattcttcatggcaatttcaggcattctttcagctttaacctctactgtatgattgtttccttggttccccagtgaaattccgcagaccaagaatcctattagcaaagttgattgttgcatattcattaaaagacctagagaacttacaaattatctgctgtctggtcatacgtccactgctgcctcaactagggagggtggagccggaaacatagctgcccggaagctcctctcttcaaagtctgggggtggagcatgcagctcacctgggcctgtggcttggcaggcaccatgattgacaaggccagtttcctgtacattagaggagataccctttttgctctgcaccttagagtcctagttatagtgcatccagaaggaaaatatgtaatcatcttgatcccttatcctcttccactgctatctaagaatttgctatattctgttcaatgcttggttgtcaaagaagcctcagttgggttctgagctctccggggcttagatgcactgcctttgtattgtctcattcctgtctccctaggaatcagggcagacgttgcacagaaacactttttctgagagaaaaagggcactttctactgggtttataaattgccgcaccactgaaccatgtcttcctaaatagatatttaccgttgacttgggctgatagagagtagaattctcaagaatttccttccctccctccttccttccttccttccttccttccttccttccttccttccttccttccttccttccttccttcctttccctccctccctccctctgtctgtctctctctctctttccttttttttttttttttttaaatggtgtttcgctgtgtcacctaggctggagtgcagtggcaggatctcggccactgcactggattcaagcaattctcctcctggattcaagcaattctcctgcctcagcctcttgagtagctgggattctagacaccccccaccacaccccagctaatttttgtatttcttgtagacaaggtttcgccatgttggccatgctggtctctaactcctgacctcaaatgatctgcccactttgggctcccaaagtgcttggattacaggtgtgaaccatcacacccggtcaagaatttattgtttcattgtggattctagaaaaaaaaaaagttgttaaaataagaacatgctgtcaaactattacattatgtagaactccccttgagattttaatttatattttctatgaactatcagtcactttattaatttcattttttcaccttttctatgtatttccaagaagctcatggctatagtttcgagaatttctatacaggtttccttgatgaatgatccttgtaggttgctgcaatctaattatcctaattttttcctatgcagaggattccttgtgattcacttaaattctcacacagttactttttgtatgttccaacatgtttagaacatattttgatacaagattctaagagagatggggaggttgggggagacattcgttggaagctgtttactttctccccagatgaccttgctgtttggcatgatgtttaatctcattaaggaagctatagtaattattaaaataaaattagatcataaaagtcttctgcaatgaaactcattgtttagatctatctggattagtgactaaatataaacgaaatgattaaaaaattaggaaattccccttgaaacagtatatgcttgggtgtaacagtggccatacttatactgttttcaagcacttagaaaataatacagtcaagcattttgccaacctacattttagaaatgtaggtgttttctgtcttttccaatgcctttcaacccctactttattcagaattagagaaagtaatttatcctgtagtagacatatatcaacctatgcaatctgctaattacttctgggacaatgtaaagcttacaaagaccagttgggttttcatataacaaaggatctcataggcagtaattatgtgataacttatgagtgaattcctttcatgaattcgtatatgacagcagaaaaggccacatacatcatgtttacacaccctacacactatatgttcatttgtatttgtggtttatttggctcagtctgtatataggaaaccttgacttagcaattaattcttagctaacaagctttgtgaaaactcctgggctttagagtagggaagagaataatagactttactggtttccaaattaattaagtaatgctttcttttaaaagattaatataggaaaatatacaactaatcaatcatatcttctcctaagttttcttttttaatcagaagaaaaattatttgaatgagattcaagttcccacaggagcaattgggcttgtagcaaaaaaatagctgtttcatttgagatgagcagaaaaatattatttttataaaatttaattaaattatcaattgcagcttttaaaaatagactcatactggtaataggcttcgccttaccccctttcccaaattgataatgatgttagaaatttcacaatattgggaaacaacctgcagttatgttgaaaagcatgtaaaatatgttttataatttgtataacagtctacatgtatattgtattatgtaggatgcccaggaaggcaaatacatgagaacaatatgaaagcaatagggtagatttgtcttttcaatgtatggtatccatcctgtctacactgtttattaatttcaaaatttctcagttgccttagagtaagcattcattatgaacaggaagaattcaggtacttaaagatgttccttaagttatctttataactgctaataaataaatatgtccacttttaaatcttttaaagaaatcacttgatcaaaatttttgtatgtacagcagtgacatataagtttggtaaaaaagtcacataagtgaatgttggaatacacacagacacattttatgtatgtttgtatatactgtatacaatgtgcatatgtgtattttgctacataattatatttagtgtattatgatcatgatgaaattgcaaacatgttacattcataataattagaaaaattcctttctagaagatatctttgagaccatgcaactttttcctgagaccagaccccgtttattaagaaagaattcaaacattacaaatatactaatgttcattatgtttacttgcctgttcagcataagttgctcagctgtgttcagtttctgataattctaaaacctcattaatttgcactaatgaaggggctgtcctttataaattaacaaatgtaatatgccaaattactatgggaaaatatgttgcttaaataaacatcataaagattgcaggatttaatgcttttttaaaagtctgtaagtgtaatataaaattactttcaatttacttttaacaaaaggctgttttccaaatctataaattctacccatagcacacataaaaatgcttgctgagtggttttaattaaaaagattaactttcttactagcaagattctttttacaatgaagactcctttggtgtagaagtataggttaacttttgagcttgtatttcctccagggttaattcagaaagtttgtatttgaaaccataatcattaaagatattttaaggtctccaagataaatacctgattttaggaagaggagttattttaagttgtctctgtgtagatgcctctttgtagtaacctcctgttctggtatttttaggtaacattcaattaaaaaatgaaacattatggttaaccttccctctaatctgaggtattttttgctggagatagaaaagttctgatttttttttcttcttggaaggtcacagtggacagctactttgtttgtcaaaaataaatttgaaaagagtcttgatatccgaattgggattgggacttctgcccagctctagttgagcaccttgggtttacgacttcatctggttgtaatgtcattgatgaatcctgaaggacaagagaaggaagcatctctcttagtgtaggtcctttgtttggaaacatggcccttctagatatttctagagaaggacacacactttgtatctctaatatagtttctttgagattacattttctcaaagaagaacaatttcattttctgcagcccaaatcaagaaagcttgttggtgctgcttcagaaacagatatcttcatattaccaattcggaatatcctctttctcgcctgatgcttgagaaaatcctgagaaaatgatgtaccctcacatactaattcctttcagtgagccccatttttagtggatgtaagagccaacgtaggcaactttgatgtattgaaaccaagcttactccttgcatagtttgccctcctaatctgtgattagagaggatcatccacacttaatttgcagcagaaagacacatttggtcttactaaaggtttattgctaatcacttgttcttaaacattgctgctgagtctcacatgactttgtttccctttcaattccacaaaatcttttgtccctagagaagcttcagagtttgaagaaatattggcgcttaaattgattctgcttacctgctagactagtccaatcttggaaaccctaaatggccatatctgtatttaaagatgattatattagtaataaagttttctactccattattaacagaatattaatttaaacataaaattatatatgacctgcttaggattctcggttagatctcataatttttgtacagtagatagtatcgcagtagattcagcttatcttttgtcctggttagaaaatgtgaactaccattaagtcatttggcaagacttatgacacagtgaaacttgaatgatatacatcattgcatctctacatctttccaggcttcataaaactgtacctttccaaaagtgttagattctgccaaactgaagcccttttcagaactgaatatggaattagacagtgtaactacccattccatcataaaggcagtaagaaaacaagttgaaagtttgaataagactgtcacaatcctcatgaaaatgatgtatccagaagtatacaggttggattcatccttcatttctttgggtgggagctgcatacttactgcctgggtagctaatgtctatcatatgataagcacctgtcttcattctcactggcaattttaaatagaattcaatgccagaacttgatgtttttcaccaatcctaattagaaacatggcttacttttatttttgaacaaaaatgtacttgttcaaagatctgtaacttaaaaattcttactacagcttggcaatccgatagctttgactttcttagttcccctatttcgacttttcttcctgagaagcctactgcctctttgacataaattcttcctcactgacccaagtggaggcagtgaatgcttcctaattattttagcacagctgattttatgctctttgcataagaaaggagaactatcaatttggactgtctttctgcatttctcactctctgtatggttaaagcctggacttttctcactcccttgcaatacttccttcctttacacttaacttttagttccaaggcaggctgtggtacctgctcccggcctcctgtttatatatcataatgtcctatcacctttttttttcagagatcatcactggtatgccagcctcaactgaaggagcatatgtgtcttcaggtaaggaaaataagcctggcaaattttactaaccagaatgacaaccataactgctggctgctccttctactaatcagaaccccttctgcatccagacctctcagctgctcttgttttctgcttcaatatttttctcaaccttgttctgtctttttggattttacttaagggaggatggttcttgctgtgtcttcaaacttaggcctgagaaacatacatgagtgaaagaaatctatatctaggtgcaacttaatgacattaagcaagtaaaggagatatatctgagttacaagctcagtttttatgtctttccaggtgattctcttagctgccttctactctttcacccctcagagtgtattcctgggtaatttgtcaacatctgatccgtgacctttgggtttctaataatcagttgtggatcgctaaacttaacaaaacaaaacagaacagaacagaacaaaacaaaacaaaaagacttacagcctttaaaaatgctgttgtctttgttttggttggtttctcacttgcctgtagtatttgctgatagcacttatagtctgagcagatattagcaacttagaacccaactctagcaatgcatatataaccataattcattgatttcttcacaagctatgaatttaatctatcctctatgtatttcattttttaaactttttcttattctttgtaatgctataattaatagagccttagaacatttaaaaattaatctttatttggaagaaaatttttgaagacccaagattggaaattcatctcagaggtacaatggtaatttggttttgcatggtgccttttcttttacaaaaattcttaaatttcatttgataatcacaataaacttgtgaaacaagacatcatttttcctcattttacagatgagaaaactgaagtattagaaatgttaagtcatatacctcaggaagtagaagagaaggtatttcaagttcgatattctttttattactccacatttaatattttagcttcattgagtttttcattatggctggtaccttgttgaaactatagaatgacctataatcaacatgtctttttccatcttacctccatcatttcctcttcccttcaaagccattttttaaaaccataaaagctaaacatctctgtatcctagactactttagctatatttaggacatattcatatgtcattactaagatataagtgtatgtgtgttgcggaatggtatgatcctggagtctaagaggttgttactcttctgaggaaaggaaggaaggaaaaaagaggaaaagagagagaaaaaaagaaaaaaaatcacatattctaaatttcttcacctttcatttacacgtttctgtaatatagggacttcgttatctgactccagtaaatgccattaggaaaaaaagagcttttacatttatatggaacttatcttgggaaattgactataactattatttcttaatatgtgacttgaatcttgataactttctggctgttgactttcaatccttctttgatactaagacttctttatttcttactaatgaaaacccatccgttccatgcttttttcggcatgagtcatatttttcattctctctgtacttaatgactgttttttcttcttttatctttgctacctgagaaaatcttgctactagatatccccaactattgtatgatttatttaattagcatggtttgtttgatcctaatgtaattattctattgctctagcagactttgcatggacttttcagcactttctggtccggatgtttatgcagatccaagttgcctggaaatactctcaatcttgtttgtttatttatttggcatgcatgaaaattggctttcactctcttggaatccaggggctattctctttggtttcatgttttctcaaaatcaagaccacatctgaaagaaggaattttctttctcacctgtggtgtgtatctcctcagagtagtctctcttggaagttcagataatgcttggtgtgtgggatattcttacagatggattgactccattttcatcccttttaaaagtctttgggtctagactatggtaatattcctttgtggtctttgagtattgcattctgacttataaatgcttcagcttctctgttgcacggtgttctactactcttttactaggcgatacccaagcctggcaaatttctaatttatgagtccaagcagcatgactcaataaagcctcattccacttttatgttttatagagtctcccattagaatatcagtatccacagaaggagcaaatacttcttcatgtaagtatacttaaatattctattcactggtttttaacccaaggcactatctgctttggaaggtcatgttcacgtctatcttctgcccctattaagggtcagagtattgagtttggcaataggtggtatttgctgtttggagtagaaatggcctcctaatatgcttaaggacaactagacatcctgtcctcccaatatacataagaatattaaaatacaccacaaatgtatcagttttagggtaatctggtggctttgaatattgaaaaataattgcacaagttctgaggcctaattcctggcaagcagtagagcacattgtgtgtcttttcagcttctctggatgccttcagcaactgcctgaggcatgatacccagctgtttggagcttccgttccaaaacttcttcattctcatataaagttagctgtgatggagtaagaaaactatatatagatgcccttaattcaaatttgatagcaagtaactgattatgaaaatgtttgaaagcaagcccctaggcaagatctcagattagttttcgtctatttaatgtgaaatgggctttgtgcttgtggacttctataactgttagattgattggggttttgtgctatgtcgggggaacttaaaatattagcaaggactagtataaagagtttttgatacttataaattgagaatatcatcgtattaaattttgatactcaacaggggagtttatcaaaccttgaaaattaaacttataactacagtctttctcttccttatgttagctccttatttaaagcatttctcaatttgataagctcttcaataaatagatgttcctagttattctatttcgatctggggagtgtgttgaaggaacaatttccttttgctatcagcagggtaggaaaactcatgaaaagaaagtctgtccttttggcaatttaagttgttttgtcaatctgtttaaataaatcctgtttgatgttacagcctttccctccaggttggtgatactagaactgtaactatatggtataaaattatcttttattgtgtgaagtatggtgttttggctatattttaactacataaagcgtcatttaactggattgatggcaatagcctggtgagatcaaacaggaaatgaaatgctagaaagggccaaattagtttcctatgtgttccaagggctctcatcatatcctccaaaatgataatttctgccggggaatttgtgctatttgttttttaattctacttataaaaagattagtataattatatggattttatgtagctagcatccaggaatcacattgagctttttttttttaagtgtttattctgcagaagcaaatactaggtttttcttttttggcattttgtctggaaataatttctctcctgtgtgattcattgaataaagttattgaaactcttgtaattggaacccttcatgctatcatcaatgggaccatagatactatccttaagcatatctgagcagtttgagaatgtaaaaaaatacttttggttttcccaagctttggggaactgaaataaatctctcagtttatgtttctattcattgcattatcactgagagagaaataattatgaaatctgactccattccctaattctcagtagaattagtttttgatatttggcaatggtttaaaactaagaaaggaagctttgtgtaccatgatattaaaatatttcaatgtgccattttcacacatcagtcacccggggtcatggtaagttctcagtaaatatggttgaattgattcatgaacacatttttttgtggaacttaattttattaggagaatataaacaatgaatataataaactagtaacacgatatattagaaggtgctacgtagtccaaaaatgagaaacagtagaggaggggaggggataaggagagttgaaacttgtgatttttattaggttgatcaaggtaagtctcattaaattgttgatatttggacaaaaagtggaaagaagtgaagggttaactttgcaaacatctagggaaactggctgggcatggtcgctcatgcctataatcctagcattttgggaggccaaggcgggaagattgcttgagcccaagagtttgaggccagtctgggtaacattagtcagacctcagctctacagaaaattgaaaacttagctggacttggtggcatgcacttgtagtcccaccttcttgggaggctgaggtgggaggatcacttgaactcaggaggttgaggctgcagtgagctgtgattgtgccactgcactccagcctgggtgacagagggagactctgtttcaagaaaaacaatcaaacaaacaaacaaaaaaacatctggggaaactgtatttaggcaaagaacaggctgtacaaaggcccttagacaaaagcatggctcatgtgccgtgtaggggaccataaggagccctgtggggttggagtagaaggaacaaagggatgaaatatagaagatgagggccacagaccctggggtctgagcatgtagtgccttgtaggccattgtcaggacattggtatttaatggaatcactctggctcctgtgtgaagaatggctcactgggaggaagggtagaatccaggatcccagttaggtggcttttgctgagagcatagtggcctggcccaggctggtagcagtagaggtggcaaaaaagtcagtctgtaatagtttgaaagtcaagccagcaagattccctaaccaattcattgtgaggtgttagagaaagagaaaagccataggtaaaaccaaggctgcttttgtttttggtttttaacttttggtgttccatttgattttcttctttggctttttcattatacttcttcatattaactattgttttacttgtttttttataattacaatatgcatgttttactaatcctagtgtgttttttaaaattttagattcagcgggtacattggcaggtttattacattttttaatctcatgaaaatatgctcttcagtttgaaaatataaaccagtcgtggcaggaaccaggtccagtcttagttacaataatgaaaatagcatgaagcacacagtccatttcaaggcagccacacgcaggacttgcattgcagggaacgactgtgaggtacaaatatctccatttagtaaaggctgaaggtgaaccttgaagagtcagcaataacaataagccaaactcaaaaatgccaaatatataaaaaagtcaaaggcctcagaaaagtttgcctggtcaaaaataatcagcttcaaagaatagatttcttttcactttattttagccagcaaggagatgctagtaaatccctgtatttgaaaagcgaactctgcttttctaatgtgattgtgcctgtaccggctacattctttgaactaatgacattggtgttttctaaagtaaatgttgaaaagcctctctgaagtagtatggattcagcaaacattttatgtattaaacagttctctgcgatttgggggtcagtgtaagacaggggaggctttcagagcaaacagatataggcagaggagatggatctgacttcacagcccccaaagttcccttttttcctctttaactcatgttggattagaagaaaaaaaaaaaaaaaaaaagagcaggcatggtggctcatgcctgtaatcctagcactttgagaggccaaagagggaggatagcttgacaccaggagttcgagactagtctgggcaacacattgagacctcatctctataaaaaaataaagaaattagccaggcttggtggcagccctgaagtctcagctacttgggaggctgaggtgggaggatcacctgagcccgggagtttgaggctgtcctaagttatggttgaaccactgcactccagcctgggcaacagagcgagaacttgtctctcttaaaataaaaacaaacaaaaaaagaaagaaagaaaaagaaaaaaacaaaaagaagaaaatagaagtcactcacctacccttctacctacttaatatattataagcatttttctcatgtttttaaatagtaatcagaaatatattttataggtcactgtaacaataaagaaatcattcttgactggaggtttttaagggattttttcatttacaaacacattatcggttttgccccctttctgtttatttttcctaccacttgtaaatattagtgaaatatcaaagttcttagtccttccctttgtaagacaatttttactactcaatttttggaaattggaaacttccattgttcattcactagtttagagttgttaattatatttttaagttctttatactaatctaataaagatcaaaattataattttctttattttcttttgttttttgtaaatgaggcatctgtgactaaaaacttataaataattgcctaaatgagttttctattacatgtaagtgacaagttttaggagaagaacttgaaccttacaaaacagtcaataggactatcttgctgctccttttatagaatcagcagaagtaaagtgattgtttggaacaagccttaatgacttcttctggagatgccagctgctggtagccccattttgcagacaattctgttgaataccataaaaaattgttataccaaccactttgctgaattaagcaccatccattccaatttaatacataaatgaggaaaacaaaacggaaaatctaacaaatagtaataggaaagaaaatcaagataaatcccgggaaaacagttgaagtggtaatatctgtttcaaatatgaataacagcaagcatttattgaaggcttactgtgtgccaggtgttgtgctagatgttttacatggatgatgactcatggttatcatgaaaacttattacactgtacgttgaaactgatacatgttgtccaaagtcacacagcagcatttaaccccagataatgcagtggactgctatgtcacataacgttttgctgcctcaaagaaaaagcccttactattgaaagaaatgggattctgtgagtggattgaaaggtagcctttggcaccaagtttattgggagtatatgtggtggattcaagtaaatgacttgtctggggccagttgtacccaagtgatcttcatgttacacgtcaaagcatggcaggtgaatgaaatgggaagagcacaaatgctgagtggactcatgctcttaagtctaaatactaatgctgaggacaatcgcggtggctcatgcttgtaatcctagcactttgggaggccatagtgggaggattgcttgagcaaattgatcatttgagcccaggagattgaggtttcagtaagtcatgatctcactactacactccagcctgggcaacagagaccctgtctcaaaaataataaaagaaataaattctggtgctgctaattaccgtataattttaaacaaattatgtgacttccctgagactcagtttcatctctcctctcctctcctcttcttttctgttctgttcttttcttttcttcttttgacagggtttctctctgtcacccaggctggagtgcagtagtgcactcatggctcactgcagccttgacctcctgggctcaagccatcttccttcctcagcctccctagtagctgggactacatgcgtgtgccaccacacctgagtaatgttttttagagacagggtttcgccatgttccccacactgctattgaactcctgggctcaagtgattcacccatctcagcctaccaaagcgttggaattgcaggcataagccaccatgcctggccccgagattcagtttctaggtctgaagaatgctatttattttaaacatatattgggaagtctaatgtgagaaaatgcatgtatatcatttagcacaactttgctttaagatggtcccttcatgtatggaagagagctagtgtgtggaaaagtgacatggctctaaaaagagaataaaagtcagagagtctctacatcttacttcaacaacgttggaaaatgcccttattgttggagaaggaaacgagtttatgattttagcctaagtgatgatgctgacagttctttgccaggaaatcactatgtcttttcaaaatattatatattctcagctaaggcttcattttacaggaactaatccaggaagtcttctatgaaatctctgaatgaaatgaacaattcagtttttaatttggcacctaaaaaagctagctgaaggaaaagaatgtctttgcagagacatttctgtcataatgagatagaatggtttcacttgggaatagcacactaatatgtattgattagattggaccagatctgggtggtccattggtggaatttagacccatggctcttacattctaccctcagttgtaactgacttacctgcttttatggtagaaaaaaacttctgggagcttagctaaatgattcttagctggaaaaatgccatttcaatttcagatgtttattggtcataacatgtgaacctctcctgccactgttggagagctacttttaattgaatgcaaattgtgttttcagatttctataaacatggcatttttcatgggttggtggctctgcccactgtggagaatgacaaacaaattatcatgcatcatatagcaataaaataataattcaaaaagaaaattgccctactcatattacctcatctttttggttggctggagagttacttacagatttttaggatactagagtgacttggtgcaagagttggggctcgtatattatagccattcataggtgcaagcaagttactgccttcacaatcagttcttttattctgtatatgaatatatcttctttttcttttttaaacaatactgcttgcgagtataatttatttcttcacttctgcctttgccctttctaaagtcattcactgtctatcattgcattccaccagtggaggagagaatctaaaaagttttgattaagctttgacctttcgtactggttgaaattaacgctttacagaattattcttttggaccataaaatatgtgtgtgcatgtgtgtgtatgtgtatgagatatagatatagatatagatatagatcattgatacttgcatcatactttacattttataaggcatattttcttattttgagtcatttatttatacaactcagtggcttagatttcatcccatggatgagggacttgacgttcagaaatctgtgacttgtcccaagtcaaagaacaaataggtagttctaaaaagaagagaaagtctactccttatctaaacagcacattttagggaagaatctgattggccctgattgcatcatgtctgaccctaaaatactgcatccagggagattaatgcctccagctgagtgggggctggggcacatatccactgctgtgtgtgttggggttagtgagggcagatgggctcagccccatgggaaccacatggtgtagaatcattacagagaggagagttctgtagcaaaagaagggaaaagtgagctagacaggaaaacaacaacacaatcattgacaactgataagcaaacaaccttagaaaaatcagaaaataggtattagtaacagaattttaaaggaaaattaaaaataggtgttgttgaaaattgtgtttcattgggcagacaaaactaagcaggatgagcaatctgaagaaaataataagctggaaaactgaatataattgcagtatcatttttttaaaagactcattagtacctatgagccattataattactcttaacagtgccctctttttaacccaggaaattctgcattttgaaagaaagtagaaaaacgtagacaaatgagttacagttttgaaattagaatgcatgggaagcattttgaaatctgtaaaatattctacctttgatgtcaaaagtcagagtacttgatatggatcctttaaaaaaaatccatgattgaggagattttgaaaaattcctagtttcttttaccagagtaattgtatgttgattagggtttgggtgttttttgttttcaatttggaaagaaaaagagcgtgcttagcccattccatataatattgtatagaaaactcaccaggtcttgttcaattgtgagataacactgattgaggttttatcagacttatagacatcaccatttaaacctaaacgaaataacaactccggtagttcatctgtgggcatcttccacttttctctgtcccactctgttataatgcacctcccatacaagctgtgaatacttaattcatttctttaataacttgctgtgtatacatagtttagctaatcatcaaaagtgttggaatgccacttttcattttatctcttagtctaccaaaggtcagcaaactctcaaaaaccaattaattgggtcactgtggcttatagcctagagctatgctcatctttattcaagtccataaccatctctgatttcaggtttggtgtttaggttgaatttatccatcaacgatgggctctttggtttgttctttgctgaggtattctagcactacctcttgagtgaataccaaactttaaagagctttttaagaaatgtcagaaggagagagcgagagagagaatgcctggctttgtgaaatgttgcagaaatttgtatttgtaattatcacaaatttaatcagtctttcctttaaatttttaaagcaattttggactattctcattatttcaatggtagggaaagtaacatatagatagggataggccaagtgacacttaaggtcaaatagcaagtgagtggtgaatgtaggtgaattaaaattggatggccctgtttttgctgtttgatccttagatcactgaaaactttccctctctttttttttttttcttttttcttttttttttttttcttgagacggagtctagctccgtcgtcaggctggagtgcagtggtgtgatctcggctcactgcaacctcggcctcccgggttcaagcgattcttttgcctcagcttcccaagtagctgggattacaggtgcgtgccaccacgcctggctaatttttgtattattagtagagatggggtttcaccatgttggccaggctggtcttgaactcctgacctcaagtgatctgcccaccttggcctcccaaagtgctgggattacaggtgttagccactgcgcttggccaaaactttccctctctttaatgaaaatgaatagataataaccaggtcctactatatttcagcatgaggctaggaaatgtgtatgcatatttcttgggaagtgggaggtgggaggtgtaatgattgggggagataaataggaaatagtccttgggctgaaggagttcgcagcaaagtaaaaagtttaattgtgattaattgtgcataatgacacgtaatcataatgggaagtaaaatatggcaagaggaagactttcaaattaagtttttttttttttttgtaatattccttaagatagaaaagccagccgggtgcggtggctcacacctgtaatcccagcactctgggaggcagaggcaggtggatcacaaggtcaggagatcgagaccatcctggctaacatggtgaaagcccatcgctactaaaaatacaaaaaattagctgggcatggtggcggttgcctgtagtcccagctactggggaggctgaggcaggagaatggcgtgaacctgggaggtggagtttgcagtgagccaaaatcgcgccactgccctccagcctgggcgacagagcaagactcatctcaaaaaagaaaaaaaaaaatagagaagccatttgtggttatgtaatttaaaagaaaattttggccaggtgtggtggctcatgcctgtaattccagcactttgggaggccaaggcgggcggatcacttgaagtcaggaatttgagaccagcctggccgacatggtgaaaccctgtctctactaaaaatacaaaaattagccaggcatggaggcacatgtctgtaatcccagccacttgggaggctgaggcaggagaattgcttgaacctgggagcggaggttgcagtgagctgagatcgcaccactgcactctggcctgggtgacagagcaacactctatctcaaaaaaataaaaataaaaaaggaaaagaaaatattattattattactatttttattattattattttactgttgtctgtctcctaaaatagcaaattgttgtttctacttcatatttataggtcattttactaagaaatcagaatcctgaaatttatctcattttaaaagatgatgacattctataatttaccgtcaagaataaaagattagtgatgattgaaggtgctggaaattaatttacactaaatagcattttgaaaatagtttggggaactttctgaaatataactagaaacttttagaaaaacatgactatagtatggtaagttgaatcattgttgatgagcagacacttatccttgatacagagatggatttgcaaaggctatgttacatatccgaggagatacttttgtttaggccatctggaaatgtgtgtatatgaaaaggttgcaattttatttttttaatagagaccaggtcttactatgttgcccagacaggtttcaaacttctgggctcaagtaatgctcccacctcagccccaaagtgctgggattatagacgtgagccaccatacccagcttgcaatttcctgaacttgttttattcattaagtaagactagttttgttttttaatttttattttttaaagacttgagttgatccaaagaagagagaagtggtaaattttaaaaaggatgcctagttataatcaaggaatccagtaaagtaaattaatctgttaaaattataaaacaaaaattttgcctgtatgatcattcctccctcaattttcttaaaattcatgtattaagagcagtgactaactgacaagaagcttctgtgccatttgataaagatttcaactacaaatgggaattaaggtatattaaaaaataaaattctgcatgacaaaatatttaaaatgttagtttttaatgttctacacaaatattgtcctacattttaacctagaaatctacgtattgaatcagcctataaaaatccatttctttcacaaataatgtagctttgagaacagatttttttcaataattctcagtctacaaagctatgaaaaggaagttgctgttgctgcattttttttaagctgtaaaatctaatatgccccagctctgatgaaatgtaccaggaggaacctgccttgtcaaacaggatatttttatgatgaaatgtgatacgaagaggcatagccttacatatatctgagagaaaattatttaagtggccataatagatttttcagaaattttgtacatttctcttatttgatccagatgcatttttttcctctgttgttctcataccagcttcttaatttcacctccctaatgttccacagcataaatacatctttgttcagagtttctccaagttatctgtgagaaaataaactatacaaagggtccctgggtatgttttaggatacatagattatgggggtgggagagttaccttgtgtgtgcaaatgagactgtatgtgaaacgaagataaggtttggagggaaatagatgattcaaagatacctaagaggtttattaagacctttaaaaatgattttacagtgcctgtaaagaggactgatatttaaactcattcagcttagtgaaaaaaatgaagaaaaatggaaagtaacatgcactacatgtgtacacacagaaacaagtataataaaactttctgccctttttttttttttttttgatatgaagtctcgctctgtcacccaggctggagtgcagtggcatgatctcggctcactgcaacctctgcctacccggttcaagcgattctcctgcctcagtctcctgagcagctgggattacaggtgtgcaccaccacacctggctaatattttgtatttttggtagacacagggttccaccatgttggccaggctggtctcaaactcctgacctcaagtgatccacccgccttggcctcccaaagggctggtattacaggcatgaaccaccacgcccagcccctgcttattttttaaggtttctagaacattggctgtgaacttttgggtaaatagtgcacataactcttctccttcctttttatttgaagtgcagacctgggtatattttattaaaataatggtctgaaattataaaaaatgttctttgtccaatcaaggagtaaaatcaaaccttgtattattttgtagttatactcagatgttagactatcttctagtccccagcagttcactctaggtggtcccatagctcttgcttgaaccacagtcttgccacttcttatccatagtgatgtgcacatcagttcccacaccagaatgtaaaatactagagggaagaattttggttgatttgtgtttctattcccataacttattactatgccagttcccagggagtatttattaaatggatgtcaatatcaacagtgagttaatgaatttttttgttggattatcattttttaagttgtacacatttacaatgaaaagaaaaccaccttcactttaaatcatgggcacagatatttaagtattttaaaatcaaagttttaaaaaactaacattggcttaaataatatttattagagaacttgtaacattttaagaagcattcacattctacctatgtatattttaaatttatttctgttttttacatctggaagatttttttcattttatcataaatacttgttttcatggtaatttataaaaatcagtttctcctttgataggattattacaaattatttcagaatctacttattaactggtcgctgttcctctctgtagtgctgaagaggcacttgcttgggaacaagagaagtgccgcaacagtgtcaataacatggatttttcatttattatctttaataataataatagatgacaataatatattttaataagcatctactatgtgtcagatgctttcttctgagaatggatattgttagtcccattatgtagatgtagagactgatactcaagacaattcaatatttgtcaagtagtggtagaagcaggatttaacctcagtctttctgactcttcatcctgtgttcttttcacccacagatggtagaggttgaaggctcagaagaacactttttgagctcagaaagctcttcttgtgacctctatgctactagtctaaagggcaaatgataattgcagctactttcagaaatggtcctttttccctaatgagatgaccaaatctgctttatgaacccagtttcctaagcaagatacagaaatagacacaccaatttagtatgataaaaggtgttaaaggtagaacaattttaggtaccaaattatatttatttgatacttggataatttaaaaataatgccacaaacttcatcccatctacctcccagtgcgcacacatttgggatgaagagataatgatgagaatgacattgtagataaaaggtatatgcattaaacatctgaaatgcttaggttattcaaagaaaagaataaacacaccatgtgatatgtagcctcagctacttcatgtttgaagttgatggtaacattcagatcagttttgagaagcagactgcaaccatagcttttagtttaagtttcagattgatatggaaggttatttgttttaacaatccctatgttaagttttcttttttctatgtttcaattgacttattttgtcagattttaggtttttttttttttttcaggcaagatggcattctcatccctgctgttgttaacatttaaagcatgcagcctcttgtgctgtggtgtaaattccaactgactgacgataattaaacagaaaatgaaacttgaatggcactatctcaaaatctacttaaagccacaacaggtatctgcctatagcaatatatcagttggaacacatgaagaataagaaattgtagcattttgtgtctgggtttatttttctttgaaatcaaagaagaaaaatactgatttttcctggatcactaaaacagtagtatggatttctaaacagggcagaccatacaaacacacaattaattatatctgaacttgaaatctcatactgtgcactttacctcttttataccagttgtaatttctcatttatgtacagatactgtagtaactttttttaaaaaaaagaatgtattattgtaattaaaaagcaaatactcaagaaagataagacacaaaggattaattgggattacaactcttctttctgtattgagtgcaaaagcttggtgatctcctgaattgtgcttcaacagtgacctcaaggctccttccaacccccaaggctctccttttttaacatttgttattacttagctattttatttggcagggatcccttctatctcatcttctaatgcactggcaatgatcctattgccaatagcttagagcctactgctgctggggtaagcgacacagccgaactttctagcctctgcatccttataaataatgcatctggtttcctgtaactacatgaactcttagactttagtaggcatttctttgttagtcagggtaaaagagttgggagatgaacagttgtggaaatagttataggcagttattatcactgattagaacctgagtccatgacatatgcattaatcactgggttaatgctaatggaatgcttatggtatttatagtagatataaataagatatagaaaaagaatatctttgctgaccaaactgcatgcttaattcaacatggaaagttctggtgaggttaatctaggacgctttgagactccgttgctcataattggacctgatttactactcatttaaaaaatctcttttaatttgcgcagaattcgctggctttttgggggtggacacacttgttcttaagaacaatagcaacaagatctttgtttaacataatatctaatgctccatgtaacttagtggtataacaaattattcaatttgtaatgaaaaaggtaaatgctgtgttaataagttaatagcaaagtaaataatgcatatttatacttttgacttcaaagtgtttataaacttatggcattaaaaagtaatgttttatttttgagcatcagagaaaatagtatttaaacaagagaaaccgatttttaaagtgaaaatcattttagcaacattttaaaataagccacgttaatataaaataagtgagttccatcgaagtatacactcttttcttcactagacgtgccttaattggacatgtcactggccaggcgtggtggctcacacctgtaatcccagcactttgggaggccaaggcgggcggatcacctgaggtcaggagttcgagaccagcctcaacatggagaaaccccgtctctactacaaatacaaaattagccgggcgtggtggtgcatgcctgtaatcccagctactcgggaggctgaggcaggagaattgcttgaacctgggaggcagaggttgcggtgagctgagatcacgccattgcactccagcctgggcaacaagagcaaaactccatctcaaaaaaaaaaaaaaaaaatggacatgtcacacagtgacaatgttcagtgttatgattctatcataaggataaaaaattcagattgatttagatgttgatgagaaacttgttgctctagagccttgtatattttcatcagaattaactgaaagaagggaaaattgtttctaatatgatacaggatgttcatcctgatcattttattattgatttctttagttaccatcagttcatctctgagcagctcattcatttagaaagatgatagcttgtaagtttaattctaaaactcattctcatccttgttagcatttgacatgccaatgattttgcagagctgggttgttatcaggactcatgtttagtcaaaatgtttaacacttatttctttgattcctgtagaatttccttattaattaacccagggtctataagcaacaaatttttaaatcagatatatatctatatgcatgtaattcatttttttctctttgatttttgactacttttttatgctgatattttagaatttctatgaaattaacacatttccttaacaattcaggaaatctgactaactgtactttaaaattgtgctttggtatcaccagtaaataagaaggcttcaattcatcaaaaagataataataaactgtattaatgctttcttttatttatttattttaatccatctaccaaaaacaatcaagacaacagctttaaaaaaatgcaatcattaaattactacgacagcctagtctgcttttgtggctgttttgttttgatggttaccgagaatggaaacagacagattatgtttttctgcttgtaattgtccagtacctccaaaggcctcttgcctgggcatgatcccttctggaattgaattctgcattcttcttctatcactaatcaaacaaaacactatcagaagaaaacatttccataactggatccggagtgaaggaaaatttcagatacttagacatgcatatacaataaacagtgtttcctgacaggctcattaaaaaagaatgactccactatgtgtcaactgcacaaatagaatccattataagactatggactcttacttctgaagtctgcctttgtgcccacctaagattaggaaaactaaatcttccactagaatttaaatatcacagaagcagaaacgattgcaatctctttccccagtgccttccttcctctttctctcagtcttgggtaggtcctggtacatatgaggcacttgcttaaaaaaataactgaaggaacgaatgaagttgcttaaggccgggagcagtagtctgtagatgagtcgactctcacctgtagtcccagtactttgggaggctgaggcaggaggatcgcttgaggccaggagttcgagactagcctgggcaacattgtgagatcccatctttacaaagaaattttaaaaattagccaggtgttgtgacatgtacctgtagtcccagccaattgggaggctgaaacagtaggatcacttgagcccaggagtttgaggctgagcaagatcttgtcttaaaaaaaaaaaaaaaaaaaggttgcataaagcagcagagacaggatcaacctagaatgtctgtggaaaaactttgaaaaagcatacattcttaaaaataaatgggaaatctgtggcagaggaaacagtaactactgacctgatcttcccttttcattttattttaatttctaatttgctgtaattgtatggtgctttcaaatactgattaaaactcttaaaaaaatgaaagagagaaatcacatttttctgctaaactgagtttgtggcatgccttcttccttcatcttgttgatgctcaaagaattatgcaacagagggccatcatactgtttagtatgttaaattattttgattcatgtacttactagcaacatcatttaaatggtttggtttcgtcatggccagacttaagacacatagcataattaagttgacaacctaatattccacattaaatcctggtgttggaaaaagctaaactgatcggagaaataaatctgtccaaagtagaaactgtaatatgtatgtgaacatgtatattctcatcatcactttttgttttcttcttttgttctctgttcctcctgttgagtcttgtgtaagtccaaataaaaattttattgtagagcccaacaacaaaaacaatgatctcttatgtaattgatgattttaaaaaatgctttgaaagtcttcttcccatactttgtatcagtataaagatattgtacagtggtacagaaaaaaatggcttttgaagttcagatggtttgaatctttgcttcaccacttactagctatgtaattgtgggttatctgtgcatctttttaaattctcactttttccatctgtaaaataagaacaatatcagttactttgcatactgattgtaaagattataaataagaactgatgtatatatattacttggcacaatgtctgacctgtttctgtttttcacagtcaggcttctcttccattttctaaggtgactcggaccttaccactctaaaaattcaaatcatgccttcactttctgcagattgcacttgttactttagaagaaaaggaaaactataagatggaaattattttaatgtcctcttaccaaatctacaaaccccagcacaatgcctgtcacagatacggtcatttagtaaacatcttttggatggataggtggatgggtagctaagtaaattaacatacagattaggtctttggaaatggtagctatttttattacaccctgtacagtgaccttaaaatttgaaatctactgcttttgaaaagcaggtcatcctgaggttttccattttgtacctgccagattgtgaaaagaagttcatttcaatgctgcacagcacatttcctgatcagttggctgaattacagtcatgccatttcattttgagttggacaattcaagcatttagccctgatttttttttttgacagtaagttagttatttttatactcattcaacacatttttcccccaccacaggttattgtaaaaccacctgtctctgggagcacagttaattctgtgcatgagatttctaaaaatgttttacattgtcattgcagttttttaaaaatgtagagatccctctgctattcttttgcattgccaaatgcttaggtaccttggaaaactgcttaattggttcttcttatctcactagattctttggccttaggttgtgaatgggtaacaatcatttaacttttgatgtgccctgaagtttccatccaaaacttttttctttgaatcttttttagggtgaaagagaagaatatgggggatctaggtgtacattgatactttttagatgcctttgatgtcagtcagtaaacagcagtagacatttggaagagcatgatagaagagacagggctaattccaggtatttaaccccaagttaaggagacttaacctgaggctgggttatttctctgatctctagggacagagtagtggcaaagccttaaggtggtaaaatttttgagaaacacttctaaagacttatgttttgttttagaatcctatctaaaagcatttcaaacaaattaagttaagccgttcctttcttactggatgtgttcgggcgcagggggtgggggcaaaaagaagcatatggttgaagctctgcactgcagtaatttgtaaaagaagtacttttcctgctaggttaaattgctctgcctgcctcttgctgtcagggacatgatttagttaaatacggatgcttttagaggggctttgtactgcatcatacatatttaatagtttataaaatatctgtgtgaatcactgggtggagaatccagcagcagagaagctcaaccttcacattggagcctctggccttagggtccactgaccagttgaccactggaaaaggtgtgttcagaatgggagcgtcctgaataacccaaggattctactgatttcaacagaataagcttagcatctaacctttcagattttttcagtaatgtgaactttacattttctcaagtcacattattcatagatgttctaattccccagggatcgaagtatagcattaaggaaaatcccttctcaataaaaaaatggtattgggtgaggggagggggacagaaaaagctcttagatgttctatagcaattaatggttgccatataaagatacctcattgtcattagataatggttaaaattatatgaatcttttacccttgatataattttgaaattcatcttaaaaatcaattccttaaaataaaagtagtaggggaaagaggtagtgatgggtggaggctgggggatgatgcagagaaggaaaaaaataagcaagtggaggttactaaatgtagcattggtggattattttgtttgtttggcataggtaatgagttttataataaaacttactatagtatatcaagataggctcctttcatatatgaacccagaaacaccatgaaaaattttttaaaaagttccagcattttattatgaaattttcaaacatagagaaaaggtgaattaatcattcagtaaacaaacttatgcccactaccaagattttacagttaatattttcctatatttgcttactgagtgtctacccatttatctatcaactttttatttttgatgaaatttcctgtatatatgagttcattttacccccaaatatcccagcatgcatagtatatatattttattacattgtttaagagaacatgtaggtcatggattatgctatcaaatagaatatatgtttctctcaaataagccaccatatttggaccgagggttttctagtcatcatatttcagagtataactcagacagtagcagccttcttgttcctgttccctaataattactccttcccctgtcccaggcttttaattctccaaattaaaagaggatgtaacctcggcttcctgattcccagatactgataatttttggtacagtttgtgtttgagctactgcagtaatgttcgggcgattcccattttggtgacagtcttctttcctgaggatacattgccttcctatcctctgtagtttctttattctatactttcctatgtaagcaataaagctaattgtaatgctcccacaattcaggtagcgtctaatctccagcctgttctcaggggaagttgttgggttctggagcacacattttgtgtgctcccttagtttgacaaaatgctgtttaataacagagtccaaatatgaatattagtctctgaatatctttcagaaagaggcccattaagtagagttgtgaccacaagtggtcgtgggagcattaaagagtaaactttcaagtagaaatggtccagggaaacagtcaaagtgaggtattggtacagacatcattcatggctctaggcgagagaaagtctaaactatctaatcaagtgtgtgtatctgagttggcagtatgcaactaaaagctttcctttgtagaaattaattaaaaagaaggagaaatagatgtgattcccagtcctgactttgaaattaatttctgtgtgactctaagcaggttttttgtttgtttgtttttacctcccaataactttttttcttcttgtataaaataaaattcatgtaatgggtgcagcaaactaacatggcacatgtatacctgtgtaacaaacctgcacgttgtgcacatgtaccctagaacttaaagtataataaaaaaattaaataaataaaattcatgggtaaggcctgttgcagctccaacattcagtcaataaaaaaaatttaaatctaattattattgagattacagttgacctttgcattaaacctaaattcttttactccaaataactactgaaatagaaagaaaagacacaagtctattttcttttttctcccagtgtcttagagatatggtctccttctgttgcctaggctggtctcggactcctggcctcaggcaatcctcctgcctcatcctccctagtagttgggatcacgggcaggagcgaccatgttggacagaaaagaaacaagtcattcttaaacaaatctgactctagcaacctattgtataatttatggtagaaacatttgagctggaggtcaaatcataagatatttttatcttataactttcaaattcatatcgttttaagtaataaaaattgtaacaattttctgtaaacagaaaaggtttccaccccttgagctgaaaagcagcaggaaaaggagattggcatttcattttaaatgggatacgtctgcttccatgagcatcataaaggttatgaccttacggtagtgttgcctgacaggtggctcactaagaatgccaaatcagttctggaaactgcatatacttttatttcttcttttttttttgttccctttggtgcaactttgtattttcattttgatcagcaacaaggagaaaaaaaatgtgtgtactctaaggaaaacgtatattgtaagacattttctctggctaaggtcttttcaggtttagaaatgtgaactggccaggcgtggtggctcatgcctataatcctagcactttgggaggccgaggtgggcggatcacctgaggtcaggagttggagaccagcctggccaacatggagaaacctcatctgtactaaaaatacaaaaattagccaggtgtggtggtgcatgcctgtaatcccagctacctaggaagccaagacaggagaatcactggaacctgggaggtggaggctgcagtgaggtgagatcgcgccactgcactccagcctaagcgacagagcaagattccatttcaaaataaataaataaatataaaagagaaaagaaatttgaaccatgtttaaaagtagaatacttcaggtaatccctttcctcaagctttctttattctgggaatgttgtgcaagtatattttatacatgggcttatgtgaagtttcagtctcttgaatagctggtactctcttatgagtaattcataactgccttcacatgtgtataatctcatgctcaactgtttctctctattttaagcaggagatttaaaaatcaaattaacacatatttctagagcatttgctataagtgatatgctgtgctatatactgactaactacatttctgggttgattgggggaccagtttatagaattggctgacaagcaactgaactttaaaacaaatagctagtgcttaagtataagtcaagttcaatcactcccatttttaaaactttgctgaatttatattaaaccgacattggttattcaaggtatttcttccttgtttttagctaaaacttctcttactgcattaaactacatccattatcattttcattaaataagattgcacattggatatgtacataaaagcaaaattatatcttgcatttttgttacatttgccagaagaatgaaaaacaaacaacagaaaatttctctgagctgtgctgctctatgccctgaacgtaactgtaatagtgaatattaatgagacacagcaaagatatttgctcaaggtagctaagccaatatgtattgctccagtaaatgttagaaatgaccattcatccacataacctcagattagtctgcataaagataatgtttcttttgttttttcttctttttgtcacacacacacacacacacacacacacacgcacgcacacacaccacacagtaatttaacattatttgcatttactcacactggtaaaacacacgtctcaaagatgtttcccatagtttattcatccctcttctatgtcgttttcatttggatgcatttgcttaacaatgtctgctgtgtgccaggcatgctctaggtactggggatatagcagtggacgcagacacaagtgcatggtcttatggagctgacattctggtattgagtttatcacgtttgataagaaaacacagataatacaggaagactgccatttgcccctcatccttggcacttatttccagtggagtccttcatcccaaagatctcagacccgcacacacacacacacacacacacacacacacacacacacacagaaactagtaaatggatatgtcattgagactctgaattcaaaaggcttctgagaacatgagcaaaggcttatctttctatcccattttatatactaaaatattatttttctgttcaactccatcctatttccctatttaaaatatacatatcggcaggcgtggtggctcacgactgtaataccagcactttgggaggctgtggtgggaggattgttgaggccaggagtttgaggctatggtgagttatgattgcaccattgcattctagcctgggtatgaaagtgagaccctgcctctacaaaataataataataatagttcaaaaataagttagccaggcatggtggcatgcacctgtagtctcagctacttgagaggctaaggtgggaggattgcttgagcccaggatatcaaggctgcagtgactaggattgcaccactgcactccagcctgggagagagagtgaaaccccgtctctaaatatatacatatatatatataaatatatttttatatatgtaaattaatatcaagttcagagttcatagttaataattgcctgagattcactgccatattgcctattgatactttctagaagaaagggtagccgacacataacaaagtctcatttttccttgagttgaaattcacacagcaaaattaaccatttgaaagtcaacaactcagttgcatttattgcactgttgtgcaaccaccccttccatctagttccaaaacctctccagtggaattttaaaagaaggacaacttgtaaaatgaccaataaactgtgtttgtagaaaattaatgattttacttatggagagtgagaaattaataggttctcccaaagtaaagcaaactcactgtaactatcgtatgcaattaaaatatctttccatatgaaattctcacatcctcatctttgagatcatttactgtatcttcagttacagaggatctaaactcataaagaacaaaatgtaccagagtaaattgctcatcgtgttacagaatgagaacacagagcacagtcaatatcaagtacttgatacagcatctcacaaagtaatgcttaaaattaagtcaaattgtctgctctgagaacattttcactgggtaagaataatcagtcttgactcacctttaaagtgggcagaaaagacatgcccaggaaggtaaaatgagtttcattcatctcacctattttgcatcataaataatgtacaagaacatcacacagcacatggatttggtttgctctcagagaacttttctatttagctggggagagaggaatgacaagaaaaaatagttaaatattagcatattccaaattttccctccactgataggatctgtggtagttgagtttcgctagatcaggctaaattaattcaaggcatactttggaacaatcagagaaaatttgataaggaagtatctgaataggccattaaaagacttgaaaaaatggagaggaggagtatagagggtattttagatagttggctatgaataaagcctgctgatttattagagaccccataatctgtgtaatgcaatcccaatccaaagtaaaaccaaacaaaatgtatgtattgaatggacagcccagctctaagtttgggacaatcaaatactgatagtctttgccttcaaataaattgcattcttcagccctgtatacacgatgtaattaaatgatgacacatgactgtgaacatgtaccccaataaatggtacagttaagaaatgctgggtctatgatttggaaaaatgggaagggcttcgtcaaggagctgagacctagctgagggcatgttttttggataggtggaagaagctgacagatccattggtgtactttatcctccagagaagctgcaagttttgaaagtcaacttcaggacatggagctttcttgtgaaaattatgatttcataattcctcagcaaataaataaataattgccatttgtatgtagggatctctccaaatgaaacgactgctgccatcatttttattttatgttagataccatgaagtaaattctactcttttgccagccgtaaaatttaggagcaagaataaactttttcagtgataatatttttagattttggagataatatttttagagttatattgccaagatacaggaaaaaagtcaaagagaaaataagtgagtaataaggtcaaaagcaaaatgtcatttatcattctctttcatctgttggagctaccgtacattcttctgatgataaagtaaataaaagtaaagcagaatgactagcttgaattcatagcctagcttgaattgatgtagctgaggaattctagtattttttatttgatgatattacaggatgtttttcttcattgaagccagcttagaaggaagctgaaatattatgaaagtggatcagaaatacaaatatattttactttattctgccaaatcccattctatattaccgtgtctcttcttgatccaggttggcatactagcatttacttccttatcctctgtggcagattaattgtggctgcaaattctttgccactttctccctcaagatttatttcttctgtccttgagtctgggctggcacggtgactgcttaaccaataggatgcagtggaaatagtttgttctgctttcaggcacagacttttaagagaactggcagcttgtgttttcttcttcttggggtgctttctctcacaacctggccaccatgctgtgggaagctcaagccacaaggagaggccacaggttggtgcaccatttcacagtgccggctggcatctagcagcagctgccggtcgtcatgtgggggagccatcttgaacgtttccacctagttgcacctcacctgcagcaccagctgacgtcaaatgaagcggaagaaccactcagctgaacccagtaaacctacagaataaaatggcggttgttgtaagctatttccaggtggtttgtttcacagcaatacataactgaaatcgcttcccaaggaaagtcctggaatgagaccatggaagagctcatttgatttaaatgataaatagacagtatttaaatggcctatgcttaattcttataatttctaaaaattattaggcaaaattgtagaagtcttattttggaaactagatccttttaagtttgtttacaaattatattaaggtaataattcctatttcattgttacatattctggttctcatagtctctccttgaagtggtatgtaatcaataatataatcaaatgcacccttttgatgaaataacaaaagcagtatttttcagcagaaataggatgaatcagaacgtactcaaatcttggccacatagctatgtgtccatggcaaaattacctaagctgcctgggccaatgaaataaaaaaaaaatttaagataaatatggactgtatgggattagtgaagatcagaaataatgtatattatgaacctagcagagtgcctgtcacctgggtggaactcaacaaaggtagcttttattattgtgagggagatggtgataaaaggttaggtagtaaaaaattgtgtagtttatttttctaagaggacatggaaatggggtgttcctgggctttactggggtggagcttaaagggttaaaatgatatatccttgcagtttttcctacaaacatgcatgttttatccaaaggaaattctgacctctaaccccattcacactttcctttcttactcttttattgctatagaggatttgatgaaggcagaaaggcaacttctgggtcctagtcccaagggtagaactaatggagaattcttttattcttcacctcccatccttctccatttccccatttacattctttttccaatttggcggaaaaaaagcaatgttataggaagctggctgtctgcagattagtcttagcaccaaggtggaatgacttttgggggaaaaacagacacatcccaaagtctggctcatgtagtccaagggaaagagtacttgtggcagtccataggattctctctctgatgtgttgtcctagtctttgtataaaatgttggttttctctgtaagtgttgggtattttcagtgtaacagctagagcaatgcccagtaacttttttttttttttctgctgaatatgtttgctcttaatggttgaggtaaggtgaataattgctcttggtgtaagttaaagaccacttttctaaactatgggttatcatgcttggtattttctcctatctgcctgacttgaggccacctgaaccccattttggtctttgaaatttagctgaccttggccttggatgaaatgctggtgtattgagtataatagttttggtttaggtcaaaattggggaattcagtgccgtatatttcaactgggtgctttttgaagaaatcataaattaccctagtttagcataaacacctgctgatattgtttctgaatatttacatgaatattgatcattgagatcttactatctttcaatttgaatgctttaaatgcttcaatagatgttttctacaccgtgaaattgtatgtcctttgctagaatctttgtaagagaggtctcactgctttgaagtcaaataaacctagaaaataagcataggaattatttttaaacaccatttactgtgcagattatagagagatgaactcaaggataactcatgttgctcataaacttgtcatagtcatggttacatttatgcaaattggcacaggcttttgttgttgttagttatagtactgcaaacacagtttaagatgttaagaccctttaaatcatgtataattatggactaatttcatcttgaaggaagaagtgataatattcttatctcctgccgtttaaagctgaaacatacctcaaagtagtggagattgtgccctacaaaatataatgtgcttaaagcggattttctcaggacttgaattctaaattttactgcttcagggactcatatgatggctatgtagtatagatttagagagagttttacagactcctattgacataagtgaacaaaatggttccttggaaaccgtttagatgtccaatcacagtaagtgtggattacaggttcagatgcatattgtgtgcagtgatgtgcagcacagtgcttggggaagcctgtggtctgtattaagaacagtgcatttcttctagtgttttaatgactgttgttttaaaagaaaaaaacagtcagcattgaaactactgaaaggtaaagctcctgaaacctaacccaaaaggcatgctctcatagaaaactcttcttagtactttcagtgcggtgatagctgaggacatgtggtatatattacagtgccagggaatccaaacctctgcagtgtggagtcaccatgaaaggctaatctaaaaatgaagtggtagctttgctcgcatcataactctgttacttactggtgcttcctattagcttgacattattagtcttctttgggtgagatagaataaatggaaattcaaaggggaccacagcaggggatatatgggctgccaacccctcccctagcactcccttcctccagcctgtactcagcatttctccctgggcatgacaaacaaagtcttacatagtcattgcaaaaagggctaaaggcagagctgtccatggttaggaaaaaaatgttcaaactgttggttgaaaatcaggtaataacagtcctcttagtgaacaaaacttattagagggctagggaaggaatgctatctctcagcagcaggcaggaagaaattgctgttgaaaagcttacctctctagggaggaatcagatagcagacttcaagcctcaggtccaacccataaggtcccacctacaccaccccccaccccatccccatcccagctttgttagattgctagcatcgatcgctggctttctctgacccaacagtgggtgaaggaaagagactgaaagctggcaaggtgggggtggaagaagactgggacagcttttgtagagaaagaaagaaaaaggaggaaaacgggtgggggccatggggactaggcttaactgatgcctgcctgcctctctttgatttgatggcctttattccttctaattggataaaataggaagtcactggcagtcctgtgtggctggggatactgattttactcagaccagcctgcagctctagagtgtgggtagagagcggggagtgggggttgggagagggggaggaaagagagagaggagagaggacgggcttggatgaagaagggaaagaaagagaaagagactgaagcagagaagagccgcagaggaagaaagtgaatgagcactcaagaaggacaaagaggagtagtcgggggtggggtggaggcagggcggggaagggagtgaccgcccctcctggctgcactcttgcctccggagccctctgatcctgtttgcagtgatgctccgagggcaggcacctgctgctctgtaatgattcagcccctttcagccgtcgtcgcgttaacacaacaggatgctgttgctattgtcactactgcctctcctgccgccgctgctgctgccgccgccgccaccgccgctggtcctccttctgcttttacttctcctgcatgacagttgttttcttcatctgagcagacaccagcttcagatgctcgaggtgagaaacatgcctttcagtttgggctactggtttacttaattaatcagccggcagctccgtcgatctattttcgtccctgtcctcttgacgagcccgggatggtttggagtagcatttaaaagaactagaaaagtggcccagaaacagcagcttaaagaattattacgatatactttgattttgtagttgctaggagcttttcttccccccttgcatctttctgaactcttcttgattttaataatggccttggacttggacgatttatcgatttccccctgtaagatgctgtatcatttggttgggggggcctctgcgtggtaatggaccgtgagagcggccaggccttcttctggaggtgagccgatggagatttattccccagacatgtctgaggtcgccgccgagaggtcctccagcccctccactcagctgagtgcagacccatctcttgatgggcttccggcagcagaagacatgccagagccccagactgaagatgggagaacccctggactcgtgggcctggccgtgccctgctgtgcgtgcctagaagctgagcgcctgagaggttgcctcaactcagagaaaatctgcattgtccccatcctggcttgcctggtcagcctctgcctctgcatcgccggcctcaagtgggtatttgtggacaagatctttgaatatgactctcctactcaccttgaccctggggggttaggccaggaccctattatttctctggacgcaactgctgcctcagctgtgtgggtgtcgtctgaggcatacacttcacctgtctctagggctcaatctgaaagtgaggttcaagttacagtgcaaggtgacaaggctgttgtctcctttgaaccatcagcggcaccgacaccgaagaatcgtatttttgccttttctttcttgccgtccactgcgccatccttcccttcacccacccggaaccctgaggtgagaacgcccaagtcagcaactcagccacaaacaacagaaactaatctccaaactgctcctaaactttgtaagtagagagagagagagagacgatgatgatgatgaataaaaggggtgggtttgaggtccccaaaggacatttccctttcttcttgcattttagttgcctggttttgtttaagcaaagcctatgtttgagatgcttgggatggcattgaagggccgagtaaaatgatcttgcaaactccggatctgaaccagtgttgtaacagcagctctctctagccacatggctcaatctggtaccgggaatgaaaaacttcagcatctgcaagtcatgcttgaatttaagttaaattcaatttatttctaacacattttaaaattaaaacatcacgccatctcttatgttttatagaaatgtgactttcatataccagtgagtattattttgtgtctttctcttccccatcatagatttcctgtcatctctctgttaccctctacctctcagcgaccccaagctgcctgttgtctctctctccttcccgttccctaaccacttctccctacttttgtatcttaattggttctttgagattacagcaagtcttaagacatttacggtgctagcctctcactagcttgagacgactgctgtcctgcccagatggcactttcagttagtgagcacttactagtggcagctttattttgtccaggacacagtaggattctgcatgaaggattttcccaaattagttttgtcttctataatcaaatgtttaaatagcttccttggcagttgttaaaaagtacaagatccattagtgaggtacatctttttttttttttttttttttgatgtatgtcatcttagtctggcagattgcagcggcccagtttaataacctgtgatgtgcagagagcccacgctcttaaaaacaatacattcctgtttgcattgcgtaattgcaatagctttagagtggaaagttgacaggaatgaaagcatgactgttctaaatatcaatatagaagggaggagttttctgtagccttttaaaaatgtttctagtttatttttgttgtctctatctcctatcactttttaccatgaggaatatttacttagtagaaaagtacaagatcagaaaatttggttcttaataacttgcatgaaagctcttagggttaaaagagagttgacaatttctctgacgaaatgcctcttgtttttcctctggacagtaatgaagaataaagaataccttttccagacatcatgttcagtgtgaagtagtgcagcatgctgtagaaacacagaaaaacttgatttgtgcttgtaactcccgatcatttcacgaacaccagattcagtggcaaagatttaaagaaaaaaaaagtcttgttttctaggtgcaattagggaaaacctccttcatgcagacgctgctttgtatctttatcaaatccctgaagcatcattaaaggtctgacagacatcactgcctttgctgcctcttcccacctggcaaagtgactgggaaataatacccagatgaaatgacaggctataaaaagcaagtacagatcctgcaaaaagaagcgaaattcaccaggaggacaaggttacttgatcattttaaacttgtctttaattgaaatctgcttgaacaggtttcattgtccagagaaagaaaaaaatgccctttgaaaaacacttcaactaaattctataattttgtcatctgaggaaatcaggaaaacaaagaaacatctaacacattttcctgatctaagaccatgtcagaaagtatgttgtgaagttttgataaattattttataaagtaaatttttctactaagtgttttagtagattacatattccttatcagtttttttttccccaagccagggcattgatattgtggcatctgcaataaatgggaaagatttactgctgcctaaaagcatcattgtggccagtttgaccagatgcacagctgcaacgttttgaagtgcatcggagataagcctagagaagcagtctgggaagtagttttctcctgaaaagttaggggtagacagttagttggttaagactttgaaacctataaggaaactctgttaattttttagactagttccttaaaaaaacatcaaatcttgtattgtaaaaattgtgagactactttttttgggggtggggagaggttgttgtggggagagtagtgtttgaaagggattggtccaggcagctttgtttttagagacttgtaagtggttgtttttgttgttgtttaaaaaggttgtaaccactaattaatggaaagcaaaaaaaaaaaaaaaaaaaaaaaaaagcttacaaagggattgtatttttcaactaagaaagtattgtttagtcacagaaagaactgggacgttccttttcccgtgcatgtttttgacataaactaagctgtcatggcttatatttgaaaatgacattatcatatgtgaaacatgctcttcagtggttttaggactttattctcccgtttccatttttttttctgtctcagcatattcagcacattatgcacagagctgtagccttcaaggtcatagactgttgaaggctaattgattcttctttatcctggagcctgagagagtagaagagagacaatcccagtaattgtgtctgcagcgttgctccccaaaccaatctacctactaatgttagagttttattttataaatactagaattactccctcactgactcttgtcaaattacaacattctttgtctttgttataataaaaggcaaaatatgacattttaaattgccttaaggtatagtggctatgtcgaattttctaaaatgggtatttctttcataaagtaatatttcatattttcatgatattaatctatgcattcatgtaggtcttaagaagtccaatgcagaattggaatgaaagtatataagtatatatttttattctaaagtatttctaaatatggttaatggtttcccactaccacaatgattatattgtcatgatactaattaagtttttacttctcaatgagtcacataatacttgcactattcatttgttttgtctgggctttaaaatttttcctaccctgactgttgggagattgcaaacttagattatcataaaaagagctgattaattaaattatagccaggaaacagtggtaccatcttgaaagaaaatgttttctggatatgagatcctccctgcttgacaacagattcttggatgcaagaatgtgttggtattttcatcttgggccaactttgttttgctttgtcctaagtcttattatgggattgtatgacaaaccattgttaccgcagtgacaataagaatcagtaaccatttgcaaaagatcaacatgatgagttggatataccataggatttctttccttctatttgaaagtgccgttcatttaaattctaatgcatccttcttctagttcttggtaactatgtttgtaggtatttcagaacagtgattttaaataacttctccccactttaatcatagccgattacagcctaaaatattaaaaactggaagagactgaaagatcttctattggaactgaataatttcataaatttaccaatgaagaaacccaggctcagaaatgcctattgaaattcttttattaaaatatactaaactctgaaaaatgtggcaaaatccaaagtattagaaaatgtctctgtctctgagaatttaaacacacacactctctctctctactgttttcttctatcatcgtatccttactgtagagagttggagctagagacgaatgtagcatcagactgagaattagggaagtactttaagtgggaccactgttcaggtgtgtgtttagtgcatatcactaaaattaaattttcttctcgccttcctgttttgctcttattaaattttcagtcgtggtggtcttttccctttttattagatcatccatactttgttcagcttgcttctgaaaacagcatgggttgcctagggtgagttcttccctcatatatagcagattgctctgtggctcacttcttttcttcataacccattttgttttctcctctctattcttttgtgatacccaactcagacttcttctcccctttccttcctaccttcccaattatgtattgactcttttttatttttgtaattatgtcattttggctttataggtcagtatttcattgcatcatatcaaaataatttcaactgtctttaatgaaactttattgcattttaatgctgaatggcactttcatatattacaaacatacaaaaaaaatctctagccaatgaccaatataccagtttcttaatgacataattaaatcaaatttttaccttcttcttgatcttttcctcttttttttctttagtgtgcttgattccagtttttctgtttttggacatcagcatttctgtactcccagaaaacgatgttccaaaccatacatctgtgttcttcctccttccctcttccttttaacaactcttcatagtatccttttaaagtatgaaggaagaggtattttatagattgaaaaaccaaagcataaaaagttatgacttgtttagatgcccctgagaaccaggaatataacttgtccacagagtccattgaacgttctactacagcataaactacattccgtctacttttatgctcatgtttctacttttattacttttgctctacatcaatgctttgtttttcttctattatttcctctttggtttttttttgtttgtttgtttgtttgtttgtttttcattcagtgaatgtacgctaagtgcctactctgtgccagactctgttctagaccggttatatgacagtggaaaacagtagagtgcctgccctcagggagcttatgttctagtggattttaagaatctaattgcataatgcaatttgagatatttcttgctttcttatacatataccctcttcattcagcatttcttcttctttactgtcatgttattcaccttttgacttccactcctgtcttttcttaatatgttttcttctccatctaccaaatactgaacacttgcccagcaatgtcctttaactgacagcaatcccacctctgctaccaacaggctgagtagccaggggtgattcaccatatggcactatctaatcaaaccattggagtagtgagaaaaatttgatctgtctggccctttaggagcaccctcttaagatgaaaaatatatacataattcttctagcatgtacataaagattctaagattattttcagattctagagagttggtagctgtaaatatttttgtttctatattttgctcatatttttatgtattgttttggcttgcataacatcaagagtattaaaatattcccaagggtttttcatttcactgtacggacaaagactagaatctgccattaagttgtttagttcttaaactgaataaagacatgagttcatatactattcacatgaagagtgattgactagcagtgagtgaagttaatcctcatcatctcaaagctgattgtaatctttactgcagtgaattttatcgtgtgtatgcgtgtgtgtgtgtgtgtgtgtgtagacattcaaagggtgtttctgaataatataactagtatcttataatcatagaattttatatgctgaacatttttagagattatttgtgtcacttcctaagtgagaaaaggcaggtctggaaaagtgaagtgacttgcccagtgtcactacaaccaatcagtagcagtgctgagactaaaactgaagtcatccttacctttgctacacttgcttttcttctcaaaactgtttttagcatttattcaagtagcatatgttacgttatcataatttaaaagatttggttttcccatttattatttaaatactaattagtaaaacttttatcaccctatagcagatgtcttctttagagaagagaattttggccaggtgcggtggcttacgcctgtaatcccagcattttgggaggccaaggtgggaggatcacctgaggtcaggagttccagaccagcctggccaacatggtgaaaccctgtgtctactaaaaatacaaaaattagccaggggtgggggttcatgcctataatcccagctactcgggaggctgaggaaggagaatcgcttcaacctgggaggcggaggttgcagtgagccgagatcgtgccactgcattccagccagggtgacagagtcagactctgcctcaaaaaaaaaataattttacctttataatattgatatgtataagacacccctccggaggctggacatctgtctcccaacaatataatatatgagaaaatgttttaatgatcaacgttatcccaactgaaatgcgttacatacttagaaagaaattagttccttagtgcttaaagtattcaagcagtgacactgttgagggagatttatgttcctagcagattattaactatatttacttctgaagtctcttacaactctggttctctcagtttattgtctcagggtgttagctttccagtgggtagacttgactttcaatcctacttgtccctcttcatggccttgagcaagttagaccatcatgttaaatctgtttcctcatttaaatgtgataataataataatatacatgtcttgaggctgttaggagattaaatgaggttttggaaaactccaagtcctaggcctgagacataaaaaatatgaaaccagcaccaattttgtccctcattctattttaactccctgcctcactttgttctttttctcctttgatcttgacagtggtttggtaacaatgcctggagaatacattttggggttttaggggaaccttatgaaaaactttgaaggaagtgaagagttgatgatacatcatgctaaagtaggaattatgctagaaactcgagatcaaataccagctctacctcttgcatgctgtgtgactttgaggaaatcacttcacttgagatttagttttacatccaaacaaatggggatgttaacatctaaaactctcaagagattgtgataaggacaaaagtggttactgtacctaaagaaaacagagcttaaaaatatattgaattccttctttgccctttctatcagggttcgtgtatgcatatattcacaagtgctaacatttctagaaataaattgtaggggttctttaccagtgaattaatttgttatgccttaaaatggtctgtaggactttactaatttcttgagcccagtgtcataaaaggagtattttttcccttatacaaattggttagaatacatagattattacctttgagttacatagattattactttttgagtaatgtccaaaaatcactgcatgaggggcttcattatagggaaagcgataaggagttacttttgagagaggaaaagactgcatggtatgtaaaattgtgtttgtcaagtaagtactgtttttggaaagattgggacaacggaaaacaatctatacagtttagatgtggtgcaggggaagaacttggctagaaataccatgaatcctaagattatgttcaccttactctttttattgttccaaactgggatttcctgatctcaaaagatgggaattaacgtctatgagttgttttcagcatttgacaaaaaccatggaaataatatacatcaaataattttatatgagccaaatcaaatgtagaaattctttgagtatactacatctatgtgtatctatgtgtgtatacatacatacatataattcatacatataatattctaaataaaggggaaaattatttgacaataaaatgagcagataaaaatatttttaaatttggacaaacaggttgtttattaataggtttgggaggggtggacaaaaaaacttctagccctatgcctaactgctagagtaaaagagaaaaaaaagtgttttaaaagtaaaaaataattggagcttaagtatatattggagattctgttgcaagtaacttaaaatgaaatcttactagctggattattggccagaatcctacaaaaagggaagaagccagtgctgttctagatatacacacttaagggattttggtatttttgttgtataccttatggtttttctaacagacagatataagtttgtaagagcttgccatttacaaaaatgtatagtagtgggcataatatatgtatttttatttattctttaaagtagaactagaaatatgtgagatcctttgttcatcttgattgttattcactcaagtataatacctttgctgcagaaattgaactctaaatcaatactggagcaatgaggcagccccttcgaagcataaaatatttgataacaatctagagtatgttttgcctgggtataagttttctgactgtacaatggaaataagctgatggacccaataaaacttggtgaaataaaatggaaagcttcctcaggtaaaatattttaaatttttcatcagaaacatgataggacaagacttgatttactgtgattttcagtgataggcacttagtgtttgagttgcatttcatgaggtggttgtctcccagccaaaggagaaattcatgaactctctttgaagccagagttagcacagaatttaatatgcatgtaattatcaaatgtaaaaatcttcataatttattttagtttaaaagttattaatttaaaattaaaccaaatgtacatatatgcatatgcatttggaagaaagatgagagcaacactgaagacaatgatagttgccattaggaagaaacttaattcataggcaagcagaagaccctatatcttccagttcctaactgtgttgcctgtattggtgtacaatgtaatataattttgtttcccccgtttaccttccttttccctccctttgtttctttcatacttgccattcacagttactcttctctttcctctattctttcataccccacctattccttcttctccagcgatctcagggcacatggctccacacttctctctcccaccctgctctgaagccagtgtcctaaagcatcagaggttatagagtagatggcccagacctgtggtttctcactggatggttagtgggagagagtgaatgagaccttaaccacagtcttgaccatgattagcctgatgactttcagtgttgcctcttcctttgctaagtaacaggaagtaattgttttatgaaatatgttggtgtcacagcaataaaagctccatacataaatggaatgatctaaggatagtagaattgaactcttgttagcatttgtttgtaatcccttggtagagcttcctgggtcataattgcttgctcttctgggagcaaaaggaatcagtaaccattgattgttacatgatgctaagtactgcctacaaagcaaatcttaagaatgattagtggcagagttcagggttactactctgatctctttttactataatctttaaagcaagctgaatttcacagtttttcccatcaagcaactcctatgattcttcaaaaggaagagaaaaaataatgtcatgtaatctataaaagcttcagttgacatcaaaaacaaacaaaaatatgtaaaataattacttcagtttttttaaatcttcctacttccacgataacagggagacatctaaattaacccctgaccagtaactttagtcttgcatgaatatgatccttataatcttaattgatctgaactatggaacctgtggtacacagtcaataacctacatagccgctgcctatttagtaaactatacatgtaatcagtgggatcaatacaaggattctcaaaatccttgcaaaattcattcttcaagattgctgagttttctgaatagctgatgatttgtcaccttgaaacttttttatctattttggattgaaatcttttaataacttacaatactagtgactactgtcattttaaatgggatttattgaatataggatcttcacaatgttgaatactgtgatgtctttaggacatagttgggttatgttataactttgttgacccctgttatttcgttaggacatactgagttgtattagggattctagctcttttactaaataacccagacctacgtatgttctgattgtattttgggttattacataatcaaaattagcattacagagctttaagccaccttagagacactttgaaccaaatctcttattttatcacagagagacaagcccaaagatgttaaccttcttgccagagaccacatagagccagaaaatgttgatattttcatctcttctaggctttcagctaccaggtcactttgcaaccagtgtatgttaattgaaacattttttctgcacttctgatgtatagttctggtctcctgcaggtttaaaaggcaaattttaatcaggttaaacatttgtattaaacatttatataaaggataaaatctctctgagtgagattctctccttgaggaaatgcatacattttggtgacatgttttggtgacatattttgcttatatgtcactcttgctctgttctggatcaacagagttcaaggatgagaggtgaatgacaaatgaagaggaagagtaactacttggttctgatggtccttggatttatagcgcagatttaggggagctgagtttaattcctagatgttttatttgttcacttgttcctcctttcataatatgtagaatggcagtaataaatcttttcttttcttttcttttttttttttttttgagacagagtcttgctctgttgcccaggctggagtacagtggcgtagccttggctcaccgcaacctccacctcctgggttaaaccattctcctgcctcattctcccgagtgctggggctacaggcatgcactatcatgcctggctaagtttttgttgttgtttttattagagacagggtttcaccatgttggccaggctggccttgaactcctgatctcaggtgatctgcccaccttggcctcccagtgtgctgggattatagccgtgacccaccgtggccagccagctataaatctttagaccttgatcatgcacctaattggaaattgttttttgaatgtatgagcactactaaattagtcagtgggcttcatgggatctgttttgaaatttattgtgaaaccttatgatttataaagcacaaattacttttattttcatttcttgaggacaccatagcaccaatatttacaaagcacgtatctcataaactctcttgtgatattgaagacacgcctgcagcagaaccccaaacttcctgtcttccctaactccagctgtctccccagtcttcatcccgatggaccatgttttagccaactagaactcgaccctgaatattattttttctcttccatgtttttgctcattctattttttctactataaatgtgctcttcaaacagtctctcctctcccaaattctacttaggcctcaagactcacctctccaaattagatgatgggacccctcttcttgaagacctcctccaaccccccataacctattgcttgtgctttatcacatttagatttgtgtgttcttatttggatgcttgcttattgctcatagtagactgaccatttcctaaggcccagagttatagctaactcatttttatgacctgtatagtaccaaacagtgtacaggttgagcatcccaaatatgaaaatttgaaatctgaaatgctccaaaaatccaaaactttttgagcatcaccatgatgttcaatggaaatgctcgttggaacattttagattttggattttcagtttggagatgctcagtggtaactataatgcaaacattccaaaatccaaaacacttctggccctaagccttttggataagggatactcaacctatattttatatgaagtaggtatctcattcgtatatttatggaataaaagttacactgagggtaacttgcttatgggagtggaagaggaagaaaataatctgaaaccgggtcttaaatcactgacattttaattttgaagaattcaatatagagtttagtcattacaaactttgttgagacatgcttttggacattttaacatataatttgcaaagtcggacgtgatttaaaaaattcacatcatggagtttaagagacttcaggcagcaaagaattttatttcatgatagtatggtgattaagagcacacactttggaaccagattgtctggctttaagtcccagccctgtctccggctgtgtgacagcatgcacactatgaactatctgtgccccgattttctcatctgtgaaatggtggcaataactatactttcctcaggggctttttgtgaggatcaaatgagttggtgttcataaagtgtttggaatagtctctggctcatagcgctatataagcatgagctgtcgttactaggcagttttaacaattaaagtgcatttccttagatttcaagtttgatagcttgtgattacaataacaggcttcaggaaagggccaggaattccaagggacctattgacacagctatggatgtgctactatttattttggtttggtttgttcatgtggtttttcctctgtgtgatttatgtgttaccatcatacctgcattgttctcaggatttaggagaacagaaaaggataatcatcaatctacctgtcagtcagaaatagagcgacatggatggtttgaataaaaatgctgccctctctggcaaaatgccatctgttgacattgacatggacaatcatatatgtgtatatctgaatttattgctgtaacttcttattctgtcataaaatggtggacaaattcacaaggagaaaagtaacttatcttagttgttgaagaactgttgcaaaggctttgaattctgcaatgctatcattttaccaagacagaaatctactcattatccagatgcactcaataaattaatgcgatgatgggtcctgtcattgataagataacagtgatttggaagtatctcagtgttattaaacaagatcacagaagagccattaacattttaaaaacagagagatcttgtagataacctaatcaaaatattttactttactcatggggaaactaagatccagaattgtgaaatgactgggtcttaaatacatgcagctagtaagaaacacgggctggtctaaaaaacaggaatgccacttcatttagggctttttttttttttcaatatcccatgctgcttcttataaattagataattctttaatggtggaagactttattttttctgttgttctatattctttattgagtgcctgctcaatagagaagagtttacctctaaaaggagaacaaacaaaagaataataaaccagaaatcatatactatcttagcaggcagtacatcatatggggaaaataagtgtgaggagatcagagtactggtggaggagcatagttattttaaatagattaaaaggtacaaacatacagtctgatagaagaaataacacctagtgtttgatagattagtagggtgaccatcgtttctaagagtctattgcatgtttcaaaacagttataagagaataatttgaatgtcctagcataaagaaaaaacaaatatttaagatgatgcatatcccagttatactgatttgatctttataaattatatggatgtattaaattatcacatgtacccccaaaagtgtgtacatctcttatgtatcaataagaaataaaatttcaaaaatacccttaagaaatacataaacagaatggtcaggaaaggcttctttgaaaaagtaacagctgatgaaaggcttgaatgaattaatggagttaaccatatggccatatggaagaatgttccagactctgggaaaaggccttactgcccaggcagaaggccagtgtagtcaacttaagccaatggcttaagtgtagcatgggaggcaggaggtattaaatgagatcagagaggtgatgaaggcctgatcagggaagcatgccattcattgtaagaatgatggcttttccaccgaaagagatgaggaattattgcagagttttgagtgaccatgggacttgatgccttaggttttaatgggatcactgcctgctgtgttgagaatagcttgtggagaaggatcccaagatcccggtggaaatagtcggaccactgaggagattgttgctgtaatccagatgtgtttgtaggagttgtaggagggaatgtaaagacattattggattattagattctgaatatattttgaagatagatttagaatgatgtaatgatgaattggatatgggatttgagtgagaggagtcaaggctgatttcagtctaagtagttgaaaggatacggttatcaccaactgagatggagatgatctaaagatcattttgctcagtctcccaatgcataggtgccaaataaatcaaggttcttatcaaaattagaactgtggacattaccttctcataaaaataaagcgagatatgcctgagagcctcctgtaaatcaatacggctttatgtgtgactagagatccttataaatacaaaagaaaagttgcagtgaaattgaggatgtctgcctagactactcggtaacactatccagaacccacaacacgtgatgatggaatgaagtcccagggggatgtagaataggcttccaacaaaccactttattcctattttatggtttctttttaattcatcttgttcagcattcaaacctggttcaagttgttcagtttatctaaagcatattgccccatccctctcagctcactttcagtcatcttttaaactttatttcagaagtctactcatcttagaaatgtgcactttatccctaaggtgagctaagtactttcctctctttcctctaggctttgacagtatccagtattttccacccgtttcccatgtactctgctgacatgcatgtattcctcaaggtcaagcatttcttttatccatgtacagatgcttcacatagcaccatgtatactataagctctaagactttgaagtacttgcatgtcccaggtagaggtttttctcctttctctattaagctgtcaattttctatatttatgatgaaaatacacagcaaaagtagtgtaaatgcttattttacttctcaaattactcgtcaagttgccaaggtgccaactattttttgttccacatattatatcttctctacttcactttctggaaagtaaaaagcagcaaaaaggaggttatcaagagaggagaagcaggaaaagttctagacagtctacttcatttttctcatattctagtactctagacagggtgaaggctcctgttgcagaagtgatggtcacatattcctgcaaataccaagtactcagttcagcccgtgcctgcagtctctttacatccctgtcctcctctgcttctcaaattttacctactatgcaaagtcttgatcaggttccactcttctttagagacatttcctatactctgtggtcatcattaaactttcctccttagtctctattccagcagctcgaatcatctttaatactcatgtgtgtatttaaacatccatcctaccacataggtgtttgattcagtcatgtgtgttttatattatgaattaggttttaagtctcatctttggttttatttacctcctcatacctagaaaaacagattaagcacttgttctctacaaggccctgggttcagagtagtagaattgagagagacagaaagagctagtttctgtcttccaggagcttggtttcatcaaagacataaaagccttgccattaactggagtataaggtagtatatgagatgtatgaagaaaaaatcctttagtttgaggtgaaaaaaaaaaaccaaaaaggaataaggctaagaaggaagagaatcagaggcatcttcatattgcatggatagttgaggtgggccttgagagtaacatatgattctgatgggtgtggttatttcaggtgggagtaaaggcccaagggaaacagacatgttaagtgcatggtgagtcggccagttgagtcagtatgaaggaatttgctgatagcgaacatttattaagcacgtattgtgtgttcagtgctttgcatgtattgtctaatcctcacacacacaaaaaaaacattgttcctttttggaaataaactgatggtgtagaaatgatgatgatgatgatgatgatgatgaagatggtgatgatagtgacaatctgaatggtgcagaaggaaatgggatgccatgcatgagtctaaggaagactatgaggaaggaataccactgaactaattgaatgcggagaaggaaggaaacgattccatgcacattagtaatttagcggttgttagattaatgaatctctgagtgacaacctcatacatttattcaacatgtatttattgggttctcctaagtctttatgtatttattaatgtgcaaaatcagtagatttatgacaggaagtgacttgtgctccaatttccagaaaacattcattacttcttcctgatgaagctgctcagttaaataatattaattgttcttcccctgatgttatacaaaaattaaaattgatagaatacagaacttaaaagacatttttactttactttttgacattattcattgtttgttgctgatgaatgaaacctcttttcgagtgtgtgttccctttaataggcactggtaatttatgtactaagatttatttctgtatggaaattacaagtgaaatttcatattgaatttatatttagcctgttctagtacatagtctctgcatagtatatccatggcatcctacttaatattacagattcttttatattagtgctgctacatgtgtattctcaagcttttaattgtacaattattacaaaaagaggtaaaaatatttcccctacaaaattgttgctgttaattttttcctgtttattcatggagtattcaaagaagagctgtgtgttcattacattccacaagttagtccattcagtttgttcaaaatatgaattctgatgtccagcagttaatataagattttggcaggctattaataatggcatactcaatttgtagctctttcatccatgtaattttggtgatgtatgcactatgttccagggaaaggaatagttcaagattaaagaggcaatcagtgtattggtgcttattttcagtgtgtcaaagctgctaaatgaaagggtgcaatttctacttgtacaatttccacttgtgctgctcaaaaacaagccattgatattagacgtgtatcaagcatacgtggttgcagatgtaaataattaacattaaaaacattttcttctttagttgtgtatttagaacagtgatacttagttaatatcaacagcttatttttagaatctgaattttaaaagtagtgaaaatacttctagtgattaaaacaatgtatgaaaagaaaaaaattagtaggctattttaatataattagtgagtatgctattttaacataattcaaagatgcattcctattttaattaaagctcattcagtatgcaagaattccagtttccattacttcttgctgctgctgtctgatcttgtgtttcttgagggacacttcttttatgagcaattcttttgcatttgcacccagattccttcacgtccaaagcagtagtttaaaagagaaggctacatttttccattttggcctggaacttagatttttgttctgcttacttcttctttaagtatagtgaatatataaacttgtaggcactcctttgcagacagacttcagaatcacatgttcagatgaatgtgggaatgtaggcagaaatcagaaacctgattgtgcttcaccgcttcagaccctgccctatgaggccctccttgtagaagaagaaatggaactgaaccaataactgaagtgaaaaacccttctggaaactgtatatatgaaaagattccatttagatccattgaattttgcctttcattttcaaacttgcaaatagaagcagcattttaatatttttcaagagggggaaaaaaaagagcgtggttccctggccctattgtatcacttccattttgtctggaactgatttcatgcaggagatgcactggaatcagcatgcaaattctatgtggctgttgttcagtctgtttttgattcatcgtggtaaaatatgcataccatgaaatttgctgtcttagccattgttaggcgtacagtttggtagtgtcagatgtgttcacattgttgtgagaaagagctccagactttgtcatcttgcaaacatgaaactctgtacccattgaacaacaactcctggttttccccaccctccagtccctggcaaccaccattctactttgtgtttctgtgaaacatcatataagtggaatcatgcgttatttgtctcatgtgactggcttatttcacttagcacagtgccctcaaagttcacgtgtattgcaacatgcatcagaatgtccttcatttttaagactgaataatattccattatatatacagtcatacgtcacttaatgacaaggatatgttctaagaaatacgtcattggaccatttcatcgctgtacgaacatcatagagtgacttaacacaagccttgatggtatagccaactacacacctaggctaatcgatagaatcttttgctcctaggctacaaactgtgcaagtatgttactgtactaagtagtataggcaattgtaacacaatcgtaagtatttatatatgtaaacatatctaaacagagaaaaggtacagtaaaaatacagtattataatcttatgggaccactgtcgtagatgcagtttcctgttgaccaaaatgtccttatatggcacgtgatggtatatgccatattttgtttatctcttcttgcatcagtgaacacttgggttacttccacctcttaaccggttaataatactgatatgaacatgggtataacattctaattatgttttgttcatctgtggtgggtgtgaaagttaaaccaatggaacctttttttagtgaatttagtcaaatttctgaaaaccaagaattcctatggaaacatactgataaacatacttttcttattatatattaaaaatgcttgtagggaaaacccagcttctaatagtactctgggtttgtgaagatgcagtaagtgcttgctagagagatgtttttaatctagagagctagagcagagacttagagttcacttgtttcttctctttttttcaatcatttataagatctctcatcttaactcattaaaactggctgattgactttgattactgacacacccaaactatttcaaaccagttagttcaaaaatgcagttgcctctttgaattatttataaaaaggatctcattacatttttccatagataacgatgatggcaaaggggaagaagggatcattatgccactcctttaaaatgcgggcttctggcctggcacggtgactcacacctgtaatctcagcactttgggaggccgaggcaagcggatcacctgagggcaggagttggagaccagcctggccaaaatggtggaaccccatctctgctaaagatacaaaaattagccaggtgtaatggtgggtgcctgtagtcccagctacttgagaggctgaggcaggagaatcacttgaacctgggaggtggaggttgtagtgagccgagatctcatgactgcactccagccagggcgacagagtgagactccatctcaaaaaaaaaaaaaagtgacatgctggttaaaggtccctgtccatatcccccttttgcaactatttaatccccagcaaagtcctagccaggatttcctggtaagagtttttctgctctgcgttgtcaacagactattttctccaactgagctcatggaagtaacctagtttctatcactagtgggtctcagtcagaaaaatatgagtgtaggttattgaagtgtcagggttgtggtggccctcttggctgtgtgcttactggggatgaagtacatggtggaatgaaggctcttactagggagacttctgagttactagtttcaccacacagctgtctcacccagtatcttggaactgtttcttgcttcatgtgtgtgaaaaatatagtaaatttcctggtcatattttagcataattaattataccaactattaatttaatattttgtttgatttttagtttccagggtaaaacattaattttctctttaatttccattctataagattcctattgttttcagcaaataggagtttccttctctgtaagcattgctgactcaagactatataatgttagaaatagaaaaaagataagaacatgttagtatcaatagcctttattattataatcggtatgggcctaacttctgctagcaacattaaaaatcttttcttttactctatcatttagtaacggattttcttttggttgtgtcgaatagaattgtttccttgatgttccttgatagagagtgttctctttaatataggaatacagtaaagaaagcatccacagtttgtgaggcagagtttagtgctgatgtgtacagaaactcaagtgatatttagacaactgagtccttactgggaatcacttaagccttaaaacatctctgccattatgctgcttattttacattgttctggatagatgctcattatccagttctcattcatgatgagcatgggattgataagggagctgacatgaaaattatggagaaaaaatgcaaatagcaaaagatagaataaagcatgtatacctcatgatcattttccccattgatattgatttggactcactcttgatgtatcaggtgtgttcaatctttggcaaacatttagggttttcgtttttgctgaggtccacttgaaccctggagcccaaaagaagtaaccaaaaatttctatagcttagtaaattccatgttctagaacttttaatgtggacctcagaaaaaggaaataaccaagagtgccgaaagctacatgtactttgaattgttcagcatgtataaaacccaatggctaaccgtgtctagaaagaaggagataagtaaagtaagattggagcctggcgtttggagttcagcaacttttctctgttgtgcgctgacatttaagttaatagagtgatttctggtggatttctttgaaacaagacagttcatctgagatttggttaaaaaatatttcattactttgaggaagtgattagggttggtcttatttagttggggctttcaaaattgatagttttgcctgatggtatatgctaaaacattgaattgtgagtttcctagccagactggaccctaagcccatcatttggaaatagtctttcttatttttgttattcttgtatttattaaagaacattggactagtgaaaattacaaaagaaaggaaaatgacacaatacactacattctgttgtatcccatttctatctcagggaattatgtgtgtttaccaaactgatgtctagatgaacattcaatttcgtatcttgccatttaaaatttaacatcatgtgcatttttatgtcattaaatgtccaaacacctggaatttttacgtttgatttgttattgctaaaaagtacttctcttgatttttaggggttttcacttttaattaaaacatattcttgaaactccttctcttctccttggctaaacctgttatgctacaggacttcaggataacttgagctgctttggctctttgattaagtgcagatgtatttagggtttgaggtgaaagggtttttaggacaaatcgcattccagtttgagggaaaaagagagagaggaagttttggaagttacaaattcattaaatttttgcttccacatggaatccacaacttttccttttccctggctgcctttctcttcttcattgagttttccaggcctctcttccttctgcacaggctccaaagagaatggctgactataagggttattagtgatattttgggagttattccgttcttatccactctcccaccaacacacacactctcacacctcctcccatcaaagcttgggatctctgggaacagggaaacatatcaagatattagaagacgtcaatgttatatatgcagaaatggtgaaaaatcaatgaatttagtaagttaaatttgtttgggtagcattttaaaaatatttaagtactttgacatatgttaccccctaatacacagagggtgctcagacagcatttgctacaggagtgaaccctggccaaagctgttttaaccaagggacagtggaggcccagagaggttcgttggtttgcttaaaatcacacatccatgggtaagcaaggtgatggataatcagctcaattgagtcagtttacattgtatacacataacaaagcatcatgttgtgccctgtaaatgtatagaattatgatttgtcagttaaaaataatattaataaagtaaataaaatcacacatctcacattgagaggagggcagcctagacccagatttctgttagccccaggaattgaggcatatatgggagactagcagacaacacacataggaaacttttgccacttaattattattctttttctcaagaccactatattcatttgggtttgttcttatgcttttttttttttttagcaaattaaaaaaaaattatccttgaatgattctaggttagctttttgactaatggatgttggaaggagctcagtgacaaaggccagggattattttgcttttcctcacctcttcctttgttcctcctcatcatattacaaccttctgcttcaggattccttctgctttttagcaggattgacatgctgggccttacccggaaaggcaaaggctgatttgattagggaggtctttgttccaggtatctcacatcagagagccttcataacaaatgagaggaatggattagaagtttcctggggataattttttgtctaccctttaagggaaatcttgccttcattaattacatctcaaatggaatatgtggaatatagacattttcataatcaacaaggtgattttcattttaaaatgcttaaaaaatgttaagcagcatgtatgcacgcacacacatgcaaccaatttcttccacctttttcttgttttaattcttaaaatatgaatttttaaatataaggaaaatcctaaaagcagaaactaataaatactaataaaatgttaattacattgattaaatcattagtattttaagatgggcccctgaaatgtctccataaataagcttaatgtgctttcatttaaacaacaattcagttagtaaattcaataaaaagcaaactaatgtgacataaacatatttatgtgattagaaaatcattatatccactttaagtgaaaagaaaaagtcttcatttttgtgttacttttccaaacctccttttggcactgaattgtactttatgggggtgtcttgtcatttttttctaaattaactacacctctgcttgcctggaaactagagccattctgacttctattccgatatgtgtttttcatctcctactttttttttttttgagacagtcttgctctgtcgcccaggctggagtgcagtggcacaatctcggctcactgcaacctccacctcccgggttccagcgattctcctgcctcagcctcccaagtagctgggactacaggcacgtgccaccacgccccactaatttttgtattttttaatagagatggggtttcaccatattggccaggctggtctcgaactcctgaccttgtgatccaccctccttggcctcccaaagtgctgggattacaggtgtgagccaccatgcctggccttcatcttctactttttttatttttaaatattttttattcactattgctgacatcactctcctacctactcggtattctttcattatgagaatctcccacatgaaaaatagtggcacctctggaactcccaaattctagtttagacagattaatccacatttatgttactatttataacagcacaactctgtaaataaatccaaatgtccatgatttattggttacatgttatgatattctgtagaatggatattattgtagccaaaaaattaatttacataggtacacagatgatgacatggtaagctttctttaattagaaaatgtttctttcatttaatatctttcatcttaagatcaaaaacaatcttgcaatattgaccttacagcactgttcttctgttatcctcattaaaataatatcaataacaatatagtaataatggccattgttgttgttatgttctctgaggcatttagctcagagaatgttgagaaaaaaacctgacaaagtacttaaatattcttgatgccatctctctcactcttcataggttgtggatataaagaactctgtttttttcattttttataagccacaaacaatgaagtaatcatttctttgttaaaacaagaatgtgcagattattctcactgaaaagttaaaattgagttgtatttaagaataagcatctagtcttgaccatagtgtttatgcctataattaaaacaaaccaaagccaaaaacatatctttcaaatggtttggtgtcacaccacaaagcgagttattttaaagccattggaggattctagcaactgagcaaataccgctgatctagtcaatatcaattgataatgtattatatgaaggaaagtaaaatctctttcaaaactttatacatgtttcaattcagttaattatgtaataatagaaatggcactatcatataagagggtagatgatataatttatagatcattttatcacttaaagcacctctaagtgtagaaatagaatcatagaacctcatattcaaaagcctttctgtttatctatagtggaatcgattaaatcatatttgtgtaataaatgacagtcataacaaatacagtaattaaaatacagttgttttacaaatcactgtcttccactctttccacttccagcattttcttttgatgggttagaagattaaatagcaagttgtaattttaagttatggctctttgacagtggaaaatggattaaaaaaacacacaacaacctactaagtcttgtagtttcttccatgtggtcttttcttatctagagatagtaagtcaggcatctacaggaaaagaatccactctagtgaattcgtgcctgcctttgaactgtgaaaatcctttgcattgccccacatttctaaagacccatgaattgtgcggtcagctagaaatatcctgtttcaaaattgagattacgtgacactgccctagaatgacacttgagctgaatgctcttgtccactgctgtagggtacacatgaaaccttttacttagaaatttaaggttcttcatgtggctggaaaaatgccacaacatgacttttatcaggctaaaatttactgtgtcatgacgaaaattgaataaagtaatcttgactcattttaatttatttcacctatgtctgactccagctttatcctaatatacaggacaaaagttatttccataggagcatctattatttgcctctatttctaaccctgtacaggtatgttagaaacactgaacataattttatatatgtctttgtctcatcaatacagtgcagttttattttttaactgaagaattcgtgttttgacatataaggggttaccagagctatccaattttattttatgaaacaaaattgtaattattcaaagtccaagacatgaacagaaaataaaaagtaatgtttaattcatgtaagaaagcataactgaagctcattagtcaaactaaaaagctcatgaaatttctcacctgaatctttcctcaccctgggcagagacttcctttcaatttgtgctcaattttaggcaacatttaaggatctgaataggcaaagagtgagagcaatgattgtaaatgtgttgttttaaaaggtttctccactaaattcgtatatgacaactgaaaaaaaccttgggacaatgtcattcagaccacaggaaagtgcttgaatatgttctctgatgctctttttagagcagctgatataaaaagcaaagaattttatgtccaaaagacttaggcaaaatatccgaacggaatgctgaatgcatggcttttcaatttatcacagtttatagacactttacatctatagtagtaatttaatttaatttcttagaattatggaaagaacaaatggtatcatttagtataaatggttctctgctcccctcacctccggagttttaaagatggtaaaactaggactcagagatgtgaagtggctcacccttgatcacacaaggagacagtgatatattttggttgagcccaagtctccttctgaatctagagctatagctgttaaactaaggtacttctcaatcatatccatggagcaaggatgtgagagtagttggcttttgtattatatgggataccactgcaaaaaagtaagcatgacagtttcaccttaggggtgaatttcatgctttgcaccagttcaatacaatgatgagagaatggctctcatggtactgaattggacactgtacaaattcatggtgttattcatattactggccataaaaagagcaagatcacatttatatatgttctggtgaaaattactctccagtgtttctgctgtcacctacccaaaccaagctgtatatttttttcttgagaattttgcatccatactgtttcttgtttggtttgcactgacgaagaacattcttcctccacagcacagatctagttatttgcaaaagatatttttaaaattataagcaaatgttgatttagactccttacacattaattaagagaagcacttttgtggatgttctttggcttagttcaagactttgtcaatctgacttttcattaagactttatttattattttccccaaaaagtacttgttgctcagatttgaataagagtagtttacttgtctacagataaaaacaccttggctgtattcaaagagtaaaatatttaattcaaattttaggctatctgaattttatcctttctgcttagaaatgataaacaaatatttattcttttattgagcaacagctatattccagaactgttttaaatgcttgagattggggaatagagataagtgatactagcttggtatgcacgtatatgggtgaccagggggattgttaggaagaggaagaaagagaactattacaaacacgcatttataaggcagcttttaatcatcaataaaatatggtaaaatatgttagtttattaattatttgattaaacacatacttttttgtatgtgaaatactcaagttaatttgtcttgtttatttggccttgcttgaatttactaagtaaacagaaatttctagccattctcaattcaaatgaccacaaattgagagaatcaggaacacttagatacttagccaacacttttcactaacttatttaggatatatgcctgagatcatgacaataataataatcatggtaaaagtagcaattattgttattttaatagtcataacagatgagtgttgccatggagtcagtatcacaacacagccaagtccatctgcctcattttgatgttttagtggccacctaactgataccgtctggtgacactcaggtcagtgactcccgctttttctaagggatggcctcagtggtttggggaaggtgccaaggaaagctaactggggacttgctcctgataagtcagtgatcatggaccacaacaggtggccatgaccccaggggggctttgcacacttggaaaggtggagttgtgcaacattttgctgtctggctgccaccttcagtggcagatctattgccacttgggttgtctttctcataattatgttccgtatttctcaatatgacagaagtttgttaacctagttttagttctaactctgccatttactgctcatgtgacccttggcaatctgtttaaattttagcattttcatgtttttcccacctataaaattaatatacttttctcaggttagctgtgaaggttaaatgagatgatatatgtgaataggattttgtaaactttaacaacggctgacacttactcaatattggctatggttttatcagataggcatggattgagttatgcagcttctctgttctcaccttgtccttggtgcctggggaatgtctagtattcgtagtcagtgcagtcatcccagttcctgcaacgtggtactgataggaggaacaacaatcaacatttaagttttgtctaacttgcctaagtttcttccatttacagtaagtgatgagaaatggggtataagtgtgagatttatgtcactattcaagtggggatggttaagtcaattaatattaagtaatattatttaaattaattattgtctccttgactctaatgtaggaatacattatataaaaagtaaagattttgtcatctcatcatccacagtgttttgcatgtgctaggttcttagaaaatacttttttaatgattggcttttgtgtttacctcaagagtatagagagagactgaaaaatatgtaaaattatgataatcctgaagtttaaggttcatgaatcaaattttcctcttcaaacaggtgaataattttgaaatttattagtaaatatttaagttgactctttcccaaatactgcctaacttcttttcttctataattaagtcagataattttaggaaattggacaatttagtcatctttctatagcatgtacactacagatgactattaaattatgattccttcagaatctttattttacaagaatataattaagcttggctcagtggctcatgcctgtaatcccagcactttgggaagctgagcggggtggatcacttgagctcaggagtttgagaccagcctgagcaacatggggagatcctgtctctacaaaatatacaaaaaattagccaggcatggtggcacattcctgtagtcccagctacttgggaggctgagataggagaatcacttgaacctgggagacgaggttgcactgagctgagatcatgccactgcactccagcctgggtgacagagccagaccctgtctcaaaaaaaaagaaaaaaattattcaatcatttatattttctggaattttttctaaaatttctcccagatactttaaaaatactcctgcaaacaatttccacttgcctagcaggccattcagaccacagaactaaaagcaaaatttatcagcctttccttccaatttgccatacccccacaaatcgcacttataaagtcaagagtaagcacatttctaacaaggaccaaaacttttttctcaccaatgacactttcctatatcaagtgtacctaatcaggcctatcattaagaaacacaacctttgctgtcctctgctatatcacatcatcttttcaattcagattctatttacaaaaatcctctaaactcattggtttttctacaatggtttttgatcacattatattactgacaaatgctatttttatctcctatatgggtgaatcatgcatattaactctttcctgggatgatggacataaaaaatctcctttagagatttaattacatttaaattattttcaagtcaagtagagtataaattcacattttacaacagcccatcatagaagtctcactggatttgttttctttccgctaatgtcccaggtcacctatctgaaataagctacttaaaaaggacagggtggggagatggcagagaactgtgctgcaggtttgggaagcaaagaaacaaataataatgtaaatgtcatctgtgatctaagattgctatcagtatcagatattttggcttttggtcctctagcctacctaacatagacttttttttttctattcaaaaaaatattacacttgtaggaaatgactagtgttgactttctcactctgagtccaattacgggttctttaaactgctcatcgctagtattatatgatggtcagctttaatgagtgctcagaagcactctcattatatacaaggcttttgaaataagctcctgtctcgatcaattgcttcaccttcttcagagcaattagcataagaataaaggaggttaaattggacttccgggctttggtgaaattaattaataccacttcaccggtaaggacaataagtagataaccattttcattactttatgtgaaagacagattatcacatgcacagcacccagactagtacaaaagtaacccatgctgaatgtgctatcttttaagtccatgtattatgaaagatttttttcctgtaattttaatagctcaaaaaaagttttaatttattggtgacgagctgggtaaaggttggccattacatactggcaactgcttgggtaggatgtaagttgaaaaatataagaaaaagaatggcattaaaaaaaaagtagcctgactgggtgctgtgcacttgtagttccagctactcactaggaggctgaggtgggaggatcgcttgagtccaggagttcgagtccagcctggaaaatatagcaagacatcaccccaaaataaaataaaaggaaaaaggaaatatctgtactcagatataataagctatctattctagacaaatgactgattagtattttcatgctcattcttgtacataaaaggtaaagtgtcctataaccatcatattttttggaattccagagcataatgccagcgatttaactgtatggatagtagttaaatccttaacaatatatagtacatgttcattttctaaatagtagttttaatgttataaatgaaatgcagcttttgcaaattgaaaatcatgataatagaagtctgtaccctccctttatggcccattaactatctttgcatcataatatagttatctttctcaaaaaaattaagcatttagctctctcaaagatgctgtcacttttttaccctaatacgtaacaaagttgaatggactcctttcctccactgttgtataaatttaatctacattacaagataccacactactattcaagatctatttgagtgtttaggcatttcttaccaaaataatctgatacctactttttaaagaagtcaactggtcatgtcagtgaaaatggcttaattttggcatatagttagtaaaggctaaattgcaagtccaatctatttttctgatcttatgtgttcacctgaaagcaaaataatgagttcagatattcttgcatggaaacatactcattgtgatcagaatgaaggaagttattgctaatgcacttacaaatatgtttatccctgcgagctaatgtgtctcaattcctgaaagtcattattaccttgctcctttctagtattttaaaagatgaaaaagtgataaatttcaaaataataaaacatcattatttttgacattgaggatgtcattttgtaaattaacctatgacatttttactttttggttaatccttcagatttactcttcattgcttttaactatgaattaaagtaatgagttgaattaggtaaatgtctaacataattaccatgtcctcagtaaaagatgattgttaatgtgtctgatgatggctggttgactagaaattatcttcagttccacattttcaaaatgaatgcaccgtgggtggaatggaaaataataatttaaggcacattaaccattaatatagatctagggtgaccaattgcccctgtttgcccaggacagggaactttgggttttaaaactgataccaaggggtacctgggatgctgaatgttcagtgctaaaaccaggaaagtccaggcaagtgctgagtggatcaggctacatagattactgcacaattaattatagtaaattgattctgtatgcaacttaaataaacccagtttattgaggcatgatccagtttgcccgtgtgagaacctgatttctgtgaacatggagatttagccataggtggctgaaggagagacataatatagatgatgatgttaatgatagcaatggtaaccatttattgatgacaggactggacttttttaagacttagccaaagataacattctctgaaatctttcttgatatccttaccctacccagaattttctgattcttcctttttactcccaatgtaacctgtgccgaagtttattataatgcccttaaacttccttatttgtttatttgtcttcctctgctagaatataagcttctttaggaggatagaggcattatgttatttatctttgtaccccaagcatccagtatatttagtgaatgaatgaatgacctaggtatttttttttactcttcaaagtaatacaataaaatacatgataccatcctgttttactgatgagaaacaagtatctaagatgttctgtaacaagcataagaatacgttaataaattatgaagccaaagatggaaaatcagatctgtctgattgcaaagccagttctctttccattactctgtattaaataatgctggccaaacatagtgacttggaggaccctctcctttcagtaagagagtaggaatcagatatacaaatgaagactatgtcagtcttattatggatactgatgaaagttttctggtaatctgcaaaatagattttatagataattgctgtggaaaagaagtgactaaatgtaaaatataatctctgctggtatgtttagaccaggaaatcaaaatgcatgacctagtcagacaaagcaaaaggttctttacgtgttcttcttgtatcatcagtgagcctttttcatttaagtacaatgaagtgtctctgccttaagaaattcttcagaggcagaaattcattattctttattaactcactgtgcccttctccttcttctgcaccttttcctgtgtattgtctcccattttaaaatgtattaactgagaactaaagatagcaaagtgttgtcaatattataaagtatagtaagacagcatagaactacatggagaatatattgataacagcatcttttacacagtgatgaattaataattaaaccaaacaaaaccaaacaacaaaacagttttacagctacttgggaaatatctgtaaacaaagtttcataataattaactcttggaatatcgtcacttgtacaaatgctgcaattctagcaagtttgggacacttacaggaaactgtctgcaaataaacatgtataatgattttagtgtatatgacatgaaacagacggcgacccatttattaaggtccattacacagatataggagggactttaaaggcatcacaaaatacttgccaggaagtaaatgttgactatttccaaatctcagtgcaaaatgagatagataacgttaacatgcacatggagtaatacattctttaagtacctattcagtgaggacctgctatgtgcaaggcacgtattccagatatatattaatgaaaattgtgatcagttaaaaataaatgttactattttcattgatctcattttctattttcaataaatcaattacaggtaaaatgtgttatgagtgacaaaatgactggaaagtttttgccttaatcaaaatttgtgtaattattttttgtaggtaatcaggtgatttagaagcttaggaaattatgatgctatttttatagttattatgctattattatgatgaatcacccattcatgtgcattaagcagcattgattaatatttagattttcagcgttttaagtgtctgtaccttatttacatattattaaaaagtcaccttggttgtaatcatctgtcttcccatgatcacaatacaggtttgtggttttcaatatgtcatgactaagaagagattttatggtgcttaaatatgtagtaaattcattaaaccttagtcatgagtaaaatgatccctgtaataccactagttgcataatacctgcttctgatgcctgcttttaatttttctaaatacattggctggtttctagaagataaatgtaatattctacagagctatagactgttttgccacttggaatatctcgaacagttgtcatgggcaaggccgcaggtgctatatcccaagtgtatactgcttttatttttacatgtacaaaatattagaataataaatatatggtaaggcttctagaaatgaaaactgttgtcaatctgtaatttatagaaaatttatgtaagaaaacttatgttgtcttttaagcaattctcctgcataataacttagtttagagtaagaaatatgcatcttatctaaactgatttatagaccacatgctatttttacaaatatttaagaaaattcctagataaactttggaaccaaaaacaatgtagcctaataacaatgtcaactatacttacagtataattttatatataaccttttatctttataataataaatactatcacagccatttagagaaggcaattttagtttacctctattgcttaaaggctttagctattatttatgcacaacaagaattctgactttttaaaattagttttaaaattttggatcagctttataaagaaacacattgttgttaagtgcagacaaatgagaaccttgccatttctgcatttatgaccagaagccaacagagtcaattttcatgtttatttattctttgctttagaatgttatgtcagttgacagtattcagggcttgtgttgatgtaaattgccataaagcaaggaaacacgggctatagtactgtcagggaggctcagcactgcagaacaacacaatttaagaaaagcatttgcagaaagattcagtgtcagtcttcggaaattgactgtagatgcaaattggcatcaactacttcacaatctccctctaacaaaagagatggaaagggtggaatcaccaaacagagtgcacttttcggcatagtagctttcatgaagacaaaaataggatcccatttgttcattcacaatggatattcagactccacattctgccacccccatgttttattggagcctgcaattctgccaggagaagggttgcctcatgctaattcatcctaatgtttctcctccttcctacataggggaagtcttccaacccttcctactttttaagattagaagaaaagattcctcttaagccaaccatctctttggttacctttctgtaatgcctttatactgatgaaatgctgttatgttttacctaagttcggatattgtcattgtctcctgctgactcaacatgcattgtagccaggatcctggtctaaattcctgttatacaaaaccctgagctcttctaatttgcttcttgaaaaaaaaaaaaaaaaagaaaatctggccaggcacagtgggtcatgcctgtgatgccagcactctgggaggctgagatgggtggatcacttgaggccaggagttcaaaaccagcctggccaacatggtgaaaccccaccgctactataaatacaaaaaaactagccaggtatattggtgcacgtctgtgatcccagctactccgggaggcggaggttgcagtgagcagagatcatgacactgcactccagcctgaacaatacagcgagactttatctcaaagaaaaaaatagtcagctctagaattcttagggcatagaggcaatgttaacaaatcagaaggtacattaccattttaaaaaattttgtcaggcttatactcagatctctttaaacattacctacatttaaagaattattgtatgtaagagataaacacacaggaaaaaatatttgatttttgcttttgacctgtgtcattaaaataagatgattctccttatttctcaagaggcattccaattttaaatagagtggtagggaaaaaagtgattttagcagggatttacctgttcgtttgtactggtaagttatttttgtgttgataaattatttacactttaatggaattgaggtgtcatcatcttccatttatattattttgccttcctttttcacaaattttttactattaagaaagctacaagaggtgttatttgaggaaacagtcctataatatcattctttttttaaaattgacagtttcctcaaatatttatgggggaacctttctacttctcaaatttgaacagacaactttagtcaatgcttagcattgattttttgacaactcatgtccatttcaacattttattgtgagatagctaggaaattagttgtaagagcagaaaggtaattaggtaggtggtataaaatttttgacagttttgacactactgatattttcaggaaaaaaaacgcatacatatcctagtttagagtaagtctagctgaaaatttaaatatatttttaactgaacataatttttgagtttgagataattttagatatacatatagttgtaggaaataatacagagagaacccctgtaccctttgtccattttccccaatggtaacattctgcaaaaccatggaacagtatcacaagcaagatattgaccttgattcagtcaacatacggaatattttcatcagcgcaggaatgtgactattaaaaaaaatttaaatttttgaggattattctacctccaaattctttagtactaaatattcttacatctagacaaactaaaataggatttataggaaaaatgatttgactagagagtcaatatgcctgaattcatatctcagctctgccaccatcactggtttaattacatttggggagtcacagcgtggtggggcctcaatttattcttttggagggacttagtctaaatcagtgattgtcaactagaatgaaagtgagggaactcctcccttggagacttgtcagaatcttggaggagacgttttgcagacaaagcccaactcttttccctccacactcctacctccaccaccatcacaagcaaattctgatgtttgttcctagacttctaagattttgactccctcatcttccattgaggattgcttatggaaacaacgtaatagattcctagcaaatcttcatgtatagtgtgtcagcaactagtctcaagtgtctaacgttcttttcaactttaaaataataataagaaaaaatatctaccaagaacactaaaaatctttgtgcttcacaccatctagctgatgacgcataagagtagaggaaaatgtggtcaatacatgagccaaattcagagtggtgcatgcagaaggcttcctccaacagggatttgagagaaaggagatctgaggaaatccagttccactagggaatgatcccacagaaatggaatcttccagcttgagaacctgaagaaagtgactcacactacatgagaatttgaccctatctgatgctactttcaaacatatttgagtatttatagtttctaatttttggaatacgtagctttctctataattttgataccctatctccagaaaagatttattataaagttagagcacaaagaaagaaagatacagttgtgtttttatcattacaattgctgccttaagcatttctttctgtggtctagtctaagttattaaacctcattagttttttacttctggttagtgctgtctccttgattgtggcaaatgcaagttaccaatatgactctttgctacttctttccataagaagacaaaatatatggcaaaaagagaaaaaaactctaggattccaaattataagcactactcatattgaaagttagaaaaagaaaatgagcctgaactgaaaatcaaacaaaaagacgagaaaaggaaatggaaataaagtttccctgtatcccattagggttgatacattaaagaaagagtgaggatagctggaaataatattttccttcaaatgacagctaaatgagatctttggagctgtgccacaatgagtgaagtcagggagacagggccggtagtgacaggaggagaaaagtgcttcttcatgtgtcagccctgggtttaaaataactcagaaggtataaaagaaattccctcctcagatacaagattatttgtgggacacctgattaccatttaagagatatcaacagttaaaggaaggtgatttaaatctggatagctcccttttaaatccagccctctgattctataaggcaaatgacaaggctgtctagacatggagtacattgagcaaggtttagatgagggagccccggagactgtgagacagacctgttctgtgcctgagaatgtcagtgatgactcacaggaggtggagaaaagtgtgctcaatgtatgggccaggctcagggagctccttgaagacagatcatttggtattaatgatacagcgataccacaaagcacaggaggtgtagcctgctagcattgaagttaggaactgatttgaattaacccagtgtttgaatctggatgcaagagcctgtatggtatcttgcatgctaacttcttcataatcttgttcctgaatgggtgccagattgaggagtctttgggatagttgatatttcttttaaaaagcctgatctatataaagctgtatcaaccacgtgcaaccactttagcataccactctatattaatagaatagaaaagataattagcagagaaaaagagccaaggaaagctaccaagaattagtgaaatataaaatgtgttcttattatcccttcctcaataaaggggcaaacaaggttgttctggtatcatctgtgggaattttacacaaactattttaggaggaaggtgggtgactagatgatggatggatggatagctgatggatggatggtggctgaagtgggtatgtgcattgaaagaaactgcaacagagcactatcttctgaagtcacttgaagttatcccaaaggtcaggggaagaaaagggaaaaccagaaaccacatatgaaattagcaaagctgagcccgagtctgaacgcactgtgaggaggaagcaccattagggaggtgatccattgccagtggaaagccagaagctcagaaccattagctgagaccgtgctcctcccaggcagggaccctctagttgcctggggagatgatctgaattcacataggaatggtcgttgcctcttccatgaggatcatgagaacatcactaggtccaaaccacaagctgttcttgtaaaagatagagtaaatggttacatcaaatataatcataactgtagtcaacctgcagctcagagatatgtaagagtacaagtaaagctctttatccacgtgctgaacatttttattaaaatgtgtgaatgaaaaactattttaaaaaatagaccaggcatgatggctgatgcctataatcccagcattttcagaggccaaggtgggaagactgcttgagatcaggagttcaaatccacccccatgagctagtcacctcccaccaggtcccacctccaacaatggggattacaattcaacatgagatttgggtatggacaaatatccaaactatatcaggtggttactgtagagaaggggagaaatgaactcccttaacgttccagctagatcttacagaagaaaataggaattagttttgatggtatacagaaaggaaaaccatgtgaaaacaaggcataaggctaccaatatgtttaatgagaataaaaggaagaaagaataagtgactaacatacgtacgaaacatgcagctcttagatccatgttccttcagtgctctttatacttttcatggcttttcccacgtaagccgctcaactcacctaaacttctgtgccccataaccagtttccattaattgacattataaccatctttcaaagcatggagcagatacggccctttttcccagctacgaggatttgtcaaaagcagctttttaaaatggttatcttcgaatgtgcctaatttttcttatcacactgtaaactttttaagtcaaaaatcttatgatcaaatcatcattaccatttattacttttcatcttcacctgtctgcctcccctctgctcaaccccagcccctcatgcagtacgtgcacaataaatatttgttgaattatgaatgaatacctaatattgacatgcaaggagtttcatgcctcagttaaaactcccagaaaatctttttccagtccccagttagagccagtgtaataacagtgactttttttcaacaattacttaaataacattattaaagcaattgttgctttaggttgttcattaataaaaataaatgtatattttctttactgttagaacagtttgattctgtatgaattcctattcctgattttattatactcctgaaaccacagcttgctgctggttcatctattaggcatttgaaatgttgaattactttgaattgcatttgttcttatattgcctaggctctggttggcctcctagggtcgtcacaccataatcttaaacacaacatgtgccttgtggcccagatgttttccaagagggagtgctgcagccaagaaaagcaagatagtatcttgaatacccaaaggggttgatatgactaaaaagcaaccgtacagccaactgtagagctgtccaagaaaaagtgagcctattatttgtatagtttaggtttttgtgatcaaatagtaaaatttgcaaaagtttcatgataagatcttttgcttcacagattctcgtaatatctgcttttgtagtgtggactccagtgttcagcagtttgtagataaaactgggatcgtggcaacaataagagaaatcaaaaaaaaaaaaaggaagagttcatggactcttgtttcttcataaatgtgacatgataaaaattacctttctttcttaatatttgaaaataacataaagaatgaacaaagattgcttctagaactaaacttggattgaggcaacttaataaacggctgtttgttgttgtttctgttcttttcttctgacaatatttaccttttatattcttgtggagagctgagatacctgcaattgtgcttttaaaaaattgttctgtcttcttgcagtgaggtctcttttttggcttacttattaacaaagaagcaaattacatatatacatatactttatgtaacatgtatacacatatgtatatgtaacaatgtaatgctatgtgtatacatatatgtatgtgtaatatacatatacatatttatacatatgaaatataaatatctatatttttatttcatttacctactagctgattcacatcgttttcataaccaaaatatagctcatggcttgagtatgaaaccctgacaaagtatggaatttcacatacatgtcatgataatgtcctagtcagattcagtcctacctcttgcttctgaaaatgtgctagcttctgttctaatcctaattgcatgaattagttcattgtccagtttagaagagaggaacgagtaggaagctgctttggttctggggtcaatctaggacttcaggtctattttagggaaagcattctagaatgtccttgcccttcctgatacactttgatataccttcaactttgagatcattgacttagtgttatcttgaatgagggggtccaatagagccagctactccatgctgatttagatctcaatgcttttgaaattcaagtttttaaagcacttgactctctgttttctccaaatgaaatcctattttgtatttaaaacagtaagaccagatttccccttttgaagtaattataggatcccaagaacccttaattccactggtcccatggtctacttatccccccgccccccacagcaagtcccttacccctgaggcagcttcagcgactcctccactcacccagcactgtaggaaaatgtctgctgtgctccagccagagcagacctactgtattgcaaatttatcgtggctggaccatcctccagagatgtatgccataaggacaatggaggcctcagctaagtacctcctgctgcattcattcccagggtagtaggtggtatagctgcaagacacggaacccagtattaggccttgctccattttctctaggcttcaaagctctgagccagtgatagtttataaaagcccaggactccaaagaattaaaatcagcacctgtagatctcctggtgaagataaactccatgggcatgtaaagaaagcaataaagatacacacatagtttttttttttcttttgaatatcaacagtaaccttgagcagagtgactctttatcagggctcttggtacttaggctgagctggtgatcacaaaggaaagaattagaaatttaaggtgattttattttattttatatttttagtaggagtatctggctgctatctaaggaatctcttctattagttacatggaaacttggagattttattgtttccctctcagtgtgtgtgtgtgtgtgtgtgtgtgtgtgtgtgtgtgtgtgttagccatttattaatcctaactcccccaagaaaagacaatctataaatttcattttcactcacattaaaaggtgagatgcaggctgggtgctgtggatcacacctgtaaacctagcactttgtgttgacttagtgttatcttgaatgagggtggacagatcatgaggtcaggagttcgagaccagcctggccaaatggtgaaaccctgtctctagtgaaaatacaaaaaattagctggacatggtggcgggcgcctgtgatcccagctacttgggaggcaggagaatctcttgaaccaggaatgggaggttgcagtgagccgagattctgccactgcactccagcctgggcaacagtgccagactccgtctcaaaaaacaaaacaaacaaacaaaaataggtgagatgccaattctcttcctgactctgcactccagtgcagtgctccatttcccctattgataataccaccccaaacatacctatttttccaggaccacatttcttcaaattgcactagtcatgctgttaagaaacacagaatctaaaaatgatctgagaaaaagagaattgcaattacaaccacaaaattttctatatactagtgaatggataaagatatttattgtgacacattgagcaatttttttgaaagttcatgtactcttgctcaactgattgaaactttgggaaaatgtaactttttgagttgtaagatcatgtaaaagttaaatgaaggaagaacagcaaagaagttatgggaattgttgttgtgattaagtagttaaatttgtatatttttttcctgctgattagggagttgttactgaaatacgttagcaggatccttcttttagcttttcacatgaatatttgggttgctttctgccttgataattaaaagagaattgtgtatatcttgttttccctaaagaaaggtgatactgactttatcatgtcatcataatcttcacagctagtagtgaaatacctttattgaacatccaccatatatataagactgttctaatctaaactcaataaacctttaaggtctatttcttattcttcttactttatttccataacttaattagccttcaaagcccaattctaatatgcataatgacttgaagtattttccaaatacaatcagtgatttttttgtgtgtgctaagtgttctcaggacagggtcaaaactacctattacatacattcaccatgagaatttagcacagttggcctctggcaacagactcaaagatttattctgtgtagctattttctagcctgctggattccagccagttgcctaatggatcatgagtgagtcagtttcattcagtctcttagcaaagtcaatttgtccagcagcacacaattttctgtcatgtagggtctttgcctggcattgctgtgacaaacacaatctaactgttttgcttccctagattccaactgagctttggccctggaaggctggcttagataatcaaagtcccctctaaggagggaaagatggtataatgaaggcttcctggaaaaattagaccctacaatttacccatctccaaaagtgggtcatggaacaaaaatatccatgtattaagttagattaatatttgtgtgtgcaatgaacaacagcatttgccttttgattacttcgggcccaaatgagctttctcttttaagtagcagaaaaataacaaaagcagagtacacctggaagggacagaatagtcacaggccagtgttgtaagagtcagtgtggcacttctgaaggaaatctgccgagtgcatgggatactagagcaccatgatgggcaggaggagaaacaccctctttctctaccttccttctctaccgccactccttcgagatggccaagtatggaatttctctgtcaggggtcctgccacctgacatgtgcaggtccagttaggtagttgaaaaggacacattactacacttatcagggttctcactacaaacaaattttcatagtccttctggaaataagccacatcaccgaatgcctttccggtagctgacatgattgattgtggacaacgaagaagtcacttattcctaaggaagagactggagtgagggttgctgtttgcacatacataaaatcctagaagagataccaaagctacattatgcagaaagattattattttagccagtggctctgaggacaacctcatttgtcttctctatgggtcactctttttttttttttttttcttttgagacagagtctcgctctgtcacccaggctggagtgcagtggcacaatctcggcgcactgcaacctccgccttctgggttcacgccattctcctgcgtcagcctcccaagtagctgggactacaggtgcctgccaccacactggctaattttttctatttttagtacagatgaggtttcacatgttagccaggatggtcttgatctcctgaccttgtgatccgcccacctcggcctcccaaagtgctgggattacaggcgtgagccaccacacccggccaggtcactcattttttaagtgaatattttcatttccaaaaaaaaaaaaaaaagcctcatgtttccaaagtggcataaaaggccctggcatgtagagtgtagaacagaggctcctcctttttagccagtctctatttcagaaatcattagatagaacatacttggtctgaaaaaaaactatgaaattttgatcccccttggagaaaatgtactttaatgtgtatattagttttcatttccttcctctgatacagtaaagtcaaaattttgcgaaccattgtgaaataaggagatatgaccccataaacacaaacaattttcgttcccttgttcctacatatgtttgttaggagtacataaaagacaagttagctctatagaccctctaattttgagaaagagaagcacagcattttcctctttgattctgttttgaaagagtgcacataatgatgcatacctcatgcttgtctgccttcccctggactttaatttcttcctgtccagccaaaggagaaggtttttggcttggtttcagctgtgcttccatagctgctacacatcaaacctatcctaccaggtagagactagtgtattcttttcactgagggtagatggtcttctaactttaatcttccattctgcctgtcacgtctagaatctatctggttaaaactcacgttttaaaaatgcatgtcctaaattgtatccaacacttgttagtatcaattattatcataatttaaagcctagattgcagatgttcatcgtaatactttgccaatattcttatgactgtttcttttttcccatagataagtgttccaatttaagtgtgttttcctttccagaatgttctgtatgtaactcttctgacatttcagagattgtgttattactaatatttagtctcgtgaggtgcttcattttttaaagtattctttattgtgttttttcttcatgacccatcatggtgctcgatcagttccttgttttttcttttgagcatgactaataataataaagtctgagctctggtctcatatcacatattttaattgtataaaacaactatgaagacccacactgacaagatcctgagcctaaataaaattaggtcatgtctaaaagatattgtcctttgaattaagcagaacgtgtgggtgtgtgcacatgtgtgagagagagggagagtttgctcacacacagccttgacactgataatattttcccagacagcttctactcagtgactttgtagtaaaatcaaaggagctttagtgtgtactcattttacagattagaatagtagagcccagagagagtaagttatttgcctgaaatcccacagcgagggtccacgggagctaggactctggctttcaggaccctccttgttcagtcctctttactttgagtcaactctgacgggacctggcatggtgccctgcaattactgatgatgcgaaaggtgagagcggatgaaattttagcacactgatcaatcttgagatactaaaatataccagcaaagttgtgaactcgaaaattactaaacaggctgggcatggtggctcatgcctgtaatctcagcactttgggaggtcgaggaatgagattgcttgagcccaggagtttgagatcatcctaggcaacaagaacaacaacaaaaaacaattagttggggatggtggcgcatatctgtaatcccagctactgaggaggctgaggcagaagaatcgcttggacctgggagttcaaggctgcagtgagctatgatggtgccactgcactccagcatgggtgacagagtgagaccctctctcagaaaaaagaaggaaagaaagagagagagggtgagagagagagagaggaaggaaggaaggagaaaagaaaagaaaagaaaaaaagaaaaagactgaacaaaacttgagaaaagcaatgtacccttatcacagttttatgggaaagtacacaaatgagtaaaatgcaaaataatggcattttctgtactgagaacagagataccacagagcaatcgaggaagaattagttatactgttctctgttggattacaaagcagaattctgaaaagcacacgttgtttgacacgcagtgtgaagttgcttgacgttcactgtgatgttggctgggacactgtgccgggtatgtgtgggtctacagattcatcaaatggcacatggtcagaacgaccttctttttgctaatgtcattaagtgccatctattaaaaatcaggtgcttacaaatgagagtatttaaagaatcagagggagcaaggtattatgtgtccccttgttatcaaactatattatccaaataaggatatgatataatcaagccaattctaaacagtccaaaggcaaaacaaaagaatgtgcccagtgctttcagccagtgtctggatgctaaaaatcagactgactagtcaatgaaagcgaccacaaaattagatgattttgacccaaaagaatgccttggcctcccttcccagagtgtttgccagttttccatgtctgctcttcccctcttcacccccagccccaggtggaaatgaagatggttttccattttgttttgaagagagagcttcatgtcactgatctataatgtgaaggaaaatatcttcatcaaaaccaacattcttaggaatacatagaaaataaaaagactactcatgtcttagaaaagttttcccaaaagttggatcatgttggataatgttatgatccttttcactttcaaagttccctagttcccttagagaggggaaaattatattactggtagaaatcaacatttccttttctttagtgaaaaaaataacacagcactctttaattgaaacctgtgtatctttgccctccccactttctgcctttgctttttcattcacatttaactcctgcagcaacaataacctctgggctgttctgcattagagagaactcaagagccctggaaattataatttcagaagtattgataatattaaacaacatcaaaaatttttaccacttttgcctgcccttcttacttttttcacaagttaattgaagatggaaggcagtaaagcctcgtgattctttttcaaaaaggttaaaatacaatataatctatcttttttttttttttttttttttgacacagagtcgtgctcttgttgcccaggctggagtgcaatggcgcaatcttgactcactacaacctccgcctcccaggctcaagcaattctcctgcctcagcctccaagtagctgggattacaggcgtgcgccaccgcacccagctaagttttgtgtttttagtagagacggggttttaccctgttgccaaggctgatctcaaaactcttgacatcaggtgatccacccacctcgacttcccaaagtgctgggattacaggcgtgagccaccgcgcctggccaaagtaatctatctttaaagatggtctgctatccttaattgtgtatttggtataggttaatagagtgaaagtcctgtaagctataggattagatggacgttgcctgcaattcaattccatctgtagagcagatttcattgtcacattaaacattagaacttaagaaacaagttcttcagagaagtggattgagaaagattgaagtagtattgtgtgagctgagcttgagtcagctattctgttggagaatccctaggttacatcagagaagatagccgtgggctagtcacctctatgagctttgtcatggctataattttcatcaccagtcagtccttcaaatagatatttcttagagatgcatgggtaattagagaaactctcaattcagttattaaatttttcctactcatatccagagttaactgctcatttttagcttgaacaaattagaggattgcttagtgctgaatacttgtctctttgttctataagcttgacagagctttcttattgcctatatgataatgttggaccatcttcaagtgtctacagtctttcctggggctggtatggtgctccagcataaatgcataaatgtgtaatgcagtggaatttcaactcagtgataaaattctctaaaagagagaactaattaattttagagccagaaagaggcctatatccaacctatttatgtatgtgctagagctggttactacagagcaaattagagaccaataaaaagacatggtgatcacttcaaattgaactgtcttaacagaaataaattgcagaagcagataagattttcacaaatcagtgcagtatggccctgttactttttatagcatctggattatggcttagacttattaagaattagaaaaacaaatttcagtgccatcactgatacctcaatataatatgggacaagctgttagacatcaatatgctgaaaaatggccaggcatggtggttcacgcctgtaatcccagcactttgggaggccaaggcaggcagatcacgaggtcaagagatcgtgaccatcctggccaacatggtgaaatctcatctctactaaaaatacaaaaattagctgagcatggtggcacatgcctgtagtcccagctactcgggaggctgaggcaggagaatcacttgaacccaggaggcagaggttgcagtgagccgagattgcaccaatgccctccagcctgatgacagcgagactccatctcaaaaaaaaaaaaaatatatgaaaaggtaacagcaattttcagtgagtaagcatataagtaaaggataaggagagaattgcctcttttctgtcgcattcaaggaacagctggaaaatggaagaaacatagaaggagagaaacatcaagaaatacgtattagtcattccactgtaggaaaagttcattacaggagagtcatgcaggcagacagggtcttcttagtatcaaggactgattttgataatgtgcccacatttcagcgagggcgttttaagacataagcacagcattaaggtgtttcaatagcagacatacctgtctttattgcagtggggagaaagcccaggctcatgaaagaggcgtgagcattcacgggaaggaagaaagaccaaataaaggcctaggaggaggtgagccggggaactgtacaagggagcaaaggccccttcttcagatgagttcaggatggccttagcaccagtgcttggggaagaatggctcacatcctctatggcttaccctcttcttccaaggctaattttggaggctttctagtctttcttttgggatcaaatatatcatgaaattgaaacaataaaaccaccccccatagagctgttacttggttttcacttttcatataatattaaaatctcaggactaggagcgatttccagaagctattaagtctaaccactacctccagacagaacttcacctagatagactaagggaatgtattccttattgaaaatatattccacctcattcatttacaaataaggtgtaaaccttcctggaaaaaaattcacaagtgccattataaatgcttctatggataaagaccttaaagctaacccaaagttattttgccacatatacttaggtgtcttaaataaataatatgcattctctcgattccatccttgtgaatttgcatttgggttcccacttcttcaaaagagagtgtgtttgttccatggccaattagtttgatagtacatataagtaattttgcatggataaaaactaaccatgcaactttaactctgcctttaattaagtaatcattaaaaatgaaacttgtctacttcctcctgttctgtagttgacggtgattgaggggcttggtatggctgtagtggcacaaaaatggaaatcagtaaattagagcagttgtcagacccagattctgattagctaaacagcttgcctgggttagtgattaatgcagttgtagggaatgaaatctgctttcctagaaaagtcaatagagaacgtttaatgaagtagaattatgtgacagttgtccagttgtgtgaaccatctttgaacttagtcaaatgcagatgtaattttatattaagactttaaaagaatggaaaaatggcttcaaacataggagaacaaaattttctgctttctttgtttacttcttattttatgtcaccccataaatgtgattggtacggcttttgagattattggtttagaatttcttaccctttgttgtcttgagccatcttttctctagaaacatgctaatattacagatggttcaaatgttcctataatgtcaatgtgtaaatccatattgagcaatgtagaggtccggctgtgaataggacaaagaaaaaattaagaaaatatttaaatgtacatacctccttttctaggatttaataactcgaattatttataaaatgttattgacaactttattaaaagtataagttacacgttataagattcacacttcaaagtgtacgattcagtgtttttagtaaagtcacaatgttgtacaactcattaccactatctaactccaggatattttcctcattccaaaaacaaacctcatacccattagcagaccccctcccatttcctctttccaccctttccccagctattcaagttattttttaagcagatgttctgattaaaactctgtatctgtctttggtgctttagctagcaaaaaaataatgaatataaaacaattgcctccccatatatattggtatatataatttattagaatgtttttcttttcacttttaatgaaataataatgaaatttcaatatgtataactggtgaaataattttggcaatactgtgagtgaaatgatagggcaaaaatgaatgcttttatttaactcacaattgatataaacaaaaaaatcaaatgatccagtcaggtcgagggtaaattctcttaaggaaataacaggtaaatacttttccttgagtgtaaagacacttatgtgtatttattaacacatacatagaatttagataagaattatctttaaaaatatgcatccttttaaatttattcaactagtattatcttttcactacaaacacaataaatcctggttttgcttgcctccactagtcgatatcttgagttaatcttgcacatcagctgaaagaatagagttaaagtttgtatctatgaatagaaggacttgataaactatttgataatgtaaataagagtagaaagggaatatgtagtgtattatgctaagatagtatatgtaattcatgtgagtgagcacactgatacattttaagataagcaagtgccagattaatgcatattcttgccctgattccttttcatcccctttcccttcatttcctcccctttcccatcctcttccctttagacccttgtcacactgacctgcattcacttactggaactggctatgtcccctcctgcctctgggtcttcaagcaaggcctctcctctgcatgtcttaacccaatccgcacacctcccacaccatgctggccctttgcttacttaaattaacttatcatccttcaaatttcaactcagtagtacttcccctagaagccttttggaactttccagaagtcgggtcctgttcatgttctcagagcaccctgattttttggaagtaacattcatgcttctatcctcatcttctctattttcaaagaagaatcaaagaatgtatgtatattctaatatatattgtgtaagtatactaatgattcaatatctttttagaaaatctgcaattttggactttttagtaagtcagacatcttttgcttctgagaaatctgaactattttattttgttatgactgtgacattcattccatgtgttgaaatcaagacacaagaatgcaagaaatgacgacttgccagtaaatgcccagttttcactattaaaaaaagcctggcattgctctcccagaagaataacaactcagtgatagaggggcgtaaagaccatggggccagcatatttgaaggtgatttttaaatattaactgttgtggtcttcaatgtgagtaagcctgcatttttcaaaaggtttcatatcttacaaactcctgatttctccctttattaaaatctattttgaagtaggccaagctgtcaactaaagtgaatgttttcaactaaaagatgattcactttctaacttgacaaaaataaatggagaaaattatagattatagatcaattatcactttctaatttatctctatgatttcaccctgatttattccatgaacaatttaaggtattttaactatctgacattcatttagttgaacaaaaagaaaacgtgaaaccttggtaaataagggacccccttaaactgaaactttcctaagtacatttgaaagtccataaactgacaatggataccaagatcatgagatcacaaatgtgacttttccttaagatttcatcacaagataaatcaaagtgctaggaattgtattttcccttttcctagtaatcaagtatccttctcagatgactctttttgtaaaagtaacaacttctcatctttgagacttgactcacataccaaatatcaaaaatggaaaatctttgaattctttttcctgttgtgggaatacgagtcatttataacaacaaaaaaaatcgataggaaatggatgttttagggaagtgtatcctgagtgctgtctttaaggcattgattggagactgcccacatctaaaaaatgactctaggacatcactctcatgtatttccgtgaaaaagctggtggaaaaatgtgttttcttctaaaaggctatgtgtgggacgtgtgtcagtgttcacatgtgcctaataggcatacgtaaaatcacacttgtatgaaaatcaagtaaatctgctgaaataaacagcaacccatgtttgggcatttgtgttggtagagattggcttttaaaggagaatggattaatatatgattctcttgtcggtattactatgaattgttcttttttgaggaggagtctcgccttgtggcccaggctggagtgcagtggtgcagtcttggctaactaccacctcctcctcctgggttcaagcgattctcctgcctcagcctgctgagtagctgggattacaggcacatacaatccacacccggttaacttttgtatttttagtagagaagggtttcgctctgttggccaggctggtctctaattcctgacctgatctgccttcctcggcctcccaaagtgctgggattacaggtgtgagccaccatgccaggcctgaattttcacttgcaaaattatcagtcagttcttaaaacttgaggaagggaggagtcaagaaaatgaggtgaatgagaaggctgtttagactgtttttattgtcttacagtcccatttttgtctttcactcttccttctctctaatggctgggttttcaacaataatacaggcaagcataaaagttagcaaatgagggctaacctagaattgcaaatttgattgggtttcatgttggttttccttaaataaatcaacagttttaacagggtggcatttaattatatttgtttacagaaatatttttatatttgaatttctttcataacagtgtttattgtggtcaaaggatgggagggatgaggaaataatatttgaagaccacaggggcattcctcacctctgtagtcttattatctggccttgaaacactacgacattctttaactgaatttattaggggctgaataccaacaacataagtcagaaaagggtttacattgacccctttggattctaaatattgtaataaatattattagttccgaaatatcatatctgtttgatttcccaaatgattgcagaaatgctttgatctttttagtcctatgatattgtagagatatctcactaatgatgttttttttttttttttgagatggagtctcgctgtgtcgctcaggctggagtgcagtgagccatgtttgtgccactgcactgtagcctgggtgacagagcgagaccctgtctacaaaaaaaaaagaaaagaaaagaaaagaaaaaaagaaatgtaattcactttcttctggtcagcagctgacaggatagaacacattggactagaaacctgttgtattcttacttttacccatgacatggcttcttttagaatacaaactgtttagaactaagacaggaaaatttaacaaagcattagatataaaaatgttcacaacatgtatggtctattctttaatttgagaatattttaagaaaatttgtggttgaaagctattgctgtcattgaggtggtgttacaacacaatcgatctttgaaaaagtattggcttcaccagggaaacactagacctctaccccagtgactcctgctaaagaggtctttgccatcgctgccctttctgatacctttgtgtgtgctcagattggcacactgattaatttcagataccatcagcaaaaatggaatatgctgaacaagcacttacaaagtagtggttcttcatagaacagagttgtagcccttcagtaacaaagaatgagtcagaggaaatgagttaatttaacaaattgctagttgcctaccagatatcatagcaaggaatgatatatgcaaggtgtgttaaaggcaatgtttccttaatttcttctttctatctcccatctcccaatgtcctctggggaggccgtagaggtgggagggacatattaagtaaaaagtgtgaccacttgctgagtaatttttagtgatttgttgagctggattaagtgaatttagagttgaatcttcaaaatgatcatttcctttttttaagagtttatattctggatattttcatttgaagagcagtgatagtatccggctaaggtttactaaattgttcaagtgagtttgcagaagactaagtgaaacaacttctgtataatgaactggaagattaatctgcatatcacataagcaaataaaaaacaagcaatcatatattttataatggaacaaccgtaagataaacaaacaaaaggcatagttaaaaatctgtatgaaaaagcaaattcttggtttcccaagaatccttggtttcccaaggctcaagaattttatgatttgagaaaaatacttaagtgttgcctgcacttctgtgcaataaatctcattatttcatactttattgccactactgtcatgaaattaatggatcacatttaagtattccttcttggaaaaatatcactaaaatgtaatgttcctcaagtcatagtgcaaacaaaattatatttatcatttacagacaggttttattggtcctggtgcattcatctgctgatggccaataaaagctatacaaagtctcatcaatgaaattagtaatctgtggggacaaacatgccattagtgcctgtcattcgagatttgtgatcattgacgtgctttttatggcatctgaaaatattagtttgactttaaaaaatgtagagttgtttctattgttggatatatttataaaattctgaacataaaaatgctctttggtagccacttgaatttttaaaactatatttaataaaatacagcttttaggaatagcaatcagcatgggataggtgacaatgaattttttttttttttttttgagacggagtctcgctgtgtcgcccaggctggagtgcagtggcgagatctcgctcactgcaagctccacctcccgggttcacacctttctcctgcctcagcctcccgaatagctgggactacaggctccagccaccacacccgggtaattttttgtatttttagtagagatggggtttcaccatgttagccaggatggtcttgatctcctgaccttgtgatctgcccgcctcggcctcccaaagtgctgagattacaggcgtgagccaccgcgcccggccaagtgacaatgtattttaagtagcctctgctatccttgacgaaatgtgctaaagtggcaaaatgtttgctttagagatgtacaaaagtagaaaatttgtgaaggacattaggtgtttctccactttgagaggggatctcctcttgatctactctttatttcccatcccagagtgaacaaggtactagttgatgaattcgaatcaggatacttgaaattaagacttagatgtagcactttgtgatctgtaaaaatcatatcagatcttaaatatgaaaatgtttgagtttagccaaaatcaccagcatcattggtgtatatcaagtttaatcctatccttggaataatagaacttcaaggttggaagatgaatcttgaatagtttgaagttaaaccctacctgccgttgcaatgagtcccattgaaaaacatttcctacatgtcctcgacaagtctttgctttctttagttacaaggaattgcccaacctaccaaggcttccccattttatctttgactatttctataaatttctttttaaaaattgtggccatattttaagacacagagggagggtagacacctagatctaaaggatattaatctacttaagaggaatttgcttatggaaagatgatctagcaaatgagataaactggactgataaaaattatccaaactcaggtttagatgcctatagcagtttcacaaaaactaaatctttgtctctaatggatctgagctgatagcagtgtagtagagaccaaaggtctgtgactgtcgtggagaagccccttttggatgaagctttacggaggattttcaaatgttaattatatttacaaacagatcagatgtaggcatagatatattagaatactttatatcttctctcatttatttttctactgctagataaatgggacttataagtagctgagtaggcaaacaagaaagaatgcatacagttttatcaatttatctgagattttgtgataagctacagaccaagtcaaatggactagttttggcaggggcttgctgtccatatgatggtcagttagcttttttctgagttaaacttgaaaactaagaactttaagaagtgcatgggtatatataggtgtgtgtgtgtgtgtgtgtttgtgtgtaattttacaagactgtagaattataaaatgacatttgttttaaggaatatttgattgacagtttcacttaccaacgttagcctctaattatgacactgaggatacccaaatttaaaaatttcctttataatggtccctgagacctggtgattgaggtcataaaaaaggaatggtagttttctttcagaattttaaattttctcaaataatatttcaccaaatattagccacacttgtatactttgactctgttggtcgttaaaatgtatagtcataattactcctatggaatagggatttcaatagaaagaaagctttagaaatgaatcttctttgcagataaatgctatttaattttcagagttaatataattcaaattatttagaagtttacaagattctattataaagccagtttatttatttttttaattccattatcatctgaatattctaaaaaatgtaaaaagaaatctatttgtagagaaaacaatgccttttaaagaaaaatgtattttgtgctgggctgcagtcttattcatcacttgataaatgatgcttttaattcagataattagagtaatttgtaacaaattattagatatagcagacttgccattccatttctataaaataaaaatacattgtaatgtttacattgatgagtaataataacaacaccttagtagttgtaacaatatatgacctaaaatcagtggtaataatgtcctatgataagaagattgtacaaacttaaaagctagattttctttcaaatcttttgtcatactcctgagagaaagatatgaggggaaaaaagtcactatagcaaaatgccttctcagaactgtttcagagcaattgaggggagaaggaaagaatcagtcagagattgtttcaaatttaatatgaaataaactgttacctttaactattcagcaatgacacagttatatttcattccaaaggtgtttacaatcatatgagtgggtttctgtattcaatgttacaataagtcaacttggaatttcccattaaatatgatattaataaaagatttaggtacagtcccctggtgtgtttgaagctgtgcactctgcaaacacataaataaaaatatatctaattggtttgtggcattttgagattttttttttcagaaggaatgtacttaaaaaaattaaattactgcagttttctttcagaaaattgggcttttgtattaaataatgctagtccaaacttaaaaataagaatatttaagcctggtaagcatctttgttctctcaataaaaagaaaaaaattagagactctctttctccctggcctcatacccccatcatcttctgaagttatatgtatatgaagtattttttttaatctacagggataccttttaaataaaatattcctttattatcataaataatctgtaaaacaaaataatagtggcagtatttgtaataaagtcctaaaagttaaatcatccttattatacttaacataatccaaaagactcctaattaagttttcctttcctaacttatattatcttatgatgatctacaataattttgatgatgttctcaaatgttcttatatctgcttctgaaatagttaaacagattattgaaaaagacctctgaaacaaagcaaataaaataatgcatagaaggaaacagcttttagtcttatctctaatggaatcatgttattgagttttctaaattatggaagatgtcaaaggtcatttagagctagacttcatgtgaagaattcttaacttgaattggcttcagaaaaagaggtccatgaaactccaaaattgtatgcttggtttttatttgtacatgtaaacaaaaattgatagctttccccaaattctgaaaggagtccttagctctcaaaatactgagaacctccattgaataagacatttgagtagggactttgtggtcagagatctgagtttgaatcccagctctgctattttccacctgtagggtcttggcaaactcctaatctgtctgagatattgtttactttctaataagtgcaggtaaataatacagaatttacaggttattgtgagagcctatgagatcatgtgtatttttgccctggcatgttgaagtcacacaataattctttcctttctctcggtttctctcttttaagatgacaggaatggttagctaaagcaactgagtgttaacatgagggttcctgctctattgcttgttatcacacatgggtacatataacagtgactgcctataggaagaagtcattaccccgggacagctttcactggtggatttttatgatggaaagcaaccgcattaactgcaatatggcccagggtgacacttgacatctgtatgttttatttttattaaaaaagtaatttaaattattgccttttctttttattatggaagaaaatgtaagaatgttgactgttcactaagccgaagattccctttttgctttcaaagcttttctcaaggacattaaacactcttcctaattactttttattgatttcttgacatttctactcaacattgactgcttatttttaggaaacaaagaagcctaagtgaaaaatgttaatggtgcatttgaaactacaaagttcaatattttagtcacgcctcttatatgtaattgtaggtaaaaactatataatatttttgccatgtgcctcagctctcttatcaccgaagtaaatagaaaattctgtgattctcagatttcttccatagctttaacttattttgaacaaatctgtgacttaccttgctatatttcaaattttattttattattattcatttttatttttatttttttgaaacagggcctcactccattgccccagctggagtacagtggcatgaactacagcctcaatttcctgggctcaaatgatcctcccacctcagcctctcaagtggctgggactatgggcccataccaccatgcccggctaatttttaaattgttttatttgtagagatggggtctggtactactatgttgcccaggctggtctcgaactcctaggctcaagcaatcctcctgcctcagcctcccaaagtgctgggataataggtgtgagccaatgagcctggcatattttattatatatatattttttgtctcaagaggttctgagaacatgtgtgcctgtatttcaaattttaaatgagtgaagataaggcttggcatagtcaattgaataaaatttagtaaaaaatcaacggaatactgaagagactgatgaaaattacacaaattaactcacattttacattgttcttccaattttgcagttatttgccattagtaaacactttaaatatgtctgccactctgatttttagcattatttttgttaggagtaactatgtaaagcaagtctgattagatgatcctcatatgtaatttaaccaaacgaaagatgtcttatgttaactatttagaacagcccatttatttaaatgttgctcatttaaattacttgacagtcaggaattaacttttaattaaggagtgctaccatcagacctatttttaagagtttcttgtgtgtgatttgcatgttatatacaaatgaggttaaagaaaattacaagtcaacaaaatgaacctaacatcaaatgtccctggagataatttttttattttatgtaatttatctgcatctcttatagaaatactttttttgtcttttctccctatctctttgttgtgtacaatcagcttttaaaggatccagtggtattaattttgcattgcggtcaatcagagatcttatgcaaatattaaatattgcacaggcatcataactaaatttagcatttcatttggaatagttccttgtgccataactccctgatggtgtttataactcagcatatttatatttgtatgtgcatttttatgtatatgcatttctctttggtctcataaaaaagtaaagtgtgtatttttttctaactctacagtcattactaaatgaaaattaagttgtttttaaggcatattttttaaaaggaaaatgatgttaatctgaatgaaggttaaatagaatcccttataacactctggcactatgtggtcacatcattgaatttctgataactttcatattatactttagtctaactactcaagatcagtttagttttctagtgtttaggaaagcttaatgaaaaatataagacaacagacaactagaaaactagacagataaactgaaacagacaacagaaaactagataatatagacagagcgttttccgtgaatgaaaactaaaatgcatcagtttgactcacagtggcctcctgccttctgctaagtatgcacaacctaaaggtaatattttaagtctcattctctgacaatgtagtttgcaaacatagagaaatattcagatgtagaagaatatggcttctctaatggccttgtttgtttttagctacaaggtgacatatatagttctggaatgaaagaggcgtcatcgggcagaatatttcagtggctgtattatgggcctagcaagtaacctgccttggaattcctctttattattttgagaacaaaggcatgccatttaacttttttcagcctcagttttttttttttttttccaactgtgagaaagagaaagtgtcacctatttcttgttaaggactaaaggtgttaaaatgctagaatgtctggcacatagtagatatttaatgaatgtcagtttatcttgtcttagctaagaattttcatgctttactatacagataactcttggattttatctgcattcatttcttctccaaaaaaagggaaccaggaagaagagaagcaaaagacataactttacaatgcctagctaacattatcaatgccaaacacctactggtcgtggtaaaaatgatttctacttcaaaagacaagattgctgtaaaaaatcattgctacactatgaagttatgctgtaatgttacgctatgaatttgttgtgctataaagaggaaagaagatgtttaagaacaaaacatgctatccagagcacacctccatttttgcaattacaaaatgtcttctttctttgcttctcatttctccagttcctccctcgtgacctaccttgaagatcacctataagcagaacatgataaatagcatgcccagtagaaatggtagttgtgagcacatttaaagtgctctgtgatgttttactctcagctgtattgaaatatagttggtgatgactcattctagaaatatgactattaagaatgagtacatttatttcttcaataataagaaaaccaacagaatggtaatcccagaatcttagttctacttttaacatttcacacccagtaagttggataacggatggcagagtgagcctgcgtaggtaataacttattattattacccttaccgtacatggcccttttccttgtacttttctccttgagccaataatgactttgatggttcagtctttctgcactttgtagaaaccatatcccaaacagtattttctagacatcaattctagcatgtgaaagaatctagacagcctctccgattttcatgcttctgggacagaaaagtatttatcacaggtaatgatgataatccagttaaatttgttatgcctttccttactttcaaagttaatttccatttttccattttggatgctgtgttttatggaaattgtctgtaaagagtctactagccttacatgtaatggtcagcagacatatttgatacctttctttttcctttagtaaaaggagttgtaagtaaggagcaagtgaaaagtgaaggggaatttagtatgtctcctatttggcagcaactgcgcatgctattcaatctttaaataatttttaaggaacttgtctcttattgtaaattatgtctggagaattagaagtgctacacataaaaattctgtctttggaatcagtacagatccatgttaacctcgttaaaatgatgacttctcatctaacttcaaatattcatttttaccttattaagtcatagagtttagctaagcactgagggtatgtcctttttgttattttgattctgaaatcctcctgatggtttttagggtagttatggttaagattttggtgccacgcctgatatttcctaccattactgtggtagtgatggatttcttctgtctggacctccgcttctagtggttctctgatctaagcatggttggaactttgtactgacctcatactatgcctagtcacagagcttgtaaaatacagccaaaattttattaattcagctatatctcttatctctagaattggatcatccatggctcctctgtcagagttgtgaaaatggtcagctttgttacgttgagcctgaagcactgatcccacaaatcaaaagaccacgtgactcaattcctagctcagtcatcttttctctttcgacctttgtgtatatacttagtgtacctgtctctcgaaagtgattccagcaacatagattacataccccacttaacagattaaatttcattagacttatcaacgaagatcctttgttgccatattgctgctatgatagtcctatataggaaactccagcttcccatcaggatttgaagctagactttaccataaattgcaacagctgccagcctgttgacccaagaaatgtggtgcattcaaaaagaaggaacaaactcagacaagtaaccagctctgtacatcaaaaatccttccggtttcggtaaactatcctgtgactatctaactttagtccctgaagggtattacgccttatttaccttacaaaactggcatcctagaccttcctaattgagttgaacttcaaattcattgtctaaatcctaagaaatgttgaattttcacaaaccccatttcctgcctgctctctccttttctcccatacatccaccatcagatttttttttgtttactttctctctgataattcatgagtaagtttaaaaaaaaaaaaatgtgtggccagagttttctgttttctgtagatattgctgtgggtttgcccatgcctagttccaacttttaaataaatatatataataatatatttatgttataaatatataatatatttgttataaatatattatatatttatataattaaaatcttatatgtaattataacataaatatatatgatattatatacatatatatatttctttttttttgagatggaatctcgctctgtcaccctggctggagtgcagcggtgcgatctcagctcactgcaacttctgcttctagggttcaagcaattctcctgcctcagcctccccagtagctgggattacaggcacacaccaccatgcccagctaatttttgtatttttggtagagacggggtttcaccatgttgagcaagcttgtctcaaactcctgacctcaagtgatctgccgacctcggcctcccaaagtgctgggattacaagtgtgagcccctccacccaaccgaaaagaaatattttgatgctatgaatgcatttgtcatttctattctgtttcatccatgtgttcttcttgtttacctttgtagtagtcatttacagtgaaaataattgacaaatgacatggtgttatgttcttgaaaacaaacatacaaacaaaaacaaaaaatgaaagcagacaaatgaacaaaatggccaagtaggtgtttaaaggcttaaattgagcaaagaataaaatggtattttttaaatgttaaagaatgatgatgtgttttaatagtattgttaactattgaatcaatttatgtttagtctgcttaaaattatatttggattcaagatggactactgctatcaattgattagattgaaaacaagcaagcaagaatctagacaacacaaatgggggaaaaaataatgagatgtattggacactttcctggctgtaggaaaagagctttgataaaaggagtgatgagatataattaagcacaaagtaacctacatgcttatttatcagtgaatctttcagttccagatcatttcttctacaaaaaactaaagaataaaaatcagtctttcagtcactgggtgacaggatgcactttgatttttccaggaaaggaaagccaggatcacaggcatgcgcatgcacacacacacaaacacacacatgcacactcacacatacacacacaagctcaagcgcgtgcacgcacagtactttggcaagtagagtgttagctccccaagcatgagcttcaggccagactcagtggctgtgatagacccatgcagccatttgacagattttgataacctttttattcaaagcagcatgaagggccaatgaaggattgctgatttttttttaagacaggatcttgctctgttgcccaggctggagtgtagtggcacaaacatggctcactttaactttgaactcctggacctcagtttcccaagtagctgggaccacaggcacgcaccaccatgctcagctaatttttaaaattgttgtaaagacagggcctcaccatgttgcccaggctggttgaactcctgtgctcttgccatccacccgcctcagcctctgaaagtgctgggattacacgtgtgaacaactacacccaactggattgctgaatttttataacatgtctctggtaactaagatcctttgaactatgaccattgaattcctaggacttgtgtgatctcagtagagcaatgactcacttccctcaggttttcagacttagaggaaaatccaaggatcagtctgtagtataatgctaggcatgaaaggcatgaggaaatgatgggagcctccagacagaaaaggtctcccactggtgactgatttctattcagagacaatgccatccctgtgattgaagctccaacacactgaaaaggtgtgaaaccaagaaaagtctctctttcaataaaagttttccatatttcaaaaattttcagaagtaaggatttcttaagggaaaagccatgaataaatcaggccctttttttttttttttgagacagagtcttgctctgtcgcccaggctggagtgcaatgatgtgatcttggctcactacagcctccgcctccctggttcaagtgattctcctgcctcagcctcctgagtagctgagtagcctcctgaggcgtgtgccaccacacccatctaatttttgtatttttagtagagatggggttttgcaatattggtcaggctggtcttgaactccgaaccttgtgatctgcctgccttggcctcccaaagtgctgggattacaggcgtgagccatcgtgcctggcctaaaccaggcctttttaaagaataggatcagaggtctggtttcttcttcttagcaaggtcttgttttcctggtaaggccttgttttctgcttagaggcatcactacaaccagcctgtcatctgtgaactcttcccttggtgggattcagaagtgtagctcctgcatatgtctctccattatgggagtcactggattctgtggttatttaattagaacatgcctcactaggtgttggctacacctatttgagctgaactagaaatgcaaattcctgctacacatattttgcattacaaagtgttctactttttgaaagcttttgagtaaatggcaaatctcaactgaagactttgactcttctacaggaactgcatggaaatgtgaggaaccgaattggaagaatgaacacagcctaccatttggttttcaatgctttgatttttaggtggctttgtagtaatggatggaaagaacaaagatctgtattaaacacatgcttgcagcgtctacaaaaatggtttatgttttaaaagaagcaggggaagacctcagtcattctgagttattacagctccaggagatggaagtgttttattagcccatatatatatagatagatacagtgctaccaggaaaaaactaatgaattataactaaggtcctatgtatggaccttaatattccttgtgtctgacgatgcaggaatttagccaggcaagctgagataaggccctaacctttgctctacttttctttttatgatcttcttccacatgcccttttttggtttaaatataaccaagatgatttccattagatttttctaacaactgcatgatgtgtgtgcgtgcgtgtgtgcatgtgtgtgtgtgcatgtgcgtgtgtgtgtgtgtgtgtgtgcatagcagcaaagccagatgatgatagcaggatgcagaaccccaattttttttaatattatgtaatgtagaaaaggagtgtgcacacctgtttgcttccttcccattgaacaacattaggttgaaagccaacagtagaaaaacaggtgcttgttatgtttgagtgtggagccccaaaaatggaaaaagaagaaaaagaaaaagcaccgggttttagggaaggcttctttaggcataatgtaaagttaatttatcattttggccctgttccactaaagacacagaatttgcggcaatactacctccccatggcctatttctctgaactaaaatgtacattttctttagagaagcaagaactattatgaccagctagtcctggttttgggtggcgggggtggcaagaaaaaaaaggaaatcgttttctttaagtaaagcacttaaaattatatgtttttttgaaactggttttattcctgttcagattggtcatgagtgaaatgacgtagagtactttaaaaagttagattttcatgtgttatttggttaccatagaatttgtactggaaacctaacagcagatatacatttaataacacaatgtattacagggagacatgttttgctactctgatcgtgaacttgggaacaaggaactcctgggagttgtgggaaaatatatggactgaaattagccaagtgttatggagcaagattcatatgctcaaacctacttttactgcttcgttgctttccgtgcagcaatttctggcctcagtgaggaaaatgttgtgtttgtggaaacataaactggctatttatgtccacaaccatcacacaaacacagaactgcagtgatttggctaaatggtatatagcaacgtgcagtctggggttttagagaggcgtgtttcaagctgcatgggcgacattctaaggaatattaggctttttacctgcaaagccactgttcaaagaggcctggctcaaacccgaaacacttggaagattgtgtctaaatcctagaacccactttttgctacacttttagggaggctccttgcctcaaagtactgaaagtttagattgtttaaaacatttgtcagaaatcatttcctggagtgaagatgcttctataactcataggcacatcactgccttcatcatctctgtaaaaaacatatcatttcaagccaactatggtattgtccatcttaatgggatcctttatatcaacagacacgtagtctagtgagattaggaaagcacagtgacagctttacctgtaacagacgttttagtgttaccggtgagtattgcatattgagaatgggcctcagttcctctgttaacatgatgagtgtttcctagattgcgtgaagagtaatgagaaaatgtgtgataagcagtttgaatgcctttgaaagaggtgtagtacaaggtgtgaaatacaaaggaactccagcagttagctcttctcaaattttcatgtatataaatataaagtagtgtcatttcctgaatatgatccctattctttttccatcattttcttgcaaacactgttatcctcaaaccctcttctactctcacctccttcactagtctcatctccatgttttcccgttccaaaggctgcaggagagaccattagtttcattaattatggccctactcaaaagcctaactctcttcatggcctacatattaaacattaattccaaccagattatcaatggcttctctggtatggttgcattattattttatagcttcattaacttcacctccttatttataatccatgtcctagtcaaattgaactgctgcctctcaccaccaaacatgacatttactttcttacctccgcatttatttgttttttccctttagtggaatgccatcttctcccacaaccataggccaaattcaccttcttaatatatgactcttttaatatagttcccattctcacatttattgttaaattcatgcctgactgacctaactgattgatattttctgttgctgctgtgaatatgatcacattatttcactgggttttcttgatggttactactggtatccaaccatatcatctccagatcgtgattattttatcttctcatcttctaaagctgtatcataatttttttattcctgccttactgcattgattagaacttttaagagcaatgctgaatagtagcactgatagtcaatatcctttacttgtgtttgacagtcatggaaatctcccctagagtttcactgttaaggatcatttagattattagctaaaagcagatattcttagtgatacagaatatcattctagttttacaatataaagacatgttttgaaaaacctaaaatcattatatttttgcatttttaaattttaaatataaatataagcatatatttaaacaagtacatatataatatccatttaaacatgcatattaaaaacctgaaaatacaagggattgtgtaatgaatctccatgtagccatcacccacttcagccgttatcagttttgtttcatcttcatcccagtcatttcccttctctcttactattttatagcaaatcccagacatcttatcatttaatgtataaatatttcagtatgtatctctaaaagataaggactcttctatttttaaatatatccataacatgtttgacacacataaaaattaatgataaccccttaatattattattcattatctaatccatgatcagatttcctacatttgtaactgtttgaatcaggatctgaataaaattcacaaccattttgattggttgctatatttcctaatgctattttaagtgttgatattcgaatttttctccttttttcactctttgtttgattctagccctagctccctttgtctcttttttctacgtttaacttttttttaaagaaaccaggttgtttgtcctgtaaagttctctgggttttattgcatcccctcttgatgccacttaatttagtccctgttggttacatgtatgtggatgtttgattaaattcaggtttgatttttaaagataatactgaatagttttacaaaaattgactttctaatttcatcaaaggttgattcggtatccattgaaatgaccatatgacttttatttgttgatgtgccatgatgtttttttttaaatttgttgaataagataatgaatttaccttatgatttctctcttttgacctttcagctactttcatttctaagtgggctttagttggtgaataaattaacatgtcattaaatgtcacatggtaatttcagtagcttgttgaataactgaatccttgattcttgttggatgttcagtcctctttgttttgatttgttttgcttggtacgaaagatttgactagtttggaaagtgacaggttaacattttctacattgacttgaccttcttccacccaaaatgatcctggtagaaaatgcagagtatagtaaagaatgtgtgccttccacatttagcctggtgaggtctataaatatatcaaattaagccagtcagatggcctgctgatatttgctttgcaggctagacggattgtactcctttagaatctaagtattgatggaaaaagattcaagggacagcttgaaagtttgtggactccggctatggaaattttatactcatataaaactgtcagtgattagtagaaaatatgtagcagaactgtgtttctggaattggcttctcagctaagaaaagattattggctttgtgaagaagaaaatgtagctttcttgtaactccatttagtcaattatccactatgggaagatacttttcttcttctttggaaaagctatgacatcctccatggtattcgtatcattgagatgtttctcctgagaaatagtagacttaggatgattagactgtgccatgagtaaaatgcactgtctgaaaaaaacagaaaaaaaacagcaacttgtaggtttgaaaaataacctttcctggcaatcttattattctaaggataacactgtctaatgacaccaaatcatttgctcagccactgctgggaacttagaatctgctttctgtttagctacaaatgagatcagtgttacaacaaaaattataattttgttttatcaggagaaacacccaaaggtcacttttcattctgctgaataggaagaaatgatatcagggtctgcccagaaagcttgtaagggagaaaggaatcttacccacttaggaagcattttctaattcacttatgtgaccttgggcagccttcccctgtgcacttttgtgaattcttagctagaggtattttactaaagactgcagaactattcttttgagatgatctgtatcctcctttaaaatataggataaactataaaatgtgctaagatccttgatagtcctatcattctatatatgtttgaacaatgccaaagcccaagttcatcagttaaaccagttaatctccattggcccttggtgtcaacttgttctttggacaaagtgtcaccttgtaggaagtctacaaacctctaagtgctcccagcgtattagctaagtcctgagctccatggagttggatgccctaattctgctttagaaagtcctagttccattaaccgtctcctgagaattctcctggcttccctttttgtttcttgagcagagttcagtcaaggagaggtcaagagagatgatacattacttccagtcactgtattggctctgggaacctccaactctatgcaggttctttgatctcctctggccactttctttctttttcaagtacatatttgctattcagcaaaggattgaatgacttctcaggaaaaaatgccaacccagaatgacaaggcttccgtggttctgagcctggctctgaacctttcctttggaaaactaatgactccacctatcattcccttggcatctagagaagctacattaggtggcacagctctttctgctcagcttctgctccagagcttcatcttcaggaaccacctaagcatttttttccccagtaggagttcagtctgctcattatacctaattgcaaaggagctatattcagagcaagaataataatttcagattttttaactggacttcaaagagcaggaaagtatgcagattcctaaacacataagcattgaagatattacaggtaaggttaaaaaaaatctgtaattttgtagtgactagcagtttaatattcaaacatttaaaatgtgcatattttattaagcaaatggcgtagagttatttggtttaattttctgtaagtaactcgtaaagaattgtcctaaaagctgtgggtgaggactaattcattcaagggaaacaggatctaatgattgctttgtgaggtatatatacactgtatactcatgctaattcctgctaattgtcaaagaagaatagtggctttttatcagcagtttgcatttgtgtaatggtcctggtctactggttttgtctacttcactgataaggaaaacaccacttaaaacaagcaagaaaagcaagccatcctttacagtattattttctttttagcctgtcttgagaagaaaaaaacctagccttctacaggaaatactgtttgattccatgggaaaatatttagtaacaagcagagaacacttgattatttctcagctatttattctgagtatttacaaaatgggcaatagtattatttccaaaatcttaagttgtaaacgaagtttatattacagtctacatgctatggatatgacactattttaaaatattttatactttaaaaaattgttataacacataatacataatattgtaagtaagtttaattcttgtaatttggaaattcagtcagaaatattaaagaattatgtagatcttgaaagggtaaaataatcctgcatttatgatattaatttctcttaaattgttcaattttattttataaggaaattaagtggttatacatttttgacaagtagttttgataaagttaaacacagattattgatatttacttaatgctttataatcactcaatgattgtcactccaaattaggccatcttttttcacattttgcagaagaataatttcctaagaaacaactattgaggcttggttatatatgtaacatttcagtctgggcagaatttctttttttacttttgtttgctcaatatttatgtcattagtaatagtaacagtatcatatatttgtgtgcagtgttgcaactgacaaagtgttttaataaacttggcaacaaccctttggtatccatttttgcagctgaattttctaagacaggtagatagagagaagtcccacagctaataattggaaaattgtgccttggacctgattcttcccagccaacttcagtgttcatttcagtacattttatctatgaagggtttcttctagggagagttggtcatggtcttacaatttttaaccccagtgattttggttgttatcattatgtcttgcacataataaacagtcactaaagaattgtgggtcaggcgtggtggctcacgcctgtaatcccagcaatttgggaggctgaggtgggtggatcacgaggccaagagatggaaaccatcctggccaacatggtgaaaccccctctctactaaaatgccaaaaaaaaaaattagccgggtgtggtggcgcatggctgtagtaccagctagctactcaggaggctgaggcaggagaattgcttgaacctgggaggcagaggttgcagtgagccaagtttgtgccactgcactccagcctggcaacagagctagactccatctcaaaaaaaaaaaaaaaaaaaaaaaaaaaaaacaattgtggaaggaggtgaggaaggaaggacggaaataaggaaggagggaaagaaggaaggaaggaaagaaagaagggagggaggggcaggctgaaaggaagaaagaagaagggcatgaaggaaggagggagtccttttgtgtggtaaaggatttttggaacctctaaatgataatagtagtcccccagttctcagctatttcagagaactgtccagcttccccagcaatgatcatttgtcctgaccttttttgccaaggcaaaccaggtctagagtaaaatactacaaaatacattctctggtattaaaaaggaatggccaaaaccgtaattacttttgcaccaacctaatagtaagtttctgctttaccttatactttcttccttataatactgtagttgttgacataccaaggaaagtgtgtttgggataaagtggtcacataaatggcaaacatcaaagtaatgtcagattttgtagtgtttctaattgctgttcattttgtagtcactagaagacaacttacaaattgtgaaaaactagtcataaatcagagggagacaaggtttagtgagatccagttcacctccttcctggaacaactattggggggtatcatcttttatatattgaaacatattttatcttccaaatctttagtttacctttaatacaactcctcccagcccccccagaaagaatgctgtttgctctgattggcataggaccggctttgtcggtttcattacatcctggttgaattaccaaatggaaactgatttaggaatactgagtgtgtacggcacagagaaaaaatatcactgcgaaatttataggcctgtgtaagactgtcagggccctgtgttcaaataaagagagcaaaaggaaacctggcgaaaatcaccatctccatcccggcttcttccgacaattacaacttattcctgtgcttggctgctggtttggagcagctgcatccactcaggtaacacttcgcatcacctgggagctcattgttgccttacaattcgtgatcattttttgatctcactactgctaaaggataaaagtgctaagcataataatccataactgtatgagatacttgctacttcatttccctccaagaatcattttgctatgaaatatcccattactagtttcaggtaatgatctaagaattttttaaatgactatgtcagagctaggggcttcaggatagcattacaaggataatcatttcagagagttatatttttaaggccttttaaaaagagggttgtttctagtttttaacatatttgttaatcttattttgatgatctcataaaatcagagtctaaggaagagatgtgtctatgtgttgcttatgtcactgcttttttttattgtttacattttataaggagtgtctacatttgggggggagttggaatgttggttttgttgtttttagcaaaagccttggcatttgtcctgagagagctcatgcagtgtttgctgttcaggttgcatgaagggcaatctttagcaacctgtcagagatgcaaaggccactagggtctgcttgaggttcagagttcctctgcaggactgcgtggtgacagcacaccacaggtggcccattcagcactgtcatctgggacagcaaggataccctgctccatttgtcatcctatggaattctgtcagcagttgaaagcctttcagcacaaaacctttaacattcgaggcaaacttcctaatttttttttttttttttttttttttttttgagacagagtttctctctgtcacccaggcttcagtgcggcagtgcaatctcggctcactgcaaccaccacctcccaggttcaagcgattctcctgcctcaacctcctgagtagttgggattacaggggcacgccaccatgcttagctaatttttgtatttttagtagagacggggtttcaccatgttggtcaggctggtcgcaaactcctgacctcatgatcctcccatctcggcctcccaaagtgctgggattacaggcgtgatccaccgtacccagcccatttcctgatatttttaaaggcaattgccgtggatgaaaatattaatacatagcacctaaataagtagttttttacatgaaaggatattatgttaagattatatgctgtgtgatatatagaaatgttgtatactccatgattttacagaccaaacaatgcaaatcatgtttcccctcttcttaatgaagatgttaaagtataactgataattgatggtaaaaatcacctgtctactcattctttcttattccttttgtttagtttgtttgctttgtaagcctggaaaagatgccttgaaatgtattttgaaaatagctttttgttggagtaataaaaaattagtccaattcttatttatccatagtaatgattccagaataacatgcacatccttaggaataaagttctcctttaaaaaaataaataaatagcatacatctttgaagtccccagatttccattgtcaagatttttctctcttatacatacccaaattaagagccttccctgcttgcccattaatatttgctattattcattgaatgccaatttttttttgccaattcctttatctagattatttataacctctacagaattctgtaagagtgccattacccctcttttcttaatgggaatattgagcatctgagtggttaaatgacttattcaaagccagtaggagacaagacttgaaccacatctgtctccaaatccaagttgttttgagtgtcttttgctgttattcgaaaaagccatgctgagatcaatgaaaggggtccaaaaacatgccttagacaggataataagaggtaagcaaggccatgagtaattcagaaatggaataatcagatattgagtattccagtcagatagaataaaaatcaagcaggggagaagacaaaattaggttatgtgtcacaacaaaatgtagactttcgaaggaaatgaacaggaaaggcagaagaaaatggaaaagtaatacatggcaggtcaaataaaagtaaacaaggtcatatgaaactcacatgcaaataataaagtagaaactagtaaggaagacagaaaggaattaaaaaggaattaaaaattcataagaatgttatcagtagacaagacaaaaaattgcctctaaagatggatttttttttttttcctaaaagagtatatagaatctgtactggcttgatatactggttttgcttttcatcctgaaaatatcattgataaacattgtgtatattagactatttttggttgggactgagtattgcccatggtgttcccaatgatatgagaagaaacatcctggtactaaatgccctggtggcctggggctgagagctttggctttgtataattcatgcacccactttcatgtaacatgaagtttgacaagtgaatattaagttcattatatgaaggtgttgcaaaccaaacttgaaacttatttctacctctcattctaaatggagatattttgtagtgctttagtctacatttacagtgatattagactctttccatttccttaaaagtatgatggcgtttggacattcaaccatgttcctctaagaaattagagtagaaaagaaatttagaagagaatggcttctaatctgcatgttgatatgtatctgactaataatctataatgttttcatttggaacaaataagccaacttgtgtttctttttcaatatatacatcatgtctaaaaaatgtaaagtcaataggcatgtaaaacatttcaaaaataaataattttatcaattgattgccattaaaaatagatgtctaaattgagctgcactgacatgactttataccattaccttgaaccttcctgagaaatgtattttgcttaatgacaatagagcttctcttttccaactacctggaagataaaatattggttaaaaaatgttgagcctcttttcctatttagttatagtaaaattagttaactctataattctctcttttataatttgattctatgtagtgagaccacaaacagcttaacttctctgctattgtttgtaaggtctgcaagtttagtgaaatctgtaccttatatgaactcttccttttaggataatttaagattaaaggctgcttagaagggggaaaaaaagtccatgttaacctttctcctttctctcctcttcagctacatctacatccaccactgggacaagccatcttgtaaaatgtgcggagaaggagaaaactttctgtgtgaatggaggggagtgcttcatggtgaaagacctttcaaacccctcgagatacttgtgcaagtaagaaaagaaatcctgtgtgtcgcttatgtctataactccttgtttcagatgattctatgtctcatgatgtattgttgctttttttccaattttgttgcatcatgttgaataatgctgttttatatgtagagtgttttaaaacattcacaccattcgtcatcactcctctgtcatatgcagaattgttttttgctcttttcaatgtgtgtgaggtgttttttgtttttgtttttgttttttgccatgttatttatagtgttgctttccttgtggtttttcttgttgttattcagaaaagatgtgcagatatcacagaggcctataacttttggtatctacttctacatccaatgtatgaattaagctgtaagataatgttgctttcttatcccagtgatcacctgccaaatgaataagacaacaaagagaagcagaagggcagaagattatttactgacatatatctattacacttgggattgtcttactgttgcataactattttttaaacggagtttagttttatattgctagtaaaaaaagagaaaaaagtaaattgcatatatttggaaatacattgtatgtagcatccctgtgggtgacagcagtgttctttcatttgtctatagatatatctagaatagcactgtctttccaatgacctgaaggagttgatgcaccattaagaagtatccaatttaggcctgggcacagtggctcacgcctgtaatcccagcactttgggaggccgaggcgggcagatcacgaggtcaggagattgagaccatcctggctaacaccgtgaaaccccgtctctactaaaaatgcaaaaaaaaattagctgggcgtggtggcacacgcctgtagtcccagctactcgggaggctgaggcaggagaatggcgtgaacctgggaggtggagcttgcagtgagccgagattgcaccactgcactccagcctgggtgacagagcgagactccgtcccaaaaaataaaaaaaataataaaaataaagaagtatccaatttattctctctcaacaggcagcgtaagatagtgatagtatcagtacattaaatatttaaaccttgtagtaaaaactaataggactcattaaaaagtatgtttattttgccatgcattttaagtttactgttgatatttagtctacatatggtatatggacttaaaatttgatgtgggcataaaaatatatttaatattttattgaaatgatgaaaatacacctttgttttcctctttaccaacagctatatcccaaaagcaaggtattttaaaagtcgttccttaaaaaatgtaatgtagaacatctaataaattttgccagcagtccccagcgaaaacatgcagtggggacattattctaaagcagcaatgcttgttctaaaggagggaaaaccattttgtcacaaaaactgttttctgctagaatattggcgtgtgacttaaatcttgacaaggaagaacaagtctgttagagaggcaattgaactgataggagcaattagcaaaatgaaaaaggcaccagaaatagtcaacaaagccatgtcccttttacatcacagaaatactatataaatatttaggtgccaattctaataaaatcttaattatatttataagtaaggaagtgcatcttaaaaaacatatgttttaaagacaaaaaaagcaacgatcgaaaatgccattttgtaggccatgttttgctgctctctgagctgtggtagattgggcgtgtctgtagcgtgcctgatgggacctcatggctctgaacaagcaccttccagaacttctcctttgttgcactctaaagctcttctttgaaaaaagtagatacagtgccaagacaagtgttggtggttgtatagctgattttatcaaagacagacaatttgtaaaagtaaatgtaatctgttagagtgaataaaagacttagagccagaacagtaaaattctaatctcaattactaaacatctctttcacggaaataaataatttttataagccaaagtgaaatgataggtaaaagtcttgcaaaaaatattaaagcaagatgaaatacgagtatgaggccaggtgcatgcctgtaatctcaacactttaagaggccgaggcagacggatctcttgagcccaggagttggagaccaacctggacaatgtagcaaaacaccattgctacaaaaaatacagaaaaataattagccgggcatggtggcatgcacctgtagtcccaactattcgggaggctaaggtggggggatcacttgagcccggaaggttgagcctgcagtgagccaagatcatgccactgcagtccagcctgggtgacagagtaaggctgtcaaaataaataaataaatagaataaaaaattaaaaaaagagtatgtagaaaagatcattccttttagatctgaattatctcatacgactatgtttattgtttaaaaaataatcttagagattcacttcttggtcactaaaatattcaaatctatatgcttgcagcagaataaaaatctgtctgatttagtctttagttctgctgacttgctgtgaatacagcacaaatatgagacatccccatatttatcatagcaaattgggatgaaccaggtttttagtttgtaaggttttctctgatcaaaatagaaaatgccagaagctgagaattgtaatctataaaatatgaggttcatttgttatatggggaaaccttgttattttttcctaatcttaagcatacagtgtaattgtattttaataaatctccttgaaaaagcatttaaattataggtccttaaattcttctcctttttaaacagtgtacccatattatctatgtctcatatttttacttcttcagaaaagcatctgagaccactatattttaattatagtaatgaaatatgatcatttttcatcatcacttagcaaagatttacaagctgagtgagtgcatatgatagtttctgcatacctctaaggaaccagggcagttcttttccacatattaatttcagctattctttagccctcccacgtccaatacaaaacatgcaatcgcgtaagtgctgttcagttttttcattttaatattgtgccaacaactgcaatttttcttcactcaacacagtttctcattaaatcttaagcctaatccagtagtaaaaacgtgctatattttaaaaatcttgaagtgaaacatttgttactcttctgataattattaaagccccaagccatcctctgagctaattgtctagtggatcattcttgccttctagttctaagaaattacaccttttttttttttgtaattaggatcttttaggtaagttatttaaattattactggatcttatcagaaagaaaatctttgacatctatgattttgataacttccccctcctttgagatggtgactttattcacatattaaagcaagccagaaccttgagggaagaattggagagtatattttacatccaaaatacttcaaacctttctcgttacatgaaactgtttttatttttttaaatcctgtatgtaaaatatgtatagcattaaaaataatcactagtcagaatttaaacaaagacataatatactaggtcttatgataatacattgttcactagaccacttgaatagaaacagaagacataaaaatattgcattggctcatcatggtcctgtctatgaagccagttcatagtttccatatggtctatctgtctagagctaagcattgctgaagcatgagccacatcattgaaaatcagctttatccctgactaaagacatgactcagaaacaccacaagcatggaagtttccaagtagtctctctggtcacctaatctgctgttgtcttcttgggagttgaagtagaagatgttacagcaaatctcttttgtctctctgcttagaacaaggtgtttcgaatggattaaacatattaacagtgaaaaacttctctgaggagaggtttccggattgcttggacctcctcctggggactgtgtgggaatttcagtggtagttctcatcttttatattttgtttctctacagtaatttaaaatttattctgtggaaaaaatagttactattccagattataaaaagatgagaaaagaatcattccattttgtaccctctgatgctttatgtagtcctgtggttcaaagaaacaagacacatgaaatcaaacatgaaattgtccagatttcctcttgcatcttttctctattcttgtgtatctgttcttctgaacagtttcagtggagaactactttggaagatgttgatgtgattttttttaatctaaaaattattttatatcaggctgtgcttataagtccaacatgttgtccagtggacagatgtgccttcatctggaggggattagagttttaaactaccaattttggtgaacagtcttatgtcctttcacttcaactctctggacaatatatttatttataacatgaagttaatatgttctccaaatttcttcccagggagtcagtgaaattaaatgagttcatttctgctaaagtacttttaactctggggaagcaaaatttatttttccttataataaaaagtaaatggtagtattacattctctcagtagacattggaaaaatatatacacctgttttaacagactgtgttatcatgtttaatttctttttttttttttttttttttttgagatggagtttcatgctcttgttgcccaggctggagtgcaatggtgcagtctcagctcactgaaacctctgcctcccaggttcaagcgattctcctgcttcagcctcccaagtagctgggattacagacatgcaccaccatgcccagctgattttttgtatttagtagcgacagggtttcaccacgttggtcaggctggcctcaaactcctgacttcaggtgatccacctgccttggcctcccaaagtgctgggattacaggcatgagccaccatgcctggcccatgtttaatttctaattctttattttacttaagagtagcagttttatttggtttgttgggaccaccaactatctttataacttttctttgacagatcgtttaatatttctgatcattagtttccttataatgcaaaaacaacaaaaaacaaactaaatttggaaagatggaaggtatctgtaaacatagacttttataattttgtataatgaatgtttatgaagccatgtagggccttattatattatacattattataagagacaggtatgaaaaacataactatgggagacaaaatcacagcaaatataatactttaagtttgatagataaaatatttatcaaacgtatttgataatatatataatgtaaatgaaatatttatcaaattatgcctgaggtcgcaatttttttaatttttgcaatcagaccttggcaatgaccttgagcagtagggtattaaaatcttccacaggcttagcgtcccaataatggaacactaagcataaatggattaacatttgtttatagaacagctatttgccaggcactttttaaaacacagagaaaatataaggaatggtgtctgatctctgggaactcagtctgttaaagaaaatgaaattgctaaaatagaaaatcaatgagtgaatatatgccaaatggtacaatgctgactattaaggtaatacaaatttaaagaagggaaagaaaagactgaaataagttagagaagactttttaaatataatcatcatttatagagtctttcctttataccaggaaggcattgtggttgtaggaattctttctctgagacacggtaacatgcagcttaattctaggaagtaaaacaaacaaatgaacaaaataaaagaactaagttaaacagtggagccacttaatgacctctgaaggtcaggcagaggactttgggtattgtaatagctaacagggagccatagtaacatctggagcagaagagtggcaccatagacatagcagatgtttagggaagcgagtcttccttacaggctagaagaagtctggggactaagtaagatggaaagagaaagtcaaagacatcaaaggcactagctaaggttaacattttataaaatactgacataatgatgctgatgatagtaacttttataatatgtattagtagctgaattaatataattaaacaagggggcaacggtacaaactcacagttgtgtcctgcagtctcatcatcatggctgcagaaagagaaatttggaaaaaataaacaggactgggttagaacttccagtctataagaacacacttttgttgtatttgtagtatttgttgtatttgtagtattgctgctaacaccaataccagcctagaagagttctttctttagaatcagtgttacacttgcctgtggtacttctctgttcttgaatattgtaacatttaacagatatagacagcatttgtgagagcaagtggtgggactcatgtggatctagatagtgcgctcttcagacgactgtgtcctctatttctttcatgtcctcatatatctagaatcctactatgtgcttatgaggaatttattaactcatttagacttttaactcactgaagtagggttgaagaaaattctttagtttttataggattcagtttaggtgtagttttacctaaaatcaggtgcattgtctaagtgttctgaatagcttcattcctcacttataaaaatcagttgagcagccatgtacatttattgaactcatatgagacaggctctgtgctcatgctacagacaaagtagtgaacaaaaccatactggtctttgcctgatggagtctgtaggctactgcaagtaacaatcatgtttcatgtaattaattgaattataaatcacaggtttgccaagtgctatgaaggatattaattgagctaagggaatgtacaatgaaagacctagtcagaggctgactctgctctgtggaaaaaagaataaaaaaagagtatgcagtcatactcttcagatgtatatagagtcaatttaaaatatttcattgtgtatatataccacattttcttaatccattcatctgttggtgaacacttaagttgattttataagttggctattgtgaatagtagatttttttataacttggctattgtgaatagtggattttataacttggctattgtgaatagtggatgaatattttagctagattgatttaattattcaacgttgtattcataaatcataacatcattttctaccccataaatgtatacaagtacaaattgtcaatttacaggaaaacgaatacacaattttgaaatatttatattgaatgatttaaggaaaaagtgaatatttagatgttttatcacagaatgaggctggtgaagtggataaggctataaagcccctcagaacccctaagctgtttgacgagacagggaaacttcctcaagagaggaaaaccaaaccacaaattagcagtcgatatgtcattgtgtcacaatgacgtggagatgtatgggatgtagattgatcccacatccaatgaaattgtttgacccccaacttaaggattcatcatgtagagtaaacatgggcaagggttttagtctttctgcagatgagcatttcagagcaagctgtgcaaacagagatttaggaagggcaccaaggttcaaacaagaagttaattcacaaacaccgccaccctcattattgggattatatgtcctggacattgaaaaacaacatttgaaaaggcaggacaagttaggtttggtttggttttgtttttttctcagcatttacccatgagtctagtgtggccactctatgtatcctcttatctcatggattggaaactagtccccagattgtcattaaaaaaaaaatggaggatatatactgtctgaacagtggtggtgagatataggttggatctgaaggaaacattactggaacattttatatttaatattttctttaatgatgttaaagaaggcattcccttggggaaataaatgtcttttgcagatgatgctagaaagaacgctaaaacacaaattagaaaagcatatgcaaacctcaagaaacttcacttaaaggtagataacagaatgaggttcatcttggaaaaatgcagactaatagtaacaatacctttgggaaagaataatctacaacacagatactcagccagtgagtgggcgagttctgggcagaatgctgagctggctaagaggtgagaaaagtcaatgtttgcaacacgatactgtaggaaaacagaccagcatagttggagctggcgtagacactgccacctcgagtttacacagagagagagcaaaggctttggtgtctgatactttctcaccaatattccttgatagagatttgttgatatttctatcatttaatatttgtaaacataggcatcaaataatttcaaataccacagctagtattgaggaaaagcagacagataatagggacttttcatttttcgacaaggtattttttaaattgtccaaatatttcactgtggaatgatgactagagagagaggaaatatcagctgtatttttttttcttcctcttgttcctgatcaagggagggtttgatgaaaatgaagctgagaagagaaaggatgtctaaggatggtttataaattgaccataaatgtgtggtttataaaattagccaaccctaactagaagtttcttggggtccgtgaatatctataaaaacgtctagaatctccaccaagaaaaaatggaaaataatttattcaattggaatataaaaaatacaccaagcattaagtttatttcaaaatacatacatctatgattgattacatagtaagcatatcaggatattaacagtatattgaagttattattaaccacagtttttattatactggtgctgggcagaagtttggttagtagaatgcactgctttattgaatctgaagtaaactggtatttcactaatagtatttaaattcaagataacagacttacttttaaagaatcaaagaatcttttccaaattgcaaacatgatgttaaaggattttattggagggagggagactgtgagaaggatactgggaatttctgtaaaaattatttgagggcaggcacagcagctcatgcctgtaatcccagcactttgcgaggccaaggcgggtggatcacctgaggttcaggagtttgagaccagcctgaccaacatggcaaaaccccgtctctactgaaaatacaaaaattagctgggcatggtggtgcatgcctgtaatctcagctacttgggagactgaggcaggagaattgcttgaatctgggaggtagagattgcaatgagctgagatcttgccactgtactccagcctgggtgacagagcgagactccgtctcaaaaaataaaaaaaaaattatctgggagtccacagaggagagtgtatcataaactataaaaataacagacagatgttcaagattgacctgtgcttgcaaatcaattaactgtatgacaatcttcctttttttttttttttttttgagatggagtctcgttctgtcacccaggctggtatgtagtgttgtggtctctgctcactacaacctccgccttctgggttcaagcgattctcctgcctcagcctcccaagtagctgggattacaggcgcccaccaccacgcccaaccagtttttttatttttgatagagccattcaccatgttggccaggcttgtcctgaactcctggcctcaagtgatcagcccaccttggcttcccaaagtgctgggattacgggtcttagccaccacacctggcctgaaagtctcctttgatacaattgtggatcagatacggacgctgtggtctgatcttaagttcattttcacggacattttgtgagagcctattatgagccaggcattgtgctaggcattagagatacaaaatgatcagaatgtgatcattgtctgacagaatgtgatcagtgtgtcacagatcatcacaatacagataagtgcagtgaaagaggtcaggatagggtgcaatacaaaaggcaaggagagaattctccccagagcatagaagtgggtgatggggaggtggaggacagggaaagagtgatgcctaagttcagaaaaaactgtgaattttcaccccattaataacaaatatagaacaaacatgatcatgttaagagcaaatactaaaatttttaaaaaccctgatttccatcttctaatctgattaatgaaacgaatggtatatacatacacacacacacacacacacatatgtatatatatttaaagctacaacaagtacttgttattcagatccttagattgttctcagacataaaattcttggaatttgctcaaactcatgccaaagcttatttttcaaactcaggtttgatttactgttattcttatcttccaggaaagtgatggattgaatgtttaacatacaatgttgataatagaaatgtatcagaagccagtctccctagtctgttagaagtaattccacagaatttcacagagcttatagatcaactgggttttcatttgcatgtgctttctctacacaatcaatgcagtgtgcagtttgcatatgcagaaactatctcagtttctgcttttcccttccatctcatttggcaacaaatttagatgtctctgaaggctacatccttttgttgctgaacacttgagttgcttgggcacttgcagtttgttttacctcaacgattgtcttaaaaatccattttatcaagaaggatttttagaagtcattgagttctgtcgtccctgactggtaatgcattcagaagaaatgatgttggggttttctagcagtgattccatgtgttagaataagtatcatttcccagaaccttagtgggaaaagaggtctttgataatcacttaattacattccttcattttatcactgaggaaaatgagaccccgtaaagcaaaatagcgtgtccatgtgcaaacagcaagataccacagtgccgagagagggcgtttgcctcccttttcccagttcagggcaccttacgtcttgaactttaatctacatccacatctcttagggatcttgttaaaatgaagcttcttattccatagttctcggctgtggcctgcgtttacactagcacactcctaggaaatgctgatgctgtcagttctaagtaataacagggtcttataacactaagaaacaatgctgagaaaattcatctcccaaatgaagacaaacactagcaaaaggatagttctggttgagaggtagctgctatttccaaaaaatgactttcatacctcaagtagttctggtgttagtgcacccagttttccgtatgattttatgatagagataagccatcatcttatgctagcttcctaggaaacatcatgttagaaattcatagcagttagaaaattgattgggtaggatttctgactccctttacctagttgtcttgtgccttctgatcacagaactggttataagatgcctaatgacaatttccttataaatgccttccttctcttaaggaactcgtgattccttagctatttgttaatttaatgattcttactaacgtaagggcatttcctgccttgagcaattgtgtggtgtgtgtgtgtgtctctcttacacatacacagcgtgttcacatatcttatactatgttcttttgtaagaaacaaatggattatttgtgctcagtatgagaattttaacttttatcaagaattcaaagaagcaggatggaatgataattactgaatacatcattaattctggaaacacctgctttaattatagggtttgtctatatgaacttatagtcctggtagagaaacaaataaaaaccctatttacttcagaaataattttgtcaaataagttatatgaaaaaagttcccatgtgttttttcttatatacgttcagtaagaatgtgaagacattcttattgaagcatatgaaatggcgtctttttgagaaatgacccaacctcttttttttttttttttttttttgagacagagtcttgctcttgtctcccaggctggagtgcaatggcacgatctcagcttactgcaacctctgcctcccgggttcaagtgattctcctgcctcagcctcctgagtagctgggattacaggcgcccgccaccacacccagctatttttcatatttttagtagagacagggtttcgccatgttggccaggctggtctcaaacacctgaccttgttgtgatcttcccacctcagcctcccaaagtgctaggattacaggcatgagccactgcgcccggccaagcttatacttcttattgacatgtttctcaaggtagctcttcctctattccctgcagcaaaaatattctaaacaaaaataatccgtttacttatatgaaggtgtttccaagagtttgaaagagctgtgtcaatataagatgtttgttgtttaagcttaaacacatactcacagggcaaaaaatctgaaactgctagtattttatcgcgcaggctattttcataaagtaggagaattacatataccaagtcacttggtgaattggtttgaagggaaatgaaattacccctatattggtaacaaggaacagttttgttcatatctctttgatgccaaaaatatagtatgtattcttatttactctgtagtgaaaagggttgtgtaaaaatcactagggatgagctaccagagctaacttggataggctctttgcttgatggttgctgtatagatgaactattaataataattatgatgatggatgttgaggattcaaaatgatggtctttctatctgtaagtatattgcttcctagaacctttcagtggccctttttattagaggatatactggtaaaatcaatcctacttaaaatgctttagttattagagtaacagcaacagcaacaacaaaaaagtggtaattataaagagcttccatatttaagcacagccccattgcatgaccttaagaacaatattatatcaagattctagaattttgatagttaaatatatgtgagtgaataacatgaaaaatgttatacagttttaaaaatagtttttccttaaatgcaaaatgacatgtattaagtaattctgcataagaataactgatctaaattttaaaatgtatttgtctttgatttgggataatgcaattaagtgaaatttgtcttgataaaaatctgcttctagtatctttgaacattaaaaacaagagtttatttgtaatgtctttttaaaaaacagggaatgtagtttttcttgtcaataatcattatagtgtgaaagtacttgacttctattgtttaatgacttaacttgtaacataaaacacccatgaaataaatacacaattgaaataagtatataaaagaaaaagctcaagatcatttattgataagagacagggatggaatcatgttagcgcttatcaaaaccagtgtttcaacatagtgagaatcaatgatcagtggcaaatagggtcatgccaaagggaaattgacagctctccgggccatgctgcctcttattccacatttcaacttcactctagttaaatttcagttaaccaatcatttgaagactgaagcaaacaacaacaaaaatctgtaacccacagttttcgtgggacatggttttctaaatgttgtgtcttttcttttctttatattgcttggtaccagatcatttttaggaatctccatattccataggaggaaaattgccagtctgaaagctcagtgtctttagcattttttttttgcttaccacatttttgccctctaggtgccaacctggattcactggagcaagatgtactgagaatgtgcccatgaaagtccaaaaccaagaaagtatgtcaaaataatctgaaatttgctttctcccccaactacagcaacaatcactaccacttggtgcttttacagctcagtcgtaactgattcattttgttctaattatggcttaacctctcaaggcataaacccattcagtgttaccttatttaactgtctctcaaagtgggtccctaagtcatcaatttacaagaatggccagtcacgatggcccgtgatgctgacaaactattgcaggcaagccaaccgagaaacattttcttccaacgtgtgtgaccaaagccatcatatggaaaactgagatgaataaaacatcggatttcattttaaggggttccctttgaaagaaggcaaccacttaaagtgctgggatctttccaccataccaacttaagaactgcattctgtccaaatttttaaccatttgggggaagtgccagagcctgaaagccatgatcagggcaaagattcagttcctgagggtgaactcaccaagtttcagtcaaatgacactgaaggagcttctttctagcatatattcacctcttctctttttctctgtttttctaccattgtttttttgtttcttctctcaggtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaaggagttcagatgtttttcttcattaaccaa

SEQ ID NO: 903 - DNA, 180409 bp, Homo sapiens; identical to SEQ ID NO: 900

SEQ ID NO: 904 - DNA, 212780 bp, Homo sapiens
gaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccaggtgggtgcgcagcgcggcccgggccccacgatcctcctcctgctcctcctactcctcctcctcctcggatgccgtggcctctccctccccctctccctcgcccgtcctcttcgccctgcgctctgagcgcccgttgagtcgcgcggtgcttcccctcctgggggccgccgctcacctgggcgccgagtcctaccgggcgcctacgcccagagctcagggcaagggacagcagtcccggccgcaccctcccagagtcccgggagcgcttcgctccctggcacggcccctccccagcgccttagcggctgagcccagcccgggagtgggacctgggctataggagtcgaggctgcgtgcgcgcgtgccccgcgccataagcgctttgcacgggggccgtgtgccctctagcgggaaacgctggaatgggccgcctggagggagagccggtcccctcggtgtgcctggcagcgcagaagtgggtggtcgagcaagaggccgcgtgggaagttagcttcggcgttttggggcacagggcaagcgatgtagagtgcgcgccggttcatcttgattcagtcctgtgctacggagactcaagagcagcggcagggattcctaaaggtcagcgaagcagatgaaatctagtccagtgtcaggaatcagctctgccccaaacaagttctacaaacttttggcttaacagttctatttttcaagacctctgtgataaatatggataatttactttcccaagagatgtaagaaaacaaccgtttatctgaatttttgaacccaattgtttgctggttatctatataataaaatggcaattgaagctttctagaaacaaatcttgtatttcatcatcagaacacgagcatgaacaaaagctttaccttagatgtccctaggaagcgctgatgctttggacattaccttggacaaaagaggcatgtcgaataaatacttgtttatgagtgattggtaggtagctgataaaagaggggaggaaggagatgggggagaatttattttttgcctctgcaattcccaattattaattgatccagatgccttaagtcgcttcgagcgtacccccaacacacatttcatgaagcacttctgcagaattaattcactagtacttgataatactgtggctacagtaatactgtagaagtatttgtcccttgctggaagaaaacaaaccacatttgcttggtcttcttactggtatcactgatagcatttcagaacctgggttattggcagagaccttcagcagagttttgagcaaaacagaaattgaacagagagtaattgtttcaccactggccattcttgtgcttgcttctttaataagatcctgctgatcatattcacttcaattactgatcattgcccctcatgagggtgtattgaattttcccttatttttaccctatattttggggagagaccatagcactttattcaacaagataggaaattggggagctggattagttacctccctgcgtgactttgtctactgtcctttctaaggtcatcatagtacattacggagatttcagacctagctcaaatcgttgtaaagagttattttgggggctcttatcactgtttgtggttgtgttctcctgtctccctgctcattggcttcagaagaagtttctgtggtcctctgtagatggtctaatgaattaagaaggggccagcggtctgaagtagcatcctgttcaggtaataggtgtgcattttgtcaagggctcccagcagcagtaccgtaacacagcaacttgacaagttcagtgggggaggggcaggcatttctgtgccctccagatctcatctactaggtaggcagctgtcttgtgattagctacgctctcttgacacagagcaccagagcttccttggtggctctcatctgctttccagtggtacagcagtgattccctgtaaaccagctaagtcagtatctttaagtgacatttgcttaactgtcttccctgaaaaattggggtgaatttggctgtaggttagtttttagtatatttgtctctgttttccaccagattataatcttttttggggagggactttttacccccttcgaagcatcttgtgctttttaaaccagataagaatatgtattctttatttgattcagaaagaatggtcaacaacttgaaaccagctttatatagaagcacatggcattaaatacaatgcttcagaatcagtgtttctttccttctttgtcattttccttataatggtaagtgccagtgtagttttccttgtcttaggagaattcatacctgatgactataatggtttgtgagaaaaacccacactctaggtttcaggcattcccaaaggaacgacctatagatgccataactctagtattcacacttgccgtgccagcccaaattaggacttaggaggacaagtttctcttgtattgctcccatcttagtgcctgtcagttccaagtttcactcctttcttaaaacagccactgcaactgtctgtccttgatgatatgtatgcaatagccaagcctctcttcagctgttttaacattgcctcatgacagtcaggggagagataatggggtgggatctcagccactcagccccgctgtgtgctatattgtacgcataggcataaacacatctgttggagggaaattttcagggggaaaaggcttctttaactttcatatggcatgagtgactgatatgcgatacatacatggctatttcagagcatctgcacttttatacaattaactaaatgttgaattgcacactattggggctgcagatgttcaacacaattatctattccataataatagctctaataggtcccaagcccttggagtcattgattccttttctttgctcaaaataagcaagctaagaatagtcttgggtgctgtatcactgatccacgtaccaagagccctgtaacagcctgggtctccttggtgctggacctcccatatccagcctcttcatactgattcagctcaacagactttttctcttgaagcctgaattacaaaaccagagcttttttttttttttttttttgacggagtctcgctctgtcgccaggctggagtgcagtgggtgcaatctcggctcactgcaacctctgcctcctgggttcaagtgattcccctgcctcagacttttgagtagctgggactacaggtgtgcgccaccatgcccagctaatttttgtatttttagtagagacagggtttcaccatgttggccaggatggtgtcgatctcttgacctcgcaatccacatgcctcggcctcccaaagtgctgggattacgggcatgagccacggcgcttggccgctttttttttttttttttttaatttttggccaattggtatttgactctaagcttcctttgtgattctctgtcgatatgttgttcttactctgcacctctgcacggaattctgtcttttttctttttcctcttaaataacctgggaaaaattcactatcatgcctagccagattctagaactatcctgtctcccttcactcctggtaggaggggcatttgtgagtctgggtgatggaaacattgagaaacctagtatcccaaataggtagaagcaggctgtgtgtttccccaatgacatcacccacctgtttccctcactaagtggctctgcaggctgaagtgcttgtaaacattcttgcgtataaagtaccctgaccctaacggggcagcctgtgtttacagaacaagaggaatgtccagtgatctgtttcaacctggttacttgtaaccacctagcctatgtaattattaaaaacattaaagattattcacagaatgaaataggacttattttgcagaattaaaatagcaggaagagcggaagaaagttgtatattcagacatgaatacttctcatacccatgaaatggtcagataacactaatgaaaaagaggagaaaaaatatatatagagaaccaaaaaatattagacaaacatgaacactgaatacctactacatgccaggcactgtgctggacacttttatgtttattaatgagggacctgctatttattgaattcttaccatgttccaggcagtaaaacagatgtatattgtgtattttgtcatccgtcctttcgaaaataagaaaattccttgctattaggcagcaagatgccagatggcctagtccttagctcttcagccagattgcctgggtttaaatcctaattaggctgttccttaaatatgtagtcatgggaaagttacttaatctttctgtgcctaaatttcctttttctgcaatatggggataataatactattattattatcatgagggtttcatgaagcttaaaggaaataatccatgaaaagcactctgaacatcaaccaacatgtaataagtgcccagtaatattagctgtctttataaaactacttaagaaatgaattatctgtgtctttgcaaagatatttgatataatttccaaaatttaccttttatggtaaaaaatatccaaagctgacctcagattacagtggttataaatattaatatgtactacctgtaaaactagagaaaagtggataagagtgtcaaattccataactgcatatatacattatgaaaacagtactgaactcaatctaaatattgaaagtagagtgaggtgcaacataattttatctctggcagaaaaatgttgaggtttcaagctatgagaagattttgaaacatgactcttttttctggcaacacttaagagttgatgcttaaacctcactttattgtatagaatacataatcttctcttttgggactcgtataaattgcagcaattgaaaaacaaaagtgtgcaccaacctgcccctcactatctttttatcaagcataacagtatattgccagcaatgttcatagaattgagtgcaggtgtttctaaatataaacaaaataaggaatatattaaattcacatttctagttttttatttcctcctcagccttcctagaatggctataggtagtgtttaaagttctggaagtgtgatagattcttaccaaatcaatgttctgttagcattctccaagtaacaagttaaattggatttgaacagtactgatagtttatcatgttctgttaggatagatgaaaacaaaccaaatgccagtattttgggtgagtcactttatttgctcaaagacgcaaatgaatgaacttctggtagtttagttaaccctggagctccccctcttgacaaatagaaaaaacaaaaaaataaatcagatagtattagcttgaaaacggatttcttttacccagataaaaaatatgccactaaggtacatacaatgaagttttcttgaaggaactaatgatattttggatttctcctaattttgtgcatgtctgcacttgtgtgtgtccttgtgtatgttttaatgggttaaaaaaaaaagcgagctaccaaaataccaatagatgtcagtgtttgtcgctttagaaaaagtgaggtgttagaaaaaaagaagaaatggacagctttatttatttttggttttactaaacataaagctggctacttttcaacaattgactaataattcactgtatataaccctgtttacaaaagtacattttattaaggaaaatattccatgttctcatctttcttctaaatttttttaaaaaagcctctgcagtaaattcccaaaagaattcagaatgtaggcagaaaatatgttaattttttaaaattaggaaacaaaattatttgagaatgtcgttaacacattagatttcttttgcatttttaaactagaaattagatatgcactttcttatgttgccctgattatgactgataaagtgcatttttcagtccaagtcaagtgagatctgtggagttctgcctctacataagagcagagatgatcagaattctcttcattcttcctatgccccatgtcacctttttctggcctccagagggtgctccaggagcatcacactgctattccccaaagactgcttttttcttctctctctctctctttttttttttaagttactgcagtattctgggcaatctactggaagaacagagtcccgattccatacatgttagctgcctcaactggagtttgttttccagctggaccacatagccctaattcattaagtattctaaattagaatattttaaaacattattctgatgatgttgatgcagtggttagcttgcaaggggacatctgtcagattaattccctctaggaatttcccccaagagaatcaagcatctttaaataccttccaatcacgccttacaacagctccctcccactgaagtgcacatggtacccacaaagagatttagtgctatttaagagtttcactctggcattggaaaactataggtgaaagcatcaaagttggacaacagatctttactaacacatttgttttcatctcttcctatctctctgtttcctcaacccaggggcaacaaatgtttaggagccccactttgattgagtgcacatttttgaacacaggtttgagtgactaattcttgtggatcatgggctgattttatttatgtactttttttgagacggagtctcactgtgtcacccaggctggagtgcagtggtgccatctcgactcactgcaagctccgcctcccgggttcacgccattctcctgcctcagcctcccgagtagctgggactacaggcgcccaccaccacgcccggctgattttttgtatttctagtagagacggggtttcaccgtgttagccaggatggtctccatctcctgacctcgtgatccgcccgccttggcctcccaaagtgctgggattacaggcgtgagccaccgcgcccggcggggctgatattttaatatggtcacacaggccttgttatttatggtttacctgcttatgttaattccaccctgtacttgttatctttgacatgagttactctcaggatattactccccttccctttttaaagtgtaatattgttcccattgtttcttgctccaagaaatctgtcgttgatgggaatagtctttgactgccacagtgccccgaacctttcattccacagctttgatgggcagggagctgccttctctgggcagctgtggagttttactttcaatgatatgagagtcacagaatgttttattagattgaatcatatgaaattgtcagttttgtaggtcatacctggctgaatattgtccatgtcatacagtttaatatttggactttgaaaaagtaatttgactttacttattctttacatattctttaagtaataatgacaactttgaaaaagaattatgtacgtttttgataattaaataggattgaagtaatacataaaagaaatctgagctagggataattgaagcagtaacattttttacaaccaataaatcagctaaaatcatatccatattaaatgaatttagcataaaattagaatgacagagcaactagcattttcccttggtgagaaaagtagtaagtttccaccataaaatatgactcatttttatttgacctattagcagatagttgttattgcaccttatcttaaccaccattatttctacagagagattacagagcaatgagtaggaaatatggaagattgctgaataatcctggctttagttatggagtaatatgaaaaaaggaaaagaaaaccttttgttcactttcacagtactacatcaatgcaagctttttagtagttttaatgtatgaattttatcatcaggtgaaaatgcatctcattattagatggcctattttataaataaagttcaaatttcgatatagccagtttttaaaactgtatatgtttataactcatccctttgttgcatataatctcccaattttagagacttacattgcatttttaaaggatagcacagtctctttagcaatcccacagggaatctaaaaccagcctttacaaggagatgtcaaaattccaatttgcagtgatatttttgtcaaaacaagtaacgtgtgttattacgtatagtaagttaacacaatttttcatttgtgtatcaagtaggcattggtttttgttttttggtttttggttttttttgagactaagtcttgctctgtcacccaggctggagtgcagtggtgcgatctcagctcactgcaagctccccccactgggttcatgccattctcctgcctcagcctcccaagtagctgagactacaggcgcctgccaccacacccagctaatttttttcgtatttttagtagagacggtgtttcactgtgttagccaggatggtctcgatctcctgaccttgtgattaacccacctcggcctcccaaagtgctgggattacaggcatgagccactgcgcccagcaagtaggcattgtttttgtgtgtacgtatcaaatctgtttttatatcttttggtattttatctcttttctgccaacagggtgaaatggaagtacagtattgggattatgcacaacattttattgtttaaaattatagtattccttttccattctgttgtttcagttgtttaaaaataagtaacaaaagagaggggtctgtcttgaagcccatgagatggtagatctttagaaacagttataatagcagtcatattgaaactgattgtcatctatttctgggaaaaatattgaaggctggtatattgtccccagaaggattagatgaaatacagaaaatagattatgattataattttttttagtgaggtcaccttgctgtagagttggaaccttcccgggggattgctcatgcattatccattttgggaaagagtaatacttacaggcattatggaaatgagcgggtaggtttgtcaagaggaaaccaataatttgaatactgagttgaatggaaaatgaaatacatgattttccatatattaaattgaatagaaatgggagacttatgtcttgagggtttttcttttctttttttgaaacatgttgatgatattgtgtgttcccaagtgccctcaacctgacaggaaggagaaatgtcaatagaaatagttacttattatattttgatatttagaaaggaacagtggagttttaaatgttgtgcatatcatttatgccccatccaaaaggatagcgatccacttaaaagaaggcagaaaagacaaggaccgctatcgttctccaggaatcaacagaagctaagggagagcgtagagtatagtccctgtggcctctacggagtcatcgccttctcagactgaatccacacaaggccgccttgactgaaagagcctctacattggactgtgcatggcgtggggaaatgtgattacttgcaatatgctactgattacagaataaatattatgcattcggttttcactaaacttaaaaagcccagtgaaaaccccacttctgcatgtggtgaatgtggttatgctgtgtcaggtgaagacatgtttcagtgccttcgtttactttccattaagatatgctgatttccttctcccttatgaaatagaaaaggaaggacataaccatcctgctgctctgccctgagtgcaccagtataggaataaaactctgtaaacagagggtggtggcaaccatctaacagggacctgcatttggacctgtgtgtttgggagagccgcaaagtggctgtgcctctgatatcacaggactctatgaaagaggcaaccaaagaagacctgaggctcttcttgtcattttagatatgtgatttcataaagttactcttgaccttaatgcagatggccatttgggatttgtgtctgtgcatttcatccacagctggatggcatagttgctgagtaatcctgttgctctggagcaatgtaagttacagctgtggccaggcacgtggctcatgcctgtaatcccaacactttgggaagccaaagtgggagatctcttgaactcagggattcaagaccagcctgggcaacacaggagtcctcatctctactaaaaatccaaaaagttagccgggcaaggtggcatgtgcctgtggtccagctgttaaggagggtgagatgggaggatcacttgagcccaggaggttgaggctgtggtgggcaattatgatacaccactgcactccagtttaggtgacagtgtaagacttgtctcagcgaaaaaaaaaaaaaaaaaaaaagttaacaaccatatcaaaagaacaatttattcaccccccaaattgtcttggaattctcacattaatttacagagagaaataaccctttggaaaattcacaatgttttgctagtattagtatgtcatctcactctaaaatgtaaaaaaaaaaaaaaaaaatcactactcagaccttataagaatctggtttttgattatgaatacagcaattcttttttgaaaactcccttgacaaattaagccaatggtggacattctaataattgtcatattttatggtacatttgtaactaaaagcctcttctttgggtaatgactgatagtttcatggaagaagtcattctttttctggtcactctagaaaataagaaatgggaaatgattgtatgtgatatacatatgcatggttctaagtaccaaatttgcagattgcctgaaaatgttcttatgtactttttatggatacaggctttcttttcaattagattcaaaaagtatcaatacattattatactttaaattgactagagctaccttttaaatggtcagataggttttctttttaaagaattacttttgtgattactagccacctgaaatggtgtttcaaggccatgcatggtgcctcatacttgtattcccagcactttgaggggctgaggtgggagcatcgcttgagctcgagttcaagaccagcctgggcaacatggcaaaaatctgtctctacaaaaaaatacaaaaaaaaaaaagaaagaaaaagaaaaaccattagccaggcatggtgggatgcacctgtagtcccatctacttgggaggctgaggcagaaggatcacttgagctctcagaggttgcagtgagctggaatcgtgacaccacactccaggctgggtgacagagtgagaccctgtgtcaaaataaaataaaataagatataaatgaaatagtattttcaagacttggtataaatgcatagctgttaagctgtaaggacatcaataaatgttcataaataggtaactttctacattctatcaccttattttctataatacagaaaatatactttaaattattttatttatctgagtccttttattctttttgcttttttttttgtttgcaagaccaaagtcagagcaatttcaattctattttgagcattttattttggcactcatgtattttaattaaaaaaaataaataaaccattgtcctcagccagaagaattttctgctgagtggtcataaatgcagagtttagcatttcacatctctagaatgtaaaagccacaaagtcatatctgtcttttatgttgtcatatcaccaggtgccatcatggtgctgagaacatagtctttgtttttaagaatttattcagtaactgactgaatgaggaagtatggctagtttgcttaagacattgagttgtaggagttgatgggtagcagtttagttattatgctactgtcagttaataagaaagtatgagtgcaattcagcagtatcagtgatgcatggatttgttcctaaattgttatttttgtggttgaaatttgcactgtttattttgaagctctctgtgtaagtcataatcagtgcttaattattcagactaatgaattggaattagaggtttgctcagtccacaattcttgctaccattaaaatattttgttacatttgtttttgagtacatagaagcaactaagaaatggattaagatgctgcagttaatctttgtaaattactatggccattgcctggcacctaatgtttgctatgttaagagtttgttatatgaataaacgaccgctgttcctggtaggtaatgaaagtaatcttaaacaatattagtactgcctaaaaagtaaggtcttaaatataactacagtagtcctgagaaaaatcatagagtgttagaactgaaaaggttgtcttagaggtcatctgctcgaatctcatctttttagttgaggaaaaccacaaggtacaaacaacaagggcatcaatcctagcactagaacccagatctccagatttcagggtaaggattttaattattaccatgctatactttcagtctcaagatggcactatatatgaattcagcttcacttttatagtgctttgggtgttattatgcttccagataagagagatgtatttctgtgccattgaggaatagcttagagtacctatgattcataggaatttgaaggctgtaaatcaaccgaatctttatatctttttgttccttcttgcagtatcttgtacccaagtagcttcaataaattttgactgacaagatgaccataaaataagtagtcctaatgtcataacatggaaaaggagggtaatgggtgtgtgtgtgaatgtgaattagtatagtatagtaatgagctgcctcagcgctcttaaactttttttagcaccaatgcctttatgcaggaaactctgaaaacaagcaagagatctttgtgggctctctgtaaattatgtgcatgcaaaaaagcatcctcagtgcttgtcccttgacagctgctctgagaccactgagtcactcgcttgcatctgtgagccactgaccagtcactgattgcagtgacagtttatcactaacaacctgaattatctttgacccagagacccaggggtcaaaggcctcctagtccattattaaatttccagggcagtagttcagtttgcattaggggatttgtttatatttatttatttagggtttttggggggtggggggtggaggagcttgggggaatgagacctgcagttattttccccacattataagattatttagtcctttatttgtgggatttggcatcctaaaagaaaggaagactcaaagtattgtggttctggtctgggcctcacatgggtgtcctaaagatttctgggacccatttatgggaagaatgccactctacagattatagcagggaggagctttgccctcaggaagacacagatcctttgagggtggtagagactcctaaagtctgctgattcatacccagctggccccattaacaagagaattaaagagtggctagaaagggactgaagagttcactgggggcccatccaaaaagctgggggtacagacaactgctgattcccagccagtcatggattttattttgagacaggtctcgtttggtcgcccaggctggagtgcaatagtgtgatcatagctcactgtagcctgggactcctgggctctagtgatcctcccaccttaacctcccaagtagctgggactacaggcatataccaccatgctcggttattttttttttaattttgtagagatggggtcttgctatgctgcccaagctggtctagaacttctgggctcaaggagtccttccaccttggcctcccaaagtgctgggattataggcatgaaccactgtgcctggcttgccagtgatggattcaaagtcgcctctgggttgtaaccaggaagcatgcctgggccagactgagagggctgaaggatgacggcatggtttcagtgtgtgagtgtgcatgtatgtacgtgtgtgtgagaatgtgggtaagtgtgtgagcctgtaaaagtgtatcatgagtagctgtctcttgggaggagagggaatcaggaaccttggtcaaataacaccatgtactggcatggaaaggcactgttctgggcagcagtcaagaagacagaggaggactaactgtatatgatttgggcaatcatttaaagtatctgggatttatttccttgtctaataattagcaaggttgatgtagatgaggtataacaactttaggggtagaagaaagctatgattcaaagtcggcattttattagatcagtggtctctgatttggtgtgatgtgttcctggtatgttttcgcttagaacaaggttgtttaacccatggcccatgggcttcatgcatcctaggacagctttgaatgtggcccaacacaaatttgtaaactttcttaaaacattatgagcttttttgtgattattttttccagttcatcagctgtcattagtgttagtgtattttatatgtggcccaagataattcttcttccaatgtggcccagggaagccaaaatattggctcacttagagtctttagtagtgactatgtttttagaaagcctaaggtatttgaagaataatagtcacataaagtctaggcaaatagcaaatttgttttatgtaggaaacagcttatcttctatagaataacttttgatgggtgaaattgtagtgttaatttatcttagtgaacacctagaagatttgtttaggtatgtgaattgtttagtgaaaatgtagaagatggtaagtatatttgggaattactagtgcagaagccttttattaaattctcaatagaaactgggtactggttatgaattgtgatctctcagatacctttaacttagtcgtctctcatgagtatgtgatacaattgaagttgtgggatttaacctctgctgagcagcagaaagatatgaagcagtggaaaatacaggctaaacagagcctttcagaataatttttcctcagtggtttatgttcttcacattcagtttttattcttctccatccttaactttctatagctgatacttccattttggatataggctctgtttcatttccagaggtatctctttccctaaactcatcaagtactttttcaaccttgttgatcatcttaacagaagaatcgtaacattaagttgatttatgacaccatatctctgtagtaactctgaattgtcatcaagctattcattgaaaggatacctcttaaactttctattactaagatccccaaatgtatctattctcctctcgataaaatgagtattgtcttagacaagcagcagactgctttttaagtgaagtggattaagctgctgtgatcgtccctgtgaatgtgtatgataaatcattttgatggcctttttaaatcagagtcaccgagtcccacacagagaaacagagaatgctgtctgtcattattacaataataattaagcgttggctgataggatataaagtataaatcaaagatcttagaggaaatagatgaaagaaaagctttgtttctcaaaaacttaatctaaaagaagaaatattgagcaagcattgggtgcttcatgaatggcctaaaaatatatttaagtctatcacctggaggttcgttcatttattgccaggaaagaatcaatcccacttttttttctctttccctgtggctcaactccaggaaggtgttttaattgattggtgggaagattttaacacagacaaaacttataagctaagcatcattatttctagtacagtggcttcaccacattatagggtaataaagttaaaagctgccgattgtttcagaattattttcagaaatttacatcctctttattcctattaccttgagaaagagttcagagaatgggcttagtcagcatgcaattatggtattagataaagcatacagtttggtctaaaaccaagatgcagctagtctcatcagggtactttaatcaatcaagggttgttaagaaggtaggaatgtcagtctaacttcattcctttgaaggtgatcagcctttcttctctggaggctttgaagattttgtcctatggctgggcgtggtggctcacgcttataatcccagcactttgggaggctgaggcaggaggattacttgagctcaggagtttgaaaccagcctgggcaacatagaaaaacaccatcttcctctccccactaccaaaaaaaaaagttagccagttataatggtgcacatgtgtagtaccagctacttgggaggctgaggtgggaggattgctggagcccaggagtttgagggtacagtgaaccatgatcatatcactgcactgcagccagggtgacagagaaagacccagtctcaaaaaaaaattgttctccaacaaatcttttttgaagttatggcatttaaccctgcccaccattcccattcccctgtcagtttcactatcatgcattcctttttctttatcccactcaggaccattgggcttgtcaaacatataaattggctttcaggaaaattcttctccatatctcttaaaaatttcctgtatcccattctcttccctctttttggaattttctttttctataatttaaagatagagtcttgctgttttctaggctgctctcaaactcctgacctcaagcgatccttctactttggcctcccagtgttgggattataggtgtgaaccattatgcccggtctagaactttaactaaaagtacgttggaccttctttctctgaacactggttctttttacttccctcacgtttcccatcattttgtttcactctcccgctgtatctcttttgaagttatcttccccttcactcattgactcttcagctatgtgcggtctgctgccaaaaccatccatgaagtttttcatttcaaggactgttttcccccctaaacctagcagttttatttggtgccttttcaaaccttctatgttgtattttatattttcaaggtccctgtagatatttttcaggttgttatttatttcttttagcagagtaagcctagttgtttcataatttctgtgtggtaatttcagtttgtgttggttctcactctctatgccttggttccttctgtgcttgatggttggtctctgaccctgtgttggccattgctctgtaaaaattatctgtgtcattcctcaaggcatgggatagaagcacattcctgccgagaaggtaagtgttactgctgggtacttggaaacttaccgagttcgtggcttgaggttctgtggcctaccagcctgtgcacacctaggcatgtagaaacctgtcggtagactcagcttttccctctggctgaactcaggatcaagacaatgtgtctggccggacacggtggctcatgcctgtaatcccagcactttgggaggccaaggagacgggtggatcacctgaggtcaggagttcgtgaccagcctgaccaacatggcgaaaccccatctctactaaaaatacaaaaattagccgggcctggtggtgggtgccaataatcccagctacttgggaggctgaggcaagagaattgcttgaacctgggagggggaggttgcagtgagccgagatcacaccacttcactccagccacagaacatctcaaaaaaaaaaaaaaaaagacagcatgtctttagttctctggggctaaatgggtatgtttagatttggtgtagcttttttggggttctttactccttttggggtcccagcttaatgtgaagagggtctactctaagactccccacttcaggaagatcctggagcctctatccctttctccaggatgagcaaatgcacttgaagaaaaagtagttgctttgtccaggtattttgcgtctatctctaaggtttgagatttgccttagaatttgtccaaaaaatgatcttttttgtcaaattcttttaaggtgatgtttattatatttcattcagcacttttaattgtttccagccaggaggttcttgtgagaaacttaccttccaggaatggaagaggaatcattagtcattaaggagctaaaaatgttaggaaaatattaatgcttcagaaacaatttgttgatctgaagagtacctaagttagggattttcagaaagtagcattttgttttgttttgttttgttttgtttgagacatggtcttgctctgtggcccaggctgaaatgcagtggcgcgatctcagctcactacaacctccacaaacgattctgttgcctcagcctcctgagtagctgggattataagcaggcaccaccacacccggctaatttttgtatttttcgtagagacggggtttcaccatattggccaggctggtcttgaactcctggcctcaagtgcccacctcggcctcccaaagtgctgggattacaggcatgagccactgcacctggccagtagcattctttggatgaattgactctggttttgttagccttcagaatctaaggaagtttatatctggtcaattttgagaaagaagatctctaagaaatgcctcaagtggggaagggatggactttataaaccaaaatgtcaatgtgttaatcctaaatatctcaatgaaatggggcaaaatatggctaagaaaaatttgacaaggtgtaaatctcactgaatgcagttgctgtggttgctaccaagtttacaagagaagaaaccaggttttgccaatgcatcaaaaattagattaaaaaagaaatttctctggcctagtctgatgcttagccttcaagagtaaaatgatgtgttgttagatgacttgaccaaagtcccatagccaaggcagggagagtgttgcagcctggtggtccattatctgatgccactggatctatgtagatgagtttggaacttcactttctgccttgtctgggacgtaaaaactttgggtgcccctcacttcttttttatataaactgttgtgttttattgccctggcactcttaagttgctgtttcaccctagcagtgcctgcttcaagccatcaccaatgaaagtgcctttgaagtgtcttaaggcgtgtgcattgcctagacaaatagttggcagaagaggtcaacacaagcgtctttgctttggagtgtcaattgaagaaattgtttttccacttgaattggcagtgtgtgctcttactgctgttagagttctgggcagagaagtagatgtgataattatgaagggagaagggggaagaacagctgcagaatgcagggaagtgactggactccagtaatcatatttggcaggtcaagggtgagatttagcctgatgggatttggaccattccctgggctagaaagtagtgttaaaatcaactccaggtgtttccgttattcttaaggcctaagtattattaaagcagaaaataatatggttaggatatgaatgggaggggattggtcattcgctgcttgggaatcacttatttgcaatagagctcattctctcttgacagttgctcctacatgtctaaaatacaccataaatctcgaagtgctcgtttcaatattgaagtttcctccaagtgagctgttatcacttttgtcttcaagagaatgctaactcactgaatctctttgagctttttatgctttacactgtggattttggagtttgctttggtttttccactagttctttaagttaaatttaggtaaagaaatttaaaatcatcaggcttattcttaaaaactcaagtattatcaaatgatggatgatagagatatgctttgggaatatatccaagtacttcaaatgatagaagttagaacaccaggagacatttagtaagagattcttctgctgggtgaaatcaacatcaacatcacctggaaactcgtgggtagtgcaaatcccctggcctcaccccagagctcctggaatgaagctgtccgggatagggcccggcatcctgtgttttaataagctgtttgtgggattctaatgttcgccaaagttttaggatcatgcctgcagagaatcctgctcactatgaaagtttgcatgcctgagtaagtcaaaagagatctttgaaaatagtatctaggtttgagagacttgctgtgattgtataattttagcaaatgtgtcaaaacaaatttttacttgcaggcaatatcttgttagtacagagaaataaaacaaacaaacaaagattataaataagaacaaaagtaattcatccaagagccatgtgaaaatgaaaatccttgaaatggaaaaaaaaaaaaaagtttttcagactaccctgtggaagtagtaagttacattgaaaggccgaaatcagccaagatcattttttgttgttttgttttttgttttttgagacagcatctcgctctgtcactcaggctggagtgcagtggtacgattttgactcattgcaacctctgcctcccaaattcaagcaattctcctgcctcaggctcccaagtagctaagattacaggcgcacaccaccacacctggctaatttttgaattttttgcagagaggggttttgccatgttggccaggctggtcttgagctcttgacttcaactgatccgcccaccttggcctcccaaagtgctgggattacaggcatgagccaccgtgcctggccaggccaagatgattcttgaagtgtgtgtgctgtgcgtactgtgtgtgcatgtatacgtacatttctgatggttcactttagtgatactgtagttcagtttatctgggattgcctcagtagaaagctatactcttacttgtttaactttctgtctattttctcctttaaaaaagaaaagattatatagtagacttatacttggtatctgtctgaaaaaaattatatgaaaactgtctttattgccagggaagcacttgtactttcttttctcatttattcttttctgcactttaatattacagtttatttgcttctggctttctttcataatttatcagaaatacaggcttgtatagaaatcaccattttttaaataaaattttatttttattaaattattgtgagctcattgttttttaaaacaatcatacacaagtaaaacatttaccttgggggtgggcatcagttccttttcccatccgttttcatctctagttttctttcctaaaaacaagccctctcaacaattctagttaattctttttctgatagttatcttttttttttttttttttttgagatggagtcttgctctgtctcccaggctggagtgcagtggcgcgatcttggctcactgcaacctctgcctcctgggttcaaccagttctcctgcctcagcctcctgagtagctgggattacaggcacacaccatcacgcctggctaatttttgtatttttagtagagacgggatttttaccatgttggccaggctggtctcggactcctgacctcaggtgatccgcccaccttggcctcccaaagtgctgggattacaggcgtgagccactgctcctggcctctgatatttatctttatattttctatataacatgcatgttctgctgtttcttttttaaaaaccttttattttaggtcttataggaagcttgtgcattcatttattcaacacataattattaagtacctaatacattctgtacattgtgctaggttctggaaataaacagagaatagaacagacatgattcttatccatggagagcttatattctaaagatgctaggaagtacttttaaataaaactctgacttatatataaaaacttcagaaaagaaagggcctgcttttaaatattttttttggtgttgtccactacttgaacttcatcaagttcatcagaaaaaatttaaatggtatttctaaataagtggtttgctccactctatcattaagcttgttaagatgaataaaaatcagaatattttcaaatgtatgtaaatacatacattcagtgtatttcccagcttcagaaagtcctaatttctgaaagtccttgttatcaactcttgttttgaaaggaccctttctttaagataaagtgtcacatacattattttgtattgatacaaattattgatgattatggatattttaggtaatcaatactaagataattatgttaatatgaattatgattatagggtattggtaacagacaggagtgtaggtgaatgatatgaatttgcactgagtttgtcatgcccagaaagttaatctgagccaaatttctaaaaagtgccttccttattccatattatgtatgaaagaagagcatagtttatgtgtgaatatatgggcaacatgtatatagatgtccacatgaactgcgcctggttaggtcctagaaaagcctatggtgggaaaggtgggttaagaggattgaagttaggagtgaacttgttatagtcttcataaatatttttatagccagtaacataaaacaataaagacagtgctccaaattaaagatacagcaatgacatgacatctacatttgaaactagtaataatggatgccgggccctattactaatttctgcttagcattccttactcaccagaaatgttttaggatcttagttcctttgcagcttgggatgcttgtaaattcacttgttcttttataaataatgtgcatacaaggagattttcaacagcattttcttatcaaaggtctgggcctatagtcaaatagtcaatgccatcgtggttttacagcacccatgaggaggtgttgacgttcaggttttagcttcaggattttgacttgtgtcttcttcctgcttgggtcctgtctcttcccacctccccagctcagccttcatgtacgaattttagattcttttgccttcgtatcagccagcagaagctagttttttgttttgttttgtttttttcaaggcctaggtttccttttactcacatctttcttcaagctttatttgcaaacacctccattcctcttgccattacttttgcttcatgtctatttcaaaactctgtttcatctttttcttgttactaccaataggagtaaattgagtgacttgcaattaaggtacaacagaagcagaattttcaaagttactcaaaaggaataggtagaaaaattcccatggtaagacaactcagtaaataattacatacaggcagtgaccatatatgctcattttaagttacaaatatacacacatggccataaaaatagtcagagactgagctggaactcaatccgtaaactgattccaaaccccatgtaatttttatacacagtttattgctagctttttgtccttttatgttcacttttatgtcctatcttctctatattcctaagttgcccacattttaaaatctgcctgtcttctgactttttaccacaagtgtttttttctcatccacttttattattctcatttcctgttttcaaagaaacaattgcaacacattttagaaatgcttacgacataagtggcacactcctgaagtctttccaaaatctattttcctccatgtcttaatttttgaaatttatatacttagcttctttctgctaattcccacagaaaaactcagcacaattttataagcaatgtgaatgatcttagagccctcataggaataaattgcacagaatgttatcaatatatcataagtgaggtacaggattaattttctaagatatcatttaaaatttcttctattgttactatacacatttgatttattaagccaaaacttcattcctctaagaataataatcccgtcacagttctaatcctagcatagtgtcgtcttaactgcaatgtactatcctaactttcaattacatcttatttcagctttctttattatacagtagctaaaaatcattgatagttataaagaccataatgccataacctctcaaatttaaacaggatagaatattttatgttactaatacagcaacagaggcattttcctctgttgggtagatgcaattattcagattccaagtggttgagacattccataattatgtctctaattttacattctacaggcctcatttcctctgtctgataactgtcctcacccaagggtttctacaaagtcacagtttgggtgaatctgtcatctcattttttcaaagaaggaaatcatcatcaaataaaattatacacaccaaataaataaatatcaaataatatattaatctacaaatttgcgacatatttattttctgactttgaggttaatttcgccaccatttttcctaatctgtatatcctatccccacttgcaaacaatgttttgcctgaaccgagtaatggcaacatttatcgtaagtatatcttagcttcttctccttatctgaatggggttctagttcccttagcattctcagataacattctgaatattctactctgtatatccagtttgttcatagacctcaaaatgcagaccctgcatggattattcccattctgctgtctgtctttatgaaacctgccaatacttattgctagatgaaattctacagatgttccatgatgacttattgactcgataacagggatctgcaaacatttctgtagagacccaactctgcagttgtagcacaaaagtagccacagacaatttatgagcaaatgaatgcaagtgtgctccaataaaactttatttacaaaaacagatggtaggcaggatttggcttatgagccgtattttgctgacctctgctctataatattccttgaagagatactattatcccaatatcctgacataaaatatatatccttaccatttgctgtagcaatattcaatttttctttacctggcgttgcttatgttctccagccagttctgtcttttcattaggaatctgagttaggatttcttagaactatgtatttgggtaagtttatcaaaggcctttttatttttattttttattttattattattatactttaagttttagggtacatgtgcacaatgtgcaggtttgttacatatgtatacatgtgccgtgttggtgtgctgcacccattaactcgtcatttagcattaggtatatctcctaatgctatccctccccgctcctcccaccccacaacagtccccggtatgtgaaattccccttcctgtgcccatgtgttctcattgttcaattcccacctatgagtgagaacatgcagtgtttggttttttgtccttgcgatagtttgctgagaatgatgatttccagcttcatccatgtccctacaaaggacatgaactcatcattttttatggctgcatagtattccatggtgtgtatgtgccacattttcttaatccagtctatcattgttggacatttgggttggtgccaagtctttgctattgtgaatagtgctgcaataaacatacatgtgcgtgtgtctttatagcagcatgaccttttaaagatcttaggagcataatgctgtaacctctcaaatttaaacaggatagaagattttatacattactaatctggttgggtagatgcaattattcaaattccaagtgggtgagacattccgtaattatgtctctaattttacattctccaggcctcatttccctctctcatttcatcaggtcttcaaaaggcttttaataaacttacccaaatatataattctaagaaatctcaaattcagtgcttgatcagatcactgtgtggtatagtttgtatatttttccccacccaaatctcatgttgaattgtaatctccaatattgggggtggggtctggtaggaggtgactggatcatgggggtggatttctcatgaatggtttagcaccattccttggtgctgtcctcatgataatgactaagatctggtcattttaaagtgtgtggtctctctctctttctcttgcttgctcgctcctgctttcaccatgtgatgtcccccactactcctttgccttccgtcatgattgaaagctccctgaggcttcaccagaagcctggcagatgccagcatcaggcttcttgtaaagcctgtagaactgtgggccagttaaacctcttttcttgataaattacccagtctcagttattttttacagcaatgcaagaatggcctaacacaatgtgtaatctttgtttcatagagtttacactacagctttgccacctaactctcctatgttagtacatagaatttctgaaccttcaatcctgttcagaatgccagattgtgagagaatcagttatgcttcaaccttgaaagcatggagttctctgctttcagggaactccagatgactcaggaacagaagtaaaccctagacaaatctaaagccaaacatagaataaagctgaacagcagatcataaatcccattccttgctccctaggaatacctcttcttctaactccagcttcagatttttccccaggtttcacaattgacctttgtcttagtgtccatactggttggacatacccctctggcatagacattcatgataggcattgccattcttcatgatatgtcattcttggctacttcctctttttctaggatgcatgttttagctcacttcatgttcaattgccttgtggttggcctacttcttctttctcttctttcctacttttgtggttgctttatagttgactaattactagttcatcggctctgcttattgcctaatactataaaagttcccttcctggaagggttggggatgggaaagtgggggtgggtggtagtaaaattaactaaactttgtagtgggctggagatagggcatgagtaaaggaaaagttgtattttaggactgctcaactgcatggatatttatactttttaagacaagcaacattaacaaagtctggatcttaaagtagagatctacactggagataataatatccctgtgggcatttaatgctcatggttacctagaaaataagtataaagtaggaaattttgagagagtattcttgtaaagattaaatggtgacaccaatgtaaggcttgaatgttctaataagggtgaaacttggtctgggaatggcagttcttacaccttttataattcttaactgttattttttagatctggtcatttaaatctgaggacccagatatgctagtcttatagaaagcacaaatttaaaatgggttctttgtcttacatagctctaaagtttaggaaaaaagtatcttcaagcaaccttcataggaattctccaaaataaatgtgttcctgattaatatgtgttttattttttaaaatttatttttaattaatttttaaattgacaaaattgtatgtatttatggtatacaacgtgatgttttgaaatatgcatacactgtggaatggctaaagcaagctatttagcatacgtgtcatcatctcacataccatttgtttgtggtgaggacatttaaaatctactctcttagcaattttcaaataatgtaattattttaaatcagttgtttaaatattatgaaattactttcagcccttagagaatagtccatctcacatgacacataaaaatggaaggaggtgtctagctcaggagaaactttttggaatatttgattctctttccctcattttctcttctttttttgttttttaaaaaataatttttaaaccctgtattgactcctggctattattttgaatatgagtgctaacaatttgagccttgtagataactatcccaatgccaattgaaccataattttcatttgtctctttctacaagattctgaattttttcagaagtgaaattaagtctcaattccctataatttacccagggcaataaatcttaaacattttttcttaaaaaaacaaaacaaaacatttttactggaaagactttatggggtggacattaactctgtaaatgccatataacttttggagagggctgcccctggcacagtgtaatatttatgagaaagttgtgcccatactaaccacctgtatgagaatcgcctgcgatgcttttgtttaaaaggcagattcttttttccctatatttttctctttttaaaaaaataatttcgacttatattttatatttatatttatattattttaaaaaataatttcaacttatattttatattcaacctacgtatgcaagtttgtcatatgagtgatattgcgtggtgctgaggtttagggtacgaatgatcccatcacccagatactgagcatagtacccaatagttggtttttcaactcctgttccctccttccctccctgctctagtagtccccagtgtctgtttttgccatctttatgtctatgagtatttgatgtttagctcctacttataagtgagagcatggagtatttggttttctgttcctgcattaattcgcttaggataatggcctccagctgcatccctgttgctacacaggatgcagtttcattcctttttatggctacatgatattccacagtgtgtatatactacatttcctcaatgcagtccaccactgatgggcacctaggttgattccatgtaaaagagcatattgttaggcttttctctgaattactgaatcagagtctttcaatgggttccatgaatatttcatattcattttagtaaacttgctcaagtgacttatgtatacagttataggtttgggaacctctggcctggggaagttgtctgcaacaccactgacaggtccctgtcctgccacagacatttctgctgtaactccatgcttgcattttttgggaaaaacaaagcaagacaaaacaaaactcattttgcaaaatgacacacaaaataaagaggcttctggaaaaagtagggctaggtgaagagaattcaaaacttacgaaactataaactgaacaccaacaagaataacaatgaacctaataaaaaactagcatagttatggctctaacaacatttattctcaacaacttagttaaatcgttgtacccttaaaccttaacactttttttttttgtttttcgagaccttggttcttgaggacattttcttctagcagaaatcagtattaacttctttatccatctctctcttttttttaaactgttatgtaccatcattatagcacttcttacaaaaatgaggagctgtctttgtaacttcatctgtgccatcagcttttccagatagtttaacataaaaggaagatgaagtggttctggaagcaagaaaaccagccaccacttgcagtaaggaaggcaggtctatgggcctattagctcatggaggtttttgtttgcttgtttgtttgtttttgagatggagtctcacacagtcgcctggtctggagtgcagtggctccatctgagctcacggcaacctctccctcccaggttcaagcgattctctagcctcagcctcctgagtagctgggattacaggcacctgccaccacgcccggataattttttgtatttttagtagagacaagatttcagtatgttggccaggctggtctggaatgcctgacctcgtgatccacccgcctcagccttccaaagtgctgagatcacaggcatgagccaccgtgcccggccagatctttttaaataagatcttcatgtgttataatactaaggttgtctctttaatcacaaaaagccagtcctttattgcttcaaattgttcatgtgctgatatcatatgtctattgaggtctgacttactacattaacacacgctggcagaaccactgcagacattctctgtcctccttttttttttttgtcactaacatgataaaattcttaagggtttgaattctcagaggtactgtctgatggttaaatcacagaggtccactgcattgctgatagatttttttttcaccacagtgctgacaatacaattgttcaggaatggccttcatgaccataaggttggtttgacctaggttcttaattgtgatgtctctatagcttttaacttatttcaggatgatttcccccattgcaaatagataattgttcaatagatttgctgcagacttttggacctgatctatagttttcccttgggatatgtaagatatttgaggtacaccaaagtaatgcaagaaatatctttctttagagctagagtttagacaggaagtatgtcatagaactatggtgtgtccttcccaagtgagggatttcattagaccttgacttagaattgaatgtaatgttaatctgtaaaggcttgttgtgagggttttgcttaaatttttaggtttattaaatttttaggtttattaaaattcctaaatgatgatatttttatcagcaaagacaaaaatactgctacttaagtagtagtcactagaaaaataatttattttgttttgttaccttaactgtcagatttaagcacattcctaccaatatttgggtttgggctctgaaacccaaaacttttgaaagctttggaaaattttgtagaagttctttcttctgtcttttttttttttttttttttttggatactattgccactgggatgcaagcattcataaattatgtttaaatataaaaattaggtcggtaactctctgctcgtggattcctgaaacacaatgtacaaaaacccagaatagatcttcgtggctcactttagagcgtaacagcactgggaggtgatctgacttttcattttacacgcaagaaactgaggctggagagaaagaagggttgtctgggtcacaactgttgaggtcagcctctgggattgaacttcatttcctgaattcctcatggttttccacctccattcctcagcttctgtgatccctttggtatggggctgtttcttgaaccttgaataggagggtatggaggtgaagtgacatgtgagctaattcttttacctcactctggtttatctatttttatgtactaaggtcctgtgtattaattaatgagatgagttccacagttgctaatattagaaaatcaacacaattgatttctccttgggaactgtattagttttctattgctcctgtaacaaattaccacaaactttgaggcttaaagcaacatgagttcatgaatttattatcttagagttttaaatgttagaattctgtgaggagtgtcactgggctaaaattgaagtgttggcagggctgcaggaggctctaggagagaaatcattttcttgcctttttcggcttctagaggggcttcccttcctcttacttccaagccaacaacatgacatctctgagtattcctctttaactgcaccaagggaagataatctccttttaaagattcacaccgttagattgggtgaacctggataatatagtcagcccttcctatgcatgagttttgtagctgctgataaggaggtcatctgtaagcaacttgaacatctatggattttggtatctgcaggggatcctggagccaatcccccacagttagtgaggaatgaccatatagcataatttccccatgttagtatccttaatctcaaggtctcaatcatatctgtgaagtcccttttgctgtgtaaggtaacatattcacaggttctggggatcaggatttaggatctttgggagccattattctgcctgctacaggaatgaatttgtttccacttgtctcaactctaagtgggcagttatttaaaaactttgtattaatttagagagcttcataaaatgctaaaattttctgagaacctaagtgataatataagaagaatagctaccaacatttgttgagtgcttgcaatgtgacacacactgactgctatgtgctttaattgcaatatcttatctaatcattttagtagccctatgagataggttctatttcatttacattttagaaaatgtaaaatgaggcttagagaatttaaataatttgtccaaggtcaaacaactagcatatgggagactaagacttgaaattgggtttgtctgacccaggcttttaatcagcatattgcactgtttatatgtagctctgaagtggtaaaattgtaacatagtgtaatgcagtactgagaatataatatcttagtaatttttaataaataagtgttttagtaaggaaaataagttgttattaggaataaacactttctaaatgacatagtacccattgagcagtgttcaactgattaatattagttggttatatactgatttagtgatcagttctcaaagcctcaatttaaatagaaaaggagttatgtggaatttaagtggaaaggatatagctactttaacaattttttgtgctctcagattgtaaagaggaaggatttattttacaaataaattgcttgtgaaagaaatttaattggttaataaagtctctatctcttgccccctaaccagaatgtcaactccaggagaacaaggatcttggttttcatactcaattctatatgtccagtacttaaaacagtgagagcaatgtaactgatgcacaatgatatttgttgaatcaatgggtactgacaaattcctaagggaataaagccagttatctacatgaataaggcaggatctagatactagctgcatgccagaagaagaatatagagcgttctaatgtgtttggctaggaacagaccatatcatgggctaatatgatagagtaataaaggtagtgataaccctgataaattcaatatgtttttacataaatcctgtgcattaaactagtagctcacttgatatggagtgtttgaatcacagattgactttgctcattcgttcttccattcagtcaacattattgagcactgtgctagttattaggataaaagatgcattaaaagaataaagcccctaacttccaggagcctctgtctcctaagtgaaacaaacatgtgtaaagataaaataccttatattaaatggaataataatggttttatagaaacatggaagagggatacttaacttattattcaaaagagacacttattcgaaagacataaattgagtttagtcatcttgagttttagaagaaataatttttgatttatggagggattgcaaatataggacagagagttctcctataccctttattcagctcgtttaataatacatagctttgctatattgatcaaaactaagaaattaacattggtacaatactattagctaaactgcagaccttacttggattgaaccatcttacagccttttgtgctaaagggaaattgtgtatgaaagtgctttgtaaacagtaggctaaatagtggtagtctaagaagtgccatctggtgagcccagggtaggtcactgagggtgaaagttgcattctctgaagggagctttaaataatctaaccatgaactctattttattttattttattttattttgttttgttttatttatttttgagacagggtcttgctctgtcacccagactggagtgcagtggcatggtttcagttcactgaagcctaaacctcctgggctcaagtgctctgcccatctcagcctccggagtagctgggaccataggcacatgccaccacacctgggtaatttttgtattttttgtaaagatgatgttttaccatgttgcccaggctggtctcaaactcctgggctcaagtgatctgcctacctcagcctcccaaagggctgggattacaggcgtgagacacggcgcccagcctgagctctctatattttagtttcctttaataacatgatcagttccacccatgaatttaattaattccttatgagtttgctattaaaataaaatgagcggttattgatgcttattgtgtgtgtgacagtatcctattcaaagtatgggatacagttctttgattctctcactccatcctgtggaaggtaaacttaccttgcagatgaggatgaagttcacctaggtaatagatggacttggccaagccatgagactttaggtgggaaaactggaatcagaacctgagccaacctgacttcaaagcccaagttttctcctttgtgttgtctcctgagtcattttcctgtatagccccgctgaataagcattttccaaattatattttgtattgtgcaaaacttcacttccttttttattcaaagactatgtatttcatgcttcaaggttttctgagaactgcagtattctgcaaattctcaaaaaatgcttttgctctttctaagatttcatgactttaaagaacagttactttcttcctggccttcctggtgtcagtctgtatgattctataatgtttagtgtattcctttatattggctgccctttcctttgagcatttcggtaacttttcttgatagtttccagctactttttttttctttttgtctctcaagaatgaccaaaagtatatgtagtttttcagatatttgtcatgtaatttcgtgccatctagatttatataacctaacattttctggctttttcttagatatttatagatggtggtggttaaatcagagttaataatattaatttttaaaatatgcaaaatgcttttattgctctttttaattaggtttttacaactgtattgaaataggtgtggcaggtgctatttcccctcctttttctgctcaagatgattgagattcagagtaattttgtgactgcttcatcctgcagaccaaacaagtactttacctaagtttcctgtctccattctttttgatagggtctatcaagcttgtggcaaaagctcaagatgttatgtgtagagttcagtaatttaaattcatggacttataaactattaacaaagaatctaattaaccttctttctaagtaaaaacaaacaaaacaaaagatacttctagtagagtgccagtgtctttagggattcatggggaattaattaaattcatggttggtactgatcatgttattaaaggaaattaaaatctagagagctcatggttaaattgtttaaagctcccttcagataatgcaaatttcaccatcaatgccctaccctgggctcacccagaaggcatttcttagactaccactatttagcctactgtttacaaagtactttcatacatgatctcattgttcagcacgaaaaaagctgtacacaagttggtgcaatccaagtaaggtctccagtgtagctaatagtagggtaaggaaaacgatatgttgacatgctaagtgagcttcattttgacttctttcgtgtaacatgtttgagtctttgtgctgagaaaattgtattacattctgggagtcagtgggttgtgtcagaatgtgtgggaagcagctcactttcactttcaaaagattctttaaggaatttatgctttttgtaaaataggggagactatttggactctttcttattgggatttctttttgtgtgttttatgagaccaaagggcactgacttccatcatacggtttgactttggaggacagtacgggaaagtgcagcagccttgtagttatagtggccacagaatgtagtcacagaataatgtagcaccaggtttcttactgtcaacaatctgtttaatttgattttggttattttccacctcttcagcaaattcatgtcactgggaaccctaagataaggaatttgccttccctgatcttcctgtggggtagaagtaaaatgataagaattcaatcgttaggttgtccatggacctgcttaagagtgcaaggaggttttaaaggtccttagaaagtcaaatgtggaccctgctgaagaagggatgcagcgttgcttacttaaaactgtagtgaacagagaagagagaaatttaactttgatattgtaggcctcaacgagtaaagaaggctttcaatcctggcaggtactaaggttttagtatcattctctttaataagtcatctgtggacaaaaatgaaaaaatcagaaagccataattactaagaaaggagatctgactaaataacaaagaaacagattttagaagtcctgaaaggacacatttgtttcagaattagctctgctaaaatttttctttttcacagaaggaataagctttaaatggctatgtgaaaaatagattatagggaactaatgttcttagatcatgaatcagggactttgttcatttatatgcactgcttaaaagttttcacatagttatcattgtttaaaactaattataatcaattgctaactcatcttacctgggaatttatttagtttagaacatgtaagtaaatttctttaaataaaaaagagaattttagtggcatgaattaaatgtaattcaacttgagcaaagaagaaatggttataaagacaaatattaacatatcaaaatcatgttaatgtgctaactttacctaagcaataaacacatcagaacagaaaaaaacttgacaataagaaaataagtaaatatatttttaatttttagtaactagatgtttctcagtttttctgtttaacattttggaagtgaatatggctggtatgtataatgcataagaaaaaaatcctgttttatgacaatggaaaaaatcatatttataagcttatgtcatgtgaactttgctacacatcaattaggtaaaactgtactggatccattttaaccctgtgagttgattgctttcagtgaagcttgctggacatctttatgtccgagagtgagatgttcttataattaggggcagctgtggtgacagaatcaattaggcaggcctgctgaacacttaccttccagctgctggccgcggcgcagtgatttgctccagcattcattgtcacggtgtattgcctttacacctcgaaagaacaacattaatccattaagccacttttgttgctgtatcctcacgtgggggttatcacatcgcagtgaacacaggagtgagatacagcactgttcacccttgtggcatttggcatatgacagatagacagctgcatagttcaaaagaattattttaacaccaatcgcaagtattgccttgttttatttccccatcaattatccaagtagctcagaaaattcagcaattttgcatatctactgtatttctcagactgtcttttgcacgtggaataagtgcagaaataatgtcatgtggtgtatcccaggttttgtgaggaaaatatggaccctattgatagatcattaaataaaatctttagcacattgtctggtagttaagagccagggctctggagtcaaacttcctgggttcagatactgacttgatagtataccagccgtgtgactatagacaggttactttacctctctgtttctgtttcttcatctgtaagttggtgataatggcagtaatacatatctcctggagttatcataaaacttaaaaacgttaatgagcataaagctcttagaacaatgcctggcacatagtaggtactcaagtatcagctattattattcaaaggtgtttattgttgaaagtactatatatatatatatatatatatataatgtgtatatgtatacattacattctactatatatactatatataaatatactgtaaataaaaaggactttatttaacttcatctcataggctttggaaatacattatagttgttttaagatttttatctttagtccctaactgtgaagtacagggcaaggaactgtatagaaaagagagattgctaatttcaataaataactaatttcaattatcagggtgaaaaattatctcacctaataaacctgcattcattttcccttgtagaattttacagtattgtaaatttctcacagacaaatgtggagaggtgatttggtttacatagctcattataagaacaaaaaatttactgtagtggctatgaaatggagtgatctttcccagatttttaatctactgtccttctctccattttctgcctccacttcaaactttgtagaaaaactaggtatggtaaaaagtcctaggtttaagttttggttctgcaacttgttagacttacgacattaagttcccctatcagtttccatctcctcacctgtaaatggaaacaatcattaggtaccttacatgaaatacacaccagaactgttgcagatgaaaggagatttgaccaaatagtaattttgcggatatgtagtgacaacaaggcacattaacagttaagggagcaaaccagcatcttgtagaccatggtcaatcaatggagaagagcaactttgacttgagggcataggaggtatggtggctgacacttataatcccagcactttgggaggctagagcaagaggattccttgaagaggattgcttgaagtgtttgagaccagcctgggcaacatgaatctctgtatacaacaaaacaaaaagcccagcgtggtggtgtgtgcctgtgcctgtggtcccagctatgtgagaggctaaggcaggaggatcacttgagcttaagattctgaggctgcagtaagctgtgatcacataacaccactgcattctagcctgggtgacagagtgagactctgccgccaaaaaaaaaaaattaaagcagagaaggtaatgtgcttttcttgcaataatacaagaaccgtctgaccactctgggtagactctgaaattaggtgaaataaatgagctagcaaggaacatgaccagggtctcggctgaggcagggtccagtttgagagtcctccaacagtgatggccagataagagaaatacagaacatgaaaacttcaaagtaaagataatacgacttacttgacaattttccagttagatttacatgtcatttttgttagtgtctgatggcagagcggcataagagtcctagcccagtggcatgcagaacacaaacaatgtcacagggcctcacgattccaaataataaaaagtcatagagaagatagatggggcctctggaatcattttgtacctgggtttcttctttgtcagcatcttccagattcttcctcatcctttcagcagacacttgaagtcctactttgggttaggagagcctgagatcctgtatatcttccattcaataaattcagaaattttgatgtttaggtatagtatcaatccaaatggacacatacacagtcaggaaatagcctaaccctccaaatagagactgtgaccccctgctattaacttgctgacccttgtttgatttcgtagggataaattccttgaatggccctctgtttgtacatgtgggtttttttgttttgttttgttttgttttgttttgttttttgagacggactcttgccctgtcacccaggctggagtgcagtggtgtgcccactgcaatctctgcctccccagttcaaatgattctcgtgcctcggcctccctagtaactgggattacagatgtgtgccacaatgcttggctaatttttgtatttttagtagagatggcgtttcaccatgttggtcaggctggccttgaactcttgatctcaagtgatccatctgcctcggcctcccaaagagctgggattgcaggtatgagccaccagcgcccagccctctacatgttttttaagtgcagtcagttgagtatggttttcagatggagaatctgattaatcatcttcaatggccttagcataagcattctatttaactgagctgattgtggctcataccctcaaatcaaatatcttaaagaatcatactgtttcagtcatcgtgtagcagttaattgtgagaagtgaaacttggaggacatccgtatgtaaaatcccccaccaaaggaaaccaatatgtttgggaaatcaaaatgaagcactagtaagaagccaactctggctgtagtggcaccactgtgatgagtgttagcataaaatgctgaaatactgcccccaattttattcttttatgttgtataatgaaacgttctatgcatgttatgtgcttgcaaagaaattattcagtagttcatatacacatcgttggattacataaggagctggacatggaactgctagaatggaatttccagagtccagccatcttaaccctactttgaagcctattcccagtgtgtttgctggttggatttagtttgctgccagtggtaaagagagtcagcttgagaatatattataacaaaatactgaattttatggcaacttttatttcaaatgaaggtgccatcctccttcctcagtagtcagggacaaatagcagctccattccagctcacagggaaccctatttaacttgaatcaagaacattctgtctaagcctgattcagctagagcacagggcggggtgagcacaacatcaccacaggtggcaacaaataatgatcttgttgggcgattcgggatataacccaacatcacccactgcgtcagtagcagggcattaaaacctagctgcattccgaaataccattaccactagaatgtgctgccttttacacagctatatttacacatttgataagacaaactttcccttttatagccaaatttgtgagtgcagctcagaagagaagaccagatggaagagcacaaagtttatccactctgttgcaggactgtaatcaacttcgtgagatagtacaaggagagagaaatatgactgggggagttttggagactctccatagtaatttatctacttctaacatgactattaacaaaaggacatcctgcatagaggactgattaatggtattcgtgtggctttcattagctaacataattgtcagtcaccggttgtcactgtgggatctgcacatatgtgatggtgggctttttacacatttatgcagggaagacttagctgggatcatagctgaaagctcattgttacttgataacattttgcaggtttcctgtgtaatttgttcaatgtgttgaggctcttcagattagctgcacaaacgtggagagtaaagatatgagctagctttgcattgtcagatccttcagagaccagaaataacaacttacctagtgtcacatgccatcagcatatctctgcagcagacacatgctaaaatttgtttcctgttcttaacaatacagtacaatattcgatatagctgcacgaataatatttgaaaaataagggcacagtagatgatcaaaacaagaggattgcttagatgaatgaggttgtttttttggaaatttattttgcccttaccacaagtattttttcacccattaaattattagaataaatgaacatgttgcattgagtttttgtggtggtcagaatatgaaatataagtatttttggattacaaccacatttttcttccctaaattgtgtgacatagcaaataggaaaagcagaacacaaaagtagactttggaagtatactttgcatacctgcatgttttgagttagagtcagaggagtatatttgtgatcttttaagatatttgaaaacacttaaagcctgtaaagagaagtattcaaaagaagctcctgtgaaatgtgtggcattgctctgaaagcatttgcatgtctgttttaaaaggctgttctttgcactggactgtctgcctctgttgatgcatttctaaggatgtggatatgtttatattaatgtcaagcaagtttgaaatagatttaggcacagactgcttaaaacttgctctgttattaaattgtttcagggtgtggaactaccgcctctctagaaacacatagagagcaaaattatgaactgcggtagaccaaatacaattaaatcatgcttaagattctcggaacacctcctgcatttgaagcattaacttagccttgagcttgccttcaactaatttttaattaacagaccttttatgcttagataagactttcaagacaagtaaaaatttttttgcacttttaaaattcgagtacttacttaacaagaattgaccctaagtttaggaactaccattggccttataaagttattcctgggtattagaagatacttggtgaataggttttatttcagtgaaataaatgatattgtttcatgtgagtaaaccatatgcctgagaaacacgtgtacattgaaaatgaattctattaacagatagctatttatataatctctgacaaaaagaaaatttactctgttgaaaattgactcattatggatagatgaaaaaaagtcatacaaaccacatgggctcaaatattagtttgcacttttataagaatctgtgaaatattcagggctattccagtagtcctggaagacaaaaagtttgaaaaaatatccataaagacaaaaaaaggtttaaaatttttgccctgtgtccttgatacttgaatttgagctctgccctgagtgagcgagaacctttgtatggtccttgtctagaaggtaccactgacggcagaacatccataagtcaaggatgcaattgtgcagctctgttggtagtacacagatgtgtttcttcacttacgctatggaggattttgagttatcaacttaagagagctgttttctgaaaagctggatatcctcatgtcatagaagttaccccagaaggacgcagcagggacattattacacctggacttctagggatgcaaagttagagtagctgtgagcttttccacatctgatgattttggaactatgtgcaagagagagaaattcaggctggtcactagaggtatccttgaaccgcaaacatcgagaaatgttcatacatcagggtcagcttaagaggggatattttagctaagaaggaccttggatctgaaggtctctgcctcattgcattgtagatcatctcgtaaggcaaggaatgtaccactctgcatatggaccccaaaaggaaaggagaagtgttgacctgcccaatgagtgattggtttccttccatcaaaagaccatagtggggttggggccctgaagtcacgattgtgaggatgaaccatgagcatttcagtgcaataccgcttgcagaatttaaatgatttaaatgaatgtaatgttattattaattaaatttaacttataaattattaactcaaatatttacaagaatttctttcatgaatgcaaattaaccaagagtttaaaaatacttaatgacatgaacataaagaagaaacctccttgagagcggagggtgagaagaacgtgacgattgaaaaactgccagttgggtactatgcttattacttggacgatgaaatcatctgtgcagcaaacccctgcaacactcaatttacccatataaaaatctgcacatgtaccccctgcacctaatataaaagttaaaaagaaaaaaaagaaaaaagaacagactaatgcacacacgcacacacagacacacatacacacgtgcgtatttaatgaagcctaggtcttttatctaatggcagaaagatcagatgagaaaggcagaaaatcagagacagaccaaggctcccggtttttttttttttcctctgtatgtgttagcatgtatatgtgtaaatgtatttctgtttgctaaaccatctaaagtttagttgaagacatcatgacatttcacccctaaatgcttaagcagatattgtctaagaacaaggagattcctttgcgtaaccacaacgcagtgctcctgcttgagaaatttaactttgatacaatatttttattcagatttccccagtagtcccaataatatcctatacagctctttttcccttggagcaggatccaatcagtagctccacattagattgacttgccatgtctctttaatctcctttaatctagatcacatttacagtcttcttttgttattgatgacattgattttaaagcctacttcagttgttttatagaatatctctcattttgaatttgtcgtattgtttcctcatgtttgaaatcaaaacccctaatacagaaataaataaactaatgaagacagaaggtgaagaggaaggagagacgagctagagagagaaaagaaggaaagagaggggcaaactgattttatgataaaatgtttatcaaaggggaagaaaacaaagtctccatagatttatgctcagactatattgataagcaaatatatggagtggtaaggggggaaacatggtccttaaagagaaggtatctgaagtatagttgacactcagacaatgtaggcattaggggtgccaatcccctgtgtggccaaaaatttaagtataacttttgactccccccaaacctaactactaatagcagcctactgttgactggaagtcttatcgatcacacaaacagttgattaataaatatttttaacttatatgtattatatatggtattcttataatacagtaacataaagaaaatattacaaggaagagaaaatatatttattcatcaggtgaaagtggatcattataaaggtcttcatccttgtcatcttcatgttgagtaggctgaggaggaagaggaagaggcgggcattggtcttgctgtctcaggggcagcagagacagaagaaaattcatgtataaggcattttgcttagaggcaagggaataaaccttggaagttctggtgtgttcccaagttaaatgtaaaatccagaggggtgaagaattcaaactagttatttcagtttataataaattaatgaggcaatgtatttttttaatatgtgtaaaccagtttttggtgtcatgtagcaccggcagatttgtttctttaaaacccttcaccaggccattggctcacacctgtaatcccaacattctgggaggccaaggcaggcagattgtttgagcccaggatgtggagaccagcttgtctaacatggcgaaactctgtctctatgaaaaatacaacagttagccaggggtggtatcatgcacttctggttccagttactcaggaggctgaggtgggaggatcacttgagcccaataggtggaggttggagtgagccatgatcatgccactgcactccagcctgtgcaaccgagcaagatcctgtctaaataaataaataaataaatcccttcaccaggctcacaaaattaaaaatgatcttaaggagttaacagaaatatgtagacactatttcagataacatgagaatttagtctgttttaaaaaacctgcaaaacagagattcatgaaccacattttaaaaagacttctatgaaagctcttcagaaaaaaatattttcaaggtgtcaaaaaaaaaaaaaaaaaaaagaaccagacaaaatattcaggtatcaagggctaagaacagctaaaacatgttttctaatttgccagtggccagtgtgtcaactacattaaatggctgcttctccacctcatctcccagccaccaaataaataataaggggaatatgtagctgtaggggtactgctaagaaatcacagcattcaaatgatttttttctgaaatttattggaaacttcgtatgttcattcttgacatttttaggatttacttggcaagggcagaatcgtagaaaaacaaatagagttccctgagtaggaaaggtctccatttcctgttcatggttaggtgatcctgattactgtccttggagtcttgagccccttacccggtgaataattaggtacggaatcagggaggtatagactcatttgcctgggtttgttttctgggagtttctgtttaacattcctgaactggagcagaagtagattttgtagctggcttttctgagactcaggaaacagaattgtggaattctcaggttctgtgacatttgttgattattaaagtgaaattatgtgtgagaggaaaatttattcatctatgcttttaagaaatgtctatgataaacagaattagacatactatatagaattgcataacacaccaccacatgtccgtattacccagtttccacagttatcagcttcttggtaattgtttttcacctttatgcctatccatttcccaccaccatattattttgaagcaaatctcggatattgtaacattttatctgcaagtatttcggtacatatttttaagcagtcttgcttaaaataagaatggtatgtaggtgtttaatgtattctccaagctaatgcataatttaagtactcacagtctctgttgagactatttagatgcactaaatccaatcaaagagagaatttgttgtgagtagtggtcatctggaatggtccattcattgtgtatgggatagaaactctgtaggtccagtcaaagagtgatagcatcagagaatttctgtcttgaagaaaggagccattgttaagattgatgggttttctgtgttctttggtcccctctgatgacaggatagtgaaatgagccctagctccgagtacccacaaactttgtaaccatggataaagtcagccacttacttatctctgaaattaaacttcccgattttaaaaatggatgtgatgcttcctgcgcctattcacagtactgtgatacactgtgatttgggatgtgaacacgctttaaaaataatggcccggttacatattctcctttttattttttatttttttttaatttctttttgaaacagaatctcactctgtcacccaggctgaagtgcagtggtgggatcatggctcactgcagcattgacctcctgggctcaggtggtccttccccctcagcctcccaggtagccgggactacaggcacatgccaccatgccgagctaatttttgtattttcatagagatggagtttcaccatgttgcccaaactggactccaacttctgaggtcaagtgatcctcctgcctcagcctccgtaagttgggggattacaggcgtgaaccaccgtgcccagcctacatacgctcctttaacacaggcttttggttctttgaaattaccaacattcaggattcttaatggcatcagagaatataaagcttgaaactatctagaatttttttaaggaataattttctaatcttggttctctgcttctgagtatattttatttgggcattttatttttctccaagatgagatccattttcgctcatccattttgaaattgtttttctctctgttaataaaacctttggaatggtgccttgatcaggctaactccagattaaatgtttctctttgaaagattgcctggtgatcagagttgtttttcattctcttttcttcttttagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggtaagtataatgcataaaatagtagagactgcccccagcaataagataacatataaatgttatttagaccctaataagtgaatttactatcagaaacataatagataataagtgaaaagctgtttcattatataatgacaaaaaatcatgttatcacataggcaagaattcttgtggttcttacatcttattgatgaaggaaataaaggatggctggagaaagaactgtaggaagtaagaagagatggaagggaagaaggaagagagcattagtggtagatgctgtcatagtaatagatcctaaaattcaatttcttggccgggatggtggctcacaactgtaatcccagctctttgggaggccgaggagggcagatcacctgaagtcaggagttcgagaccagcctggccaacatggtgaaaccctgtctctactaaaaacacaaaaagtagctgggagtggtgggcgcctgtaatcccagctacttggaggctgagtcaggagaatcacttgaacccgggaggtggaggttgcagtaagccaagagcacgccaccgcactccagcctgggcaacagagcgagactccatctcaaaaaaaaaaaaaatgcaatttctttaaaataagacaaatgcatatgataatttagagtaccagtgccttacacagttaaaatcacaacttcattgtaaagctcagtgaatacttagatttatggaaagaattggaatgtaaccagttgaattcagactattttttaacaaggggttaatgatataattttatctaataagaatttttaactgacactgctgataaagcacatcatcattctagcagattttaaaattaggtaatcttaggtagcaagaattttacatgttcctaccctccccgaggaggtccatatttgacagggcttcatgtgattcctgtaacatcttggtggatgcattctgtatctactctaaaatgatactctgttatcatccctacactcttcattcttatttacttccttacttaagaatcatttcttctaatatcaaactacattttgaaatcagagaagagataagtggattagatttttgcttctaaagagtcctttaatcaacgtgacatgtataatagtggttccaaactcaaagatgatattttctgcactcacatctcacagggttccagtgaacccccaagtatggtaacagaagcaacagaacaatctcctatactttgattttataggacattaaccagaaagttgttacacattcatgagcaaagtgattacaatgagaattaaatttaatcttatcaaagattttgctctgatgactgtattttcttttctagtttctgtggttttattagctacatactttattaactacacgttgactctagttattgatcatgtcagatagatctatagctttggaagtataataaagtgtaaaagaaagggttgtatcactttctgcagcaggtggtacttcaaagatacaaaatataatactgtaaagagacatggcatttttatacctaatattactaattttttttacattattccaatatgtagcagttcagcagcacatggcaactatcttattttgcagattaggaaattgagggtcaaaaaagtgttctgctttgcctcaagtcatataactagtaagagactcagtgagagctgagtttatcattgttatacccattaaaaatgtaatatactgagaatgaaattaagtttcttcctgtagatcatagtggtaattaatggttcaagttagatttgaaataggtctgactctaagtctcatgtttaacagcatatgtgcatgaggggaggaggaaatacaatgaatgaattgaaaagataagtatgattcttacaaagaagtttaacaggacaaaaaaatactcctagattttggatggaatggattttggtgtttgcttttcatcagacaagttagtaaggaatgaagttatctctacatgcagggtaatgtctcatttatttctacgtggctgtcaaaggataccagtaatatttaagtgcccatgaaaggttttatgctaggactgtggagaaattaaagaggtatagggcattacaatctctgtgcccaggggcgggggtcataagattgtacagagattatctagttcagtcttatatgaaacatgggaaattttggaagttatgtattgaaacactgttagagcaggggaggaggaagggagggaggagaatttcatctagaagaaagcatctcacattgcagatattcaatctgatgctacctggagagaagcaaatgaagttcggtagataagatgagaaaatgaatttttttaaaaaagtgaactgactagaatgaataggctttagaaaaggtacatgtatacttaaagaggtaatttgttacctggcttcaatgacatataaaagtatcattagtattcagaaaagcattttcatattggcttcataggtccagacagctaagagcactgtctacatattaataaaatcccattataccagaaagggcaatagttagaaattacttcttttaaacaatagtcttgctggaaagaattaaatggggaaaaatgtattgaagtgatgcaaccataaatcactcgcagcaaagcagttaacatatttgatctaaaaataagacatactttgtatagagtggacagctacttgagaagcgatcatcttatcagtttttagaattgggtattttgtcatttctaaaattgtgtctttttataaagaagagcattgtcagcttttttaagattaaaggttccaactgaatctcaatttaattaacatttgcaaggtgttctattatttcaatttatccagtaaatataagtagaaggaatataattattgttatacccatttaaaacattaatatcctgaaaatgaaggaagctgagtttcttcctgtagatcatagtggtaatgaattgttaaacttagatttgaaataggtctgactctaagtcttgtgttttttcaacagacatttgtgattatgctacataaagttagaagtcagaacatagggctctggcatgcttaggataatgtctttaattaaaagattcttatttttcagatgcatttatatattactattaatgatttttaattactaagatattcagactattagtgttttgcagttgttagttggttacttgacttaaactttttcttaggctatgatcaaccaagcagaggtgaagtttagtttgaggtgtaagatttttctgggattctctttaattaaatactttgactctttcccaatccttagtcttggcttctttttcacacttcttataatcagattatgcatagcagccaacatatccttttaatctcttggtgtttagtggcacaatttcacagcaatatgcaatttctattattttgtaaaatcttacccttgttttgcccacggtcctactaaaaactacattcctacgtgttctttgtatgatttttgaattcccattgagcctttgtttatttggctaacccatgtgtggggccaatgaaaagaaatggaaactaccctcatgttatatgtctgcttatgtctttgttcttgttttctttgattggtggatgattttgatcaagaaaactggttaaaaagcttggcgtgtgacagattcatatgtaaggactggcagattgacctcatttaaatacctgttctatcttagctttattaaagactggcttcctattatttgtatgtttcacacacttttggacaccattaattttgcctcagctcttacatattttaattttgtttaaaattggctgtcattggttacattggacaaatattacaattatttcctctatttttactggttgctttttttgactttataatggaaaaagtttatgtgcatttcttttctcatattagctgagcaactctggcagatcacttgaactttatatataatgaaatctcaatgttcttatgtagaaaatgagaatcctcagtggcattccatatggtttatgtgaggcacttggtacagtgactggttctgttgcttaagaagcctctcttttagccaagcacagtggtgtgtacctgcagtccctgctactgaggatctcttgagcgcaggagttcaagaccagcctgggaaacatagcaagaccccgtctctatacttaaaaaaaaatcataatttcctctttcacttctttgtccttttcacgatgatcagttttacactatctgaagcagtgttggacacacacacacacacacacacacacacaaacactgtctatataattccttaggggtcagggaaccaaaactgtataaacagaagagttcttccctatatgtgtttaagttgccttagcctgtaactatggtagaataatcgagttaaaataaaactaaactaaataatagctaatggaaccttgaattcaccttgtaagtgagcacacagtaaaaaacacagtgtgctttctgatattaaaaaaatgaaaaggaaattaatattcagaactttttatcttcaaatcacttcacattaatttatttttacactgtactgttttttcttattctaaaagtaatgcatgcttattatgaaaatccaaatatttcaggaatatagaatgtaattactataataatagctaacacttattgggaagttactatattgaaaaaattattttaaacactttacacgaattaactcatttaatatttttagaaaataaaaatccattgaaacaccaaccttcctccagatccctagaaaactcatcaattaaagagcaaaaagttaaatttatgactataagggaatcaagtagtctttccaagctaatttccttcttatagacagagtatggtatcttacagaaaagaaaaaaagaagactgttgtatccatacttatcaaagccccaaatctttttgcaatatataattttcaaggaagatttggctcattctacactcttactacattctgtccttactctaggacacaaggctggatgaatcccatagttaaatgtatcattagaattcagagggatgtttatgctccttgaggtcagtggttttccaatgatgtctctgtagagtcctaaatttctattgaattgcaaaaaggattaccagtcactctgacctggaacactttctgtgtgatatttttgaatatgaggttctgatttaagctttcattttaaaacaggattttgttgtaaaaaatagttgaaaccactgatctaatttaatctttctctgcacagagatattcttgtaggaatgtgcttggcaggtggctatccagacttgaatctttccaaagagaaaacctaactctttcacaagacaccctatacatttttgaatgctcagaaaagtgcttctatgtaatatcattcaaaacatgtttcctttttcctgtaagacttagttttcctgtaagacttagcaatcccaaataatttccttttccatatgcatcctggaaatatatttaaatagctactcatatttcattcatagttgtctgccagtgggacctctgtttctttaacataatcctctctagtgataagatttctaggccctattcaattctgatcaccctcttctaaagtcctttaattatgtttttttatcatcaaatatcattccaaagtatatccaaagtataattcagcattctagatatgatctagccgatgaggaatgtattggggcttttatccaagttgattgatgctctgctttaatattaatttggctaaagagtacataaggttttttttgttattctttcttcttaaaaatagttttaaaaatgggttaataataagcatgtggctaattagaaatccttatttctgcatatattgtagtcaagggatatctcctcttgtatttatgtcaccagttttcgtacgtgaatgtacttgtgatgcttatctcgatcaaattgaatcttagtcttggcccattgatgttctgtcttaggattcccaagggtgttctccatagaaaagattccatggccacatgtcatggctgccttagaaattcacagtacagatttgcaaaaattcactgagatgcattgttgtaaagagacctatttaactttttttaatgcaacatttattttagcatagaaccattttttttaaatctctctttcttttaaagcctaacatttgattgcattactaggaatagtattccaggaaacagtgccaaggcctattaggagaagtttgattttaagacttatccctttaagattatgttaactgtaaatatgattaccatgttttcttatagttccatctagttcaatagttaaaatgttaattgcattgggtcaagaaaggggtctttacatacaaacacgattgttcctagatttgtataaataggaaagaaaggttgttcttgagggtgttgtaataatcttggagttgtaaattcttgggatgttgttgtaatcttatctcagaatttggggacttaagaaaagctacagttttcttactttagaaatttactccttctgtggcattgaaaatcaagatactatgccccaccctgatattgttcataatttatctattattgctagtggtttcatggttatacatgaaaattcttccagcaaaccatgctaaatgttgggctggaaaatcttacagtgcttatccatttttttcctcactatttttcaaaggtacctgtcatgaaggaaacttgtcatatatgatcaaagtagatatatagctgataatccatttaaaaaatcatacggtatttgaacgctccaaaattcagccccaaaattaatacagcctgcattgggtgatattctaatattgttttatttcgataattttaaaagttgtcatattttattgttaagacatatctatttgcaaagatacttgtcatcaaaaggcccattttggcttatagggatatacttcagggaagctttcctatgaataatgtctctggttgatgtgtgaatattctttaaatggcccttggtggtctccccattcctagatagataaggctgttaaattacatccactttttgtcaactttgttccgtggaccattattttcagaaaacattaacagatatgccttgtgaatgaaaaggattccatggtcaaaggagtttgagagaaaataaataatatatcccttttcggggagtcagagtacaacagcatattcaagatgctgagaaatcctgtgagattaaagataatgaaaagcctgtctttatttcacctaatattttccaaatttatttgaatgtggaacacattgctttgttacctcatgtttacctgttgacatcgagtcccgactagcgcagttaacttttctttttctttttctttgaccaagtctcactctgtcacccaggctggagtgcaatggtgtggtctcggctcactgcaacctctgcctcccggattcaaatgattctcccgccttagtctcctgagcagctgagactacaggctcatgccacacacctggctaatttttgtatttttagtagcgacagggtttcactattttggccaggcttgtcttgaactcctgacctcgtgatctgtcttcctcggcctcccaaagtgctgggattacaggcgtgagccactgctcccagccgtgaagttaacttttcaacccctatgttggtttgaccaccactgcccctggtctggaccacctctgatggtctttgccctctcattatggcatttttctttcctcccaaccagccttagaaatattaggttctgctgagtacttaagcaaacatccagatattttattcattcattcacacatttattcaataatgtctgaagagaaagcatagcctgatgtatgctccacgagactagcaagaagttgacattatagctacactctccaaagtatatgtcctaggtcaagagatgagacatactgaaggaactctcatgagaggcgtactcagggctgtcagaatttagacacgtgagagcagctccagctacatgaccaggaggggcttggtgaagcagttggcacctgacatggccctggaaggtcagctgagattttgatgcataggaatgcaggacccccattgtaggaagaaaaaatgacacagacaaaagcacagaggtggaagatcagggggtctacatgtggaactttgggtggttcaatcggatagactggaggatactagtaggaattatatttggaacaattgatttttctcagttaacattaatgtgtgacaagaagaccagaaaattcaccagaaaactagcaaagtataacgtgggagatttgcaaccagaaggattactgttgtttcttcctcctttgttttctcccttgtcgttatccccttaagagcccaataaatcacagttaccaggctagagcatagaaggattgctattattttttggagataggggtctcaccctgctgcccagactggagtgcagtgactcttcaccagcatgatcatggcacactacagccttgaattcttgggcccaagtgattctctcatgtcagcctcccaagtagctgggattccaggggcatgccaccacaccaggctttagaataattctttagaaagaattcagtaaactctgagccaatccctgctgttctgagttcttatatcttggagactgcttaaattataggttatgtgcaacagtaaaacacagacacagcaaatcacaatgctgcccatgttaaaaaaaaaaagtgaatgttgatgtaatattcagagttttataaaactatgtgataatgttgcccaaatatttattccagtattaagaacctttcatgtggtactatgctcccagcaatgagaatcttaaggaaagaaaaattcccttccttttggaattgataaatcctcttaattcaaaattaacattattcttgatgttactctactgagaagaagagtgcacagtatttttaaaatctattctaaccttcagtaagtgtccttaacagacttgtaggaaatgattttatacatttttctcttcctaaaccctagtggctgatggcatttggatatagaaaagtaagaaaatttaccaattgggtttaaaaatctaaagtataacacagttattggtgatggtaagggagtaaaaagaaaaactacagaagaattcctttaaactactgatttaggtgataaaattgagatgaaatccatggtacaacttaaatgtgatgcatcttacttttactctaggtaaaatcatgaggtcagatcaatgtaacggaagttgtattttaacatatgtataaggtggggagaggcagtttgagaactctgaaagcatagaaaagtatgtatttatatttgttggatttctgtgatatatactgacaccactttggtcctgatcttataggaagtcagaacttcgcattaacaaagcatcactggctgattctggagagtatatgtgcaaagtgatcagcaaattaggaaatgacagtgcctctgccaatatcaccatcgtggaatcaaacggtaagagatacctacggtattctgttcctcaatctgtaacaagagtaatcaaaacatgtggtaagactcataatagactggtgtgttaaatctcattgtgaacaaattaaaaacagagaaagaaaaccagatgtttcaaggatcttgtatgtctttcataaatttctgtactctatgagattatatagacctgaaatatacatatattttttacaaaaggattttaataaggccatgaatggcagagataggttgggttgctaaaatataggggctatactatttttttaagttggtcagtgagggcagtcaagtctttggctctctgaacaacagaatacagtcatatatatatacaggatatatatacacaatatgtatatatgcacacagaatatatgcatattatgtattatatatgcgttatatatgtatatatgtttacgtatatataacatatgtattatatatgtattatgtatgtattatatatgtattatatatattacatatataatatgcatacatatataatatgcatatattctgtgtgtgtgcagaatacagtcctgactcaattctggcaattttattcccattacatctggcattaggtagtagaaagttaaaccattaattttttttaggcctattaattttgaaattaggaccgtcttagaggcaataaatttcctactaggaagaggcttcatcttcagctttgttcagaatagtaccaggcaatacttgttaaacaaatgaatgacttagaggtaagaaatacaatccacctctgacaacttctgtgttattccaggaaattaaaagaaccaccccgatggctttgtgttttgtaatagcctgatactccatgatttgatggaatcatctataggagctgatgatgatgatgacctagcaatgcttctttaaaccttttagaataatcaaatgctattttaaaacctttagtgcttatttatttatttattgaattatggcacttaactattgcctttacaaaatttgtcatctgttatataaccaagcctaattgcatcttcttggtaggagatgagaaagattctgcatttcaaaggcaagcgctcttaaagtgataaggtaaaaatgccaggtcagcacaggcagagttaaagtaattttaagggttaattctatgggaggctgatgtagtttttgtcacttgattcttctgtaacatactaagaaagtgagaagggagataaaaatcagaaacagggctgggaaaattcaggttaatgcctcatcctctctggacttctcaaggatctgctccatcacagagtaatcaaagtttatcactttcattttaaatgtctccctccatagagagtaaaggagagcagggaaaaggagtttccattaccattaggagtcctgtttattacagtttaaaatgtaaaagccatttaaaatttatatgagtaaatatagcatcactttattttttaaccagggcaggttaagcaataatagtttgctagtattactttaccccacgtagaattctataggatgctacctgaaacacacattaaaaaattaattttaatgggctgttttttactttctactataaccattgtttgaagctcgttctccttagtttgtcactggcttggttcagtgtgtttcctcatagttaatggtattcaattgtgatttttgacacttggatttgattcgtgtagctataccacaaagtcccaggaaaataaaattaaagctagtgtcatagtctcactgagtgtctacagaagtatcatattgattattccatggtttctgatttacaggattaagcaatgaattatttactactatattattcctggcaaaaacccatagaattccttttttattaatttgggggtactgaaagtttgataatatggctttttacatttcttacataggaaaaacagctaattcattttttccacattaattcactgaagtcttggtctagtgatcaaatttgaatatgtagtgttgaccaattatagggtagagagatgaaactcgaggtgtttttgataatgagtcttttttacctggcaagaataaagagaagttcatggaatattttaagtaaatccttcttaaacaaccaacaaaaattctttcagaaataggttcctatggacttatgtaattaaagcctctgaagaatgagaatgaagagtctcaattgcaatgcaagttggccttctttttattctcttcttggaatgttaggaatagatcatccttatccaaccccttcattgtattaaaaaagaataaaagacagcatagaaaacagacttattcaggatcacagagatatttaacagcaaaaggagatatgaacccaggttttttttgttttttttttttttgtttttttttttttttgcttcattcctaccacagtgcagttccatctgtatctgaaatgttttttgtgtgtgttttcttttttgttttttgagacagggtttcactctgtcacccaggctagggtgcagaggtgtgatcttggctcactgcaacctctgactcctggactgaagggatcctcccacctcagccccctgagtagccaggtgcatgccattacgcctggctaattaaaaaaaaaaaattttgtttgagatggagtgttgctatgttgcccactctggaactcctaggttcaactatgttgcccactgtggaactcctgagttcaagaagtctacccaccttgaactcccaaagtgctgggattacaggtgtgagccgctgcgcccagccttactctgtatctgactatatgcttgcaaatgtttaagtgagattcttttgcttataaagaacagaagctgaaggaatggtatgaggcctaaggagtgagggattctatggcgaagaactagaacttcattataactcagcctcgaggagatggaattgtatgctgagcatctctgcgaatttaagcaatgcgagtttgtggcttttctctctggtgtttctacctttaatatgcttctgatagttttaacaaaagttacctaccttctcacctctcctactttcagactccgcctctttataattccaaactttgacctgtttcttgcccccacgtggccatattcttcatggcaatttcaggcattctttcagctttaacctctactgtatgattgtttccttggttccccagtgaaattccgcagaccaagaatcctattagcaaagttgattgttgcatattcattaaaagacctagagaacttacaaattatctgctgtctggtcatacgtccactgctgcctcaactagggagggtggagccggaaacatagctgcccggaagctcctctcttcaaagtctgggggtggagcatgcagctcacctgggcctgtggcttggcaggcaccatgattgacaaggccagtttcctgtacattagaggagataccctttttgctctgcaccttagagtcctagttatagtgcatccagaaggaaaatatgtaatcatcttgatcccttatcctcttccactgctatctaagaatttgctatattctgttcaatgcttggttgtcaaagaagcctcagttgggttctgagctctccggggcttagatgcactgcctttgtattgtctcattcctgtctccctaggaatcagggcagacgttgcacagaaacactttttctgagagaaaaagggcactttctactgggtttataaattgccgcaccactgaaccatgtcttcctaaatagatatttaccgttgacttgggctgatagagagtagaattctcaagaatttccttccctccctccttccttccttccttccttccttccttccttccttccttccttccttccttccttccttccttcctttccctccctccctccctctgtctgtctctctctctctttccttttttttttttttttttaaatggtgtttcgctgtgtcacctaggctggagtgcagtggcaggatctcggccactgcactggattcaagcaattctcctcctggattcaagcaattctcctgcctcagcctcttgagtagctgggattctagacaccccccaccacaccccagctaatttttgtatttcttgtagacaaggtttcgccatgttggccatgctggtctctaactcctgacctcaaatgatctgcccactttgggctcccaaagtgcttggattacaggtgtgaaccatcacacccggtcaagaatttattgtttcattgtggattctagaaaaaaaaaaagttgttaaaataagaacatgctgtcaaactattacattatgtagaactccccttgagattttaatttatattttctatgaactatcagtcactttattaatttcattttttcaccttttctatgtatttccaagaagctcatggctatagtttcgagaatttctatacaggtttccttgatgaatgatccttgtaggttgctgcaatctaattatcctaattttttcctatgcagaggattccttgtgattcacttaaattctcacacagttactttttgtatgttccaacatgtttagaacatattttgatacaagattctaagagagatggggaggttgggggagacattcgttggaagctgtttactttctccccagatgaccttgctgtttggcatgatgtttaatctcattaaggaagctatagtaattattaaaataaaattagatcataaaagtcttctgcaatgaaactcattgtttagatctatctggattagtgactaaatataaacgaaatgattaaaaaattaggaaattccccttgaaacagtatatgcttgggtgtaacagtggccatacttatactgttttcaagcacttagaaaataatacagtcaagcattttgccaacctacattttagaaatgtaggtgttttctgtcttttccaatgcctttcaacccctactttattcagaattagagaaagtaatttatcctgtagtagacatatatcaacctatgcaatctgctaattacttctgggacaatgtaaagcttacaaagaccagttgggttttcatataacaaaggatctcataggcagtaattatgtgataacttatgagtgaattcctttcatgaattcgtatatgacagcagaaaaggccacatacatcatgtttacacaccctacacactatatgttcatttgtatttgtggtttatttggctcagtctgtatataggaaaccttgacttagcaattaattcttagctaacaagctttgtgaaaactcctgggctttagagtagggaagagaataatagactttactggtttccaaattaattaagtaatgctttcttttaaaagattaatataggaaaatatacaactaatcaatcatatcttctcctaagttttcttttttaatcagaagaaaaattatttgaatgagattcaagttcccacaggagcaattgggcttgtagcaaaaaaatagctgtttcatttgagatgagcagaaaaatattatttttataaaatttaattaaattatcaattgcagcttttaaaaatagactcatactggtaataggcttcgccttaccccctttcccaaattgataatgatgttagaaatttcacaatattgggaaacaacctgcagttatgttgaaaagcatgtaaaatatgttttataatttgtataacagtctacatgtatattgtattatgtaggatgcccaggaaggcaaatacatgagaacaatatgaaagcaatagggtagatttgtcttttcaatgtatggtatccatcctgtctacactgtttattaatttcaaaatttctcagttgccttagagtaagcattcattatgaacaggaagaattcaggtacttaaagatgttccttaagttatctttataactgctaataaataaatatgtccacttttaaatcttttaaagaaatcacttgatcaaaatttttgtatgtacagcagtgacatataagtttggtaaaaaagtcacataagtgaatgttggaatacacacagacacattttatgtatgtttgtatatactgtatacaatgtgcatatgtgtattttgctacataattatatttagtgtattatgatcatgatgaaattgcaaacatgttacattcataataattagaaaaattcctttctagaagatatctttgagaccatgcaactttttcctgagaccagaccccgtttattaagaaagaattcaaacattacaaatatactaatgttcattatgtttacttgcctgttcagcataagttgctcagctgtgttcagtttctgataattctaaaacctcattaatttgcactaatgaaggggctgtcctttataaattaacaaatgtaatatgccaaattactatgggaaaatatgttgcttaaataaacatcataaagattgcaggatttaatgcttttttaaaagtctgtaagtgtaatataaaattactttcaatttacttttaacaaaaggctgttttccaaatctataaattctacccatagcacacataaaaatgcttgctgagtggttttaattaaaaagattaactttcttactagcaagattctttttacaatgaagactcctttggtgtagaagtataggttaacttttgagcttgtatttcctccagggttaattcagaaagtttgtatttgaaaccataatcattaaagatattttaaggtctccaagataaatacctgattttaggaagaggagttattttaagttgtctctgtgtagatgcctctttgtagtaacctcctgttctggtatttttaggtaacattcaattaaaaaatgaaacattatggttaaccttccctctaatctgaggtattttttgctggagatagaaaagttctgatttttttttcttcttggaaggtcacagtggacagctactttgtttgtcaaaaataaatttgaaaagagtcttgatatccgaattgggattgggacttctgcccagctctagttgagcaccttgggtttacgacttcatctggttgtaatgtcattgatgaatcctgaaggacaagagaaggaagcatctctcttagtgtaggtcctttgtttggaaacatggcccttctagatatttctagagaaggacacacactttgtatctctaatatagtttctttgagattacattttctcaaagaagaacaatttcattttctgcagcccaaatcaagaaagcttgttggtgctgcttcagaaacagatatcttcatattaccaattcggaatatcctctttctcgcctgatgcttgagaaaatcctgagaaaatgatgtaccctcacatactaattcctttcagtgagccccatttttagtggatgtaagagccaacgtaggcaactttgatgtattgaaaccaagcttactccttgcatagtttgccctcctaatctgtgattagagaggatcatccacacttaatttgcagcagaaagacacatttggtcttactaaaggtttattgctaatcacttgttcttaaacattgctgctgagtctcacatgactttgtttccctttcaattccacaaaatcttttgtccctagagaagcttcagagtttgaagaaatattggcgcttaaattgattctgcttacctgctagactagtccaatcttggaaaccctaaatggccatatctgtatttaaagatgattatattagtaataaagttttctactccattattaacagaatattaatttaaacataaaattatatatgacctgcttaggattctcggttagatctcataatttttgtacagtagatagtatcgcagtagattcagcttatcttttgtcctggttagaaaatgtgaactaccattaagtcatttggcaagacttatgacacagtgaaacttgaatgatatacatcattgcatctctacatctttccaggcttcataaaactgtacctttccaaaagtgttagattctgccaaactgaagcccttttcagaactgaatatggaattagacagtgtaactacccattccatcataaaggcagtaagaaaacaagttgaaagtttgaataagactgtcacaatcctcatgaaaatgatgtatccagaagtatacaggttggattcatccttcatttctttgggtgggagctgcatacttactgcctgggtagctaatgtctatcatatgataagcacctgtcttcattctcactggcaattttaaatagaattcaatgccagaacttgatgtttttcaccaatcctaattagaaacatggcttacttttatttttgaacaaaaatgtacttgttcaaagatctgtaacttaaaaattcttactacagcttggcaatccgatagctttgactttcttagttcccctatttcgacttttcttcctgagaagcctactgcctctttgacataaattcttcctcactgacccaagtggaggcagtgaatgcttcctaattattttagcacagctgattttatgctctttgcataagaaaggagaactatcaatttggactgtctttctgcatttctcactctctgtatggttaaagcctggacttttctcactcccttgcaatacttccttcctttacacttaacttttagttccaaggcaggctgtggtacctgctcccggcctcctgtttatatatcataatgtcctatcacctttttttttcagagatcatcactggtatgccagcctcaactgaaggagcatatgtgtcttcaggtaaggaaaataagcctggcaaattttactaaccagaatgacaaccataactgctggctgctccttctactaatcagaaccccttctgcatccagacctctcagctgctcttgttttctgcttcaatatttttctcaaccttgttctgtctttttggattttacttaagggaggatggttcttgctgtgtcttcaaacttaggcctgagaaacatacatgagtgaaagaaatctatatctaggtgcaacttaatgacattaagcaagtaaaggagatatatctgagttacaagctcagtttttatgtctttccaggtgattctcttagctgccttctactctttcacccctcagagtgtattcctgggtaatttgtcaacatctgatccgtgacctttgggtttctaataatcagttgtggatcgctaaacttaacaaaacaaaacagaacagaacagaacaaaacaaaacaaaaagacttacagcctttaaaaatgctgttgtctttgttttggttggtttctcacttgcctgtagtatttgctgatagcacttatagtctgagcagatattagcaacttagaacccaactctagcaatgcatatataaccataattcattgatttcttcacaagctatgaatttaatctatcctctatgtatttcattttttaaactttttcttattctttgtaatgctataattaatagagccttagaacatttaaaaattaatctttatttggaagaaaatttttgaagacccaagattggaaattcatctcagaggtacaatggtaatttggttttgcatggtgccttttcttttacaaaaattcttaaatttcatttgataatcacaataaacttgtgaaacaagacatcatttttcctcattttacagatgagaaaactgaagtattagaaatgttaagtcatatacctcaggaagtagaagagaaggtatttcaagttcgatattctttttattactccacatttaatattttagcttcattgagtttttcattatggctggtaccttgttgaaactatagaatgacctataatcaacatgtctttttccatcttacctccatcatttcctcttcccttcaaagccattttttaaaaccataaaagctaaacatctctgtatcctagactactttagctatatttaggacatattcatatgtcattactaagatataagtgtatgtgtgttgcggaatggtatgatcctggagtctaagaggttgttactcttctgaggaaaggaaggaaggaaaaaagaggaaaagagagagaaaaaaagaaaaaaaatcacatattctaaatttcttcacctttcatttacacgtttctgtaatatagggacttcgttatctgactccagtaaatgccattaggaaaaaaagagcttttacatttatatggaacttatcttgggaaattgactataactattatttcttaatatgtgacttgaatcttgataactttctggctgttgactttcaatccttctttgatactaagacttctttatttcttactaatgaaaacccatccgttccatgcttttttcggcatgagtcatatttttcattctctctgtacttaatgactgttttttcttcttttatctttgctacctgagaaaatcttgctactagatatccccaactattgtatgatttatttaattagcatggtttgtttgatcctaatgtaattattctattgctctagcagactttgcatggacttttcagcactttctggtccggatgtttatgcagatccaagttgcctggaaatactctcaatcttgtttgtttatttatttggcatgcatgaaaattggctttcactctcttggaatccaggggctattctctttggtttcatgttttctcaaaatcaagaccacatctgaaagaaggaattttctttctcacctgtggtgtgtatctcctcagagtagtctctcttggaagttcagataatgcttggtgtgtgggatattcttacagatggattgactccattttcatcccttttaaaagtctttgggtctagactatggtaatattcctttgtggtctttgagtattgcattctgacttataaatgcttcagcttctctgttgcacggtgttctactactcttttactaggcgatacccaagcctggcaaatttctaatttatgagtccaagcagcatgactcaataaagcctcattccacttttatgttttatagagtctcccattagaatatcagtatccacagaaggagcaaatacttcttcatgtaagtatacttaaatattctattcactggtttttaacccaaggcactatctgctttggaaggtcatgttcacgtctatcttctgcccctattaagggtcagagtattgagtttggcaataggtggtatttgctgtttggagtagaaatggcctcctaatatgcttaaggacaactagacatcctgtcctcccaatatacataagaatattaaaatacaccacaaatgtatcagttttagggtaatctggtggctttgaatattgaaaaataattgcacaagttctgaggcctaattcctggcaagcagtagagcacattgtgtgtcttttcagcttctctggatgccttcagcaactgcctgaggcatgatacccagctgtttggagcttccgttccaaaacttcttcattctcatataaagttagctgtgatggagtaagaaaactatatatagatgcccttaattcaaatttgatagcaagtaactgattatgaaaatgtttgaaagcaagcccctaggcaagatctcagattagttttcgtctatttaatgtgaaatgggctttgtgcttgtggacttctataactgttagattgattggggttttgtgctatgtcgggggaacttaaaatattagcaaggactagtataaagagtttttgatacttataaattgagaatatcatcgtattaaattttgatactcaacaggggagtttatcaaaccttgaaaattaaacttataactacagtctttctcttccttatgttagctccttatttaaagcatttctcaatttgataagctcttcaataaatagatgttcctagttattctatttcgatctggggagtgtgttgaaggaacaatttccttttgctatcagcagggtaggaaaactcatgaaaagaaagtctgtccttttggcaatttaagttgttttgtcaatctgtttaaataaatcctgtttgatgttacagcctttccctccaggttggtgatactagaactgtaactatatggtataaaattatcttttattgtgtgaagtatggtgttttggctatattttaactacataaagcgtcatttaactggattgatggcaatagcctggtgagatcaaacaggaaatgaaatgctagaaagggccaaattagtttcctatgtgttccaagggctctcatcatatcctccaaaatgataatttctgccggggaatttgtgctatttgttttttaattctacttataaaaagattagtataattatatggattttatgtagctagcatccaggaatcacattgagctttttttttttaagtgtttattctgcagaagcaaatactaggtttttcttttttggcattttgtctggaaataatttctctcctgtgtgattcattgaataaagttattgaaactcttgtaattggaacccttcatgctatcatcaatgggaccatagatactatccttaagcatatctgagcagtttgagaatgtaaaaaaatacttttggttttcccaagctttggggaactgaaataaatctctcagtttatgtttctattcattgcattatcactgagagagaaataattatgaaatctgactccattccctaattctcagtagaattagtttttgatatttggcaatggtttaaaactaagaaaggaagctttgtgtaccatgatattaaaatatttcaatgtgccattttcacacatcagtcacccggggtcatggtaagttctcagtaaatatggttgaattgattcatgaacacatttttttgtggaacttaattttattaggagaatataaacaatgaatataataaactagtaacacgatatattagaaggtgctacgtagtccaaaaatgagaaacagtagaggaggggaggggataaggagagttgaaacttgtgatttttattaggttgatcaaggtaagtctcattaaattgttgatatttggacaaaaagtggaaagaagtgaagggttaactttgcaaacatctagggaaactggctgggcatggtcgctcatgcctataatcctagcattttgggaggccaaggcgggaagattgcttgagcccaagagtttgaggccagtctgggtaacattagtcagacctcagctctacagaaaattgaaaacttagctggacttggtggcatgcacttgtagtcccaccttcttgggaggctgaggtgggaggatcacttgaactcaggaggttgaggctgcagtgagctgtgattgtgccactgcactccagcctgggtgacagagggagactctgtttcaagaaaaacaatcaaacaaacaaacaaaaaaacatctggggaaactgtatttaggcaaagaacaggctgtacaaaggcccttagacaaaagcatggctcatgtgccgtgtaggggaccataaggagccctgtggggttggagtagaaggaacaaagggatgaaatatagaagatgagggccacagaccctggggtctgagcatgtagtgccttgtaggccattgtcaggacattggtatttaatggaatcactctggctcctgtgtgaagaatggctcactgggaggaagggtagaatccaggatcccagttaggtggcttttgctgagagcatagtggcctggcccaggctggtagcagtagaggtggcaaaaaagtcagtctgtaatagtttgaaagtcaagccagcaagattccctaaccaattcattgtgaggtgttagagaaagagaaaagccataggtaaaaccaaggctgcttttgtttttggtttttaacttttggtgttccatttgattttcttctttggctttttcattatacttcttcatattaactattgttttacttgtttttttataattacaatatgcatgttttactaatcctagtgtgttttttaaaattttagattcagcgggtacattggcaggtttattacattttttaatctcatgaaaatatgctcttcagtttgaaaatataaaccagtcgtggcaggaaccaggtccagtcttagttacaataatgaaaatagcatgaagcacacagtccatttcaaggcagccacacgcaggacttgcattgcagggaacgactgtgaggtacaaatatctccatttagtaaaggctgaaggtgaaccttgaagagtcagcaataacaataagccaaactcaaaaatgccaaatatataaaaaagtcaaaggcctcagaaaagtttgcctggtcaaaaataatcagcttcaaagaatagatttcttttcactttattttagccagcaaggagatgctagtaaatccctgtatttgaaaagcgaactctgcttttctaatgtgattgtgcctgtaccggctacattctttgaactaatgacattggtgttttctaaagtaaatgttgaaaagcctctctgaagtagtatggattcagcaaacattttatgtattaaacagttctctgcgatttgggggtcagtgtaagacaggggaggctttcagagcaaacagatataggcagaggagatggatctgacttcacagcccccaaagttcccttttttcctctttaactcatgttggattagaagaaaaaaaaaaaaaaaaaaagagcaggcatggtggctcatgcctgtaatcctagcactttgagaggccaaagagggaggatagcttgacaccaggagttcgagactagtctgggcaacacattgagacctcatctctataaaaaaataaagaaattagccaggcttggtggcagccctgaagtctcagctacttgggaggctgaggtgggaggatcacctgagcccgggagtttgaggctgtcctaagttatggttgaaccactgcactccagcctgggcaacagagcgagaacttgtctctcttaaaataaaaacaaacaaaaaaagaaagaaagaaaaagaaaaaaacaaaaagaagaaaatagaagtcactcacctacccttctacctacttaatatattataagcatttttctcatgtttttaaatagtaatcagaaatatattttataggtcactgtaacaataaagaaatcattcttgactggaggtttttaagggattttttcatttacaaacacattatcggttttgccccctttctgtttatttttcctaccacttgtaaatattagtgaaatatcaaagttcttagtccttccctttgtaagacaatttttactactcaatttttggaaattggaaacttccattgttcattcactagtttagagttgttaattatatttttaagttctttatactaatctaataaagatcaaaattataattttctttattttcttttgttttttgtaaatgaggcatctgtgactaaaaacttataaataattgcctaaatgagttttctattacatgtaagtgacaagttttaggagaagaacttgaaccttacaaaacagtcaataggactatcttgctgctccttttatagaatcagcagaagtaaagtgattgtttggaacaagccttaatgacttcttctggagatgccagctgctggtagccccattttgcagacaattctgttgaataccataaaaaattgttataccaaccactttgctgaattaagcaccatccattccaatttaatacataaatgaggaaaacaaaacggaaaatctaacaaatagtaataggaaagaaaatcaagataaatcccgggaaaacagttgaagtggtaatatctgtttcaaatatgaataacagcaagcatttattgaaggcttactgtgtgccaggtgttgtgctagatgttttacatggatgatgactcatggttatcatgaaaacttattacactgtacgttgaaactgatacatgttgtccaaagtcacacagcagcatttaaccccagataatgcagtggactgctatgtcacataacgttttgctgcctcaaagaaaaagcccttactattgaaagaaatgggattctgtgagtggattgaaaggtagcctttggcaccaagtttattgggagtatatgtggtggattcaagtaaatgacttgtctggggccagttgtacccaagtgatcttcatgttacacgtcaaagcatggcaggtgaatgaaatgggaagagcacaaatgctgagtggactcatgctcttaagtctaaatactaatgctgaggacaatcgcggtggctcatgcttgtaatcctagcactttgggaggccatagtgggaggattgcttgagcaaattgatcatttgagcccaggagattgaggtttcagtaagtcatgatctcactactacactccagcctgggcaacagagaccctgtctcaaaaataataaaagaaataaattctggtgctgctaattaccgtataattttaaacaaattatgtgacttccctgagactcagtttcatctctcctctcctctcctcttcttttctgttctgttcttttcttttcttcttttgacagggtttctctctgtcacccaggctggagtgcagtagtgcactcatggctcactgcagccttgacctcctgggctcaagccatcttccttcctcagcctccctagtagctgggactacatgcgtgtgccaccacacctgagtaatgttttttagagacagggtttcgccatgttccccacactgctattgaactcctgggctcaagtgattcacccatctcagcctaccaaagcgttggaattgcaggcataagccaccatgcctggccccgagattcagtttctaggtctgaagaatgctatttattttaaacatatattgggaagtctaatgtgagaaaatgcatgtatatcatttagcacaactttgctttaagatggtcccttcatgtatggaagagagctagtgtgtggaaaagtgacatggctctaaaaagagaataaaagtcagagagtctctacatcttacttcaacaacgttggaaaatgcccttattgttggagaaggaaacgagtttatgattttagcctaagtgatgatgctgacagttctttgccaggaaatcactatgtcttttcaaaatattatatattctcagctaaggcttcattttacaggaactaatccaggaagtcttctatgaaatctctgaatgaaatgaacaattcagtttttaatttggcacctaaaaaagctagctgaaggaaaagaatgtctttgcagagacatttctgtcataatgagatagaatggtttcacttgggaatagcacactaatatgtattgattagattggaccagatctgggtggtccattggtggaatttagacccatggctcttacattctaccctcagttgtaactgacttacctgcttttatggtagaaaaaaacttctgggagcttagctaaatgattcttagctggaaaaatgccatttcaatttcagatgtttattggtcataacatgtgaacctctcctgccactgttggagagctacttttaattgaatgcaaattgtgttttcagatttctataaacatggcatttttcatgggttggtggctctgcccactgtggagaatgacaaacaaattatcatgcatcatatagcaataaaataataattcaaaaagaaaattgccctactcatattacctcatctttttggttggctggagagttacttacagatttttaggatactagagtgacttggtgcaagagttggggctcgtatattatagccattcataggtgcaagcaagttactgccttcacaatcagttcttttattctgtatatgaatatatcttctttttcttttttaaacaatactgcttgcgagtataatttatttcttcacttctgcctttgccctttctaaagtcattcactgtctatcattgcattccaccagtggaggagagaatctaaaaagttttgattaagctttgacctttcgtactggttgaaattaacgctttacagaattattcttttggaccataaaatatgtgtgtgcatgtgtgtgtatgtgtatgagatatagatatagatatagatatagatcattgatacttgcatcatactttacattttataaggcatattttcttattttgagtcatttatttatacaactcagtggcttagatttcatcccatggatgagggacttgacgttcagaaatctgtgacttgtcccaagtcaaagaacaaataggtagttctaaaaagaagagaaagtctactccttatctaaacagcacattttagggaagaatctgattggccctgattgcatcatgtctgaccctaaaatactgcatccagggagattaatgcctccagctgagtgggggctggggcacatatccactgctgtgtgtgttggggttagtgagggcagatgggctcagccccatgggaaccacatggtgtagaatcattacagagaggagagttctgtagcaaaagaagggaaaagtgagctagacaggaaaacaacaacacaatcattgacaactgataagcaaacaaccttagaaaaatcagaaaataggtattagtaacagaattttaaaggaaaattaaaaataggtgttgttgaaaattgtgtttcattgggcagacaaaactaagcaggatgagcaatctgaagaaaataataagctggaaaactgaatataattgcagtatcatttttttaaaagactcattagtacctatgagccattataattactcttaacagtgccctctttttaacccaggaaattctgcattttgaaagaaagtagaaaaacgtagacaaatgagttacagttttgaaattagaatgcatgggaagcattttgaaatctgtaaaatattctacctttgatgtcaaaagtcagagtacttgatatggatcctttaaaaaaaatccatgattgaggagattttgaaaaattcctagtttcttttaccagagtaattgtatgttgattagggtttgggtgttttttgttttcaatttggaaagaaaaagagcgtgcttagcccattccatataatattgtatagaaaactcaccaggtcttgttcaattgtgagataacactgattgaggttttatcagacttatagacatcaccatttaaacctaaacgaaataacaactccggtagttcatctgtgggcatcttccacttttctctgtcccactctgttataatgcacctcccatacaagctgtgaatacttaattcatttctttaataacttgctgtgtatacatagtttagctaatcatcaaaagtgttggaatgccacttttcattttatctcttagtctaccaaaggtcagcaaactctcaaaaaccaattaattgggtcactgtggcttatagcctagagctatgctcatctttattcaagtccataaccatctctgatttcaggtttggtgtttaggttgaatttatccatcaacgatgggctctttggtttgttctttgctgaggtattctagcactacctcttgagtgaataccaaactttaaagagctttttaagaaatgtcagaaggagagagcgagagagagaatgcctggctttgtgaaatgttgcagaaatttgtatttgtaattatcacaaatttaatcagtctttcctttaaatttttaaagcaattttggactattctcattatttcaatggtagggaaagtaacatatagatagggataggccaagtgacacttaaggtcaaatagcaagtgagtggtgaatgtaggtgaattaaaattggatggccctgtttttgctgtttgatccttagatcactgaaaactttccctctctttttttttttttcttttttcttttttttttttttcttgagacggagtctagctccgtcgtcaggctggagtgcagtggtgtgatctcggctcactgcaacctcggcctcccgggttcaagcgattcttttgcctcagcttcccaagtagctgggattacaggtgcgtgccaccacgcctggctaatttttgtattattagtagagatggggtttcaccatgttggccaggctggtcttgaactcctgacctcaagtgatctgcccaccttggcctcccaaagtgctgggattacaggtgttagccactgcgcttggccaaaactttccctctctttaatgaaaatgaatagataataaccaggtcctactatatttcagcatgaggctaggaaatgtgtatgcatatttcttgggaagtgggaggtgggaggtgtaatgattgggggagataaataggaaatagtccttgggctgaaggagttcgcagcaaagtaaaaagtttaattgtgattaattgtgcataatgacacgtaatcataatgggaagtaaaatatggcaagaggaagactttcaaattaagtttttttttttttttgtaatattccttaagatagaaaagccagccgggtgcggtggctcacacctgtaatcccagcactctgggaggcagaggcaggtggatcacaaggtcaggagatcgagaccatcctggctaacatggtgaaagcccatcgctactaaaaatacaaaaaattagctgggcatggtggcggttgcctgtagtcccagctactggggaggctgaggcaggagaatggcgtgaacctgggaggtggagtttgcagtgagccaaaatcgcgccactgccctccagcctgggcgacagagcaagactcatctcaaaaaagaaaaaaaaaaatagagaagccatttgtggttatgtaatttaaaagaaaattttggccaggtgtggtggctcatgcctgtaattccagcactttgggaggccaaggcgggcggatcacttgaagtcaggaatttgagaccagcctggccgacatggtgaaaccctgtctctactaaaaatacaaaaattagccaggcatggaggcacatgtctgtaatcccagccacttgggaggctgaggcaggagaattgcttgaacctgggagcggaggttgcagtgagctgagatcgcaccactgcactctggcctgggtgacagagcaacactctatctcaaaaaaataaaaataaaaaaggaaaagaaaatattattattattactatttttattattattattttactgttgtctgtctcctaaaatagcaaattgttgtttctacttcatatttataggtcattttactaagaaatcagaatcctgaaatttatctcattttaaaagatgatgacattctataatttaccgtcaagaataaaagattagtgatgattgaaggtgctggaaattaatttacactaaatagcattttgaaaatagtttggggaactttctgaaatataactagaaacttttagaaaaacatgactatagtatggtaagttgaatcattgttgatgagcagacacttatccttgatacagagatggatttgcaaaggctatgttacatatccgaggagatacttttgtttaggccatctggaaatgtgtgtatatgaaaaggttgcaattttatttttttaatagagaccaggtcttactatgttgcccagacaggtttcaaacttctgggctcaagtaatgctcccacctcagccccaaagtgctgggattatagacgtgagccaccatacccagcttgcaatttcctgaacttgttttattcattaagtaagactagttttgttttttaatttttattttttaaagacttgagttgatccaaagaagagagaagtggtaaattttaaaaaggatgcctagttataatcaaggaatccagtaaagtaaattaatctgttaaaattataaaacaaaaattttgcctgtatgatcattcctccctcaattttcttaaaattcatgtattaagagcagtgactaactgacaagaagcttctgtgccatttgataaagatttcaactacaaatgggaattaaggtatattaaaaaataaaattctgcatgacaaaatatttaaaatgttagtttttaatgttctacacaaatattgtcctacattttaacctagaaatctacgtattgaatcagcctataaaaatccatttctttcacaaataatgtagctttgagaacagatttttttcaataattctcagtctacaaagctatgaaaaggaagttgctgttgctgcattttttttaagctgtaaaatctaatatgccccagctctgatgaaatgtaccaggaggaacctgccttgtcaaacaggatatttttatgatgaaatgtgatacgaagaggcatagccttacatatatctgagagaaaattatttaagtggccataatagatttttcagaaattttgtacatttctcttatttgatccagatgcatttttttcctctgttgttctcataccagcttcttaatttcacctccctaatgttccacagcataaatacatctttgttcagagtttctccaagttatctgtgagaaaataaactatacaaagggtccctgggtatgttttaggatacatagattatgggggtgggagagttaccttgtgtgtgcaaatgagactgtatgtgaaacgaagataaggtttggagggaaatagatgattcaaagatacctaagaggtttattaagacctttaaaaatgattttacagtgcctgtaaagaggactgatatttaaactcattcagcttagtgaaaaaaatgaagaaaaatggaaagtaacatgcactacatgtgtacacacagaaacaagtataataaaactttctgccctttttttttttttttttgatatgaagtctcgctctgtcacccaggctggagtgcagtggcatgatctcggctcactgcaacctctgcctacccggttcaagcgattctcctgcctcagtctcctgagcagctgggattacaggtgtgcaccaccacacctggctaatattttgtatttttggtagacacagggttccaccatgttggccaggctggtctcaaactcctgacctcaagtgatccacccgccttggcctcccaaagggctggtattacaggcatgaaccaccacgcccagcccctgcttattttttaaggtttctagaacattggctgtgaacttttgggtaaatagtgcacataactcttctccttcctttttatttgaagtgcagacctgggtatattttattaaaataatggtctgaaattataaaaaatgttctttgtccaatcaaggagtaaaatcaaaccttgtattattttgtagttatactcagatgttagactatcttctagtccccagcagttcactctaggtggtcccatagctcttgcttgaaccacagtcttgccacttcttatccatagtgatgtgcacatcagttcccacaccagaatgtaaaatactagagggaagaattttggttgatttgtgtttctattcccataacttattactatgccagttcccagggagtatttattaaatggatgtcaatatcaacagtgagttaatgaatttttttgttggattatcattttttaagttgtacacatttacaatgaaaagaaaaccaccttcactttaaatcatgggcacagatatttaagtattttaaaatcaaagttttaaaaaactaacattggcttaaataatatttattagagaacttgtaacattttaagaagcattcacattctacctatgtatattttaaatttatttctgttttttacatctggaagatttttttcattttatcataaatacttgttttcatggtaatttataaaaatcagtttctcctttgataggattattacaaattatttcagaatctacttattaactggtcgctgttcctctctgtagtgctgaagaggcacttgcttgggaacaagagaagtgccgcaacagtgtcaataacatggatttttcatttattatctttaataataataatagatgacaataatatattttaataagcatctactatgtgtcagatgctttcttctgagaatggatattgttagtcccattatgtagatgtagagactgatactcaagacaattcaatatttgtcaagtagtggtagaagcaggatttaacctcagtctttctgactcttcatcctgtgttcttttcacccacagatggtagaggttgaaggctcagaagaacactttttgagctcagaaagctcttcttgtgacctctatgctactagtctaaagggcaaatgataattgcagctactttcagaaatggtcctttttccctaatgagatgaccaaatctgctttatgaacccagtttcctaagcaagatacagaaatagacacaccaatttagtatgataaaaggtgttaaaggtagaacaattttaggtaccaaattatatttatttgatacttggataatttaaaaataatgccacaaacttcatcccatctacctcccagtgcgcacacatttgggatgaagagataatgatgagaatgacattgtagataaaaggtatatgcattaaacatctgaaatgcttaggttattcaaagaaaagaataaacacaccatgtgatatgtagcctcagctacttcatgtttgaagttgatggtaacattcagatcagttttgagaagcagactgcaaccatagcttttagtttaagtttcagattgatatggaaggttatttgttttaacaatccctatgttaagttttcttttttctatgtttcaattgacttattttgtcagattttaggtttttttttttttttcaggcaagatggcattctcatccctgctgttgttaacatttaaagcatgcagcctcttgtgctgtggtgtaaattccaactgactgacgataattaaacagaaaatgaaacttgaatggcactatctcaaaatctacttaaagccacaacaggtatctgcctatagcaatatatcagttggaacacatgaagaataagaaattgtagcattttgtgtctgggtttatttttctttgaaatcaaagaagaaaaatactgatttttcctggatcactaaaacagtagtatggatttctaaacagggcagaccatacaaacacacaattaattatatctgaacttgaaatctcatactgtgcactttacctcttttataccagttgtaatttctcatttatgtacagatactgtagtaactttttttaaaaaaaagaatgtattattgtaattaaaaagcaaatactcaagaaagataagacacaaaggattaattgggattacaactcttctttctgtattgagtgcaaaagcttggtgatctcctgaattgtgcttcaacagtgacctcaaggctccttccaacccccaaggctctccttttttaacatttgttattacttagctattttatttggcagggatcccttctatctcatcttctaatgcactggcaatgatcctattgccaatagcttagagcctactgctgctggggtaagcgacacagccgaactttctagcctctgcatccttataaataatgcatctggtttcctgtaactacatgaactcttagactttagtaggcatttctttgttagtcagggtaaaagagttgggagatgaacagttgtggaaatagttataggcagttattatcactgattagaacctgagtccatgacatatgcattaatcactgggttaatgctaatggaatgcttatggtatttatagtagatataaataagatatagaaaaagaatatctttgctgaccaaactgcatgcttaattcaacatggaaagttctggtgaggttaatctaggacgctttgagactccgttgctcataattggacctgatttactactcatttaaaaaatctcttttaatttgcgcagaattcgctggctttttgggggtggacacacttgttcttaagaacaatagcaacaagatctttgtttaacataatatctaatgctccatgtaacttagtggtataacaaattattcaatttgtaatgaaaaaggtaaatgctgtgttaataagttaatagcaaagtaaataatgcatatttatacttttgacttcaaagtgtttataaacttatggcattaaaaagtaatgttttatttttgagcatcagagaaaatagtatttaaacaagagaaaccgatttttaaagtgaaaatcattttagcaacattttaaaataagccacgttaatataaaataagtgagttccatcgaagtatacactcttttcttcactagacgtgccttaattggacatgtcactggccaggcgtggtggctcacacctgtaatcccagcactttgggaggccaaggcgggcggatcacctgaggtcaggagttcgagaccagcctcaacatggagaaaccccgtctctactacaaatacaaaattagccgggcgtggtggtgcatgcctgtaatcccagctactcgggaggctgaggcaggagaattgcttgaacctgggaggcagaggttgcggtgagctgagatcacgccattgcactccagcctgggcaacaagagcaaaactccatctcaaaaaaaaaaaaaaaaaatggacatgtcacacagtgacaatgttcagtgttatgattctatcataaggataaaaaattcagattgatttagatgttgatgagaaacttgttgctctagagccttgtatattttcatcagaattaactgaaagaagggaaaattgtttctaatatgatacaggatgttcatcctgatcattttattattgatttctttagttaccatcagttcatctctgagcagctcattcatttagaaagatgatagcttgtaagtttaattctaaaactcattctcatccttgttagcatttgacatgccaatgattttgcagagctgggttgttatcaggactcatgtttagtcaaaatgtttaacacttatttctttgattcctgtagaatttccttattaattaacccagggtctataagcaacaaatttttaaatcagatatatatctatatgcatgtaattcatttttttctctttgatttttgactacttttttatgctgatattttagaatttctatgaaattaacacatttccttaacaattcaggaaatctgactaactgtactttaaaattgtgctttggtatcaccagtaaataagaaggcttcaattcatcaaaaagataataataaactgtattaatgctttcttttatttatttattttaatccatctaccaaaaacaatcaagacaacagctttaaaaaaatgcaatcattaaattactacgacagcctagtctgcttttgtggctgttttgttttgatggttaccgagaatggaaacagacagattatgtttttctgcttgtaattgtccagtacctccaaaggcctcttgcctgggcatgatcccttctggaattgaattctgcattcttcttctatcactaatcaaacaaaacactatcagaagaaaacatttccataactggatccggagtgaaggaaaatttcagatacttagacatgcatatacaataaacagtgtttcctgacaggctcattaaaaaagaatgactccactatgtgtcaactgcacaaatagaatccattataagactatggactcttacttctgaagtctgcctttgtgcccacctaagattaggaaaactaaatcttccactagaatttaaatatcacagaagcagaaacgattgcaatctctttccccagtgccttccttcctctttctctcagtcttgggtaggtcctggtacatatgaggcacttgcttaaaaaaataactgaaggaacgaatgaagttgcttaaggccgggagcagtagtctgtagatgagtcgactctcacctgtagtcccagtactttgggaggctgaggcaggaggatcgcttgaggccaggagttcgagactagcctgggcaacattgtgagatcccatctttacaaagaaattttaaaaattagccaggtgttgtgacatgtacctgtagtcccagccaattgggaggctgaaacagtaggatcacttgagcccaggagtttgaggctgagcaagatcttgtcttaaaaaaaaaaaaaaaaaaaggttgcataaagcagcagagacaggatcaacctagaatgtctgtggaaaaactttgaaaaagcatacattcttaaaaataaatgggaaatctgtggcagaggaaacagtaactactgacctgatcttcccttttcattttattttaatttctaatttgctgtaattgtatggtgctttcaaatactgattaaaactcttaaaaaaatgaaagagagaaatcacatttttctgctaaactgagtttgtggcatgccttcttccttcatcttgttgatgctcaaagaattatgcaacagagggccatcatactgtttagtatgttaaattattttgattcatgtacttactagcaacatcatttaaatggtttggtttcgtcatggccagacttaagacacatagcataattaagttgacaacctaatattccacattaaatcctggtgttggaaaaagctaaactgatcggagaaataaatctgtccaaagtagaaactgtaatatgtatgtgaacatgtatattctcatcatcactttttgttttcttcttttgttctctgttcctcctgttgagtcttgtgtaagtccaaataaaaattttattgtagagcccaacaacaaaaacaatgatctcttatgtaattgatgattttaaaaaatgctttgaaagtcttcttcccatactttgtatcagtataaagatattgtacagtggtacagaaaaaaatggcttttgaagttcagatggtttgaatctttgcttcaccacttactagctatgtaattgtgggttatctgtgcatctttttaaattctcactttttccatctgtaaaataagaacaatatcagttactttgcatactgattgtaaagattataaataagaactgatgtatatatattacttggcacaatgtctgacctgtttctgtttttcacagtcaggcttctcttccattttctaaggtgactcggaccttaccactctaaaaattcaaatcatgccttcactttctgcagattgcacttgttactttagaagaaaaggaaaactataagatggaaattattttaatgtcctcttaccaaatctacaaaccccagcacaatgcctgtcacagatacggtcatttagtaaacatcttttggatggataggtggatgggtagctaagtaaattaacatacagattaggtctttggaaatggtagctatttttattacaccctgtacagtgaccttaaaatttgaaatctactgcttttgaaaagcaggtcatcctgaggttttccattttgtacctgccagattgtgaaaagaagttcatttcaatgctgcacagcacatttcctgatcagttggctgaattacagtcatgccatttcattttgagttggacaattcaagcatttagccctgatttttttttttgacagtaagttagttatttttatactcattcaacacatttttcccccaccacaggttattgtaaaaccacctgtctctgggagcacagttaattctgtgcatgagatttctaaaaatgttttacattgtcattgcagttttttaaaaatgtagagatccctctgctattcttttgcattgccaaatgcttaggtaccttggaaaactgcttaattggttcttcttatctcactagattctttggccttaggttgtgaatgggtaacaatcatttaacttttgatgtgccctgaagtttccatccaaaacttttttctttgaatcttttttagggtgaaagagaagaatatgggggatctaggtgtacattgatactttttagatgcctttgatgtcagtcagtaaacagcagtagacatttggaagagcatgatagaagagacagggctaattccaggtatttaaccccaagttaaggagacttaacctgaggctgggttatttctctgatctctagggacagagtagtggcaaagccttaaggtggtaaaatttttgagaaacacttctaaagacttatgttttgttttagaatcctatctaaaagcatttcaaacaaattaagttaagccgttcctttcttactggatgtgttcgggcgcagggggtgggggcaaaaagaagcatatggttgaagctctgcactgcagtaatttgtaaaagaagtacttttcctgctaggttaaattgctctgcctgcctcttgctgtcagggacatgatttagttaaatacggatgcttttagaggggctttgtactgcatcatacatatttaatagtttataaaatatctgtgtgaatcactgggtggagaatccagcagcagagaagctcaaccttcacattggagcctctggccttagggtccactgaccagttgaccactggaaaaggtgtgttcagaatgggagcgtcctgaataacccaaggattctactgatttcaacagaataagcttagcatctaacctttcagattttttcagtaatgtgaactttacattttctcaagtcacattattcatagatgttctaattccccagggatcgaagtatagcattaaggaaaatcccttctcaataaaaaaatggtattgggtgaggggagggggacagaaaaagctcttagatgttctatagcaattaatggttgccatataaagatacctcattgtcattagataatggttaaaattatatgaatcttttacccttgatataattttgaaattcatcttaaaaatcaattccttaaaataaaagtagtaggggaaagaggtagtgatgggtggaggctgggggatgatgcagagaaggaaaaaaataagcaagtggaggttactaaatgtagcattggtggattattttgtttgtttggcataggtaatgagttttataataaaacttactatagtatatcaagataggctcctttcatatatgaacccagaaacaccatgaaaaattttttaaaaagttccagcattttattatgaaattttcaaacatagagaaaaggtgaattaatcattcagtaaacaaacttatgcccactaccaagattttacagttaatattttcctatatttgcttactgagtgtctacccatttatctatcaactttttatttttgatgaaatttcctgtatatatgagttcattttacccccaaatatcccagcatgcatagtatatatattttattacattgtttaagagaacatgtaggtcatggattatgctatcaaatagaatatatgtttctctcaaataagccaccatatttggaccgagggttttctagtcatcatatttcagagtataactcagacagtagcagccttcttgttcctgttccctaataattactccttcccctgtcccaggcttttaattctccaaattaaaagaggatgtaacctcggcttcctgattcccagatactgataatttttggtacagtttgtgtttgagctactgcagtaatgttcgggcgattcccattttggtgacagtcttctttcctgaggatacattgccttcctatcctctgtagtttctttattctatactttcctatgtaagcaataaagctaattgtaatgctcccacaattcaggtagcgtctaatctccagcctgttctcaggggaagttgttgggttctggagcacacattttgtgtgctcccttagtttgacaaaatgctgtttaataacagagtccaaatatgaatattagtctctgaatatctttcagaaagaggcccattaagtagagttgtgaccacaagtggtcgtgggagcattaaagagtaaactttcaagtagaaatggtccagggaaacagtcaaagtgaggtattggtacagacatcattcatggctctaggcgagagaaagtctaaactatctaatcaagtgtgtgtatctgagttggcagtatgcaactaaaagctttcctttgtagaaattaattaaaaagaaggagaaatagatgtgattcccagtcctgactttgaaattaatttctgtgtgactctaagcaggttttttgtttgtttgtttttacctcccaataactttttttcttcttgtataaaataaaattcatgtaatgggtgcagcaaactaacatggcacatgtatacctgtgtaacaaacctgcacgttgtgcacatgtaccctagaacttaaagtataataaaaaaattaaataaataaaattcatgggtaaggcctgttgcagctccaacattcagtcaataaaaaaaatttaaatctaattattattgagattacagttgacctttgcattaaacctaaattcttttactccaaataactactgaaatagaaagaaaagacacaagtctattttcttttttctcccagtgtcttagagatatggtctccttctgttgcctaggctggtctcggactcctggcctcaggcaatcctcctgcctcatcctccctagtagttgggatcacgggcaggagcgaccatgttggacagaaaagaaacaagtcattcttaaacaaatctgactctagcaacctattgtataatttatggtagaaacatttgagctggaggtcaaatcataagatatttttatcttataactttcaaattcatatcgttttaagtaataaaaattgtaacaattttctgtaaacagaaaaggtttccaccccttgagctgaaaagcagcaggaaaaggagattggcatttcattttaaatgggatacgtctgcttccatgagcatcataaaggttatgaccttacggtagtgttgcctgacaggtggctcactaagaatgccaaatcagttctggaaactgcatatacttttatttcttcttttttttttgttccctttggtgcaactttgtattttcattttgatcagcaacaaggagaaaaaaaatgtgtgtactctaaggaaaacgtatattgtaagacattttctctggctaaggtcttttcaggtttagaaatgtgaactggccaggcgtggtggctcatgcctataatcctagcactttgggaggccgaggtgggcggatcacctgaggtcaggagttggagaccagcctggccaacatggagaaacctcatctgtactaaaaatacaaaaattagccaggtgtggtggtgcatgcctgtaatcccagctacctaggaagccaagacaggagaatcactggaacctgggaggtggaggctgcagtgaggtgagatcgcgccactgcactccagcctaagcgacagagcaagattccatttcaaaataaataaataaatataaaagagaaaagaaatttgaaccatgtttaaaagtagaatacttcaggtaatccctttcctcaagctttctttattctgggaatgttgtgcaagtatattttatacatgggcttatgtgaagtttcagtctcttgaatagctggtactctcttatgagtaattcataactgccttcacatgtgtataatctcatgctcaactgtttctctctattttaagcaggagatttaaaaatcaaattaacacatatttctagagcatttgctataagtgatatgctgtgctatatactgactaactacatttctgggttgattgggggaccagtttatagaattggctgacaagcaactgaactttaaaacaaatagctagtgcttaagtataagtcaagttcaatcactcccatttttaaaactttgctgaatttatattaaaccgacattggttattcaaggtatttcttccttgtttttagctaaaacttctcttactgcattaaactacatccattatcattttcattaaataagattgcacattggatatgtacataaaagcaaaattatatcttgcatttttgttacatttgccagaagaatgaaaaacaaacaacagaaaatttctctgagctgtgctgctctatgccctgaacgtaactgtaatagtgaatattaatgagacacagcaaagatatttgctcaaggtagctaagccaatatgtattgctccagtaaatgttagaaatgaccattcatccacataacctcagattagtctgcataaagataatgtttcttttgttttttcttctttttgtcacacacacacacacacacacacacacacgcacgcacacacaccacacagtaatttaacattatttgcatttactcacactggtaaaacacacgtctcaaagatgtttcccatagtttattcatccctcttctatgtcgttttcatttggatgcatttgcttaacaatgtctgctgtgtgccaggcatgctctaggtactggggatatagcagtggacgcagacacaagtgcatggtcttatggagctgacattctggtattgagtttatcacgtttgataagaaaacacagataatacaggaagactgccatttgcccctcatccttggcacttatttccagtggagtccttcatcccaaagatctcagacccgcacacacacacacacacacacacacacacacacacacacacagaaactagtaaatggatatgtcattgagactctgaattcaaaaggcttctgagaacatgagcaaaggcttatctttctatcccattttatatactaaaatattatttttctgttcaactccatcctatttccctatttaaaatatacatatcggcaggcgtggtggctcacgactgtaataccagcactttgggaggctgtggtgggaggattgttgaggccaggagtttgaggctatggtgagttatgattgcaccattgcattctagcctgggtatgaaagtgagaccctgcctctacaaaataataataataatagttcaaaaataagttagccaggcatggtggcatgcacctgtagtctcagctacttgagaggctaaggtgggaggattgcttgagcccaggatatcaaggctgcagtgactaggattgcaccactgcactccagcctgggagagagagtgaaaccccgtctctaaatatatacatatatatatataaatatatttttatatatgtaaattaatatcaagttcagagttcatagttaataattgcctgagattcactgccatattgcctattgatactttctagaagaaagggtagccgacacataacaaagtctcatttttccttgagttgaaattcacacagcaaaattaaccatttgaaagtcaacaactcagttgcatttattgcactgttgtgcaaccaccccttccatctagttccaaaacctctccagtggaattttaaaagaaggacaacttgtaaaatgaccaataaactgtgtttgtagaaaattaatgattttacttatggagagtgagaaattaataggttctcccaaagtaaagcaaactcactgtaactatcgtatgcaattaaaatatctttccatatgaaattctcacatcctcatctttgagatcatttactgtatcttcagttacagaggatctaaactcataaagaacaaaatgtaccagagtaaattgctcatcgtgttacagaatgagaacacagagcacagtcaatatcaagtacttgatacagcatctcacaaagtaatgcttaaaattaagtcaaattgtctgctctgagaacattttcactgggtaagaataatcagtcttgactcacctttaaagtgggcagaaaagacatgcccaggaaggtaaaatgagtttcattcatctcacctattttgcatcataaataatgtacaagaacatcacacagcacatggatttggtttgctctcagagaacttttctatttagctggggagagaggaatgacaagaaaaaatagttaaatattagcatattccaaattttccctccactgataggatctgtggtagttgagtttcgctagatcaggctaaattaattcaaggcatactttggaacaatcagagaaaatttgataaggaagtatctgaataggccattaaaagacttgaaaaaatggagaggaggagtatagagggtattttagatagttggctatgaataaagcctgctgatttattagagaccccataatctgtgtaatgcaatcccaatccaaagtaaaaccaaacaaaatgtatgtattgaatggacagcccagctctaagtttgggacaatcaaatactgatagtctttgccttcaaataaattgcattcttcagccctgtatacacgatgtaattaaatgatgacacatgactgtgaacatgtaccccaataaatggtacagttaagaaatgctgggtctatgatttggaaaaatgggaagggcttcgtcaaggagctgagacctagctgagggcatgttttttggataggtggaagaagctgacagatccattggtgtactttatcctccagagaagctgcaagttttgaaagtcaacttcaggacatggagctttcttgtgaaaattatgatttcataattcctcagcaaataaataaataattgccatttgtatgtagggatctctccaaatgaaacgactgctgccatcatttttattttatgttagataccatgaagtaaattctactcttttgccagccgtaaaatttaggagcaagaataaactttttcagtgataatatttttagattttggagataatatttttagagttatattgccaagatacaggaaaaaagtcaaagagaaaataagtgagtaataaggtcaaaagcaaaatgtcatttatcattctctttcatctgttggagctaccgtacattcttctgatgataaagtaaataaaagtaaagcagaatgactagcttgaattcatagcctagcttgaattgatgtagctgaggaattctagtattttttatttgatgatattacaggatgtttttcttcattgaagccagcttagaaggaagctgaaatattatgaaagtggatcagaaatacaaatatattttactttattctgccaaatcccattctatattaccgtgtctcttcttgatccaggttggcatactagcatttacttccttatcctctgtggcagattaattgtggctgcaaattctttgccactttctccctcaagatttatttcttctgtccttgagtctgggctggcacggtgactgcttaaccaataggatgcagtggaaatagtttgttctgctttcaggcacagacttttaagagaactggcagcttgtgttttcttcttcttggggtgctttctctcacaacctggccaccatgctgtgggaagctcaagccacaaggagaggccacaggttggtgcaccatttcacagtgccggctggcatctagcagcagctgccggtcgtcatgtgggggagccatcttgaacgtttccacctagttgcacctcacctgcagcaccagctgacgtcaaatgaagcggaagaaccactcagctgaacccagtaaacctacagaataaaatggcggttgttgtaagctatttccaggtggtttgtttcacagcaatacataactgaaatcgcttcccaaggaaagtcctggaatgagaccatggaagagctcatttgatttaaatgataaatagacagtatttaaatggcctatgcttaattcttataatttctaaaaattattaggcaaaattgtagaagtcttattttggaaactagatccttttaagtttgtttacaaattatattaaggtaataattcctatttcattgttacatattctggttctcatagtctctccttgaagtggtatgtaatcaataatataatcaaatgcacccttttgatgaaataacaaaagcagtatttttcagcagaaataggatgaatcagaacgtactcaaatcttggccacatagctatgtgtccatggcaaaattacctaagctgcctgggccaatgaaataaaaaaaaaatttaagataaatatggactgtatgggattagtgaagatcagaaataatgtatattatgaacctagcagagtgcctgtcacctgggtggaactcaacaaaggtagcttttattattgtgagggagatggtgataaaaggttaggtagtaaaaaattgtgtagtttatttttctaagaggacatggaaatggggtgttcctgggctttactggggtggagcttaaagggttaaaatgatatatccttgcagtttttcctacaaacatgcatgttttatccaaaggaaattctgacctctaaccccattcacactttcctttcttactcttttattgctatagaggatttgatgaaggcagaaaggcaacttctgggtcctagtcccaagggtagaactaatggagaattcttttattcttcacctcccatccttctccatttccccatttacattctttttccaatttggcggaaaaaaagcaatgttataggaagctggctgtctgcagattagtcttagcaccaaggtggaatgacttttgggggaaaaacagacacatcccaaagtctggctcatgtagtccaagggaaagagtacttgtggcagtccataggattctctctctgatgtgttgtcctagtctttgtataaaatgttggttttctctgtaagtgttgggtattttcagtgtaacagctagagcaatgcccagtaacttttttttttttttctgctgaatatgtttgctcttaatggttgaggtaaggtgaataattgctcttggtgtaagttaaagaccacttttctaaactatgggttatcatgcttggtattttctcctatctgcctgacttgaggccacctgaaccccattttggtctttgaaatttagctgaccttggccttggatgaaatgctggtgtattgagtataatagttttggtttaggtcaaaattggggaattcagtgccgtatatttcaactgggtgctttttgaagaaatcataaattaccctagtttagcataaacacctgctgatattgtttctgaatatttacatgaatattgatcattgagatcttactatctttcaatttgaatgctttaaatgcttcaatagatgttttctacaccgtgaaattgtatgtcctttgctagaatctttgtaagagaggtctcactgctttgaagtcaaataaacctagaaaataagcataggaattatttttaaacaccatttactgtgcagattatagagagatgaactcaaggataactcatgttgctcataaacttgtcatagtcatggttacatttatgcaaattggcacaggcttttgttgttgttagttatagtactgcaaacacagtttaagatgttaagaccctttaaatcatgtataattatggactaatttcatcttgaaggaagaagtgataatattcttatctcctgccgtttaaagctgaaacatacctcaaagtagtggagattgtgccctacaaaatataatgtgcttaaagcggattttctcaggacttgaattctaaattttactgcttcagggactcatatgatggctatgtagtatagatttagagagagttttacagactcctattgacataagtgaacaaaatggttccttggaaaccgtttagatgtccaatcacagtaagtgtggattacaggttcagatgcatattgtgtgcagtgatgtgcagcacagtgcttggggaagcctgtggtctgtattaagaacagtgcatttcttctagtgttttaatgactgttgttttaaaagaaaaaaacagtcagcattgaaactactgaaaggtaaagctcctgaaacctaacccaaaaggcatgctctcatagaaaactcttcttagtactttcagtgcggtgatagctgaggacatgtggtatatattacagtgccagggaatccaaacctctgcagtgtggagtcaccatgaaaggctaatctaaaaatgaagtggtagctttgctcgcatcataactctgttacttactggtgcttcctattagcttgacattattagtcttctttgggtgagatagaataaatggaaattcaaaggggaccacagcaggggatatatgggctgccaacccctcccctagcactcccttcctccagcctgtactcagcatttctccctgggcatgacaaacaaagtcttacatagtcattgcaaaaagggctaaaggcagagctgtccatggttaggaaaaaaatgttcaaactgttggttgaaaatcaggtaataacagtcctcttagtgaacaaaacttattagagggctagggaaggaatgctatctctcagcagcaggcaggaagaaattgctgttgaaaagcttacctctctagggaggaatcagatagcagacttcaagcctcaggtccaacccataaggtcccacctacaccaccccccaccccatccccatcccagctttgttagattgctagcatcgatcgctggctttctctgacccaacagtgggtgaaggaaagagactgaaagctggcaaggtgggggtggaagaagactgggacagcttttgtagagaaagaaagaaaaaggaggaaaacgggtgggggccatggggactaggcttaactgatgcctgcctgcctctctttgatttgatggcctttattccttctaattggataaaataggaagtcactggcagtcctgtgtggctggggatactgattttactcagaccagcctgcagctctagagtgtgggtagagagcggggagtgggggttgggagagggggaggaaagagagagaggagagaggacgggcttggatgaagaagggaaagaaagagaaagagactgaagcagagaagagccgcagaggaagaaagtgaatgagcactcaagaaggacaaagaggagtagtcgggggtggggtggaggcagggcggggaagggagtgaccgcccctcctggctgcactcttgcctccggagccctctgatcctgtttgcagtgatgctccgagggcaggcacctgctgctctgtaatgattcagcccctttcagccgtcgtcgcgttaacacaacaggatgctgttgctattgtcactactgcctctcctgccgccgctgctgctgccgccgccgccaccgccgctggtcctccttctgcttttacttctcctgcatgacagttgttttcttcatctgagcagacaccagcttcagatgctcgaggtgagaaacatgcctttcagtttgggctactggtttacttaattaatcagccggcagctccgtcgatctattttcgtccctgtcctcttgacgagcccgggatggtttggagtagcatttaaaagaactagaaaagtggcccagaaacagcagcttaaagaattattacgatatactttgattttgtagttgctaggagcttttcttccccccttgcatctttctgaactcttcttgattttaataatggccttggacttggacgatttatcgatttccccctgtaagatgctgtatcatttggttgggggggcctctgcgtggtaatggaccgtgagagcggccaggccttcttctggaggtgagccgatggagatttattccccagacatgtctgaggtcgccgccgagaggtcctccagcccctccactcagctgagtgcagacccatctcttgatgggcttccggcagcagaagacatgccagagccccagactgaagatgggagaacccctggactcgtgggcctggccgtgccctgctgtgcgtgcctagaagctgagcgcctgagaggttgcctcaactcagagaaaatctgcattgtccccatcctggcttgcctggtcagcctctgcctctgcatcgccggcctcaagtgggtatttgtggacaagatctttgaatatgactctcctactcaccttgaccctggggggttaggccaggaccctattatttctctggacgcaactgctgcctcagctgtgtgggtgtcgtctgaggcatacacttcacctgtctctagggctcaatctgaaagtgaggttcaagttacagtgcaaggtgacaaggctgttgtctcctttgaaccatcagcggcaccgacaccgaagaatcgtatttttgccttttctttcttgccgtccactgcgccatccttcccttcacccacccggaaccctgaggtgagaacgcccaagtcagcaactcagccacaaacaacagaaactaatctccaaactgctcctaaactttgtaagtagagagagagagagagacgatgatgatgatgaataaaaggggtgggtttgaggtccccaaaggacatttccctttcttcttgcattttagttgcctggttttgtttaagcaaagcctatgtttgagatgcttgggatggcattgaagggccgagtaaaatgatcttgcaaactccggatctgaaccagtgttgtaacagcagctctctctagccacatggctcaatctggtaccgggaatgaaaaacttcagcatctgcaagtcatgcttgaatttaagttaaattcaatttatttctaacacattttaaaattaaaacatcacgccatctcttatgttttatagaaatgtgactttcatataccagtgagtattattttgtgtctttctcttccccatcatagatttcctgtcatctctctgttaccctctacctctcagcgaccccaagctgcctgttgtctctctctccttcccgttccctaaccacttctccctacttttgtatcttaattggttctttgagattacagcaagtcttaagacatttacggtgctagcctctcactagcttgagacgactgctgtcctgcccagatggcactttcagttagtgagcacttactagtggcagctttattttgtccaggacacagtaggattctgcatgaaggattttcccaaattagttttgtcttctataatcaaatgtttaaatagcttccttggcagttgttaaaaagtacaagatccattagtgaggtacatctttttttttttttttttttttgatgtatgtcatcttagtctggcagattgcagcggcccagtttaataacctgtgatgtgcagagagcccacgctcttaaaaacaatacattcctgtttgcattgcgtaattgcaatagctttagagtggaaagttgacaggaatgaaagcatgactgttctaaatatcaatatagaagggaggagttttctgtagccttttaaaaatgtttctagtttatttttgttgtctctatctcctatcactttttaccatgaggaatatttacttagtagaaaagtacaagatcagaaaatttggttcttaataacttgcatgaaagctcttagggttaaaagagagttgacaatttctctgacgaaatgcctcttgtttttcctctggacagtaatgaagaataaagaataccttttccagacatcatgttcagtgtgaagtagtgcagcatgctgtagaaacacagaaaaacttgatttgtgcttgtaactcccgatcatttcacgaacaccagattcagtggcaaagatttaaagaaaaaaaaagtcttgttttctaggtgcaattagggaaaacctccttcatgcagacgctgctttgtatctttatcaaatccctgaagcatcattaaaggtctgacagacatcactgcctttgctgcctcttcccacctggcaaagtgactgggaaataatacccagatgaaatgacaggctataaaaagcaagtacagatcctgcaaaaagaagcgaaattcaccaggaggacaaggttacttgatcattttaaacttgtctttaattgaaatctgcttgaacaggtttcattgtccagagaaagaaaaaaatgccctttgaaaaacacttcaactaaattctataattttgtcatctgaggaaatcaggaaaacaaagaaacatctaacacattttcctgatctaagaccatgtcagaaagtatgttgtgaagttttgataaattattttataaagtaaatttttctactaagtgttttagtagattacatattccttatcagtttttttttccccaagccagggcattgatattgtggcatctgcaataaatgggaaagatttactgctgcctaaaagcatcattgtggccagtttgaccagatgcacagctgcaacgttttgaagtgcatcggagataagcctagagaagcagtctgggaagtagttttctcctgaaaagttaggggtagacagttagttggttaagactttgaaacctataaggaaactctgttaattttttagactagttccttaaaaaaacatcaaatcttgtattgtaaaaattgtgagactactttttttgggggtggggagaggttgttgtggggagagtagtgtttgaaagggattggtccaggcagctttgtttttagagacttgtaagtggttgtttttgttgttgtttaaaaaggttgtaaccactaattaatggaaagcaaaaaaaaaaaaaaaaaaaaaaaaaagcttacaaagggattgtatttttcaactaagaaagtattgtttagtcacagaaagaactgggacgttccttttcccgtgcatgtttttgacataaactaagctgtcatggcttatatttgaaaatgacattatcatatgtgaaacatgctcttcagtggttttaggactttattctcccgtttccatttttttttctgtctcagcatattcagcacattatgcacagagctgtagccttcaaggtcatagactgttgaaggctaattgattcttctttatcctggagcctgagagagtagaagagagacaatcccagtaattgtgtctgcagcgttgctccccaaaccaatctacctactaatgttagagttttattttataaatactagaattactccctcactgactcttgtcaaattacaacattctttgtctttgttataataaaaggcaaaatatgacattttaaattgccttaaggtatagtggctatgtcgaattttctaaaatgggtatttctttcataaagtaatatttcatattttcatgatattaatctatgcattcatgtaggtcttaagaagtccaatgcagaattggaatgaaagtatataagtatatatttttattctaaagtatttctaaatatggttaatggtttcccactaccacaatgattatattgtcatgatactaattaagtttttacttctcaatgagtcacataatacttgcactattcatttgttttgtctgggctttaaaatttttcctaccctgactgttgggagattgcaaacttagattatcataaaaagagctgattaattaaattatagccaggaaacagtggtaccatcttgaaagaaaatgttttctggatatgagatcctccctgcttgacaacagattcttggatgcaagaatgtgttggtattttcatcttgggccaactttgttttgctttgtcctaagtcttattatgggattgtatgacaaaccattgttaccgcagtgacaataagaatcagtaaccatttgcaaaagatcaacatgatgagttggatataccataggatttctttccttctatttgaaagtgccgttcatttaaattctaatgcatccttcttctagttcttggtaactatgtttgtaggtatttcagaacagtgattttaaataacttctccccactttaatcatagccgattacagcctaaaatattaaaaactggaagagactgaaagatcttctattggaactgaataatttcataaatttaccaatgaagaaacccaggctcagaaatgcctattgaaattcttttattaaaatatactaaactctgaaaaatgtggcaaaatccaaagtattagaaaatgtctctgtctctgagaatttaaacacacacactctctctctctactgttttcttctatcatcgtatccttactgtagagagttggagctagagacgaatgtagcatcagactgagaattagggaagtactttaagtgggaccactgttcaggtgtgtgtttagtgcatatcactaaaattaaattttcttctcgccttcctgttttgctcttattaaattttcagtcgtggtggtcttttccctttttattagatcatccatactttgttcagcttgcttctgaaaacagcatgggttgcctagggtgagttcttccctcatatatagcagattgctctgtggctcacttcttttcttcataacccattttgttttctcctctctattcttttgtgatacccaactcagacttcttctcccctttccttcctaccttcccaattatgtattgactcttttttatttttgtaattatgtcattttggctttataggtcagtatttcattgcatcatatcaaaataatttcaactgtctttaatgaaactttattgcattttaatgctgaatggcactttcatatattacaaacatacaaaaaaaatctctagccaatgaccaatataccagtttcttaatgacataattaaatcaaatttttaccttcttcttgatcttttcctcttttttttctttagtgtgcttgattccagtttttctgtttttggacatcagcatttctgtactcccagaaaacgatgttccaaaccatacatctgtgttcttcctccttccctcttccttttaacaactcttcatagtatccttttaaagtatgaaggaagaggtattttatagattgaaaaaccaaagcataaaaagttatgacttgtttagatgcccctgagaaccaggaatataacttgtccacagagtccattgaacgttctactacagcataaactacattccgtctacttttatgctcatgtttctacttttattacttttgctctacatcaatgctttgtttttcttctattatttcctctttggtttttttttgtttgtttgtttgtttgtttgtttttcattcagtgaatgtacgctaagtgcctactctgtgccagactctgttctagaccggttatatgacagtggaaaacagtagagtgcctgccctcagggagcttatgttctagtggattttaagaatctaattgcataatgcaatttgagatatttcttgctttcttatacatataccctcttcattcagcatttcttcttctttactgtcatgttattcaccttttgacttccactcctgtcttttcttaatatgttttcttctccatctaccaaatactgaacacttgcccagcaatgtcctttaactgacagcaatcccacctctgctaccaacaggctgagtagccaggggtgattcaccatatggcactatctaatcaaaccattggagtagtgagaaaaatttgatctgtctggccctttaggagcaccctcttaagatgaaaaatatatacataattcttctagcatgtacataaagattctaagattattttcagattctagagagttggtagctgtaaatatttttgtttctatattttgctcatatttttatgtattgttttggcttgcataacatcaagagtattaaaatattcccaagggtttttcatttcactgtacggacaaagactagaatctgccattaagttgtttagttcttaaactgaataaagacatgagttcatatactattcacatgaagagtgattgactagcagtgagtgaagttaatcctcatcatctcaaagctgattgtaatctttactgcagtgaattttatcgtgtgtatgcgtgtgtgtgtgtgtgtgtgtgtagacattcaaagggtgtttctgaataatataactagtatcttataatcatagaattttatatgctgaacatttttagagattatttgtgtcacttcctaagtgagaaaaggcaggtctggaaaagtgaagtgacttgcccagtgtcactacaaccaatcagtagcagtgctgagactaaaactgaagtcatccttacctttgctacacttgcttttcttctcaaaactgtttttagcatttattcaagtagcatatgttacgttatcataatttaaaagatttggttttcccatttattatttaaatactaattagtaaaacttttatcaccctatagcagatgtcttctttagagaagagaattttggccaggtgcggtggcttacgcctgtaatcccagcattttgggaggccaaggtgggaggatcacctgaggtcaggagttccagaccagcctggccaacatggtgaaaccctgtgtctactaaaaatacaaaaattagccaggggtgggggttcatgcctataatcccagctactcgggaggctgaggaaggagaatcgcttcaacctgggaggcggaggttgcagtgagccgagatcgtgccactgcattccagccagggtgacagagtcagactctgcctcaaaaaaaaaataattttacctttataatattgatatgtataagacacccctccggaggctggacatctgtctcccaacaatataatatatgagaaaatgttttaatgatcaacgttatcccaactgaaatgcgttacatacttagaaagaaattagttccttagtgcttaaagtattcaagcagtgacactgttgagggagatttatgttcctagcagattattaactatatttacttctgaagtctcttacaactctggttctctcagtttattgtctcagggtgttagctttccagtgggtagacttgactttcaatcctacttgtccctcttcatggccttgagcaagttagaccatcatgttaaatctgtttcctcatttaaatgtgataataataataatatacatgtcttgaggctgttaggagattaaatgaggttttggaaaactccaagtcctaggcctgagacataaaaaatatgaaaccagcaccaattttgtccctcattctattttaactccctgcctcactttgttctttttctcctttgatcttgacagtggtttggtaacaatgcctggagaatacattttggggttttaggggaaccttatgaaaaactttgaaggaagtgaagagttgatgatacatcatgctaaagtaggaattatgctagaaactcgagatcaaataccagctctacctcttgcatgctgtgtgactttgaggaaatcacttcacttgagatttagttttacatccaaacaaatggggatgttaacatctaaaactctcaagagattgtgataaggacaaaagtggttactgtacctaaagaaaacagagcttaaaaatatattgaattccttctttgccctttctatcagggttcgtgtatgcatatattcacaagtgctaacatttctagaaataaattgtaggggttctttaccagtgaattaatttgttatgccttaaaatggtctgtaggactttactaatttcttgagcccagtgtcataaaaggagtattttttcccttatacaaattggttagaatacatagattattacctttgagttacatagattattactttttgagtaatgtccaaaaatcactgcatgaggggcttcattatagggaaagcgataaggagttacttttgagagaggaaaagactgcatggtatgtaaaattgtgtttgtcaagtaagtactgtttttggaaagattgggacaacggaaaacaatctatacagtttagatgtggtgcaggggaagaacttggctagaaataccatgaatcctaagattatgttcaccttactctttttattgttccaaactgggatttcctgatctcaaaagatgggaattaacgtctatgagttgttttcagcatttgacaaaaaccatggaaataatatacatcaaataattttatatgagccaaatcaaatgtagaaattctttgagtatactacatctatgtgtatctatgtgtgtatacatacatacatataattcatacatataatattctaaataaaggggaaaattatttgacaataaaatgagcagataaaaatatttttaaatttggacaaacaggttgtttattaataggtttgggaggggtggacaaaaaaacttctagccctatgcctaactgctagagtaaaagagaaaaaaaagtgttttaaaagtaaaaaataattggagcttaagtatatattggagattctgttgcaagtaacttaaaatgaaatcttactagctggattattggccagaatcctacaaaaagggaagaagccagtgctgttctagatatacacacttaagggattttggtatttttgttgtataccttatggtttttctaacagacagatataagtttgtaagagcttgccatttacaaaaatgtatagtagtgggcataatatatgtatttttatttattctttaaagtagaactagaaatatgtgagatcctttgttcatcttgattgttattcactcaagtataatacctttgctgcagaaattgaactctaaatcaatactggagcaatgaggcagccccttcgaagcataaaatatttgataacaatctagagtatgttttgcctgggtataagttttctgactgtacaatggaaataagctgatggacccaataaaacttggtgaaataaaatggaaagcttcctcaggtaaaatattttaaatttttcatcagaaacatgataggacaagacttgatttactgtgattttcagtgataggcacttagtgtttgagttgcatttcatgaggtggttgtctcccagccaaaggagaaattcatgaactctctttgaagccagagttagcacagaatttaatatgcatgtaattatcaaatgtaaaaatcttcataatttattttagtttaaaagttattaatttaaaattaaaccaaatgtacatatatgcatatgcatttggaagaaagatgagagcaacactgaagacaatgatagttgccattaggaagaaacttaattcataggcaagcagaagaccctatatcttccagttcctaactgtgttgcctgtattggtgtacaatgtaatataattttgtttcccccgtttaccttccttttccctccctttgtttctttcatacttgccattcacagttactcttctctttcctctattctttcataccccacctattccttcttctccagcgatctcagggcacatggctccacacttctctctcccaccctgctctgaagccagtgtcctaaagcatcagaggttatagagtagatggcccagacctgtggtttctcactggatggttagtgggagagagtgaatgagaccttaaccacagtcttgaccatgattagcctgatgactttcagtgttgcctcttcctttgctaagtaacaggaagtaattgttttatgaaatatgttggtgtcacagcaataaaagctccatacataaatggaatgatctaaggatagtagaattgaactcttgttagcatttgtttgtaatcccttggtagagcttcctgggtcataattgcttgctcttctgggagcaaaaggaatcagtaaccattgattgttacatgatgctaagtactgcctacaaagcaaatcttaagaatgattagtggcagagttcagggttactactctgatctctttttactataatctttaaagcaagctgaatttcacagtttttcccatcaagcaactcctatgattcttcaaaaggaagagaaaaaataatgtcatgtaatctataaaagcttcagttgacatcaaaaacaaacaaaaatatgtaaaataattacttcagtttttttaaatcttcctacttccacgataacagggagacatctaaattaacccctgaccagtaactttagtcttgcatgaatatgatccttataatcttaattgatctgaactatggaacctgtggtacacagtcaataacctacatagccgctgcctatttagtaaactatacatgtaatcagtgggatcaatacaaggattctcaaaatccttgcaaaattcattcttcaagattgctgagttttctgaatagctgatgatttgtcaccttgaaacttttttatctattttggattgaaatcttttaataacttacaatactagtgactactgtcattttaaatgggatttattgaatataggatcttcacaatgttgaatactgtgatgtctttaggacatagttgggttatgttataactttgttgacccctgttatttcgttaggacatactgagttgtattagggattctagctcttttactaaataacccagacctacgtatgttctgattgtattttgggttattacataatcaaaattagcattacagagctttaagccaccttagagacactttgaaccaaatctcttattttatcacagagagacaagcccaaagatgttaaccttcttgccagagaccacatagagccagaaaatgttgatattttcatctcttctaggctttcagctaccaggtcactttgcaaccagtgtatgttaattgaaacattttttctgcacttctgatgtatagttctggtctcctgcaggtttaaaaggcaaattttaatcaggttaaacatttgtattaaacatttatataaaggataaaatctctctgagtgagattctctccttgaggaaatgcatacattttggtgacatgttttggtgacatattttgcttatatgtcactcttgctctgttctggatcaacagagttcaaggatgagaggtgaatgacaaatgaagaggaagagtaactacttggttctgatggtccttggatttatagcgcagatttaggggagctgagtttaattcctagatgttttatttgttcacttgttcctcctttcataatatgtagaatggcagtaataaatcttttcttttcttttcttttttttttttttttgagacagagtcttgctctgttgcccaggctggagtacagtggcgtagccttggctcaccgcaacctccacctcctgggttaaaccattctcctgcctcattctcccgagtgctggggctacaggcatgcactatcatgcctggctaagtttttgttgttgtttttattagagacagggtttcaccatgttggccaggctggccttgaactcctgatctcaggtgatctgcccaccttggcctcccagtgtgctgggattatagccgtgacccaccgtggccagccagctataaatctttagaccttgatcatgcacctaattggaaattgttttttgaatgtatgagcactactaaattagtcagtgggcttcatgggatctgttttgaaatttattgtgaaaccttatgatttataaagcacaaattacttttattttcatttcttgaggacaccatagcaccaatatttacaaagcacgtatctcataaactctcttgtgatattgaagacacgcctgcagcagaaccccaaacttcctgtcttccctaactccagctgtctccccagtcttcatcccgatggaccatgttttagccaactagaactcgaccctgaatattattttttctcttccatgtttttgctcattctattttttctactataaatgtgctcttcaaacagtctctcctctcccaaattctacttaggcctcaagactcacctctccaaattagatgatgggacccctcttcttgaagacctcctccaaccccccataacctattgcttgtgctttatcacatttagatttgtgtgttcttatttggatgcttgcttattgctcatagtagactgaccatttcctaaggcccagagttatagctaactcatttttatgacctgtatagtaccaaacagtgtacaggttgagcatcccaaatatgaaaatttgaaatctgaaatgctccaaaaatccaaaactttttgagcatcaccatgatgttcaatggaaatgctcgttggaacattttagattttggattttcagtttggagatgctcagtggtaactataatgcaaacattccaaaatccaaaacacttctggccctaagccttttggataagggatactcaacctatattttatatgaagtaggtatctcattcgtatatttatggaataaaagttacactgagggtaacttgcttatgggagtggaagaggaagaaaataatctgaaaccgggtcttaaatcactgacattttaattttgaagaattcaatatagagtttagtcattacaaactttgttgagacatgcttttggacattttaacatataatttgcaaagtcggacgtgatttaaaaaattcacatcatggagtttaagagacttcaggcagcaaagaattttatttcatgatagtatggtgattaagagcacacactttggaaccagattgtctggctttaagtcccagccctgtctccggctgtgtgacagcatgcacactatgaactatctgtgccccgattttctcatctgtgaaatggtggcaataactatactttcctcaggggctttttgtgaggatcaaatgagttggtgttcataaagtgtttggaatagtctctggctcatagcgctatataagcatgagctgtcgttactaggcagttttaacaattaaagtgcatttccttagatttcaagtttgatagcttgtgattacaataacaggcttcaggaaagggccaggaattccaagggacctattgacacagctatggatgtgctactatttattttggtttggtttgttcatgtggtttttcctctgtgtgatttatgtgttaccatcatacctgcattgttctcaggatttaggagaacagaaaaggataatcatcaatctacctgtcagtcagaaatagagcgacatggatggtttgaataaaaatgctgccctctctggcaaaatgccatctgttgacattgacatggacaatcatatatgtgtatatctgaatttattgctgtaacttcttattctgtcataaaatggtggacaaattcacaaggagaaaagtaacttatcttagttgttgaagaactgttgcaaaggctttgaattctgcaatgctatcattttaccaagacagaaatctactcattatccagatgcactcaataaattaatgcgatgatgggtcctgtcattgataagataacagtgatttggaagtatctcagtgttattaaacaagatcacagaagagccattaacattttaaaaacagagagatcttgtagataacctaatcaaaatattttactttactcatggggaaactaagatccagaattgtgaaatgactgggtcttaaatacatgcagctagtaagaaacacgggctggtctaaaaaacaggaatgccacttcatttagggctttttttttttttcaatatcccatgctgcttcttataaattagataattctttaatggtggaagactttattttttctgttgttctatattctttattgagtgcctgctcaatagagaagagtttacctctaaaaggagaacaaacaaaagaataataaaccagaaatcatatactatcttagcaggcagtacatcatatggggaaaataagtgtgaggagatcagagtactggtggaggagcatagttattttaaatagattaaaaggtacaaacatacagtctgatagaagaaataacacctagtgtttgatagattagtagggtgaccatcgtttctaagagtctattgcatgtttcaaaacagttataagagaataatttgaatgtcctagcataaagaaaaaacaaatatttaagatgatgcatatcccagttatactgatttgatctttataaattatatggatgtattaaattatcacatgtacccccaaaagtgtgtacatctcttatgtatcaataagaaataaaatttcaaaaatacccttaagaaatacataaacagaatggtcaggaaaggcttctttgaaaaagtaacagctgatgaaaggcttgaatgaattaatggagttaaccatatggccatatggaagaatgttccagactctgggaaaaggccttactgcccaggcagaaggccagtgtagtcaacttaagccaatggcttaagtgtagcatgggaggcaggaggtattaaatgagatcagagaggtgatgaaggcctgatcagggaagcatgccattcattgtaagaatgatggcttttccaccgaaagagatgaggaattattgcagagttttgagtgaccatgggacttgatgccttaggttttaatgggatcactgcctgctgtgttgagaatagcttgtggagaaggatcccaagatcccggtggaaatagtcggaccactgaggagattgttgctgtaatccagatgtgtttgtaggagttgtaggagggaatgtaaagacattattggattattagattctgaatatattttgaagatagatttagaatgatgtaatgatgaattggatatgggatttgagtgagaggagtcaaggctgatttcagtctaagtagttgaaaggatacggttatcaccaactgagatggagatgatctaaagatcattttgctcagtctcccaatgcataggtgccaaataaatcaaggttcttatcaaaattagaactgtggacattaccttctcataaaaataaagcgagatatgcctgagagcctcctgtaaatcaatacggctttatgtgtgactagagatccttataaatacaaaagaaaagttgcagtgaaattgaggatgtctgcctagactactcggtaacactatccagaacccacaacacgtgatgatggaatgaagtcccagggggatgtagaataggcttccaacaaaccactttattcctattttatggtttctttttaattcatcttgttcagcattcaaacctggttcaagttgttcagtttatctaaagcatattgccccatccctctcagctcactttcagtcatcttttaaactttatttcagaagtctactcatcttagaaatgtgcactttatccctaaggtgagctaagtactttcctctctttcctctaggctttgacagtatccagtattttccacccgtttcccatgtactctgctgacatgcatgtattcctcaaggtcaagcatttcttttatccatgtacagatgcttcacatagcaccatgtatactataagctctaagactttgaagtacttgcatgtcccaggtagaggtttttctcctttctctattaagctgtcaattttctatatttatgatgaaaatacacagcaaaagtagtgtaaatgcttattttacttctcaaattactcgtcaagttgccaaggtgccaactattttttgttccacatattatatcttctctacttcactttctggaaagtaaaaagcagcaaaaaggaggttatcaagagaggagaagcaggaaaagttctagacagtctacttcatttttctcatattctagtactctagacagggtgaaggctcctgttgcagaagtgatggtcacatattcctgcaaataccaagtactcagttcagcccgtgcctgcagtctctttacatccctgtcctcctctgcttctcaaattttacctactatgcaaagtcttgatcaggttccactcttctttagagacatttcctatactctgtggtcatcattaaactttcctccttagtctctattccagcagctcgaatcatctttaatactcatgtgtgtatttaaacatccatcctaccacataggtgtttgattcagtcatgtgtgttttatattatgaattaggttttaagtctcatctttggttttatttacctcctcatacctagaaaaacagattaagcacttgttctctacaaggccctgggttcagagtagtagaattgagagagacagaaagagctagtttctgtcttccaggagcttggtttcatcaaagacataaaagccttgccattaactggagtataaggtagtatatgagatgtatgaagaaaaaatcctttagtttgaggtgaaaaaaaaaaaccaaaaaggaataaggctaagaaggaagagaatcagaggcatcttcatattgcatggatagttgaggtgggccttgagagtaacatatgattctgatgggtgtggttatttcaggtgggagtaaaggcccaagggaaacagacatgttaagtgcatggtgagtcggccagttgagtcagtatgaaggaatttgctgatagcgaacatttattaagcacgtattgtgtgttcagtgctttgcatgtattgtctaatcctcacacacacaaaaaaaacattgttcctttttggaaataaactgatggtgtagaaatgatgatgatgatgatgatgatgatgaagatggtgatgatagtgacaatctgaatggtgcagaaggaaatgggatgccatgcatgagtctaaggaagactatgaggaaggaataccactgaactaattgaatgcggagaaggaaggaaacgattccatgcacattagtaatttagcggttgttagattaatgaatctctgagtgacaacctcatacatttattcaacatgtatttattgggttctcctaagtctttatgtatttattaatgtgcaaaatcagtagatttatgacaggaagtgacttgtgctccaatttccagaaaacattcattacttcttcctgatgaagctgctcagttaaataatattaattgttcttcccctgatgttatacaaaaattaaaattgatagaatacagaacttaaaagacatttttactttactttttgacattattcattgtttgttgctgatgaatgaaacctcttttcgagtgtgtgttccctttaataggcactggtaatttatgtactaagatttatttctgtatggaaattacaagtgaaatttcatattgaatttatatttagcctgttctagtacatagtctctgcatagtatatccatggcatcctacttaatattacagattcttttatattagtgctgctacatgtgtattctcaagcttttaattgtacaattattacaaaaagaggtaaaaatatttcccctacaaaattgttgctgttaattttttcctgtttattcatggagtattcaaagaagagctgtgtgttcattacattccacaagttagtccattcagtttgttcaaaatatgaattctgatgtccagcagttaatataagattttggcaggctattaataatggcatactcaatttgtagctctttcatccatgtaattttggtgatgtatgcactatgttccagggaaaggaatagttcaagattaaagaggcaatcagtgtattggtgcttattttcagtgtgtcaaagctgctaaatgaaagggtgcaatttctacttgtacaatttccacttgtgctgctcaaaaacaagccattgatattagacgtgtatcaagcatacgtggttgcagatgtaaataattaacattaaaaacattttcttctttagttgtgtatttagaacagtgatacttagttaatatcaacagcttatttttagaatctgaattttaaaagtagtgaaaatacttctagtgattaaaacaatgtatgaaaagaaaaaaattagtaggctattttaatataattagtgagtatgctattttaacataattcaaagatgcattcctattttaattaaagctcattcagtatgcaagaattccagtttccattacttcttgctgctgctgtctgatcttgtgtttcttgagggacacttcttttatgagcaattcttttgcatttgcacccagattccttcacgtccaaagcagtagtttaaaagagaaggctacatttttccattttggcctggaacttagatttttgttctgcttacttcttctttaagtatagtgaatatataaacttgtaggcactcctttgcagacagacttcagaatcacatgttcagatgaatgtgggaatgtaggcagaaatcagaaacctgattgtgcttcaccgcttcagaccctgccctatgaggccctccttgtagaagaagaaatggaactgaaccaataactgaagtgaaaaacccttctggaaactgtatatatgaaaagattccatttagatccattgaattttgcctttcattttcaaacttgcaaatagaagcagcattttaatatttttcaagagggggaaaaaaaagagcgtggttccctggccctattgtatcacttccattttgtctggaactgatttcatgcaggagatgcactggaatcagcatgcaaattctatgtggctgttgttcagtctgtttttgattcatcgtggtaaaatatgcataccatgaaatttgctgtcttagccattgttaggcgtacagtttggtagtgtcagatgtgttcacattgttgtgagaaagagctccagactttgtcatcttgcaaacatgaaactctgtacccattgaacaacaactcctggttttccccaccctccagtccctggcaaccaccattctactttgtgtttctgtgaaacatcatataagtggaatcatgcgttatttgtctcatgtgactggcttatttcacttagcacagtgccctcaaagttcacgtgtattgcaacatgcatcagaatgtccttcatttttaagactgaataatattccattatatatacagtcatacgtcacttaatgacaaggatatgttctaagaaatacgtcattggaccatttcatcgctgtacgaacatcatagagtgacttaacacaagccttgatggtatagccaactacacacctaggctaatcgatagaatcttttgctcctaggctacaaactgtgcaagtatgttactgtactaagtagtataggcaattgtaacacaatcgtaagtatttatatatgtaaacatatctaaacagagaaaaggtacagtaaaaatacagtattataatcttatgggaccactgtcgtagatgcagtttcctgttgaccaaaatgtccttatatggcacgtgatggtatatgccatattttgtttatctcttcttgcatcagtgaacacttgggttacttccacctcttaaccggttaataatactgatatgaacatgggtataacattctaattatgttttgttcatctgtggtgggtgtgaaagttaaaccaatggaacctttttttagtgaatttagtcaaatttctgaaaaccaagaattcctatggaaacatactgataaacatacttttcttattatatattaaaaatgcttgtagggaaaacccagcttctaatagtactctgggtttgtgaagatgcagtaagtgcttgctagagagatgtttttaatctagagagctagagcagagacttagagttcacttgtttcttctctttttttcaatcatttataagatctctcatcttaactcattaaaactggctgattgactttgattactgacacacccaaactatttcaaaccagttagttcaaaaatgcagttgcctctttgaattatttataaaaaggatctcattacatttttccatagataacgatgatggcaaaggggaagaagggatcattatgccactcctttaaaatgcgggcttctggcctggcacggtgactcacacctgtaatctcagcactttgggaggccgaggcaagcggatcacctgagggcaggagttggagaccagcctggccaaaatggtggaaccccatctctgctaaagatacaaaaattagccaggtgtaatggtgggtgcctgtagtcccagctacttgagaggctgaggcaggagaatcacttgaacctgggaggtggaggttgtagtgagccgagatctcatgactgcactccagccagggcgacagagtgagactccatctcaaaaaaaaaaaaaagtgacatgctggttaaaggtccctgtccatatcccccttttgcaactatttaatccccagcaaagtcctagccaggatttcctggtaagagtttttctgctctgcgttgtcaacagactattttctccaactgagctcatggaagtaacctagtttctatcactagtgggtctcagtcagaaaaatatgagtgtaggttattgaagtgtcagggttgtggtggccctcttggctgtgtgcttactggggatgaagtacatggtggaatgaaggctcttactagggagacttctgagttactagtttcaccacacagctgtctcacccagtatcttggaactgtttcttgcttcatgtgtgtgaaaaatatagtaaatttcctggtcatattttagcataattaattataccaactattaatttaatattttgtttgatttttagtttccagggtaaaacattaattttctctttaatttccattctataagattcctattgttttcagcaaataggagtttccttctctgtaagcattgctgactcaagactatataatgttagaaatagaaaaaagataagaacatgttagtatcaatagcctttattattataatcggtatgggcctaacttctgctagcaacattaaaaatcttttcttttactctatcatttagtaacggattttcttttggttgtgtcgaatagaattgtttccttgatgttccttgatagagagtgttctctttaatataggaatacagtaaagaaagcatccacagtttgtgaggcagagtttagtgctgatgtgtacagaaactcaagtgatatttagacaactgagtccttactgggaatcacttaagccttaaaacatctctgccattatgctgcttattttacattgttctggatagatgctcattatccagttctcattcatgatgagcatgggattgataagggagctgacatgaaaattatggagaaaaaatgcaaatagcaaaagatagaataaagcatgtatacctcatgatcattttccccattgatattgatttggactcactcttgatgtatcaggtgtgttcaatctttggcaaacatttagggttttcgtttttgctgaggtccacttgaaccctggagcccaaaagaagtaaccaaaaatttctatagcttagtaaattccatgttctagaacttttaatgtggacctcagaaaaaggaaataaccaagagtgccgaaagctacatgtactttgaattgttcagcatgtataaaacccaatggctaaccgtgtctagaaagaaggagataagtaaagtaagattggagcctggcgtttggagttcagcaacttttctctgttgtgcgctgacatttaagttaatagagtgatttctggtggatttctttgaaacaagacagttcatctgagatttggttaaaaaatatttcattactttgaggaagtgattagggttggtcttatttagttggggctttcaaaattgatagttttgcctgatggtatatgctaaaacattgaattgtgagtttcctagccagactggaccctaagcccatcatttggaaatagtctttcttatttttgttattcttgtatttattaaagaacattggactagtgaaaattacaaaagaaaggaaaatgacacaatacactacattctgttgtatcccatttctatctcagggaattatgtgtgtttaccaaactgatgtctagatgaacattcaatttcgtatcttgccatttaaaatttaacatcatgtgcatttttatgtcattaaatgtccaaacacctggaatttttacgtttgatttgttattgctaaaaagtacttctcttgatttttaggggttttcacttttaattaaaacatattcttgaaactccttctcttctccttggctaaacctgttatgctacaggacttcaggataacttgagctgctttggctctttgattaagtgcagatgtatttagggtttgaggtgaaagggtttttaggacaaatcgcattccagtttgagggaaaaagagagagaggaagttttggaagttacaaattcattaaatttttgcttccacatggaatccacaacttttccttttccctggctgcctttctcttcttcattgagttttccaggcctctcttccttctgcacaggctccaaagagaatggctgactataagggttattagtgatattttgggagttattccgttcttatccactctcccaccaacacacacactctcacacctcctcccatcaaagcttgggatctctgggaacagggaaacatatcaagatattagaagacgtcaatgttatatatgcagaaatggtgaaaaatcaatgaatttagtaagttaaatttgtttgggtagcattttaaaaatatttaagtactttgacatatgttaccccctaatacacagagggtgctcagacagcatttgctacaggagtgaaccctggccaaagctgttttaaccaagggacagtggaggcccagagaggttcgttggtttgcttaaaatcacacatccatgggtaagcaaggtgatggataatcagctcaattgagtcagtttacattgtatacacataacaaagcatcatgttgtgccctgtaaatgtatagaattatgatttgtcagttaaaaataatattaataaagtaaataaaatcacacatctcacattgagaggagggcagcctagacccagatttctgttagccccaggaattgaggcatatatgggagactagcagacaacacacataggaaacttttgccacttaattattattctttttctcaagaccactatattcatttgggtttgttcttatgcttttttttttttttagcaaattaaaaaaaaattatccttgaatgattctaggttagctttttgactaatggatgttggaaggagctcagtgacaaaggccagggattattttgcttttcctcacctcttcctttgttcctcctcatcatattacaaccttctgcttcaggattccttctgctttttagcaggattgacatgctgggccttacccggaaaggcaaaggctgatttgattagggaggtctttgttccaggtatctcacatcagagagccttcataacaaatgagaggaatggattagaagtttcctggggataattttttgtctaccctttaagggaaatcttgccttcattaattacatctcaaatggaatatgtggaatatagacattttcataatcaacaaggtgattttcattttaaaatgcttaaaaaatgttaagcagcatgtatgcacgcacacacatgcaaccaatttcttccacctttttcttgttttaattcttaaaatatgaatttttaaatataaggaaaatcctaaaagcagaaactaataaatactaataaaatgttaattacattgattaaatcattagtattttaagatgggcccctgaaatgtctccataaataagcttaatgtgctttcatttaaacaacaattcagttagtaaattcaataaaaagcaaactaatgtgacataaacatatttatgtgattagaaaatcattatatccactttaagtgaaaagaaaaagtcttcatttttgtgttacttttccaaacctccttttggcactgaattgtactttatgggggtgtcttgtcatttttttctaaattaactacacctctgcttgcctggaaactagagccattctgacttctattccgatatgtgtttttcatctcctactttttttttttttgagacagtcttgctctgtcgcccaggctggagtgcagtggcacaatctcggctcactgcaacctccacctcccgggttccagcgattctcctgcctcagcctcccaagtagctgggactacaggcacgtgccaccacgccccactaatttttgtattttttaatagagatggggtttcaccatattggccaggctggtctcgaactcctgaccttgtgatccaccctccttggcctcccaaagtgctgggattacaggtgtgagccaccatgcctggccttcatcttctactttttttatttttaaatattttttattcactattgctgacatcactctcctacctactcggtattctttcattatgagaatctcccacatgaaaaatagtggcacctctggaactcccaaattctagtttagacagattaatccacatttatgttactatttataacagcacaactctgtaaataaatccaaatgtccatgatttattggttacatgttatgatattctgtagaatggatattattgtagccaaaaaattaatttacataggtacacagatgatgacatggtaagctttctttaattagaaaatgtttctttcatttaatatctttcatcttaagatcaaaaacaatcttgcaatattgaccttacagcactgttcttctgttatcctcattaaaataatatcaataacaatatagtaataatggccattgttgttgttatgttctctgaggcatttagctcagagaatgttgagaaaaaaacctgacaaagtacttaaatattcttgatgccatctctctcactcttcataggttgtggatataaagaactctgtttttttcattttttataagccacaaacaatgaagtaatcatttctttgttaaaacaagaatgtgcagattattctcactgaaaagttaaaattgagttgtatttaagaataagcatctagtcttgaccatagtgtttatgcctataattaaaacaaaccaaagccaaaaacatatctttcaaatggtttggtgtcacaccacaaagcgagttattttaaagccattggaggattctagcaactgagcaaataccgctgatctagtcaatatcaattgataatgtattatatgaaggaaagtaaaatctctttcaaaactttatacatgtttcaattcagttaattatgtaataatagaaatggcactatcatataagagggtagatgatataatttatagatcattttatcacttaaagcacctctaagtgtagaaatagaatcatagaacctcatattcaaaagcctttctgtttatctatagtggaatcgattaaatcatatttgtgtaataaatgacagtcataacaaatacagtaattaaaatacagttgttttacaaatcactgtcttccactctttccacttccagcattttcttttgatgggttagaagattaaatagcaagttgtaattttaagttatggctctttgacagtggaaaatggattaaaaaaacacacaacaacctactaagtcttgtagtttcttccatgtggtcttttcttatctagagatagtaagtcaggcatctacaggaaaagaatccactctagtgaattcgtgcctgcctttgaactgtgaaaatcctttgcattgccccacatttctaaagacccatgaattgtgcggtcagctagaaatatcctgtttcaaaattgagattacgtgacactgccctagaatgacacttgagctgaatgctcttgtccactgctgtagggtacacatgaaaccttttacttagaaatttaaggttcttcatgtggctggaaaaatgccacaacatgacttttatcaggctaaaatttactgtgtcatgacgaaaattgaataaagtaatcttgactcattttaatttatttcacctatgtctgactccagctttatcctaatatacaggacaaaagttatttccataggagcatctattatttgcctctatttctaaccctgtacaggtatgttagaaacactgaacataattttatatatgtctttgtctcatcaatacagtgcagttttattttttaactgaagaattcgtgttttgacatataaggggttaccagagctatccaattttattttatgaaacaaaattgtaattattcaaagtccaagacatgaacagaaaataaaaagtaatgtttaattcatgtaagaaagcataactgaagctcattagtcaaactaaaaagctcatgaaatttctcacctgaatctttcctcaccctgggcagagacttcctttcaatttgtgctcaattttaggcaacatttaaggatctgaataggcaaagagtgagagcaatgattgtaaatgtgttgttttaaaaggtttctccactaaattcgtatatgacaactgaaaaaaaccttgggacaatgtcattcagaccacaggaaagtgcttgaatatgttctctgatgctctttttagagcagctgatataaaaagcaaagaattttatgtccaaaagacttaggcaaaatatccgaacggaatgctgaatgcatggcttttcaatttatcacagtttatagacactttacatctatagtagtaatttaatttaatttcttagaattatggaaagaacaaatggtatcatttagtataaatggttctctgctcccctcacctccggagttttaaagatggtaaaactaggactcagagatgtgaagtggctcacccttgatcacacaaggagacagtgatatattttggttgagcccaagtctccttctgaatctagagctatagctgttaaactaaggtacttctcaatcatatccatggagcaaggatgtgagagtagttggcttttgtattatatgggataccactgcaaaaaagtaagcatgacagtttcaccttaggggtgaatttcatgctttgcaccagttcaatacaatgatgagagaatggctctcatggtactgaattggacactgtacaaattcatggtgttattcatattactggccataaaaagagcaagatcacatttatatatgttctggtgaaaattactctccagtgtttctgctgtcacctacccaaaccaagctgtatatttttttcttgagaattttgcatccatactgtttcttgtttggtttgcactgacgaagaacattcttcctccacagcacagatctagttatttgcaaaagatatttttaaaattataagcaaatgttgatttagactccttacacattaattaagagaagcacttttgtggatgttctttggcttagttcaagactttgtcaatctgacttttcattaagactttatttattattttccccaaaaagtacttgttgctcagatttgaataagagtagtttacttgtctacagataaaaacaccttggctgtattcaaagagtaaaatatttaattcaaattttaggctatctgaattttatcctttctgcttagaaatgataaacaaatatttattcttttattgagcaacagctatattccagaactgttttaaatgcttgagattggggaatagagataagtgatactagcttggtatgcacgtatatgggtgaccagggggattgttaggaagaggaagaaagagaactattacaaacacgcatttataaggcagcttttaatcatcaataaaatatggtaaaatatgttagtttattaattatttgattaaacacatacttttttgtatgtgaaatactcaagttaatttgtcttgtttatttggccttgcttgaatttactaagtaaacagaaatttctagccattctcaattcaaatgaccacaaattgagagaatcaggaacacttagatacttagccaacacttttcactaacttatttaggatatatgcctgagatcatgacaataataataatcatggtaaaagtagcaattattgttattttaatagtcataacagatgagtgttgccatggagtcagtatcacaacacagccaagtccatctgcctcattttgatgttttagtggccacctaactgataccgtctggtgacactcaggtcagtgactcccgctttttctaagggatggcctcagtggtttggggaaggtgccaaggaaagctaactggggacttgctcctgataagtcagtgatcatggaccacaacaggtggccatgaccccaggggggctttgcacacttggaaaggtggagttgtgcaacattttgctgtctggctgccaccttcagtggcagatctattgccacttgggttgtctttctcataattatgttccgtatttctcaatatgacagaagtttgttaacctagttttagttctaactctgccatttactgctcatgtgacccttggcaatctgtttaaattttagcattttcatgtttttcccacctataaaattaatatacttttctcaggttagctgtgaaggttaaatgagatgatatatgtgaataggattttgtaaactttaacaacggctgacacttactcaatattggctatggttttatcagataggcatggattgagttatgcagcttctctgttctcaccttgtccttggtgcctggggaatgtctagtattcgtagtcagtgcagtcatcccagttcctgcaacgtggtactgataggaggaacaacaatcaacatttaagttttgtctaacttgcctaagtttcttccatttacagtaagtgatgagaaatggggtataagtgtgagatttatgtcactattcaagtggggatggttaagtcaattaatattaagtaatattatttaaattaattattgtctccttgactctaatgtaggaatacattatataaaaagtaaagattttgtcatctcatcatccacagtgttttgcatgtgctaggttcttagaaaatacttttttaatgattggcttttgtgtttacctcaagagtatagagagagactgaaaaatatgtaaaattatgataatcctgaagtttaaggttcatgaatcaaattttcctcttcaaacaggtgaataattttgaaatttattagtaaatatttaagttgactctttcccaaatactgcctaacttcttttcttctataattaagtcagataattttaggaaattggacaatttagtcatctttctatagcatgtacactacagatgactattaaattatgattccttcagaatctttattttacaagaatataattaagcttggctcagtggctcatgcctgtaatcccagcactttgggaagctgagcggggtggatcacttgagctcaggagtttgagaccagcctgagcaacatggggagatcctgtctctacaaaatatacaaaaaattagccaggcatggtggcacattcctgtagtcccagctacttgggaggctgagataggagaatcacttgaacctgggagacgaggttgcactgagctgagatcatgccactgcactccagcctgggtgacagagccagaccctgtctcaaaaaaaaagaaaaaaattattcaatcatttatattttctggaattttttctaaaatttctcccagatactttaaaaatactcctgcaaacaatttccacttgcctagcaggccattcagaccacagaactaaaagcaaaatttatcagcctttccttccaatttgccatacccccacaaatcgcacttataaagtcaagagtaagcacatttctaacaaggaccaaaacttttttctcaccaatgacactttcctatatcaagtgtacctaatcaggcctatcattaagaaacacaacctttgctgtcctctgctatatcacatcatcttttcaattcagattctatttacaaaaatcctctaaactcattggtttttctacaatggtttttgatcacattatattactgacaaatgctatttttatctcctatatgggtgaatcatgcatattaactctttcctgggatgatggacataaaaaatctcctttagagatttaattacatttaaattattttcaagtcaagtagagtataaattcacattttacaacagcccatcatagaagtctcactggatttgttttctttccgctaatgtcccaggtcacctatctgaaataagctacttaaaaaggacagggtggggagatggcagagaactgtgctgcaggtttgggaagcaaagaaacaaataataatgtaaatgtcatctgtgatctaagattgctatcagtatcagatattttggcttttggtcctctagcctacctaacatagacttttttttttctattcaaaaaaatattacacttgtaggaaatgactagtgttgactttctcactctgagtccaattacgggttctttaaactgctcatcgctagtattatatgatggtcagctttaatgagtgctcagaagcactctcattatatacaaggcttttgaaataagctcctgtctcgatcaattgcttcaccttcttcagagcaattagcataagaataaaggaggttaaattggacttccgggctttggtgaaattaattaataccacttcaccggtaaggacaataagtagataaccattttcattactttatgtgaaagacagattatcacatgcacagcacccagactagtacaaaagtaacccatgctgaatgtgctatcttttaagtccatgtattatgaaagatttttttcctgtaattttaatagctcaaaaaaagttttaatttattggtgacgagctgggtaaaggttggccattacatactggcaactgcttgggtaggatgtaagttgaaaaatataagaaaaagaatggcattaaaaaaaaagtagcctgactgggtgctgtgcacttgtagttccagctactcactaggaggctgaggtgggaggatcgcttgagtccaggagttcgagtccagcctggaaaatatagcaagacatcaccccaaaataaaataaaaggaaaaaggaaatatctgtactcagatataataagctatctattctagacaaatgactgattagtattttcatgctcattcttgtacataaaaggtaaagtgtcctataaccatcatattttttggaattccagagcataatgccagcgatttaactgtatggatagtagttaaatccttaacaatatatagtacatgttcattttctaaatagtagttttaatgttataaatgaaatgcagcttttgcaaattgaaaatcatgataatagaagtctgtaccctccctttatggcccattaactatctttgcatcataatatagttatctttctcaaaaaaattaagcatttagctctctcaaagatgctgtcacttttttaccctaatacgtaacaaagttgaatggactcctttcctccactgttgtataaatttaatctacattacaagataccacactactattcaagatctatttgagtgtttaggcatttcttaccaaaataatctgatacctactttttaaagaagtcaactggtcatgtcagtgaaaatggcttaattttggcatatagttagtaaaggctaaattgcaagtccaatctatttttctgatcttatgtgttcacctgaaagcaaaataatgagttcagatattcttgcatggaaacatactcattgtgatcagaatgaaggaagttattgctaatgcacttacaaatatgtttatccctgcgagctaatgtgtctcaattcctgaaagtcattattaccttgctcctttctagtattttaaaagatgaaaaagtgataaatttcaaaataataaaacatcattatttttgacattgaggatgtcattttgtaaattaacctatgacatttttactttttggttaatccttcagatttactcttcattgcttttaactatgaattaaagtaatgagttgaattaggtaaatgtctaacataattaccatgtcctcagtaaaagatgattgttaatgtgtctgatgatggctggttgactagaaattatcttcagttccacattttcaaaatgaatgcaccgtgggtggaatggaaaataataatttaaggcacattaaccattaatatagatctagggtgaccaattgcccctgtttgcccaggacagggaactttgggttttaaaactgataccaaggggtacctgggatgctgaatgttcagtgctaaaaccaggaaagtccaggcaagtgctgagtggatcaggctacatagattactgcacaattaattatagtaaattgattctgtatgcaacttaaataaacccagtttattgaggcatgatccagtttgcccgtgtgagaacctgatttctgtgaacatggagatttagccataggtggctgaaggagagacataatatagatgatgatgttaatgatagcaatggtaaccatttattgatgacaggactggacttttttaagacttagccaaagataacattctctgaaatctttcttgatatccttaccctacccagaattttctgattcttcctttttactcccaatgtaacctgtgccgaagtttattataatgcccttaaacttccttatttgtttatttgtcttcctctgctagaatataagcttctttaggaggatagaggcattatgttatttatctttgtaccccaagcatccagtatatttagtgaatgaatgaatgacctaggtatttttttttactcttcaaagtaatacaataaaatacatgataccatcctgttttactgatgagaaacaagtatctaagatgttctgtaacaagcataagaatacgttaataaattatgaagccaaagatggaaaatcagatctgtctgattgcaaagccagttctctttccattactctgtattaaataatgctggccaaacatagtgacttggaggaccctctcctttcagtaagagagtaggaatcagatatacaaatgaagactatgtcagtcttattatggatactgatgaaagttttctggtaatctgcaaaatagattttatagataattgctgtggaaaagaagtgactaaatgtaaaatataatctctgctggtatgtttagaccaggaaatcaaaatgcatgacctagtcagacaaagcaaaaggttctttacgtgttcttcttgtatcatcagtgagcctttttcatttaagtacaatgaagtgtctctgccttaagaaattcttcagaggcagaaattcattattctttattaactcactgtgcccttctccttcttctgcaccttttcctgtgtattgtctcccattttaaaatgtattaactgagaactaaagatagcaaagtgttgtcaatattataaagtatagtaagacagcatagaactacatggagaatatattgataacagcatcttttacacagtgatgaattaataattaaaccaaacaaaaccaaacaacaaaacagttttacagctacttgggaaatatctgtaaacaaagtttcataataattaactcttggaatatcgtcacttgtacaaatgctgcaattctagcaagtttgggacacttacaggaaactgtctgcaaataaacatgtataatgattttagtgtatatgacatgaaacagacggcgacccatttattaaggtccattacacagatataggagggactttaaaggcatcacaaaatacttgccaggaagtaaatgttgactatttccaaatctcagtgcaaaatgagatagataacgttaacatgcacatggagtaatacattctttaagtacctattcagtgaggacctgctatgtgcaaggcacgtattccagatatatattaatgaaaattgtgatcagttaaaaataaatgttactattttcattgatctcattttctattttcaataaatcaattacaggtaaaatgtgttatgagtgacaaaatgactggaaagtttttgccttaatcaaaatttgtgtaattattttttgtaggtaatcaggtgatttagaagcttaggaaattatgatgctatttttatagttattatgctattattatgatgaatcacccattcatgtgcattaagcagcattgattaatatttagattttcagcgttttaagtgtctgtaccttatttacatattattaaaaagtcaccttggttgtaatcatctgtcttcccatgatcacaatacaggtttgtggttttcaatatgtcatgactaagaagagattttatggtgcttaaatatgtagtaaattcattaaaccttagtcatgagtaaaatgatccctgtaataccactagttgcataatacctgcttctgatgcctgcttttaatttttctaaatacattggctggtttctagaagataaatgtaatattctacagagctatagactgttttgccacttggaatatctcgaacagttgtcatgggcaaggccgcaggtgctatatcccaagtgtatactgcttttatttttacatgtacaaaatattagaataataaatatatggtaaggcttctagaaatgaaaactgttgtcaatctgtaatttatagaaaatttatgtaagaaaacttatgttgtcttttaagcaattctcctgcataataacttagtttagagtaagaaatatgcatcttatctaaactgatttatagaccacatgctatttttacaaatatttaagaaaattcctagataaactttggaaccaaaaacaatgtagcctaataacaatgtcaactatacttacagtataattttatatataaccttttatctttataataataaatactatcacagccatttagagaaggcaattttagtttacctctattgcttaaaggctttagctattatttatgcacaacaagaattctgactttttaaaattagttttaaaattttggatcagctttataaagaaacacattgttgttaagtgcagacaaatgagaaccttgccatttctgcatttatgaccagaagccaacagagtcaattttcatgtttatttattctttgctttagaatgttatgtcagttgacagtattcagggcttgtgttgatgtaaattgccataaagcaaggaaacacgggctatagtactgtcagggaggctcagcactgcagaacaacacaatttaagaaaagcatttgcagaaagattcagtgtcagtcttcggaaattgactgtagatgcaaattggcatcaactacttcacaatctccctctaacaaaagagatggaaagggtggaatcaccaaacagagtgcacttttcggcatagtagctttcatgaagacaaaaataggatcccatttgttcattcacaatggatattcagactccacattctgccacccccatgttttattggagcctgcaattctgccaggagaagggttgcctcatgctaattcatcctaatgtttctcctccttcctacataggggaagtcttccaacccttcctactttttaagattagaagaaaagattcctcttaagccaaccatctctttggttacctttctgtaatgcctttatactgatgaaatgctgttatgttttacctaagttcggatattgtcattgtctcctgctgactcaacatgcattgtagccaggatcctggtctaaattcctgttatacaaaaccctgagctcttctaatttgcttcttgaaaaaaaaaaaaaaaaagaaaatctggccaggcacagtgggtcatgcctgtgatgccagcactctgggaggctgagatgggtggatcacttgaggccaggagttcaaaaccagcctggccaacatggtgaaaccccaccgctactataaatacaaaaaaactagccaggtatattggtgcacgtctgtgatcccagctactccgggaggcggaggttgcagtgagcagagatcatgacactgcactccagcctgaacaatacagcgagactttatctcaaagaaaaaaatagtcagctctagaattcttagggcatagaggcaatgttaacaaatcagaaggtacattaccattttaaaaaattttgtcaggcttatactcagatctctttaaacattacctacatttaaagaattattgtatgtaagagataaacacacaggaaaaaatatttgatttttgcttttgacctgtgtcattaaaataagatgattctccttatttctcaagaggcattccaattttaaatagagtggtagggaaaaaagtgattttagcagggatttacctgttcgtttgtactggtaagttatttttgtgttgataaattatttacactttaatggaattgaggtgtcatcatcttccatttatattattttgccttcctttttcacaaattttttactattaagaaagctacaagaggtgttatttgaggaaacagtcctataatatcattctttttttaaaattgacagtttcctcaaatatttatgggggaacctttctacttctcaaatttgaacagacaactttagtcaatgcttagcattgattttttgacaactcatgtccatttcaacattttattgtgagatagctaggaaattagttgtaagagcagaaaggtaattaggtaggtggtataaaatttttgacagttttgacactactgatattttcaggaaaaaaaacgcatacatatcctagtttagagtaagtctagctgaaaatttaaatatatttttaactgaacataatttttgagtttgagataattttagatatacatatagttgtaggaaataatacagagagaacccctgtaccctttgtccattttccccaatggtaacattctgcaaaaccatggaacagtatcacaagcaagatattgaccttgattcagtcaacatacggaatattttcatcagcgcaggaatgtgactattaaaaaaaatttaaatttttgaggattattctacctccaaattctttagtactaaatattcttacatctagacaaactaaaataggatttataggaaaaatgatttgactagagagtcaatatgcctgaattcatatctcagctctgccaccatcactggtttaattacatttggggagtcacagcgtggtggggcctcaatttattcttttggagggacttagtctaaatcagtgattgtcaactagaatgaaagtgagggaactcctcccttggagacttgtcagaatcttggaggagacgttttgcagacaaagcccaactcttttccctccacactcctacctccaccaccatcacaagcaaattctgatgtttgttcctagacttctaagattttgactccctcatcttccattgaggattgcttatggaaacaacgtaatagattcctagcaaatcttcatgtatagtgtgtcagcaactagtctcaagtgtctaacgttcttttcaactttaaaataataataagaaaaaatatctaccaagaacactaaaaatctttgtgcttcacaccatctagctgatgacgcataagagtagaggaaaatgtggtcaatacatgagccaaattcagagtggtgcatgcagaaggcttcctccaacagggatttgagagaaaggagatctgaggaaatccagttccactagggaatgatcccacagaaatggaatcttccagcttgagaacctgaagaaagtgactcacactacatgagaatttgaccctatctgatgctactttcaaacatatttgagtatttatagtttctaatttttggaatacgtagctttctctataattttgataccctatctccagaaaagatttattataaagttagagcacaaagaaagaaagatacagttgtgtttttatcattacaattgctgccttaagcatttctttctgtggtctagtctaagttattaaacctcattagttttttacttctggttagtgctgtctccttgattgtggcaaatgcaagttaccaatatgactctttgctacttctttccataagaagacaaaatatatggcaaaaagagaaaaaaactctaggattccaaattataagcactactcatattgaaagttagaaaaagaaaatgagcctgaactgaaaatcaaacaaaaagacgagaaaaggaaatggaaataaagtttccctgtatcccattagggttgatacattaaagaaagagtgaggatagctggaaataatattttccttcaaatgacagctaaatgagatctttggagctgtgccacaatgagtgaagtcagggagacagggccggtagtgacaggaggagaaaagtgcttcttcatgtgtcagccctgggtttaaaataactcagaaggtataaaagaaattccctcctcagatacaagattatttgtgggacacctgattaccatttaagagatatcaacagttaaaggaaggtgatttaaatctggatagctcccttttaaatccagccctctgattctataaggcaaatgacaaggctgtctagacatggagtacattgagcaaggtttagatgagggagccccggagactgtgagacagacctgttctgtgcctgagaatgtcagtgatgactcacaggaggtggagaaaagtgtgctcaatgtatgggccaggctcagggagctccttgaagacagatcatttggtattaatgatacagcgataccacaaagcacaggaggtgtagcctgctagcattgaagttaggaactgatttgaattaacccagtgtttgaatctggatgcaagagcctgtatggtatcttgcatgctaacttcttcataatcttgttcctgaatgggtgccagattgaggagtctttgggatagttgatatttcttttaaaaagcctgatctatataaagctgtatcaaccacgtgcaaccactttagcataccactctatattaatagaatagaaaagataattagcagagaaaaagagccaaggaaagctaccaagaattagtgaaatataaaatgtgttcttattatcccttcctcaataaaggggcaaacaaggttgttctggtatcatctgtgggaattttacacaaactattttaggaggaaggtgggtgactagatgatggatggatggatagctgatggatggatggtggctgaagtgggtatgtgcattgaaagaaactgcaacagagcactatcttctgaagtcacttgaagttatcccaaaggtcaggggaagaaaagggaaaaccagaaaccacatatgaaattagcaaagctgagcccgagtctgaacgcactgtgaggaggaagcaccattagggaggtgatccattgccagtggaaagccagaagctcagaaccattagctgagaccgtgctcctcccaggcagggaccctctagttgcctggggagatgatctgaattcacataggaatggtcgttgcctcttccatgaggatcatgagaacatcactaggtccaaaccacaagctgttcttgtaaaagatagagtaaatggttacatcaaatataatcataactgtagtcaacctgcagctcagagatatgtaagagtacaagtaaagctctttatccacgtgctgaacatttttattaaaatgtgtgaatgaaaaactattttaaaaaatagaccaggcatgatggctgatgcctataatcccagcattttcagaggccaaggtgggaagactgcttgagatcaggagttcaaatccacccccatgagctagtcacctcccaccaggtcccacctccaacaatggggattacaattcaacatgagatttgggtatggacaaatatccaaactatatcaggtggttactgtagagaaggggagaaatgaactcccttaacgttccagctagatcttacagaagaaaataggaattagttttgatggtatacagaaaggaaaaccatgtgaaaacaaggcataaggctaccaatatgtttaatgagaataaaaggaagaaagaataagtgactaacatacgtacgaaacatgcagctcttagatccatgttccttcagtgctctttatacttttcatggcttttcccacgtaagccgctcaactcacctaaacttctgtgccccataaccagtttccattaattgacattataaccatctttcaaagcatggagcagatacggccctttttcccagctacgaggatttgtcaaaagcagctttttaaaatggttatcttcgaatgtgcctaatttttcttatcacactgtaaactttttaagtcaaaaatcttatgatcaaatcatcattaccatttattacttttcatcttcacctgtctgcctcccctctgctcaaccccagcccctcatgcagtacgtgcacaataaatatttgttgaattatgaatgaatacctaatattgacatgcaaggagtttcatgcctcagttaaaactcccagaaaatctttttccagtccccagttagagccagtgtaataacagtgactttttttcaacaattacttaaataacattattaaagcaattgttgctttaggttgttcattaataaaaataaatgtatattttctttactgttagaacagtttgattctgtatgaattcctattcctgattttattatactcctgaaaccacagcttgctgctggttcatctattaggcatttgaaatgttgaattactttgaattgcatttgttcttatattgcctaggctctggttggcctcctagggtcgtcacaccataatcttaaacacaacatgtgccttgtggcccagatgttttccaagagggagtgctgcagccaagaaaagcaagatagtatcttgaatacccaaaggggttgatatgactaaaaagcaaccgtacagccaactgtagagctgtccaagaaaaagtgagcctattatttgtatagtttaggtttttgtgatcaaatagtaaaatttgcaaaagtttcatgataagatcttttgcttcacagattctcgtaatatctgcttttgtagtgtggactccagtgttcagcagtttgtagataaaactgggatcgtggcaacaataagagaaatcaaaaaaaaaaaaaggaagagttcatggactcttgtttcttcataaatgtgacatgataaaaattacctttctttcttaatatttgaaaataacataaagaatgaacaaagattgcttctagaactaaacttggattgaggcaacttaataaacggctgtttgttgttgtttctgttcttttcttctgacaatatttaccttttatattcttgtggagagctgagatacctgcaattgtgcttttaaaaaattgttctgtcttcttgcagtgaggtctcttttttggcttacttattaacaaagaagcaaattacatatatacatatactttatgtaacatgtatacacatatgtatatgtaacaatgtaatgctatgtgtatacatatatgtatgtgtaatatacatatacatatttatacatatgaaatataaatatctatatttttatttcatttacctactagctgattcacatcgttttcataaccaaaatatagctcatggcttgagtatgaaaccctgacaaagtatggaatttcacatacatgtcatgataatgtcctagtcagattcagtcctacctcttgcttctgaaaatgtgctagcttctgttctaatcctaattgcatgaattagttcattgtccagtttagaagagaggaacgagtaggaagctgctttggttctggggtcaatctaggacttcaggtctattttagggaaagcattctagaatgtccttgcccttcctgatacactttgatataccttcaactttgagatcattgacttagtgttatcttgaatgagggggtccaatagagccagctactccatgctgatttagatctcaatgcttttgaaattcaagtttttaaagcacttgactctctgttttctccaaatgaaatcctattttgtatttaaaacagtaagaccagatttccccttttgaagtaattataggatcccaagaacccttaattccactggtcccatggtctacttatccccccgccccccacagcaagtcccttacccctgaggcagcttcagcgactcctccactcacccagcactgtaggaaaatgtctgctgtgctccagccagagcagacctactgtattgcaaatttatcgtggctggaccatcctccagagatgtatgccataaggacaatggaggcctcagctaagtacctcctgctgcattcattcccagggtagtaggtggtatagctgcaagacacggaacccagtattaggccttgctccattttctctaggcttcaaagctctgagccagtgatagtttataaaagcccaggactccaaagaattaaaatcagcacctgtagatctcctggtgaagataaactccatgggcatgtaaagaaagcaataaagatacacacatagtttttttttttcttttgaatatcaacagtaaccttgagcagagtgactctttatcagggctcttggtacttaggctgagctggtgatcacaaaggaaagaattagaaatttaaggtgattttattttattttatatttttagtaggagtatctggctgctatctaaggaatctcttctattagttacatggaaacttggagattttattgtttccctctcagtgtgtgtgtgtgtgtgtgtgtgtgtgtgtgtgtgtgtgtgttagccatttattaatcctaactcccccaagaaaagacaatctataaatttcattttcactcacattaaaaggtgagatgcaggctgggtgctgtggatcacacctgtaaacctagcactttgtgttgacttagtgttatcttgaatgagggtggacagatcatgaggtcaggagttcgagaccagcctggccaaatggtgaaaccctgtctctagtgaaaatacaaaaaattagctggacatggtggcgggcgcctgtgatcccagctacttgggaggcaggagaatctcttgaaccaggaatgggaggttgcagtgagccgagattctgccactgcactccagcctgggcaacagtgccagactccgtctcaaaaaacaaaacaaacaaacaaaaataggtgagatgccaattctcttcctgactctgcactccagtgcagtgctccatttcccctattgataataccaccccaaacatacctatttttccaggaccacatttcttcaaattgcactagtcatgctgttaagaaacacagaatctaaaaatgatctgagaaaaagagaattgcaattacaaccacaaaattttctatatactagtgaatggataaagatatttattgtgacacattgagcaatttttttgaaagttcatgtactcttgctcaactgattgaaactttgggaaaatgtaactttttgagttgtaagatcatgtaaaagttaaatgaaggaagaacagcaaagaagttatgggaattgttgttgtgattaagtagttaaatttgtatatttttttcctgctgattagggagttgttactgaaatacgttagcaggatccttcttttagcttttcacatgaatatttgggttgctttctgccttgataattaaaagagaattgtgtatatcttgttttccctaaagaaaggtgatactgactttatcatgtcatcataatcttcacagctagtagtgaaatacctttattgaacatccaccatatatataagactgttctaatctaaactcaataaacctttaaggtctatttcttattcttcttactttatttccataacttaattagccttcaaagcccaattctaatatgcataatgacttgaagtattttccaaatacaatcagtgatttttttgtgtgtgctaagtgttctcaggacagggtcaaaactacctattacatacattcaccatgagaatttagcacagttggcctctggcaacagactcaaagatttattctgtgtagctattttctagcctgctggattccagccagttgcctaatggatcatgagtgagtcagtttcattcagtctcttagcaaagtcaatttgtccagcagcacacaattttctgtcatgtagggtctttgcctggcattgctgtgacaaacacaatctaactgttttgcttccctagattccaactgagctttggccctggaaggctggcttagataatcaaagtcccctctaaggagggaaagatggtataatgaaggcttcctggaaaaattagaccctacaatttacccatctccaaaagtgggtcatggaacaaaaatatccatgtattaagttagattaatatttgtgtgtgcaatgaacaacagcatttgccttttgattacttcgggcccaaatgagctttctcttttaagtagcagaaaaataacaaaagcagagtacacctggaagggacagaatagtcacaggccagtgttgtaagagtcagtgtggcacttctgaaggaaatctgccgagtgcatgggatactagagcaccatgatgggcaggaggagaaacaccctctttctctaccttccttctctaccgccactccttcgagatggccaagtatggaatttctctgtcaggggtcctgccacctgacatgtgcaggtccagttaggtagttgaaaaggacacattactacacttatcagggttctcactacaaacaaattttcatagtccttctggaaataagccacatcaccgaatgcctttccggtagctgacatgattgattgtggacaacgaagaagtcacttattcctaaggaagagactggagtgagggttgctgtttgcacatacataaaatcctagaagagataccaaagctacattatgcagaaagattattattttagccagtggctctgaggacaacctcatttgtcttctctatgggtcactctttttttttttttttttcttttgagacagagtctcgctctgtcacccaggctggagtgcagtggcacaatctcggcgcactgcaacctccgccttctgggttcacgccattctcctgcgtcagcctcccaagtagctgggactacaggtgcctgccaccacactggctaattttttctatttttagtacagatgaggtttcacatgttagccaggatggtcttgatctcctgaccttgtgatccgcccacctcggcctcccaaagtgctgggattacaggcgtgagccaccacacccggccaggtcactcattttttaagtgaatattttcatttccaaaaaaaaaaaaaaaagcctcatgtttccaaagtggcataaaaggccctggcatgtagagtgtagaacagaggctcctcctttttagccagtctctatttcagaaatcattagatagaacatacttggtctgaaaaaaaactatgaaattttgatcccccttggagaaaatgtactttaatgtgtatattagttttcatttccttcctctgatacagtaaagtcaaaattttgcgaaccattgtgaaataaggagatatgaccccataaacacaaacaattttcgttcccttgttcctacatatgtttgttaggagtacataaaagacaagttagctctatagaccctctaattttgagaaagagaagcacagcattttcctctttgattctgttttgaaagagtgcacataatgatgcatacctcatgcttgtctgccttcccctggactttaatttcttcctgtccagccaaaggagaaggtttttggcttggtttcagctgtgcttccatagctgctacacatcaaacctatcctaccaggtagagactagtgtattcttttcactgagggtagatggtcttctaactttaatcttccattctgcctgtcacgtctagaatctatctggttaaaactcacgttttaaaaatgcatgtcctaaattgtatccaacacttgttagtatcaattattatcataatttaaagcctagattgcagatgttcatcgtaatactttgccaatattcttatgactgtttcttttttcccatagataagtgttccaatttaagtgtgttttcctttccagaatgttctgtatgtaactcttctgacatttcagagattgtgttattactaatatttagtctcgtgaggtgcttcattttttaaagtattctttattgtgttttttcttcatgacccatcatggtgctcgatcagttccttgttttttcttttgagcatgactaataataataaagtctgagctctggtctcatatcacatattttaattgtataaaacaactatgaagacccacactgacaagatcctgagcctaaataaaattaggtcatgtctaaaagatattgtcctttgaattaagcagaacgtgtgggtgtgtgcacatgtgtgagagagagggagagtttgctcacacacagccttgacactgataatattttcccagacagcttctactcagtgactttgtagtaaaatcaaaggagctttagtgtgtactcattttacagattagaatagtagagcccagagagagtaagttatttgcctgaaatcccacagcgagggtccacgggagctaggactctggctttcaggaccctccttgttcagtcctctttactttgagtcaactctgacgggacctggcatggtgccctgcaattactgatgatgcgaaaggtgagagcggatgaaattttagcacactgatcaatcttgagatactaaaatataccagcaaagttgtgaactcgaaaattactaaacaggctgggcatggtggctcatgcctgtaatctcagcactttgggaggtcgaggaatgagattgcttgagcccaggagtttgagatcatcctaggcaacaagaacaacaacaaaaaacaattagttggggatggtggcgcatatctgtaatcccagctactgaggaggctgaggcagaagaatcgcttggacctgggagttcaaggctgcagtgagctatgatggtgccactgcactccagcatgggtgacagagtgagaccctctctcagaaaaaagaaggaaagaaagagagagagggtgagagagagagagaggaaggaaggaaggagaaaagaaaagaaaagaaaaaaagaaaaagactgaacaaaacttgagaaaagcaatgtacccttatcacagttttatgggaaagtacacaaatgagtaaaatgcaaaataatggcattttctgtactgagaacagagataccacagagcaatcgaggaagaattagttatactgttctctgttggattacaaagcagaattctgaaaagcacacgttgtttgacacgcagtgtgaagttgcttgacgttcactgtgatgttggctgggacactgtgccgggtatgtgtgggtctacagattcatcaaatggcacatggtcagaacgaccttctttttgctaatgtcattaagtgccatctattaaaaatcaggtgcttacaaatgagagtatttaaagaatcagagggagcaaggtattatgtgtccccttgttatcaaactatattatccaaataaggatatgatataatcaagccaattctaaacagtccaaaggcaaaacaaaagaatgtgcccagtgctttcagccagtgtctggatgctaaaaatcagactgactagtcaatgaaagcgaccacaaaattagatgattttgacccaaaagaatgccttggcctcccttcccagagtgtttgccagttttccatgtctgctcttcccctcttcacccccagccccaggtggaaatgaagatggttttccattttgttttgaagagagagcttcatgtcactgatctataatgtgaaggaaaatatcttcatcaaaaccaacattcttaggaatacatagaaaataaaaagactactcatgtcttagaaaagttttcccaaaagttggatcatgttggataatgttatgatccttttcactttcaaagttccctagttcccttagagaggggaaaattatattactggtagaaatcaacatttccttttctttagtgaaaaaaataacacagcactctttaattgaaacctgtgtatctttgccctccccactttctgcctttgctttttcattcacatttaactcctgcagcaacaataacctctgggctgttctgcattagagagaactcaagagccctggaaattataatttcagaagtattgataatattaaacaacatcaaaaatttttaccacttttgcctgcccttcttacttttttcacaagttaattgaagatggaaggcagtaaagcctcgtgattctttttcaaaaaggttaaaatacaatataatctatcttttttttttttttttttttttgacacagagtcgtgctcttgttgcccaggctggagtgcaatggcgcaatcttgactcactacaacctccgcctcccaggctcaagcaattctcctgcctcagcctccaagtagctgggattacaggcgtgcgccaccgcacccagctaagttttgtgtttttagtagagacggggttttaccctgttgccaaggctgatctcaaaactcttgacatcaggtgatccacccacctcgacttcccaaagtgctgggattacaggcgtgagccaccgcgcctggccaaagtaatctatctttaaagatggtctgctatccttaattgtgtatttggtataggttaatagagtgaaagtcctgtaagctataggattagatggacgttgcctgcaattcaattccatctgtagagcagatttcattgtcacattaaacattagaacttaagaaacaagttcttcagagaagtggattgagaaagattgaagtagtattgtgtgagctgagcttgagtcagctattctgttggagaatccctaggttacatcagagaagatagccgtgggctagtcacctctatgagctttgtcatggctataattttcatcaccagtcagtccttcaaatagatatttcttagagatgcatgggtaattagagaaactctcaattcagttattaaatttttcctactcatatccagagttaactgctcatttttagcttgaacaaattagaggattgcttagtgctgaatacttgtctctttgttctataagcttgacagagctttcttattgcctatatgataatgttggaccatcttcaagtgtctacagtctttcctggggctggtatggtgctccagcataaatgcataaatgtgtaatgcagtggaatttcaactcagtgataaaattctctaaaagagagaactaattaattttagagccagaaagaggcctatatccaacctatttatgtatgtgctagagctggttactacagagcaaattagagaccaataaaaagacatggtgatcacttcaaattgaactgtcttaacagaaataaattgcagaagcagataagattttcacaaatcagtgcagtatggccctgttactttttatagcatctggattatggcttagacttattaagaattagaaaaacaaatttcagtgccatcactgatacctcaatataatatgggacaagctgttagacatcaatatgctgaaaaatggccaggcatggtggttcacgcctgtaatcccagcactttgggaggccaaggcaggcagatcacgaggtcaagagatcgtgaccatcctggccaacatggtgaaatctcatctctactaaaaatacaaaaattagctgagcatggtggcacatgcctgtagtcccagctactcgggaggctgaggcaggagaatcacttgaacccaggaggcagaggttgcagtgagccgagattgcaccaatgccctccagcctgatgacagcgagactccatctcaaaaaaaaaaaaaatatatgaaaaggtaacagcaattttcagtgagtaagcatataagtaaaggataaggagagaattgcctcttttctgtcgcattcaaggaacagctggaaaatggaagaaacatagaaggagagaaacatcaagaaatacgtattagtcattccactgtaggaaaagttcattacaggagagtcatgcaggcagacagggtcttcttagtatcaaggactgattttgataatgtgcccacatttcagcgagggcgttttaagacataagcacagcattaaggtgtttcaatagcagacatacctgtctttattgcagtggggagaaagcccaggctcatgaaagaggcgtgagcattcacgggaaggaagaaagaccaaataaaggcctaggaggaggtgagccggggaactgtacaagggagcaaaggccccttcttcagatgagttcaggatggccttagcaccagtgcttggggaagaatggctcacatcctctatggcttaccctcttcttccaaggctaattttggaggctttctagtctttcttttgggatcaaatatatcatgaaattgaaacaataaaaccaccccccatagagctgttacttggttttcacttttcatataatattaaaatctcaggactaggagcgatttccagaagctattaagtctaaccactacctccagacagaacttcacctagatagactaagggaatgtattccttattgaaaatatattccacctcattcatttacaaataaggtgtaaaccttcctggaaaaaaattcacaagtgccattataaatgcttctatggataaagaccttaaagctaacccaaagttattttgccacatatacttaggtgtcttaaataaataatatgcattctctcgattccatccttgtgaatttgcatttgggttcccacttcttcaaaagagagtgtgtttgttccatggccaattagtttgatagtacatataagtaattttgcatggataaaaactaaccatgcaactttaactctgcctttaattaagtaatcattaaaaatgaaacttgtctacttcctcctgttctgtagttgacggtgattgaggggcttggtatggctgtagtggcacaaaaatggaaatcagtaaattagagcagttgtcagacccagattctgattagctaaacagcttgcctgggttagtgattaatgcagttgtagggaatgaaatctgctttcctagaaaagtcaatagagaacgtttaatgaagtagaattatgtgacagttgtccagttgtgtgaaccatctttgaacttagtcaaatgcagatgtaattttatattaagactttaaaagaatggaaaaatggcttcaaacataggagaacaaaattttctgctttctttgtttacttcttattttatgtcaccccataaatgtgattggtacggcttttgagattattggtttagaatttcttaccctttgttgtcttgagccatcttttctctagaaacatgctaatattacagatggttcaaatgttcctataatgtcaatgtgtaaatccatattgagcaatgtagaggtccggctgtgaataggacaaagaaaaaattaagaaaatatttaaatgtacatacctccttttctaggatttaataactcgaattatttataaaatgttattgacaactttattaaaagtataagttacacgttataagattcacacttcaaagtgtacgattcagtgtttttagtaaagtcacaatgttgtacaactcattaccactatctaactccaggatattttcctcattccaaaaacaaacctcatacccattagcagaccccctcccatttcctctttccaccctttccccagctattcaagttattttttaagcagatgttctgattaaaactctgtatctgtctttggtgctttagctagcaaaaaaataatgaatataaaacaattgcctccccatatatattggtatatataatttattagaatgtttttcttttcacttttaatgaaataataatgaaatttcaatatgtataactggtgaaataattttggcaatactgtgagtgaaatgatagggcaaaaatgaatgcttttatttaactcacaattgatataaacaaaaaaatcaaatgatccagtcaggtcgagggtaaattctcttaaggaaataacaggtaaatacttttccttgagtgtaaagacacttatgtgtatttattaacacatacatagaatttagataagaattatctttaaaaatatgcatccttttaaatttattcaactagtattatcttttcactacaaacacaataaatcctggttttgcttgcctccactagtcgatatcttgagttaatcttgcacatcagctgaaagaatagagttaaagtttgtatctatgaatagaaggacttgataaactatttgataatgtaaataagagtagaaagggaatatgtagtgtattatgctaagatagtatatgtaattcatgtgagtgagcacactgatacattttaagataagcaagtgccagattaatgcatattcttgccctgattccttttcatcccctttcccttcatttcctcccctttcccatcctcttccctttagacccttgtcacactgacctgcattcacttactggaactggctatgtcccctcctgcctctgggtcttcaagcaaggcctctcctctgcatgtcttaacccaatccgcacacctcccacaccatgctggccctttgcttacttaaattaacttatcatccttcaaatttcaactcagtagtacttcccctagaagccttttggaactttccagaagtcgggtcctgttcatgttctcagagcaccctgattttttggaagtaacattcatgcttctatcctcatcttctctattttcaaagaagaatcaaagaatgtatgtatattctaatatatattgtgtaagtatactaatgattcaatatctttttagaaaatctgcaattttggactttttagtaagtcagacatcttttgcttctgagaaatctgaactattttattttgttatgactgtgacattcattccatgtgttgaaatcaagacacaagaatgcaagaaatgacgacttgccagtaaatgcccagttttcactattaaaaaaagcctggcattgctctcccagaagaataacaactcagtgatagaggggcgtaaagaccatggggccagcatatttgaaggtgatttttaaatattaactgttgtggtcttcaatgtgagtaagcctgcatttttcaaaaggtttcatatcttacaaactcctgatttctccctttattaaaatctattttgaagtaggccaagctgtcaactaaagtgaatgttttcaactaaaagatgattcactttctaacttgacaaaaataaatggagaaaattatagattatagatcaattatcactttctaatttatctctatgatttcaccctgatttattccatgaacaatttaaggtattttaactatctgacattcatttagttgaacaaaaagaaaacgtgaaaccttggtaaataagggacccccttaaactgaaactttcctaagtacatttgaaagtccataaactgacaatggataccaagatcatgagatcacaaatgtgacttttccttaagatttcatcacaagataaatcaaagtgctaggaattgtattttcccttttcctagtaatcaagtatccttctcagatgactctttttgtaaaagtaacaacttctcatctttgagacttgactcacataccaaatatcaaaaatggaaaatctttgaattctttttcctgttgtgggaatacgagtcatttataacaacaaaaaaaatcgataggaaatggatgttttagggaagtgtatcctgagtgctgtctttaaggcattgattggagactgcccacatctaaaaaatgactctaggacatcactctcatgtatttccgtgaaaaagctggtggaaaaatgtgttttcttctaaaaggctatgtgtgggacgtgtgtcagtgttcacatgtgcctaataggcatacgtaaaatcacacttgtatgaaaatcaagtaaatctgctgaaataaacagcaacccatgtttgggcatttgtgttggtagagattggcttttaaaggagaatggattaatatatgattctcttgtcggtattactatgaattgttcttttttgaggaggagtctcgccttgtggcccaggctggagtgcagtggtgcagtcttggctaactaccacctcctcctcctgggttcaagcgattctcctgcctcagcctgctgagtagctgggattacaggcacatacaatccacacccggttaacttttgtatttttagtagagaagggtttcgctctgttggccaggctggtctctaattcctgacctgatctgccttcctcggcctcccaaagtgctgggattacaggtgtgagccaccatgccaggcctgaattttcacttgcaaaattatcagtcagttcttaaaacttgaggaagggaggagtcaagaaaatgaggtgaatgagaaggctgtttagactgtttttattgtcttacagtcccatttttgtctttcactcttccttctctctaatggctgggttttcaacaataatacaggcaagcataaaagttagcaaatgagggctaacctagaattgcaaatttgattgggtttcatgttggttttccttaaataaatcaacagttttaacagggtggcatttaattatatttgtttacagaaatatttttatatttgaatttctttcataacagtgtttattgtggtcaaaggatgggagggatgaggaaataatatttgaagaccacaggggcattcctcacctctgtagtcttattatctggccttgaaacactacgacattctttaactgaatttattaggggctgaataccaacaacataagtcagaaaagggtttacattgacccctttggattctaaatattgtaataaatattattagttccgaaatatcatatctgtttgatttcccaaatgattgcagaaatgctttgatctttttagtcctatgatattgtagagatatctcactaatgatgttttttttttttttttgagatggagtctcgctgtgtcgctcaggctggagtgcagtgagccatgtttgtgccactgcactgtagcctgggtgacagagcgagaccctgtctacaaaaaaaaaagaaaagaaaagaaaagaaaaaaagaaatgtaattcactttcttctggtcagcagctgacaggatagaacacattggactagaaacctgttgtattcttacttttacccatgacatggcttcttttagaatacaaactgtttagaactaagacaggaaaatttaacaaagcattagatataaaaatgttcacaacatgtatggtctattctttaatttgagaatattttaagaaaatttgtggttgaaagctattgctgtcattgaggtggtgttacaacacaatcgatctttgaaaaagtattggcttcaccagggaaacactagacctctaccccagtgactcctgctaaagaggtctttgccatcgctgccctttctgatacctttgtgtgtgctcagattggcacactgattaatttcagataccatcagcaaaaatggaatatgctgaacaagcacttacaaagtagtggttcttcatagaacagagttgtagcccttcagtaacaaagaatgagtcagaggaaatgagttaatttaacaaattgctagttgcctaccagatatcatagcaaggaatgatatatgcaaggtgtgttaaaggcaatgtttccttaatttcttctttctatctcccatctcccaatgtcctctggggaggccgtagaggtgggagggacatattaagtaaaaagtgtgaccacttgctgagtaatttttagtgatttgttgagctggattaagtgaatttagagttgaatcttcaaaatgatcatttcctttttttaagagtttatattctggatattttcatttgaagagcagtgatagtatccggctaaggtttactaaattgttcaagtgagtttgcagaagactaagtgaaacaacttctgtataatgaactggaagattaatctgcatatcacataagcaaataaaaaacaagcaatcatatattttataatggaacaaccgtaagataaacaaacaaaaggcatagttaaaaatctgtatgaaaaagcaaattcttggtttcccaagaatccttggtttcccaaggctcaagaattttatgatttgagaaaaatacttaagtgttgcctgcacttctgtgcaataaatctcattatttcatactttattgccactactgtcatgaaattaatggatcacatttaagtattccttcttggaaaaatatcactaaaatgtaatgttcctcaagtcatagtgcaaacaaaattatatttatcatttacagacaggttttattggtcctggtgcattcatctgctgatggccaataaaagctatacaaagtctcatcaatgaaattagtaatctgtggggacaaacatgccattagtgcctgtcattcgagatttgtgatcattgacgtgctttttatggcatctgaaaatattagtttgactttaaaaaatgtagagttgtttctattgttggatatatttataaaattctgaacataaaaatgctctttggtagccacttgaatttttaaaactatatttaataaaatacagcttttaggaatagcaatcagcatgggataggtgacaatgaattttttttttttttttttgagacggagtctcgctgtgtcgcccaggctggagtgcagtggcgagatctcgctcactgcaagctccacctcccgggttcacacctttctcctgcctcagcctcccgaatagctgggactacaggctccagccaccacacccgggtaattttttgtatttttagtagagatggggtttcaccatgttagccaggatggtcttgatctcctgaccttgtgatctgcccgcctcggcctcccaaagtgctgagattacaggcgtgagccaccgcgcccggccaagtgacaatgtattttaagtagcctctgctatccttgacgaaatgtgctaaagtggcaaaatgtttgctttagagatgtacaaaagtagaaaatttgtgaaggacattaggtgtttctccactttgagaggggatctcctcttgatctactctttatttcccatcccagagtgaacaaggtactagttgatgaattcgaatcaggatacttgaaattaagacttagatgtagcactttgtgatctgtaaaaatcatatcagatcttaaatatgaaaatgtttgagtttagccaaaatcaccagcatcattggtgtatatcaagtttaatcctatccttggaataatagaacttcaaggttggaagatgaatcttgaatagtttgaagttaaaccctacctgccgttgcaatgagtcccattgaaaaacatttcctacatgtcctcgacaagtctttgctttctttagttacaaggaattgcccaacctaccaaggcttccccattttatctttgactatttctataaatttctttttaaaaattgtggccatattttaagacacagagggagggtagacacctagatctaaaggatattaatctacttaagaggaatttgcttatggaaagatgatctagcaaatgagataaactggactgataaaaattatccaaactcaggtttagatgcctatagcagtttcacaaaaactaaatctttgtctctaatggatctgagctgatagcagtgtagtagagaccaaaggtctgtgactgtcgtggagaagccccttttggatgaagctttacggaggattttcaaatgttaattatatttacaaacagatcagatgtaggcatagatatattagaatactttatatcttctctcatttatttttctactgctagataaatgggacttataagtagctgagtaggcaaacaagaaagaatgcatacagttttatcaatttatctgagattttgtgataagctacagaccaagtcaaatggactagttttggcaggggcttgctgtccatatgatggtcagttagcttttttctgagttaaacttgaaaactaagaactttaagaagtgcatgggtatatataggtgtgtgtgtgtgtgtgtgtttgtgtgtaattttacaagactgtagaattataaaatgacatttgttttaaggaatatttgattgacagtttcacttaccaacgttagcctctaattatgacactgaggatacccaaatttaaaaatttcctttataatggtccctgagacctggtgattgaggtcataaaaaaggaatggtagttttctttcagaattttaaattttctcaaataatatttcaccaaatattagccacacttgtatactttgactctgttggtcgttaaaatgtatagtcataattactcctatggaatagggatttcaatagaaagaaagctttagaaatgaatcttctttgcagataaatgctatttaattttcagagttaatataattcaaattatttagaagtttacaagattctattataaagccagtttatttatttttttaattccattatcatctgaatattctaaaaaatgtaaaaagaaatctatttgtagagaaaacaatgccttttaaagaaaaatgtattttgtgctgggctgcagtcttattcatcacttgataaatgatgcttttaattcagataattagagtaatttgtaacaaattattagatatagcagacttgccattccatttctataaaataaaaatacattgtaatgtttacattgatgagtaataataacaacaccttagtagttgtaacaatatatgacctaaaatcagtggtaataatgtcctatgataagaagattgtacaaacttaaaagctagattttctttcaaatcttttgtcatactcctgagagaaagatatgaggggaaaaaagtcactatagcaaaatgccttctcagaactgtttcagagcaattgaggggagaaggaaagaatcagtcagagattgtttcaaatttaatatgaaataaactgttacctttaactattcagcaatgacacagttatatttcattccaaaggtgtttacaatcatatgagtgggtttctgtattcaatgttacaataagtcaacttggaatttcccattaaatatgatattaataaaagatttaggtacagtcccctggtgtgtttgaagctgtgcactctgcaaacacataaataaaaatatatctaattggtttgtggcattttgagattttttttttcagaaggaatgtacttaaaaaaattaaattactgcagttttctttcagaaaattgggcttttgtattaaataatgctagtccaaacttaaaaataagaatatttaagcctggtaagcatctttgttctctcaataaaaagaaaaaaattagagactctctttctccctggcctcatacccccatcatcttctgaagttatatgtatatgaagtattttttttaatctacagggataccttttaaataaaatattcctttattatcataaataatctgtaaaacaaaataatagtggcagtatttgtaataaagtcctaaaagttaaatcatccttattatacttaacataatccaaaagactcctaattaagttttcctttcctaacttatattatcttatgatgatctacaataattttgatgatgttctcaaatgttcttatatctgcttctgaaatagttaaacagattattgaaaaagacctctgaaacaaagcaaataaaataatgcatagaaggaaacagcttttagtcttatctctaatggaatcatgttattgagttttctaaattatggaagatgtcaaaggtcatttagagctagacttcatgtgaagaattcttaacttgaattggcttcagaaaaagaggtccatgaaactccaaaattgtatgcttggtttttatttgtacatgtaaacaaaaattgatagctttccccaaattctgaaaggagtccttagctctcaaaatactgagaacctccattgaataagacatttgagtagggactttgtggtcagagatctgagtttgaatcccagctctgctattttccacctgtagggtcttggcaaactcctaatctgtctgagatattgtttactttctaataagtgcaggtaaataatacagaatttacaggttattgtgagagcctatgagatcatgtgtatttttgccctggcatgttgaagtcacacaataattctttcctttctctcggtttctctcttttaagatgacaggaatggttagctaaagcaactgagtgttaacatgagggttcctgctctattgcttgttatcacacatgggtacatataacagtgactgcctataggaagaagtcattaccccgggacagctttcactggtggatttttatgatggaaagcaaccgcattaactgcaatatggcccagggtgacacttgacatctgtatgttttatttttattaaaaaagtaatttaaattattgccttttctttttattatggaagaaaatgtaagaatgttgactgttcactaagccgaagattccctttttgctttcaaagcttttctcaaggacattaaacactcttcctaattactttttattgatttcttgacatttctactcaacattgactgcttatttttaggaaacaaagaagcctaagtgaaaaatgttaatggtgcatttgaaactacaaagttcaatattttagtcacgcctcttatatgtaattgtaggtaaaaactatataatatttttgccatgtgcctcagctctcttatcaccgaagtaaatagaaaattctgtgattctcagatttcttccatagctttaacttattttgaacaaatctgtgacttaccttgctatatttcaaattttattttattattattcatttttatttttatttttttgaaacagggcctcactccattgccccagctggagtacagtggcatgaactacagcctcaatttcctgggctcaaatgatcctcccacctcagcctctcaagtggctgggactatgggcccataccaccatgcccggctaatttttaaattgttttatttgtagagatggggtctggtactactatgttgcccaggctggtctcgaactcctaggctcaagcaatcctcctgcctcagcctcccaaagtgctgggataataggtgtgagccaatgagcctggcatattttattatatatatattttttgtctcaagaggttctgagaacatgtgtgcctgtatttcaaattttaaatgagtgaagataaggcttggcatagtcaattgaataaaatttagtaaaaaatcaacggaatactgaagagactgatgaaaattacacaaattaactcacattttacattgttcttccaattttgcagttatttgccattagtaaacactttaaatatgtctgccactctgatttttagcattatttttgttaggagtaactatgtaaagcaagtctgattagatgatcctcatatgtaatttaaccaaacgaaagatgtcttatgttaactatttagaacagcccatttatttaaatgttgctcatttaaattacttgacagtcaggaattaacttttaattaaggagtgctaccatcagacctatttttaagagtttcttgtgtgtgatttgcatgttatatacaaatgaggttaaagaaaattacaagtcaacaaaatgaacctaacatcaaatgtccctggagataatttttttattttatgtaatttatctgcatctcttatagaaatactttttttgtcttttctccctatctctttgttgtgtacaatcagcttttaaaggatccagtggtattaattttgcattgcggtcaatcagagatcttatgcaaatattaaatattgcacaggcatcataactaaatttagcatttcatttggaatagttccttgtgccataactccctgatggtgtttataactcagcatatttatatttgtatgtgcatttttatgtatatgcatttctctttggtctcataaaaaagtaaagtgtgtatttttttctaactctacagtcattactaaatgaaaattaagttgtttttaaggcatattttttaaaaggaaaatgatgttaatctgaatgaaggttaaatagaatcccttataacactctggcactatgtggtcacatcattgaatttctgataactttcatattatactttagtctaactactcaagatcagtttagttttctagtgtttaggaaagcttaatgaaaaatataagacaacagacaactagaaaactagacagataaactgaaacagacaacagaaaactagataatatagacagagcgttttccgtgaatgaaaactaaaatgcatcagtttgactcacagtggcctcctgccttctgctaagtatgcacaacctaaaggtaatattttaagtctcattctctgacaatgtagtttgcaaacatagagaaatattcagatgtagaagaatatggcttctctaatggccttgtttgtttttagctacaaggtgacatatatagttctggaatgaaagaggcgtcatcgggcagaatatttcagtggctgtattatgggcctagcaagtaacctgccttggaattcctctttattattttgagaacaaaggcatgccatttaacttttttcagcctcagttttttttttttttttccaactgtgagaaagagaaagtgtcacctatttcttgttaaggactaaaggtgttaaaatgctagaatgtctggcacatagtagatatttaatgaatgtcagtttatcttgtcttagctaagaattttcatgctttactatacagataactcttggattttatctgcattcatttcttctccaaaaaaagggaaccaggaagaagagaagcaaaagacataactttacaatgcctagctaacattatcaatgccaaacacctactggtcgtggtaaaaatgatttctacttcaaaagacaagattgctgtaaaaaatcattgctacactatgaagttatgctgtaatgttacgctatgaatttgttgtgctataaagaggaaagaagatgtttaagaacaaaacatgctatccagagcacacctccatttttgcaattacaaaatgtcttctttctttgcttctcatttctccagttcctccctcgtgacctaccttgaagatcacctataagcagaacatgataaatagcatgcccagtagaaatggtagttgtgagcacatttaaagtgctctgtgatgttttactctcagctgtattgaaatatagttggtgatgactcattctagaaatatgactattaagaatgagtacatttatttcttcaataataagaaaaccaacagaatggtaatcccagaatcttagttctacttttaacatttcacacccagtaagttggataacggatggcagagtgagcctgcgtaggtaataacttattattattacccttaccgtacatggcccttttccttgtacttttctccttgagccaataatgactttgatggttcagtctttctgcactttgtagaaaccatatcccaaacagtattttctagacatcaattctagcatgtgaaagaatctagacagcctctccgattttcatgcttctgggacagaaaagtatttatcacaggtaatgatgataatccagttaaatttgttatgcctttccttactttcaaagttaatttccatttttccattttggatgctgtgttttatggaaattgtctgtaaagagtctactagccttacatgtaatggtcagcagacatatttgatacctttctttttcctttagtaaaaggagttgtaagtaaggagcaagtgaaaagtgaaggggaatttagtatgtctcctatttggcagcaactgcgcatgctattcaatctttaaataatttttaaggaacttgtctcttattgtaaattatgtctggagaattagaagtgctacacataaaaattctgtctttggaatcagtacagatccatgttaacctcgttaaaatgatgacttctcatctaacttcaaatattcatttttaccttattaagtcatagagtttagctaagcactgagggtatgtcctttttgttattttgattctgaaatcctcctgatggtttttagggtagttatggttaagattttggtgccacgcctgatatttcctaccattactgtggtagtgatggatttcttctgtctggacctccgcttctagtggttctctgatctaagcatggttggaactttgtactgacctcatactatgcctagtcacagagcttgtaaaatacagccaaaattttattaattcagctatatctcttatctctagaattggatcatccatggctcctctgtcagagttgtgaaaatggtcagctttgttacgttgagcctgaagcactgatcccacaaatcaaaagaccacgtgactcaattcctagctcagtcatcttttctctttcgacctttgtgtatatacttagtgtacctgtctctcgaaagtgattccagcaacatagattacataccccacttaacagattaaatttcattagacttatcaacgaagatcctttgttgccatattgctgctatgatagtcctatataggaaactccagcttcccatcaggatttgaagctagactttaccataaattgcaacagctgccagcctgttgacccaagaaatgtggtgcattcaaaaagaaggaacaaactcagacaagtaaccagctctgtacatcaaaaatccttccggtttcggtaaactatcctgtgactatctaactttagtccctgaagggtattacgccttatttaccttacaaaactggcatcctagaccttcctaattgagttgaacttcaaattcattgtctaaatcctaagaaatgttgaattttcacaaaccccatttcctgcctgctctctccttttctcccatacatccaccatcagatttttttttgtttactttctctctgataattcatgagtaagtttaaaaaaaaaaaaatgtgtggccagagttttctgttttctgtagatattgctgtgggtttgcccatgcctagttccaacttttaaataaatatatataataatatatttatgttataaatatataatatatttgttataaatatattatatatttatataattaaaatcttatatgtaattataacataaatatatatgatattatatacatatatatatttctttttttttgagatggaatctcgctctgtcaccctggctggagtgcagcggtgcgatctcagctcactgcaacttctgcttctagggttcaagcaattctcctgcctcagcctccccagtagctgggattacaggcacacaccaccatgcccagctaatttttgtatttttggtagagacggggtttcaccatgttgagcaagcttgtctcaaactcctgacctcaagtgatctgccgacctcggcctcccaaagtgctgggattacaagtgtgagcccctccacccaaccgaaaagaaatattttgatgctatgaatgcatttgtcatttctattctgtttcatccatgtgttcttcttgtttacctttgtagtagtcatttacagtgaaaataattgacaaatgacatggtgttatgttcttgaaaacaaacatacaaacaaaaacaaaaaatgaaagcagacaaatgaacaaaatggccaagtaggtgtttaaaggcttaaattgagcaaagaataaaatggtattttttaaatgttaaagaatgatgatgtgttttaatagtattgttaactattgaatcaatttatgtttagtctgcttaaaattatatttggattcaagatggactactgctatcaattgattagattgaaaacaagcaagcaagaatctagacaacacaaatgggggaaaaaataatgagatgtattggacactttcctggctgtaggaaaagagctttgataaaaggagtgatgagatataattaagcacaaagtaacctacatgcttatttatcagtgaatctttcagttccagatcatttcttctacaaaaaactaaagaataaaaatcagtctttcagtcactgggtgacaggatgcactttgatttttccaggaaaggaaagccaggatcacaggcatgcgcatgcacacacacacaaacacacacatgcacactcacacatacacacacaagctcaagcgcgtgcacgcacagtactttggcaagtagagtgttagctccccaagcatgagcttcaggccagactcagtggctgtgatagacccatgcagccatttgacagattttgataacctttttattcaaagcagcatgaagggccaatgaaggattgctgatttttttttaagacaggatcttgctctgttgcccaggctggagtgtagtggcacaaacatggctcactttaactttgaactcctggacctcagtttcccaagtagctgggaccacaggcacgcaccaccatgctcagctaatttttaaaattgttgtaaagacagggcctcaccatgttgcccaggctggttgaactcctgtgctcttgccatccacccgcctcagcctctgaaagtgctgggattacacgtgtgaacaactacacccaactggattgctgaatttttataacatgtctctggtaactaagatcctttgaactatgaccattgaattcctaggacttgtgtgatctcagtagagcaatgactcacttccctcaggttttcagacttagaggaaaatccaaggatcagtctgtagtataatgctaggcatgaaaggcatgaggaaatgatgggagcctccagacagaaaaggtctcccactggtgactgatttctattcagagacaatgccatccctgtgattgaagctccaacacactgaaaaggtgtgaaaccaagaaaagtctctctttcaataaaagttttccatatttcaaaaattttcagaagtaaggatttcttaagggaaaagccatgaataaatcaggccctttttttttttttttgagacagagtcttgctctgtcgcccaggctggagtgcaatgatgtgatcttggctcactacagcctccgcctccctggttcaagtgattctcctgcctcagcctcctgagtagctgagtagcctcctgaggcgtgtgccaccacacccatctaatttttgtatttttagtagagatggggttttgcaatattggtcaggctggtcttgaactccgaaccttgtgatctgcctgccttggcctcccaaagtgctgggattacaggcgtgagccatcgtgcctggcctaaaccaggcctttttaaagaataggatcagaggtctggtttcttcttcttagcaaggtcttgttttcctggtaaggccttgttttctgcttagaggcatcactacaaccagcctgtcatctgtgaactcttcccttggtgggattcagaagtgtagctcctgcatatgtctctccattatgggagtcactggattctgtggttatttaattagaacatgcctcactaggtgttggctacacctatttgagctgaactagaaatgcaaattcctgctacacatattttgcattacaaagtgttctactttttgaaagcttttgagtaaatggcaaatctcaactgaagactttgactcttctacaggaactgcatggaaatgtgaggaaccgaattggaagaatgaacacagcctaccatttggttttcaatgctttgatttttaggtggctttgtagtaatggatggaaagaacaaagatctgtattaaacacatgcttgcagcgtctacaaaaatggtttatgttttaaaagaagcaggggaagacctcagtcattctgagttattacagctccaggagatggaagtgttttattagcccatatatatatagatagatacagtgctaccaggaaaaaactaatgaattataactaaggtcctatgtatggaccttaatattccttgtgtctgacgatgcaggaatttagccaggcaagctgagataaggccctaacctttgctctacttttctttttatgatcttcttccacatgcccttttttggtttaaatataaccaagatgatttccattagatttttctaacaactgcatgatgtgtgtgcgtgcgtgtgtgcatgtgtgtgtgtgcatgtgcgtgtgtgtgtgtgtgtgtgtgcatagcagcaaagccagatgatgatagcaggatgcagaaccccaattttttttaatattatgtaatgtagaaaaggagtgtgcacacctgtttgcttccttcccattgaacaacattaggttgaaagccaacagtagaaaaacaggtgcttgttatgtttgagtgtggagccccaaaaatggaaaaagaagaaaaagaaaaagcaccgggttttagggaaggcttctttaggcataatgtaaagttaatttatcattttggccctgttccactaaagacacagaatttgcggcaatactacctccccatggcctatttctctgaactaaaatgtacattttctttagagaagcaagaactattatgaccagctagtcctggttttgggtggcgggggtggcaagaaaaaaaaggaaatcgttttctttaagtaaagcacttaaaattatatgtttttttgaaactggttttattcctgttcagattggtcatgagtgaaatgacgtagagtactttaaaaagttagattttcatgtgttatttggttaccatagaatttgtactggaaacctaacagcagatatacatttaataacacaatgtattacagggagacatgttttgctactctgatcgtgaacttgggaacaaggaactcctgggagttgtgggaaaatatatggactgaaattagccaagtgttatggagcaagattcatatgctcaaacctacttttactgcttcgttgctttccgtgcagcaatttctggcctcagtgaggaaaatgttgtgtttgtggaaacataaactggctatttatgtccacaaccatcacacaaacacagaactgcagtgatttggctaaatggtatatagcaacgtgcagtctggggttttagagaggcgtgtttcaagctgcatgggcgacattctaaggaatattaggctttttacctgcaaagccactgttcaaagaggcctggctcaaacccgaaacacttggaagattgtgtctaaatcctagaacccactttttgctacacttttagggaggctccttgcctcaaagtactgaaagtttagattgtttaaaacatttgtcagaaatcatttcctggagtgaagatgcttctataactcataggcacatcactgccttcatcatctctgtaaaaaacatatcatttcaagccaactatggtattgtccatcttaatgggatcctttatatcaacagacacgtagtctagtgagattaggaaagcacagtgacagctttacctgtaacagacgttttagtgttaccggtgagtattgcatattgagaatgggcctcagttcctctgttaacatgatgagtgtttcctagattgcgtgaagagtaatgagaaaatgtgtgataagcagtttgaatgcctttgaaagaggtgtagtacaaggtgtgaaatacaaaggaactccagcagttagctcttctcaaattttcatgtatataaatataaagtagtgtcatttcctgaatatgatccctattctttttccatcattttcttgcaaacactgttatcctcaaaccctcttctactctcacctccttcactagtctcatctccatgttttcccgttccaaaggctgcaggagagaccattagtttcattaattatggccctactcaaaagcctaactctcttcatggcctacatattaaacattaattccaaccagattatcaatggcttctctggtatggttgcattattattttatagcttcattaacttcacctccttatttataatccatgtcctagtcaaattgaactgctgcctctcaccaccaaacatgacatttactttcttacctccgcatttatttgttttttccctttagtggaatgccatcttctcccacaaccataggccaaattcaccttcttaatatatgactcttttaatatagttcccattctcacatttattgttaaattcatgcctgactgacctaactgattgatattttctgttgctgctgtgaatatgatcacattatttcactgggttttcttgatggttactactggtatccaaccatatcatctccagatcgtgattattttatcttctcatcttctaaagctgtatcataatttttttattcctgccttactgcattgattagaacttttaagagcaatgctgaatagtagcactgatagtcaatatcctttacttgtgtttgacagtcatggaaatctcccctagagtttcactgttaaggatcatttagattattagctaaaagcagatattcttagtgatacagaatatcattctagttttacaatataaagacatgttttgaaaaacctaaaatcattatatttttgcatttttaaattttaaatataaatataagcatatatttaaacaagtacatatataatatccatttaaacatgcatattaaaaacctgaaaatacaagggattgtgtaatgaatctccatgtagccatcacccacttcagccgttatcagttttgtttcatcttcatcccagtcatttcccttctctcttactattttatagcaaatcccagacatcttatcatttaatgtataaatatttcagtatgtatctctaaaagataaggactcttctatttttaaatatatccataacatgtttgacacacataaaaattaatgataaccccttaatattattattcattatctaatccatgatcagatttcctacatttgtaactgtttgaatcaggatctgaataaaattcacaaccattttgattggttgctatatttcctaatgctattttaagtgttgatattcgaatttttctccttttttcactctttgtttgattctagccctagctccctttgtctcttttttctacgtttaacttttttttaaagaaaccaggttgtttgtcctgtaaagttctctgggttttattgcatcccctcttgatgccacttaatttagtccctgttggttacatgtatgtggatgtttgattaaattcaggtttgatttttaaagataatactgaatagttttacaaaaattgactttctaatttcatcaaaggttgattcggtatccattgaaatgaccatatgacttttatttgttgatgtgccatgatgtttttttttaaatttgttgaataagataatgaatttaccttatgatttctctcttttgacctttcagctactttcatttctaagtgggctttagttggtgaataaattaacatgtcattaaatgtcacatggtaatttcagtagcttgttgaataactgaatccttgattcttgttggatgttcagtcctctttgttttgatttgttttgcttggtacgaaagatttgactagtttggaaagtgacaggttaacattttctacattgacttgaccttcttccacccaaaatgatcctggtagaaaatgcagagtatagtaaagaatgtgtgccttccacatttagcctggtgaggtctataaatatatcaaattaagccagtcagatggcctgctgatatttgctttgcaggctagacggattgtactcctttagaatctaagtattgatggaaaaagattcaagggacagcttgaaagtttgtggactccggctatggaaattttatactcatataaaactgtcagtgattagtagaaaatatgtagcagaactgtgtttctggaattggcttctcagctaagaaaagattattggctttgtgaagaagaaaatgtagctttcttgtaactccatttagtcaattatccactatgggaagatacttttcttcttctttggaaaagctatgacatcctccatggtattcgtatcattgagatgtttctcctgagaaatagtagacttaggatgattagactgtgccatgagtaaaatgcactgtctgaaaaaaacagaaaaaaaacagcaacttgtaggtttgaaaaataacctttcctggcaatcttattattctaaggataacactgtctaatgacaccaaatcatttgctcagccactgctgggaacttagaatctgctttctgtttagctacaaatgagatcagtgttacaacaaaaattataattttgttttatcaggagaaacacccaaaggtcacttttcattctgctgaataggaagaaatgatatcagggtctgcccagaaagcttgtaagggagaaaggaatcttacccacttaggaagcattttctaattcacttatgtgaccttgggcagccttcccctgtgcacttttgtgaattcttagctagaggtattttactaaagactgcagaactattcttttgagatgatctgtatcctcctttaaaatataggataaactataaaatgtgctaagatccttgatagtcctatcattctatatatgtttgaacaatgccaaagcccaagttcatcagttaaaccagttaatctccattggcccttggtgtcaacttgttctttggacaaagtgtcaccttgtaggaagtctacaaacctctaagtgctcccagcgtattagctaagtcctgagctccatggagttggatgccctaattctgctttagaaagtcctagttccattaaccgtctcctgagaattctcctggcttccctttttgtttcttgagcagagttcagtcaaggagaggtcaagagagatgatacattacttccagtcactgtattggctctgggaacctccaactctatgcaggttctttgatctcctctggccactttctttctttttcaagtacatatttgctattcagcaaaggattgaatgacttctcaggaaaaaatgccaacccagaatgacaaggcttccgtggttctgagcctggctctgaacctttcctttggaaaactaatgactccacctatcattcccttggcatctagagaagctacattaggtggcacagctctttctgctcagcttctgctccagagcttcatcttcaggaaccacctaagcatttttttccccagtaggagttcagtctgctcattatacctaattgcaaaggagctatattcagagcaagaataataatttcagattttttaactggacttcaaagagcaggaaagtatgcagattcctaaacacataagcattgaagatattacaggtaaggttaaaaaaaatctgtaattttgtagtgactagcagtttaatattcaaacatttaaaatgtgcatattttattaagcaaatggcgtagagttatttggtttaattttctgtaagtaactcgtaaagaattgtcctaaaagctgtgggtgaggactaattcattcaagggaaacaggatctaatgattgctttgtgaggtatatatacactgtatactcatgctaattcctgctaattgtcaaagaagaatagtggctttttatcagcagtttgcatttgtgtaatggtcctggtctactggttttgtctacttcactgataaggaaaacaccacttaaaacaagcaagaaaagcaagccatcctttacagtattattttctttttagcctgtcttgagaagaaaaaaacctagccttctacaggaaatactgtttgattccatgggaaaatatttagtaacaagcagagaacacttgattatttctcagctatttattctgagtatttacaaaatgggcaatagtattatttccaaaatcttaagttgtaaacgaagtttatattacagtctacatgctatggatatgacactattttaaaatattttatactttaaaaaattgttataacacataatacataatattgtaagtaagtttaattcttgtaatttggaaattcagtcagaaatattaaagaattatgtagatcttgaaagggtaaaataatcctgcatttatgatattaatttctcttaaattgttcaattttattttataaggaaattaagtggttatacatttttgacaagtagttttgataaagttaaacacagattattgatatttacttaatgctttataatcactcaatgattgtcactccaaattaggccatcttttttcacattttgcagaagaataatttcctaagaaacaactattgaggcttggttatatatgtaacatttcagtctgggcagaatttctttttttacttttgtttgctcaatatttatgtcattagtaatagtaacagtatcatatatttgtgtgcagtgttgcaactgacaaagtgttttaataaacttggcaacaaccctttggtatccatttttgcagctgaattttctaagacaggtagatagagagaagtcccacagctaataattggaaaattgtgccttggacctgattcttcccagccaacttcagtgttcatttcagtacattttatctatgaagggtttcttctagggagagttggtcatggtcttacaatttttaaccccagtgattttggttgttatcattatgtcttgcacataataaacagtcactaaagaattgtgggtcaggcgtggtggctcacgcctgtaatcccagcaatttgggaggctgaggtgggtggatcacgaggccaagagatggaaaccatcctggccaacatggtgaaaccccctctctactaaaatgccaaaaaaaaaaattagccgggtgtggtggcgcatggctgtagtaccagctagctactcaggaggctgaggcaggagaattgcttgaacctgggaggcagaggttgcagtgagccaagtttgtgccactgcactccagcctggcaacagagctagactccatctcaaaaaaaaaaaaaaaaaaaaaaaaaaaaaacaattgtggaaggaggtgaggaaggaaggacggaaataaggaaggagggaaagaaggaaggaaggaaagaaagaagggagggaggggcaggctgaaaggaagaaagaagaagggcatgaaggaaggagggagtccttttgtgtggtaaaggatttttggaacctctaaatgataatagtagtcccccagttctcagctatttcagagaactgtccagcttccccagcaatgatcatttgtcctgaccttttttgccaaggcaaaccaggtctagagtaaaatactacaaaatacattctctggtattaaaaaggaatggccaaaaccgtaattacttttgcaccaacctaatagtaagtttctgctttaccttatactttcttccttataatactgtagttgttgacataccaaggaaagtgtgtttgggataaagtggtcacataaatggcaaacatcaaagtaatgtcagattttgtagtgtttctaattgctgttcattttgtagtcactagaagacaacttacaaattgtgaaaaactagtcataaatcagagggagacaaggtttagtgagatccagttcacctccttcctggaacaactattggggggtatcatcttttatatattgaaacatattttatcttccaaatctttagtttacctttaatacaactcctcccagcccccccagaaagaatgctgtttgctctgattggcataggaccggctttgtcggtttcattacatcctggttgaattaccaaatggaaactgatttaggaatactgagtgtgtacggcacagagaaaaaatatcactgcgaaatttataggcctgtgtaagactgtcagggccctgtgttcaaataaagagagcaaaaggaaacctggcgaaaatcaccatctccatcccggcttcttccgacaattacaacttattcctgtgcttggctgctggtttggagcagctgcatccactcaggtaacacttcgcatcacctgggagctcattgttgccttacaattcgtgatcattttttgatctcactactgctaaaggataaaagtgctaagcataataatccataactgtatgagatacttgctacttcatttccctccaagaatcattttgctatgaaatatcccattactagtttcaggtaatgatctaagaattttttaaatgactatgtcagagctaggggcttcaggatagcattacaaggataatcatttcagagagttatatttttaaggccttttaaaaagagggttgtttctagtttttaacatatttgttaatcttattttgatgatctcataaaatcagagtctaaggaagagatgtgtctatgtgttgcttatgtcactgcttttttttattgtttacattttataaggagtgtctacatttgggggggagttggaatgttggttttgttgtttttagcaaaagccttggcatttgtcctgagagagctcatgcagtgtttgctgttcaggttgcatgaagggcaatctttagcaacctgtcagagatgcaaaggccactagggtctgcttgaggttcagagttcctctgcaggactgcgtggtgacagcacaccacaggtggcccattcagcactgtcatctgggacagcaaggataccctgctccatttgtcatcctatggaattctgtcagcagttgaaagcctttcagcacaaaacctttaacattcgaggcaaacttcctaatttttttttttttttttttttttttttttgagacagagtttctctctgtcacccaggcttcagtgcggcagtgcaatctcggctcactgcaaccaccacctcccaggttcaagcgattctcctgcctcaacctcctgagtagttgggattacaggggcacgccaccatgcttagctaatttttgtatttttagtagagacggggtttcaccatgttggtcaggctggtcgcaaactcctgacctcatgatcctcccatctcggcctcccaaagtgctgggattacaggcgtgatccaccgtacccagcccatttcctgatatttttaaaggcaattgccgtggatgaaaatattaatacatagcacctaaataagtagttttttacatgaaaggatattatgttaagattatatgctgtgtgatatatagaaatgttgtatactccatgattttacagaccaaacaatgcaaatcatgtttcccctcttcttaatgaagatgttaaagtataactgataattgatggtaaaaatcacctgtctactcattctttcttattccttttgtttagtttgtttgctttgtaagcctggaaaagatgccttgaaatgtattttgaaaatagctttttgttggagtaataaaaaattagtccaattcttatttatccatagtaatgattccagaataacatgcacatccttaggaataaagttctcctttaaaaaaataaataaatagcatacatctttgaagtccccagatttccattgtcaagatttttctctcttatacatacccaaattaagagccttccctgcttgcccattaatatttgctattattcattgaatgccaatttttttttgccaattcctttatctagattatttataacctctacagaattctgtaagagtgccattacccctcttttcttaatgggaatattgagcatctgagtggttaaatgacttattcaaagccagtaggagacaagacttgaaccacatctgtctccaaatccaagttgttttgagtgtcttttgctgttattcgaaaaagccatgctgagatcaatgaaaggggtccaaaaacatgccttagacaggataataagaggtaagcaaggccatgagtaattcagaaatggaataatcagatattgagtattccagtcagatagaataaaaatcaagcaggggagaagacaaaattaggttatgtgtcacaacaaaatgtagactttcgaaggaaatgaacaggaaaggcagaagaaaatggaaaagtaatacatggcaggtcaaataaaagtaaacaaggtcatatgaaactcacatgcaaataataaagtagaaactagtaaggaagacagaaaggaattaaaaaggaattaaaaattcataagaatgttatcagtagacaagacaaaaaattgcctctaaagatggatttttttttttttcctaaaagagtatatagaatctgtactggcttgatatactggttttgcttttcatcctgaaaatatcattgataaacattgtgtatattagactatttttggttgggactgagtattgcccatggtgttcccaatgatatgagaagaaacatcctggtactaaatgccctggtggcctggggctgagagctttggctttgtataattcatgcacccactttcatgtaacatgaagtttgacaagtgaatattaagttcattatatgaaggtgttgcaaaccaaacttgaaacttatttctacctctcattctaaatggagatattttgtagtgctttagtctacatttacagtgatattagactctttccatttccttaaaagtatgatggcgtttggacattcaaccatgttcctctaagaaattagagtagaaaagaaatttagaagagaatggcttctaatctgcatgttgatatgtatctgactaataatctataatgttttcatttggaacaaataagccaacttgtgtttctttttcaatatatacatcatgtctaaaaaatgtaaagtcaataggcatgtaaaacatttcaaaaataaataattttatcaattgattgccattaaaaatagatgtctaaattgagctgcactgacatgactttataccattaccttgaaccttcctgagaaatgtattttgcttaatgacaatagagcttctcttttccaactacctggaagataaaatattggttaaaaaatgttgagcctcttttcctatttagttatagtaaaattagttaactctataattctctcttttataatttgattctatgtagtgagaccacaaacagcttaacttctctgctattgtttgtaaggtctgcaagtttagtgaaatctgtaccttatatgaactcttccttttaggataatttaagattaaaggctgcttagaagggggaaaaaaagtccatgttaacctttctcctttctctcctcttcagctacatctacatccaccactgggacaagccatcttgtaaaatgtgcggagaaggagaaaactttctgtgtgaatggaggggagtgcttcatggtgaaagacctttcaaacccctcgagatacttgtgcaagtaagaaaagaaatcctgtgtgtcgcttatgtctataactccttgtttcagatgattctatgtctcatgatgtattgttgctttttttccaattttgttgcatcatgttgaataatgctgttttatatgtagagtgttttaaaacattcacaccattcgtcatcactcctctgtcatatgcagaattgttttttgctcttttcaatgtgtgtgaggtgttttttgtttttgtttttgttttttgccatgttatttatagtgttgctttccttgtggtttttcttgttgttattcagaaaagatgtgcagatatcacagaggcctataacttttggtatctacttctacatccaatgtatgaattaagctgtaagataatgttgctttcttatcccagtgatcacctgccaaatgaataagacaacaaagagaagcagaagggcagaagattatttactgacatatatctattacacttgggattgtcttactgttgcataactattttttaaacggagtttagttttatattgctagtaaaaaaagagaaaaaagtaaattgcatatatttggaaatacattgtatgtagcatccctgtgggtgacagcagtgttctttcatttgtctatagatatatctagaatagcactgtctttccaatgacctgaaggagttgatgcaccattaagaagtatccaatttaggcctgggcacagtggctcacgcctgtaatcccagcactttgggaggccgaggcgggcagatcacgaggtcaggagattgagaccatcctggctaacaccgtgaaaccccgtctctactaaaaatgcaaaaaaaaattagctgggcgtggtggcacacgcctgtagtcccagctactcgggaggctgaggcaggagaatggcgtgaacctgggaggtggagcttgcagtgagccgagattgcaccactgcactccagcctgggtgacagagcgagactccgtcccaaaaaataaaaaaaataataaaaataaagaagtatccaatttattctctctcaacaggcagcgtaagatagtgatagtatcagtacattaaatatttaaaccttgtagtaaaaactaataggactcattaaaaagtatgtttattttgccatgcattttaagtttactgttgatatttagtctacatatggtatatggacttaaaatttgatgtgggcataaaaatatatttaatattttattgaaatgatgaaaatacacctttgttttcctctttaccaacagctatatcccaaaagcaaggtattttaaaagtcgttccttaaaaaatgtaatgtagaacatctaataaattttgccagcagtccccagcgaaaacatgcagtggggacattattctaaagcagcaatgcttgttctaaaggagggaaaaccattttgtcacaaaaactgttttctgctagaatattggcgtgtgacttaaatcttgacaaggaagaacaagtctgttagagaggcaattgaactgataggagcaattagcaaaatgaaaaaggcaccagaaatagtcaacaaagccatgtcccttttacatcacagaaatactatataaatatttaggtgccaattctaataaaatcttaattatatttataagtaaggaagtgcatcttaaaaaacatatgttttaaagacaaaaaaagcaacgatcgaaaatgccattttgtaggccatgttttgctgctctctgagctgtggtagattgggcgtgtctgtagcgtgcctgatgggacctcatggctctgaacaagcaccttccagaacttctcctttgttgcactctaaagctcttctttgaaaaaagtagatacagtgccaagacaagtgttggtggttgtatagctgattttatcaaagacagacaatttgtaaaagtaaatgtaatctgttagagtgaataaaagacttagagccagaacagtaaaattctaatctcaattactaaacatctctttcacggaaataaataatttttataagccaaagtgaaatgataggtaaaagtcttgcaaaaaatattaaagcaagatgaaatacgagtatgaggccaggtgcatgcctgtaatctcaacactttaagaggccgaggcagacggatctcttgagcccaggagttggagaccaacctggacaatgtagcaaaacaccattgctacaaaaaatacagaaaaataattagccgggcatggtggcatgcacctgtagtcccaactattcgggaggctaaggtggggggatcacttgagcccggaaggttgagcctgcagtgagccaagatcatgccactgcagtccagcctgggtgacagagtaaggctgtcaaaataaataaataaatagaataaaaaattaaaaaaagagtatgtagaaaagatcattccttttagatctgaattatctcatacgactatgtttattgtttaaaaaataatcttagagattcacttcttggtcactaaaatattcaaatctatatgcttgcagcagaataaaaatctgtctgatttagtctttagttctgctgacttgctgtgaatacagcacaaatatgagacatccccatatttatcatagcaaattgggatgaaccaggtttttagtttgtaaggttttctctgatcaaaatagaaaatgccagaagctgagaattgtaatctataaaatatgaggttcatttgttatatggggaaaccttgttattttttcctaatcttaagcatacagtgtaattgtattttaataaatctccttgaaaaagcatttaaattataggtccttaaattcttctcctttttaaacagtgtacccatattatctatgtctcatatttttacttcttcagaaaagcatctgagaccactatattttaattatagtaatgaaatatgatcatttttcatcatcacttagcaaagatttacaagctgagtgagtgcatatgatagtttctgcatacctctaaggaaccagggcagttcttttccacatattaatttcagctattctttagccctcccacgtccaatacaaaacatgcaatcgcgtaagtgctgttcagttttttcattttaatattgtgccaacaactgcaatttttcttcactcaacacagtttctcattaaatcttaagcctaatccagtagtaaaaacgtgctatattttaaaaatcttgaagtgaaacatttgttactcttctgataattattaaagccccaagccatcctctgagctaattgtctagtggatcattcttgccttctagttctaagaaattacaccttttttttttttgtaattaggatcttttaggtaagttatttaaattattactggatcttatcagaaagaaaatctttgacatctatgattttgataacttccccctcctttgagatggtgactttattcacatattaaagcaagccagaaccttgagggaagaattggagagtatattttacatccaaaatacttcaaacctttctcgttacatgaaactgtttttatttttttaaatcctgtatgtaaaatatgtatagcattaaaaataatcactagtcagaatttaaacaaagacataatatactaggtcttatgataatacattgttcactagaccacttgaatagaaacagaagacataaaaatattgcattggctcatcatggtcctgtctatgaagccagttcatagtttccatatggtctatctgtctagagctaagcattgctgaagcatgagccacatcattgaaaatcagctttatccctgactaaagacatgactcagaaacaccacaagcatggaagtttccaagtagtctctctggtcacctaatctgctgttgtcttcttgggagttgaagtagaagatgttacagcaaatctcttttgtctctctgcttagaacaaggtgtttcgaatggattaaacatattaacagtgaaaaacttctctgaggagaggtttccggattgcttggacctcctcctggggactgtgtgggaatttcagtggtagttctcatcttttatattttgtttctctacagtaatttaaaatttattctgtggaaaaaatagttactattccagattataaaaagatgagaaaagaatcattccattttgtaccctctgatgctttatgtagtcctgtggttcaaagaaacaagacacatgaaatcaaacatgaaattgtccagatttcctcttgcatcttttctctattcttgtgtatctgttcttctgaacagtttcagtggagaactactttggaagatgttgatgtgattttttttaatctaaaaattattttatatcaggctgtgcttataagtccaacatgttgtccagtggacagatgtgccttcatctggaggggattagagttttaaactaccaattttggtgaacagtcttatgtcctttcacttcaactctctggacaatatatttatttataacatgaagttaatatgttctccaaatttcttcccagggagtcagtgaaattaaatgagttcatttctgctaaagtacttttaactctggggaagcaaaatttatttttccttataataaaaagtaaatggtagtattacattctctcagtagacattggaaaaatatatacacctgttttaacagactgtgttatcatgtttaatttctttttttttttttttttttttttgagatggagtttcatgctcttgttgcccaggctggagtgcaatggtgcagtctcagctcactgaaacctctgcctcccaggttcaagcgattctcctgcttcagcctcccaagtagctgggattacagacatgcaccaccatgcccagctgattttttgtatttagtagcgacagggtttcaccacgttggtcaggctggcctcaaactcctgacttcaggtgatccacctgccttggcctcccaaagtgctgggattacaggcatgagccaccatgcctggcccatgtttaatttctaattctttattttacttaagagtagcagttttatttggtttgttgggaccaccaactatctttataacttttctttgacagatcgtttaatatttctgatcattagtttccttataatgcaaaaacaacaaaaaacaaactaaatttggaaagatggaaggtatctgtaaacatagacttttataattttgtataatgaatgtttatgaagccatgtagggccttattatattatacattattataagagacaggtatgaaaaacataactatgggagacaaaatcacagcaaatataatactttaagtttgatagataaaatatttatcaaacgtatttgataatatatataatgtaaatgaaatatttatcaaattatgcctgaggtcgcaatttttttaatttttgcaatcagaccttggcaatgaccttgagcagtagggtattaaaatcttccacaggcttagcgtcccaataatggaacactaagcataaatggattaacatttgtttatagaacagctatttgccaggcactttttaaaacacagagaaaatataaggaatggtgtctgatctctgggaactcagtctgttaaagaaaatgaaattgctaaaatagaaaatcaatgagtgaatatatgccaaatggtacaatgctgactattaaggtaatacaaatttaaagaagggaaagaaaagactgaaataagttagagaagactttttaaatataatcatcatttatagagtctttcctttataccaggaaggcattgtggttgtaggaattctttctctgagacacggtaacatgcagcttaattctaggaagtaaaacaaacaaatgaacaaaataaaagaactaagttaaacagtggagccacttaatgacctctgaaggtcaggcagaggactttgggtattgtaatagctaacagggagccatagtaacatctggagcagaagagtggcaccatagacatagcagatgtttagggaagcgagtcttccttacaggctagaagaagtctggggactaagtaagatggaaagagaaagtcaaagacatcaaaggcactagctaaggttaacattttataaaatactgacataatgatgctgatgatagtaacttttataatatgtattagtagctgaattaatataattaaacaagggggcaacggtacaaactcacagttgtgtcctgcagtctcatcatcatggctgcagaaagagaaatttggaaaaaataaacaggactgggttagaacttccagtctataagaacacacttttgttgtatttgtagtatttgttgtatttgtagtattgctgctaacaccaataccagcctagaagagttctttctttagaatcagtgttacacttgcctgtggtacttctctgttcttgaatattgtaacatttaacagatatagacagcatttgtgagagcaagtggtgggactcatgtggatctagatagtgcgctcttcagacgactgtgtcctctatttctttcatgtcctcatatatctagaatcctactatgtgcttatgaggaatttattaactcatttagacttttaactcactgaagtagggttgaagaaaattctttagtttttataggattcagtttaggtgtagttttacctaaaatcaggtgcattgtctaagtgttctgaatagcttcattcctcacttataaaaatcagttgagcagccatgtacatttattgaactcatatgagacaggctctgtgctcatgctacagacaaagtagtgaacaaaaccatactggtctttgcctgatggagtctgtaggctactgcaagtaacaatcatgtttcatgtaattaattgaattataaatcacaggtttgccaagtgctatgaaggatattaattgagctaagggaatgtacaatgaaagacctagtcagaggctgactctgctctgtggaaaaaagaataaaaaaagagtatgcagtcatactcttcagatgtatatagagtcaatttaaaatatttcattgtgtatatataccacattttcttaatccattcatctgttggtgaacacttaagttgattttataagttggctattgtgaatagtagatttttttataacttggctattgtgaatagtggattttataacttggctattgtgaatagtggatgaatattttagctagattgatttaattattcaacgttgtattcataaatcataacatcattttctaccccataaatgtatacaagtacaaattgtcaatttacaggaaaacgaatacacaattttgaaatatttatattgaatgatttaaggaaaaagtgaatatttagatgttttatcacagaatgaggctggtgaagtggataaggctataaagcccctcagaacccctaagctgtttgacgagacagggaaacttcctcaagagaggaaaaccaaaccacaaattagcagtcgatatgtcattgtgtcacaatgacgtggagatgtatgggatgtagattgatcccacatccaatgaaattgtttgacccccaacttaaggattcatcatgtagagtaaacatgggcaagggttttagtctttctgcagatgagcatttcagagcaagctgtgcaaacagagatttaggaagggcaccaaggttcaaacaagaagttaattcacaaacaccgccaccctcattattgggattatatgtcctggacattgaaaaacaacatttgaaaaggcaggacaagttaggtttggtttggttttgtttttttctcagcatttacccatgagtctagtgtggccactctatgtatcctcttatctcatggattggaaactagtccccagattgtcattaaaaaaaaaatggaggatatatactgtctgaacagtggtggtgagatataggttggatctgaaggaaacattactggaacattttatatttaatattttctttaatgatgttaaagaaggcattcccttggggaaataaatgtcttttgcagatgatgctagaaagaacgctaaaacacaaattagaaaagcatatgcaaacctcaagaaacttcacttaaaggtagataacagaatgaggttcatcttggaaaaatgcagactaatagtaacaatacctttgggaaagaataatctacaacacagatactcagccagtgagtgggcgagttctgggcagaatgctgagctggctaagaggtgagaaaagtcaatgtttgcaacacgatactgtaggaaaacagaccagcatagttggagctggcgtagacactgccacctcgagtttacacagagagagagcaaaggctttggtgtctgatactttctcaccaatattccttgatagagatttgttgatatttctatcatttaatatttgtaaacataggcatcaaataatttcaaataccacagctagtattgaggaaaagcagacagataatagggacttttcatttttcgacaaggtattttttaaattgtccaaatatttcactgtggaatgatgactagagagagaggaaatatcagctgtatttttttttcttcctcttgttcctgatcaagggagggtttgatgaaaatgaagctgagaagagaaaggatgtctaaggatggtttataaattgaccataaatgtgtggtttataaaattagccaaccctaactagaagtttcttggggtccgtgaatatctataaaaacgtctagaatctccaccaagaaaaaatggaaaataatttattcaattggaatataaaaaatacaccaagcattaagtttatttcaaaatacatacatctatgattgattacatagtaagcatatcaggatattaacagtatattgaagttattattaaccacagtttttattatactggtgctgggcagaagtttggttagtagaatgcactgctttattgaatctgaagtaaactggtatttcactaatagtatttaaattcaagataacagacttacttttaaagaatcaaagaatcttttccaaattgcaaacatgatgttaaaggattttattggagggagggagactgtgagaaggatactgggaatttctgtaaaaattatttgagggcaggcacagcagctcatgcctgtaatcccagcactttgcgaggccaaggcgggtggatcacctgaggttcaggagtttgagaccagcctgaccaacatggcaaaaccccgtctctactgaaaatacaaaaattagctgggcatggtggtgcatgcctgtaatctcagctacttgggagactgaggcaggagaattgcttgaatctgggaggtagagattgcaatgagctgagatcttgccactgtactccagcctgggtgacagagcgagactccgtctcaaaaaataaaaaaaaaattatctgggagtccacagaggagagtgtatcataaactataaaaataacagacagatgttcaagattgacctgtgcttgcaaatcaattaactgtatgacaatcttcctttttttttttttttttttgagatggagtctcgttctgtcacccaggctggtatgtagtgttgtggtctctgctcactacaacctccgccttctgggttcaagcgattctcctgcctcagcctcccaagtagctgggattacaggcgcccaccaccacgcccaaccagtttttttatttttgatagagccattcaccatgttggccaggcttgtcctgaactcctggcctcaagtgatcagcccaccttggcttcccaaagtgctgggattacgggtcttagccaccacacctggcctgaaagtctcctttgatacaattgtggatcagatacggacgctgtggtctgatcttaagttcattttcacggacattttgtgagagcctattatgagccaggcattgtgctaggcattagagatacaaaatgatcagaatgtgatcattgtctgacagaatgtgatcagtgtgtcacagatcatcacaatacagataagtgcagtgaaagaggtcaggatagggtgcaatacaaaaggcaaggagagaattctccccagagcatagaagtgggtgatggggaggtggaggacagggaaagagtgatgcctaagttcagaaaaaactgtgaattttcaccccattaataacaaatatagaacaaacatgatcatgttaagagcaaatactaaaatttttaaaaaccctgatttccatcttctaatctgattaatgaaacgaatggtatatacatacacacacacacacacacacatatgtatatatatttaaagctacaacaagtacttgttattcagatccttagattgttctcagacataaaattcttggaatttgctcaaactcatgccaaagcttatttttcaaactcaggtttgatttactgttattcttatcttccaggaaagtgatggattgaatgtttaacatacaatgttgataatagaaatgtatcagaagccagtctccctagtctgttagaagtaattccacagaatttcacagagcttatagatcaactgggttttcatttgcatgtgctttctctacacaatcaatgcagtgtgcagtttgcatatgcagaaactatctcagtttctgcttttcccttccatctcatttggcaacaaatttagatgtctctgaaggctacatccttttgttgctgaacacttgagttgcttgggcacttgcagtttgttttacctcaacgattgtcttaaaaatccattttatcaagaaggatttttagaagtcattgagttctgtcgtccctgactggtaatgcattcagaagaaatgatgttggggttttctagcagtgattccatgtgttagaataagtatcatttcccagaaccttagtgggaaaagaggtctttgataatcacttaattacattccttcattttatcactgaggaaaatgagaccccgtaaagcaaaatagcgtgtccatgtgcaaacagcaagataccacagtgccgagagagggcgtttgcctcccttttcccagttcagggcaccttacgtcttgaactttaatctacatccacatctcttagggatcttgttaaaatgaagcttcttattccatagttctcggctgtggcctgcgtttacactagcacactcctaggaaatgctgatgctgtcagttctaagtaataacagggtcttataacactaagaaacaatgctgagaaaattcatctcccaaatgaagacaaacactagcaaaaggatagttctggttgagaggtagctgctatttccaaaaaatgactttcatacctcaagtagttctggtgttagtgcacccagttttccgtatgattttatgatagagataagccatcatcttatgctagcttcctaggaaacatcatgttagaaattcatagcagttagaaaattgattgggtaggatttctgactccctttacctagttgtcttgtgccttctgatcacagaactggttataagatgcctaatgacaatttccttataaatgccttccttctcttaaggaactcgtgattccttagctatttgttaatttaatgattcttactaacgtaagggcatttcctgccttgagcaattgtgtggtgtgtgtgtgtgtctctcttacacatacacagcgtgttcacatatcttatactatgttcttttgtaagaaacaaatggattatttgtgctcagtatgagaattttaacttttatcaagaattcaaagaagcaggatggaatgataattactgaatacatcattaattctggaaacacctgctttaattatagggtttgtctatatgaacttatagtcctggtagagaaacaaataaaaaccctatttacttcagaaataattttgtcaaataagttatatgaaaaaagttcccatgtgttttttcttatatacgttcagtaagaatgtgaagacattcttattgaagcatatgaaatggcgtctttttgagaaatgacccaacctcttttttttttttttttttttttgagacagagtcttgctcttgtctcccaggctggagtgcaatggcacgatctcagcttactgcaacctctgcctcccgggttcaagtgattctcctgcctcagcctcctgagtagctgggattacaggcgcccgccaccacacccagctatttttcatatttttagtagagacagggtttcgccatgttggccaggctggtctcaaacacctgaccttgttgtgatcttcccacctcagcctcccaaagtgctaggattacaggcatgagccactgcgcccggccaagcttatacttcttattgacatgtttctcaaggtagctcttcctctattccctgcagcaaaaatattctaaacaaaaataatccgtttacttatatgaaggtgtttccaagagtttgaaagagctgtgtcaatataagatgtttgttgtttaagcttaaacacatactcacagggcaaaaaatctgaaactgctagtattttatcgcgcaggctattttcataaagtaggagaattacatataccaagtcacttggtgaattggtttgaagggaaatgaaattacccctatattggtaacaaggaacagttttgttcatatctctttgatgccaaaaatatagtatgtattcttatttactctgtagtgaaaagggttgtgtaaaaatcactagggatgagctaccagagctaacttggataggctctttgcttgatggttgctgtatagatgaactattaataataattatgatgatggatgttgaggattcaaaatgatggtctttctatctgtaagtatattgcttcctagaacctttcagtggccctttttattagaggatatactggtaaaatcaatcctacttaaaatgctttagttattagagtaacagcaacagcaacaacaaaaaagtggtaattataaagagcttccatatttaagcacagccccattgcatgaccttaagaacaatattatatcaagattctagaattttgatagttaaatatatgtgagtgaataacatgaaaaatgttatacagttttaaaaatagtttttccttaaatgcaaaatgacatgtattaagtaattctgcataagaataactgatctaaattttaaaatgtatttgtctttgatttgggataatgcaattaagtgaaatttgtcttgataaaaatctgcttctagtatctttgaacattaaaaacaagagtttatttgtaatgtctttttaaaaaacagggaatgtagtttttcttgtcaataatcattatagtgtgaaagtacttgacttctattgtttaatgacttaacttgtaacataaaacacccatgaaataaatacacaattgaaataagtatataaaagaaaaagctcaagatcatttattgataagagacagggatggaatcatgttagcgcttatcaaaaccagtgtttcaacatagtgagaatcaatgatcagtggcaaatagggtcatgccaaagggaaattgacagctctccgggccatgctgcctcttattccacatttcaacttcactctagttaaatttcagttaaccaatcatttgaagactgaagcaaacaacaacaaaaatctgtaacccacagttttcgtgggacatggttttctaaatgttgtgtcttttcttttctttatattgcttggtaccagatcatttttaggaatctccatattccataggaggaaaattgccagtctgaaagctcagtgtctttagcattttttttttgcttaccacatttttgccctctaggtgccaacctggattcactggagcaagatgtactgagaatgtgcccatgaaagtccaaaaccaagaaagtatgtcaaaataatctgaaatttgctttctcccccaactacagcaacaatcactaccacttggtgcttttacagctcagtcgtaactgattcattttgttctaattatggcttaacctctcaaggcataaacccattcagtgttaccttatttaactgtctctcaaagtgggtccctaagtcatcaatttacaagaatggccagtcacgatggcccgtgatgctgacaaactattgcaggcaagccaaccgagaaacattttcttccaacgtgtgtgaccaaagccatcatatggaaaactgagatgaataaaacatcggatttcattttaaggggttccctttgaaagaaggcaaccacttaaagtgctgggatctttccaccataccaacttaagaactgcattctgtccaaatttttaaccatttgggggaagtgccagagcctgaaagccatgatcagggcaaagattcagttcctgagggtgaactcaccaagtttcagtcaaatgacactgaaggagcttctttctagcatatattcacctcttctctttttctctgtttttctaccattgtttttttgtttcttctctcaggtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaaggagttcagatgtttttcttcattaaccaaacagtttgcattgaggcatttttttaaaaaagcatcaagtaggaaaattaaaaacaaacatttcacagcaaatgagatatcctggcttctgtttacgttgcttagggaacaagtaattcaggcactagtttaaacaattatttatttatgttaccatttctttatgttagtttcaaaagtaacttagaataaaatagttactgttatttgtttaaatatttattttgagatataacaactcaactataggataaatatgtgtttgtatatatatatgtgtgtgcgtgtatatacatatatatataaaacttaaggcaaaacatatatatatatatatatatataaaacttaataacttaaggcaaaactgggaagtttggatagatgttcgtggcttcctgaagttttgaacatcattcctaaaagacccaattcacattgtacataattatataaaccaaaccatgtatttgtcctattgtgaactggacacatataacttctgatcctggagctttcaaaatattgcatttaaaatgcatatcatgtagttatccttgtagatgaaagaatggcaatttttttctgtaaaggttcagagagcaaatattttaggatttgtggtgacaccatcactgtcacaacaactcaaacctactattgtagcatgaaaacagctgtaaacaatgcataaaactgatgtgcatgggtgtgttccattaaatctttatttacaaaagcagacagtgggctggatttgtcaaccactgatttagattgtcaattgctcaccccgaaaaatatgtcacatagcttactgcagtttaaattcacctaacataagaaacagtgatgtaagttggttatttaggggtcctaaaagaatcagatttacccttgttctgatgcatgcagagaataagtttctgtaattcctgttaacatagaagtttccagaataaattctataatgtataatgttaagattagacccgtaatgtgcaatcatttatttagggaggtagtatttatttatttacataggctacatatcaaagacaacttcgtaggccattttctgttgtgaaaaattagtaaattggcattgcaaaatttccaaacagccttcactttattcacaaacatttaagtaatatgcatttagtagggagaatttttctatccacagctaaagcaaatagcttgatttaatttttaagttaattttttaaagctaggatagaaaataaaaataaaagggaaaaatagaatgttatttaataccttaaagcatttctcttagaaatgtgtatttgtatttaaataacatagactcagcaaatccatgtggctagataaatgcagtaaaatcatattttagactttaatgacaattctgatcacttaattaagttacacttacatttttggtgttaagagttttactgtgctttgaaggcaatgttcaggcactatataaataaaagcattaaaaatgaagctatttcccagcataattatgtagttagatctgacagtagtaaccagagaaaatattttcaacttctcttttagaccatttgctttttcagaagatatcattttaaaataaccactatgtttttgtgaagttcagagtgtgattccttaaataacttctttagtatgctttcaatgccacttttggacgacatccaggaaagcagcattcatatttaacctgatttaacaaagattgattgcacatttatgaacaatatatgtaatggctgtgcaacagagatgcctcatgtctggaaaagcaagagcttccaatcagaaattgctttccagtgttgtcttaccgagagttttttcaatttttatctctgcaaacccctacatagaagtcagaaaaataaatttgtgctgctctaagaactttatgttcaagtagcagtgaaagccagaataaagatagagaatgtcaccatagtgaccgttttaaaatttaattgtttgtagtcttaaagtctggaaaacataaattttgaacacaaactaggaaaagatagtccccagcttcaaagagaaacattcaaaacttaccaaactgcattttcagttgaaaaataacattctaaagaatagataattttttaagtttattaacataaaacttacattattcagacttgatacagtgattctggtcagaatgtccaatgagccatttactgatttataaaaactgacttaaaatatgaaagagagggacaaatgtatattttataaggcagtcatttgccttgaaataaaacattatatttatagtactttctaggaaaatattgtcaaggttagtcagcttcaaatttgacctaacttgacacagaattcctagttgaaaaaaattgtgttcatcgatatgtggtgtgtggggggtgtgtgtgtgttcgtgtgtgtgtccacacgtatgtgtgtgtatacaggcactccataatcaatgtacagattttagggaggaaaaaagaaaaagcacccacactttcaatagttaggggcagtacagagcaggtatgtcatatataaactaacataataggacctaattatagaatagctcaaatttagaatattttaaaagattgtaattttagaacttttaggaatattctcacactgagtaaatttagcagatatccttaaaagtagttttgaatcacaggttactagtgcatccatcatttgcatggatttctaaatgcaacctgttgaaattattcttgttcatcaaacatgtatcttgctaaaagtagaatagaggaacacttcacctgtgacaaaattgccataaattccagccaagtgttagtgagattttactgtgtgtgtgtttgtgagtgtgcttatgtgcacatggaatttgaaacttaaggagaaagtctccgttaacatttcaaagggcccagtgacactacggattggcatatgtgaaaaaaaacagtatctccattttataaaggtaagtctaaaattaaaagacagacactaaattggtcctgtttagaattggcattgacagaactcctttcgaaatctcagcggtacagaaagtcaagactttaagattttaagtctttgaaatgattagcataaacaggcccaagatgttaaagagaaaaatcctaaatgtcttcaaattttaacaggaaccacaattgcatggatatataatttttgtaaaagaaagttgttctattgttctttcctttaatgcaattgaaaatttaaattaacctacaggttaatcagttttcctcaagcaattataaaatcctaagacaaaggattcgtgagtcaatatttaatagtttctgaagacttttagatttaaattaattttttatattgctcagagcacagcaggaaatcacatgtagaaaaggaaactagattgtttacagtaaactttgtgtttttgaattattaatttaatttgaaaaatgtagtggctaggcagaagttcaataggaagcatgtgattcttaatgagtccaggccaacattagattaagtagaacagatagaaagtaataaccttttcataaaatgaaaagtgttcgtgtattctgctttttttttttttttttgacttacaatgaaagaaatgtagctaccaatagtaaaaatgaattagagcattatttgctctgggtctagtatgactgatgcatgttccctctgcttgtttccttgttagggcttatggccagaagagattccagttttaagtaccaatttcccattgaattatttgaaattggagctgcctgatatgaatgacttcccgtgaaatgaaattatagttaggctgacagacttacctataaaactgtaaatgcagtaatatgtatgcatgggcatgctactaattttattgaagacttaaccaagctttctatgcaactaatatagatcatgagcagtgttcatgtaggcatggagtcctgactctctggaaagagtttctgtagacatcgcttgattttaacccttaaattattactgactggtaggagaaaaaggcaagggaagggagggggctctagaaagaaaatctgggtcccaccttcatggaaatgagtaaggaaatttattattgacttccttggaaaatgaatgttttcacgtggatgttccaaagtttgtattaagaaagcaaatgggaaaaaaaatgaccaatttttgaccaattgagtgttgcacggaggcaagagaaatttatctggatttgaataaattattttgctgtgaatattgtgcaaccaagttaatcgtaactaaatcccctagcttttaatttatgaaaaatatagcttatttgcttgtgtacactggacccaaggcagaggaaattattatatatagtgcttcccattatccttgttatgcaatgtactttttgatatatgtgtttgtgtgcatatatgtgtgtgtgtatatatatatatatatatatatatactttaaaaaatctggggagctttatttccttaaagggcagcaagtttttaagttttcaagtatccccggagcttacagagtttttctggctagttaacgagaatacagtaaatggcccagggtacatctcttgatgtgtctgctacccaagctgttaaacccttctgctgtttgccaacatatttcacgtctcctttactccccaggcatgcccagtgaggcatgtgtttgcataagaaatattttgttaatgaaaaattaacatgtccaaagtcactaaaaagttccacggcagaggcaggacccaaaaccaagatgattccagcacactcatctcctgctttttccctctctatatgaggtactttttccatgcccaaatgcaagtttttgtaagagaaacacccctccacagcattttcttcacacttaagagataccttgccatatcattgaatagcccttgtatctctcgaggcagtgatcaaagaaagaaaatatagatctccattgatatgctgtctctccttccaacctgcttcttgaccacacacataggcgcatgtacacgcgcgcgcgcgcacacacacacacacacacagagagagagagagagagagagagagagagagagagagataaaggaagtcctagagccttccgcatcatgaaatttgattatcagttttggttttgagaatgaaaagtgtcatccctggagattttttattttttttatttttttggggggcttgttttcccccacttcctcaatggagcctctgcaggttctgctgttcttgcaatcctggagtctctggagtcccagctgccaggattgctggctcttggctcatacctttgagtccacttccctgggcagccctgcaggtcctccaagtggctgtgtgcatgggagtccagcattctggagaagtgatttcactggctctctgtgatttaaaggagtaataagatgaaaaaccctaggaattggatctttcccacttatttttttccttacagtttgaaaaaagtgaggcgtagaattgtcctatgccatacagaacttatatgagaaaaactagaaggagtctccagtgtcccaagcccctgtttggggttttggggcagaagcatttgttgctttctgtgaatgaaacagacaagtgatgaggaaagtggaagattagaagaagtaaaagagatacagctaagaaaataattagataaccaatgagcaagaagtatttgaggccagctacccacaatcaaaaatccaagtccaacctgataacattttcagaccaaattaccatcctcttggcttctgctcctgcctctgccaatgggtgtctttgggtaaaaattaattaattaattaatttaattaaataaaattcacctccttggaactttgcttctgccttttaaaaaaaggaatgaaatagtatcaaatgccttttctgattataaagataatctttccattcccacacaaggaaataatttaggggatagttcagcgacagaacttctccctcagtaaggtcttttaagggttaataaagacacagtgtgctggtattttgcacacctcataaaaagagacgttccctatgtgaactcacagaggcgtacctgagcactgcttcttaaccacacaccatttgtctggttcaatgtgcatgcacagagagccataatagtcatgtgtaatgtgttttggagtgcagtgtattgctcttttctgaaactttttccctttctttcttttttttgtcaactttctgcattggcagagcatcttgggattgaatttatgggtatggaccaatcatcattccttttagcctgcagaatttagagcctatgagctgaaatctttttcccttcctactcttacctttcagttcctaactaatttcctttttctttagaagggatcatacagctataacaatgatttctctgccttcaatctatgattagtttactgaaatgttactgagtgcagcaggttttagattcctaagcatccttcacttagagtttaaaagtaccctacctgctgcaaattcacatatatcccacgctgcttaacccactgattggatctagctctgctgttatataaaagctggggtaagtagtagtagcacataaaggatacaggggaaatccactcagagacctgagaacaaaggctttttaaatccatctgcttaaaaaacacacagcatcttagcctggtaggatttttggcatacaatgtaaaaatcatctatttaatataagcaatgtaatgtatatagaaagcccttacgttacaacacaatattaaatgcacagacttgaattactcagattttctggagatactcaagcaccaccctagtcaacttcattatcttataagaaggaaatagaaaacagaaagaaagcagccttgtgctattttaggtggagattccagtggtaatggaattaaatttgagtcatgaagattatccagacaagtaatcaaatagaaaatttcacactgtcaaagtaaaagaaaaatatatgagtatacaaaatttggacacacttttttgtaaggccttcatcctacatagttgggattgaagaccagtctctggggagtaaggagctgtgctaccttcccagagactccacagggccaggccagtcagtctttttcaatgctgcctgcagtcccggaccatggttgggtcagtgacacaatgtcctgattcacagaatatctggtccccatccagctggcttcagggacatcatgcagcaggggcatcctacagctgctgccttcttttggatgataacatcacaggctggacataatgtagtttccagactttgcgggaaatgaggcagttgcaagctctagcagctacagggattgctcaatgggttgcccatttcttcctcaaaaaaaaaaaaaaaaaaaatcaggagtaaactaccaatttgatgagaagcccccaggtgcacgtgaatgggcctttgtgcctcgcagaacatctccaaagagggagaaacacaagggggagcacctctattactagggagcacgttgtgtactgaggggagctatctattggagtttcttccctcagggaaaaaaaaaattgtcccacttatgaaatggattattggcctatcctgcagggagggaaaaaattctaccattaccccaaacccttctatccttaacagcatatttctcatttttatagctggagggtctgactatagaatgtattgtttctgtccccaacagtaaagtgaaagacagttgagatatataacttccccctcagtaagatcttctatgggttagaaaagacacagggggctgctatccgcatgcttctcaaaggtacagtttccagaggctcatagttccaggcttgccggtgtactaaaccagaacattgcatccttcaggaaaatcagaccttaaaggtcaagtacaactcagaaaggtaagggctctgtttcttggccaggccagatcagactgaaaaatgtgcttgatctggaaacatgttagtccagccaaaccatgaagactctggggcatttgtgctcattgagagacagacccaccgatcggaatgacagactcttgtttttagccctgtctgtctctaatttgctcttccccagttgacctgacacataagaaaaaaattaatatggggaaaaaagaggttaaagaatccattgtttgtattatttttcaccaagtatttttccttgatcacattcatagtgtgggatcacctgattgagccaaaccatgaaaaattcaaatagcaatgaggataagggttgtagtgcatctggtcaatgctgatgtgaatataagattttaatcccacgtctgtattctatgggccttcgcttgaatcagctcattctagtgctgttacattaccctttggcctttactgagctacctctttatttccatgaaatgatcattttactggaaaatgtgtgtcttcctacactgcatagaaagaatgcacccgtcatcatgcaccatatgtttccaaacgcagctcaatctattcttctgtaattaacaacaaccaaaagacaacttgtcccaagaatccctgagagtatgcatgattcctttttcccatttagcccttgtccatgtccccatttttgaagtctgcagaagcagtttcctagcttctttctaaagataggatgttaagatgtcagtagacaagaataaccacagacttgcccatcttcaaagaagaaaacaatagaggacggaaaagaggacaatcatacagggccttcatctcttgtcaataatacctacactcctatttcttcaccaactcatcacagcccagggagctgtgctctgcatcctgggtcccagggagagaaggaccagtggggtgacagctttgcttcttagacatgtatcctaaaacctgatcaggataccaagatcaggaagagaggctacagcagcagcttcaaccagataacaccccatagaaattaattccctgtcctgtggctatgggggaggggaggcagcagacatatgcaattaacatataagcactcacattccatgtcctcatctgacttttgctgcacacaaaatccgtgataccaactcaatatctcctggtacattgtttcaccgcaatgcaccagccgcttcgctttctaattgtggcttccacatgactgctagattaggagttatgctgtatggaatgacccttccaactttgcatccaccttttcttcccacccaagcatttcctccctctggttttcttttctttctttatttttcctcccttagtatcaggcatgctgtgccagggacttcagatggctccttaacttttaaccttgttttcccttcctcggtctctctgtcattctgtcagtctgtctgtcctcttggtttgtttttcctttccacctccaacccttttgatttgtttttgtatactctatgcagcattctagtcctttacccactgacttctcttttccttctcctcctgttaataatcagtgctatattaatttgatttgacaatgttcttgacctgtttactggaatttgattatcatgggctcggcttgtaggaaatgttttgtttcatgataaggtccactgtatcctagaaattaaaattcactttttcatttcaagaaaacttcctgcaagctgccctctctcaaaagagaaaaaggtgtagttaaaggtgtagttgtgccactgcagatataatatggaaatatgctttgaggttcccttgttgatgtccagaatagtcagctctgtttgtacagtattccccagttcttgaccaatttattgatcataatggcaagtgaacagcttacactgcttatttcataccagttgagttctctttctgagtgaacttgtgaagatcttccaataaatgtaattagactcactggaagctcaggtccttagggatcagagtccctattaaatcagcaaatcttgttaagaacctgacctaccttagtataatcaacttatcccccaaagaaactaactcgcaaatagaaaaacttctatgaattagagactgatcgcattttgggtgcagtagtatctttggttcaaagttctaagtgtcacatttccttagtataatctacattagctcatttgccaagttggccaacgtaggaatgtgcactctattccaaatcacacatcatttgtactggtgacttctttggacaaataaaacttgttcctaagtacaattggtggagtagttagaattgtcttccaaaggacaagtcaccatttgggcccataactgtcctacccatcacataggattttctttgatacagtgccctgctacctcatattgtattgcttcttgtgttcacattttactgttaaatcacagagagcctgactcaatttactagttaactacaagccaagttcatgtttgcaaatgtctttgaatttaatatatttaagttagaaatgactctttgtaaagaccactggatataaagtgatgatataaaatatctgggaaatacaaaaaggccaggggctgggggataaagaggggaggaaggaggaagtggggggcgcccagtgatgccaattccatctcctttaattggtgttgattcctgttgtctttgcaagagctttttatattttattttgcaagagactacaaaaaaaaataaaactacagagttttaaccaaatagttattttataattaatgtttatgatttccaatttactatcaactatatatatctctatagcttataattagaagtaatttctgagtataatatttgtattgtaaatggccccagctggcttttttatatttatgttcaaagcatagtgcagagcatgttgtaccttagctatgtgtgtaaacgtaaagaattgtcatgtatttattttcttgtgaacatggacaatgtcatgcagcatgcccactgtttggttgtagtcagtcctggcaagtggaagtgacctgtgatgacatctgctctcatccctttccagaggcggaggagctgtaccagaagagagtgctgaccataaccggcatctgcatcgccctccttgtggtcggcatcatgtgtgtggtggcctactgcaaaaccaagtaaaccttctttctccatgcctttctctctccttcatgcagagacagcttagatggccagggctttgcagaatctgagctccacagcctagtcttggggataaaaaaaaaaggaggggcagggggagattatttcctctgaataatccattttgaggatgtctcctaaacacagaaatagaaagctgtttgcctattcatgtaaagatttctgttcaatgaccacagcccctgagtggataaaggcctggagggacaggcttgtatggaaggtatgtgtgtgggtgggacagaatgaaggcacctcattctaaaaggagagggagggtaccagaagtccatttgagggctttagtataattaagttatccccaaaagaaactaacttgcacctagaaaaacttctatgagttagagactgactgcattcagggtgcagtagtaccttcagttcaaaggactactgagaacaaatccaatttacactgaaaattacgagataaaggaaacctttcgtggtatctgaaatgcagttttctgagttatagtgattattattattatttttaaattctatctaattaggttgccagtatgaatgctctcacagcctgagatgtaaaaaaggaatctcaggggaggaaaatgaagcaaaactttctttgaaaacataagagagaaaacattagaatagatttgggttccctatgtttggtcttgaagtttggtccgtattaacaaattcaattactatgtgacatggattctcttcacttttctctcctacatataacttacatttcaagcctaatatgttaaattaacaaggtttttgaaaaaatgttgctgcacgatactctgttgccaaaccatccatgggaatatttcataatctgaatgttgcattgaggaagaaaaataatatgcttttatgccacaaaatccaaagcatggattgtattttgtcaatatcccatgatttagtgtgttgccagaattaagggatagagataagccttcctggagtcgacctggtgagtctcattagattccatctcaatattcgctgcctaattgcacaaaaagcgttaccagagtaggaacatgttacgattgtgccaaaatccgctggcaaaatatgtccacattctcacgcgtatacatgggatacactcacaaacatgctaactgtgtatattcaaaactcagttcattttcttaagagaccccaggaaaagctataaatgaaatcactcttataaattctacagcacattttttttttttagacagaatctggctctttcacccaggctagaatgcagtagcacaatctcagctcactgcaacctccccctccctggttcaagtgatgctcatgcctcagcctcccgagtagctgggacgacaggtgcacgccaccagcccggctaatttttgtattttttgtagagacaggacttctccatgttgcccaggctagtctcaaactcttggactcaattaattctcttgcctttgcctccgaaagtgctaagcttacaggaatgagccaccccacccagcccagcacaaattattatctaagacaaataagtgtccatttgtaagacttaggcaaagatggattgattaggaaatttgtgattttagtcaattatcaagttatttgtgttatcctatttttttcttgtctctcagtaaaacagctaaatttccataagaatcccaggtggcttttaaaatctgtttggtaaggatgtgtggtttcacttattctgggatacagtggacatactcccttccctcttcctcatcaccagtctactgccttgaactactcataggtgttggtagaataaagacttggctctactatgaaatgaaaataatcaaaaaaaaataaatgctccctttcttatgtccaggaaacagcggaaaaagctgcatgaccgtcttcggcagagccttcggtctgaacgaaacaatatgatgaacattgccaatgggcctcaccatcctaacccaccccccgagaatgtccagctggtgaatgtacgttgactctggccagtggaaaaaactgagcctctctcctttgttcagacgccttgaagtttattttcgaaagctcttaagcttttagctgctgccattaatcaccatggcttccaggaatccaggtttttgccaggagaaaataatgggaacatttttaaaagtggatttggttactgtaaaatcagcacatttcctcttataaagtgttcattaaggggttggaataatagtgttgggtttgttctgcaaggaggccatagctggggcttgcgtggagagagtggggagaaaacaaatttaatagtacgataatcaaaaagaatgttttcatatataacttggaaatacaggctactccattctgtaactgattagtacagataaccgagcaaagagctttagagttattttcttagggcaattcacagtgcctgatgatttactggttatgatttccaaaggattctgatttcctttagggcgtggaaaggtcaagtgacttatcaaacacccttctcagtagcaaaagaagagtgtcatgccagcttcttccctggccctttctaaatgatgtcaagccctccagatgaaatatatccataatcattaaaatatttttttcatactgtaccaaacactcagcattcagttttttaaatacaactagatcatagaatattaggttctggagagtttgaagatattatctttcaaatctctctttttctttttacagataagggccagagccgcaccatctcttggcttttggagtattgctctttatattccagcatcatccttcttattttcaaattattgctctgatgtatggtttttttaatacacaaagcttgaagcttatattgtagtaccattttctatcctatagaaaaaggcatattttgaatggaacagatatatcatagacccaactacagagttggtggttactaaactatcagcaagtcttgtagcaaaaaccttcaaaactttgttggagcaaggtgcttataggttaacacactctgttgccttttcaccctctaacagtgttcatcacaatgttctccacatttgataacgatattcactacaaaaggaactataatctgtcactctgcatgttataatatataaacggtagaatgactgcctagattacatttactgctcacattgtgcatctttgggctttaacttttctcaaccttatttcttcaatataaaaacagacctaaaaataatacctacttcagagactccttgtgagccttaaataaggtaatttgcataaaacacttagtctagtggcatttagtgagtgttcaataattgttaagtatttttttcattagattcactgagcttatgttgccttccaaaaagcaatagtgaaatggttcagggactggaagtaggtcactgtgtatcctttccttaaatcaagctagctgtacttcccaggaagatccacatggaatagcctttccactaagagaaccagctagagtttcaagcataattcaagctgtatatttttggatctccctgaatatatttagagcccgcagaccgtcagattataaagtgccttatttcatcaaagagtattcctttctattggttttcctattatttaactcaatttggtataaatactaacagcaattaaaacacaacttcaaaaaggggcctccctccctaatagaaacagtaaaaactactgtggtttgctgataaaaataaagtagactctgactaggcatggtggctcacacctgtaatgccagcactttgggaggcagaggtggacggatcacctgaggtcaggagtttaagaccagcctggccaacatggtgaaaccccatctctgctaaaaatacaaaaattagctgggcatggtggcatatgcctgtaatcccaactactcgggagggtgaggcaggagaattgcttgaaccgggaggtggaggttgcagtgagctgagattgcaccactgctctccagcctgggcaacagagtgagactccatctcaaaaaaaaaaaaaaaaaaaaaaaaaaaggagaagaaaagaaaagaaagaaagaagagagaaaagtagaatctacctgcattaaatagaaatgtcctccatatattatgtgctttgtcaagatgtgtgcattgacaacaattgttaagtcccttatcagtagccttgttagccctaccactgctaacaagttaaacatttcagtgacattagtagggcaacatgggcactaggaaatggaaggagaaaggtaggcccaacatatagagattctgaatatttttttctagtgctttgaaatttgaaactatacaaatcacctgtctgcttctatttcaaatagcatttagccttcttcaccttgcaataccatgaaacaaatgaatgttggatggatatttgtatggaattctagtcattaatttaaaataaaatagaagaaataggacttttgctgataaaatgtagttggaatgatgggccgtacattggatgcacatccagagagtatttttttttttaactctattcatctaatctaaaagccacagtagccaggacaggattttccacctggccattggggaaatggaatttattacaaatcagctgtacaaaaatagatttgtgtgtttctgacagtgttaacgtttttatttacatgacaatattagtgctttgattgacatgaatctacgtgaatcttcaagttgtgtctctttgtttatccagcaatacgtatctaaaaacgtcatctccagtgagcatattgttgagagagaagcagagacatccttttccaccagtcactatacttccacagcccatcactccactactgtcacccagactcctagccacaggtatgagaatttaaaaattccacggcttttctctcagaatgaattgttgcacattgccttttgatatccctgcctaagaaaggaggcagtgaaatggatggtctttgggcagcaacagattttgaaaatcaactggctttgcccttaattcctgcataaatttgaacctcaattaggtaactccacagggccgttgtttcccattcctgagattgtctttactcatgccctgctactcaccgaattgctacactgggacaagtctgtctttggctctgcaaaatacttagaagtcaatttctttcagtaattggattgccctgggaaatgcacatgagaattggttaaatagtggaaccctaaattctcaaatgccctggtgatccccacctgagtgcacttactctaccaagaccaacactagatctccaaatgtagctcatacaaggaaatgtttctttaatctaagccactcaagaacagagagattataattatatactgaggagtggcattcgaaaatatttattgaatgagtggacaagtgaatatactgtatccttacaaagccaatctgaatcaagatcctctctatagcaaattacctttgtggcgattctattcggagacaagtgatgttacagtgagctccgggtgcatcagtagtttgaaacatttgtcagaatccattcctttcatttccatttttttgcatataatttttgcacgaaatatctgattgtctctcccatttcctccgcagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtaaaaccgaagggcaaagctactgcagaggagaaactcagtcagagaatccctgtgagcacctgcggtctcacctcaggaaatctactctaatcagaataaggggcggcagttacctgttctaggagtgctcctagttgatgaagtcatctctttgtttgacggaacttatttcttctgagcttctctcgtcgtcccagtgactgacaggcaacagactcttaaagagctgggatgctttgatgcggaaggtgcagcacatggagtttccagctctggccatgggctcagacccactcggggtctcagtgtcctcagttgtaacattagagagatggcatcaatgcttgataaggacccttctataattccaattgccagttatccaaactctgattcggtggtcgagctggcctcgtgttcttatctgctaaccctgtcttaccttccagcctcagttaagtcaaatcaagggctatgtcattgctgaatgtcatggggggcaactgcttgccctccaccctatagtatctattttatgaaattccaagaagggatgaataaataaatctcttggatgctg

SEQ ID NO: 905 - DNA, 180409 bp, Homo sapiens; identical to SEQ ID NO: 900

SEQ ID NO: 906 - DNA, 216831 bp, Homo sapiens; identical to SEQ ID NO: 901

SEQ ID NO: 907 - DNA, 216831 bp, Homo sapiens; identical to SEQ ID NO: 901

SEQ ID NO: 908 - DNA, 195043 bp, Homo sapiens; identical to SEQ ID NO: 902

SEQ ID NO: 909 - DNA, 96520 bp, Homo sapiens
ggcttaactgatgcctgcctgcctctctttgatttgatggcctttattccttctaattggataaaataggaagtcactggcagtcctgtgtggctggggatactgattttactcagaccagcctgcagctctagagtgtgggtagagagcggggagtgggggttgggagagggggaggaaagagagagaggagagaggacgggcttggatgaagaagggaaagaaagagaaagagactgaagcagagaagagccgcagaggaagaaagtgaatgagcactcaagaaggacaaagaggagtagtcgggggtggggtggaggcagggcggggaagggagtgaccgcccctcctggctgcactcttgcctccggagccctctgatcctgtttgcagtgatgctccgagggcaggcacctgctgctctgtaatgattcagcccctttcagccgtcgtcgcgttaacacaacaggatgctgttgctattgtcactactgcctctcctgccgccgctgctgctgccgccgccgccaccgccgctggtcctccttctgcttttacttctcctgcatgacagttgttttcttcatctgagcagacaccagcttcagatgctcgaggtgagaaacatgcctttcagtttgggctactggtttacttaattaatcagccggcagctccgtcgatctattttcgtccctgtcctcttgacgagcccgggatggtttggagtagcatttaaaagaactagaaaagtggcccagaaacagcagcttaaagaattattacgatatactttgattttgtagttgctaggagcttttcttccccccttgcatctttctgaactcttcttgattttaataatggccttggacttggacgatttatcgatttccccctgtaagatgctgtatcatttggttgggggggcctctgcgtggtaatggaccgtgagagcggccaggccttcttctggaggtgagccgatggagatttattccccagacatgtctgaggtcgccgccgagaggtcctccagcccctccactcagctgagtgcagacccatctcttgatgggcttccggcagcagaagacatgccagagccccagactgaagatgggagaacccctggactcgtgggcctggccgtgccctgctgtgcgtgcctagaagctgagcgcctgagaggttgcctcaactcagagaaaatctgcattgtccccatcctggcttgcctggtcagcctctgcctctgcatcgccggcctcaagtgggtatttgtggacaagatctttgaatatgactctcctactcaccttgaccctggggggttaggccaggaccctattatttctctggacgcaactgctgcctcagctgtgtgggtgtcgtctgaggcatacacttcacctgtctctagggctcaatctgaaagtgaggttcaagttacagtgcaaggtgacaaggctgttgtctcctttgaaccatcagcggcaccgacaccgaagaatcgtatttttgccttttctttcttgccgtccactgcgccatccttcccttcacccacccggaaccctgaggtgagaacgcccaagtcagcaactcagccacaaacaacagaaactaatctccaaactgctcctaaactttgtaagtagagagagagagagagacgatgatgatgatgaataaaaggggtgggtttgaggtccccaaaggacatttccctttcttcttgcattttagttgcctggttttgtttaagcaaagcctatgtttgagatgcttgggatggcattgaagggccgagtaaaatgatcttgcaaactccggatctgaaccagtgttgtaacagcagctctctctagccacatggctcaatctggtaccgggaatgaaaaacttcagcatctgcaagtcatgcttgaatttaagttaaattcaatttatttctaacacattttaaaattaaaacatcacgccatctcttatgttttatagaaatgtgactttcatataccagtgagtattattttgtgtctttctcttccccatcatagatttcctgtcatctctctgttaccctctacctctcagcgaccccaagctgcctgttgtctctctctccttcccgttccctaaccacttctccctacttttgtatcttaattggttctttgagattacagcaagtcttaagacatttacggtgctagcctctcactagcttgagacgactgctgtcctgcccagatggcactttcagttagtgagcacttactagtggcagctttattttgtccaggacacagtaggattctgcatgaaggattttcccaaattagttttgtcttctataatcaaatgtttaaatagcttccttggcagttgttaaaaagtacaagatccattagtgaggtacatctttttttttttttttttttttgatgtatgtcatcttagtctggcagattgcagcggcccagtttaataacctgtgatgtgcagagagcccacgctcttaaaaacaatacattcctgtttgcattgcgtaattgcaatagctttagagtggaaagttgacaggaatgaaagcatgactgttctaaatatcaatatagaagggaggagttttctgtagccttttaaaaatgtttctagtttatttttgttgtctctatctcctatcactttttaccatgaggaatatttacttagtagaaaagtacaagatcagaaaatttggttcttaataacttgcatgaaagctcttagggttaaaagagagttgacaatttctctgacgaaatgcctcttgtttttcctctggacagtaatgaagaataaagaataccttttccagacatcatgttcagtgtgaagtagtgcagcatgctgtagaaacacagaaaaacttgatttgtgcttgtaactcccgatcatttcacgaacaccagattcagtggcaaagatttaaagaaaaaaaaagtcttgttttctaggtgcaattagggaaaacctccttcatgcagacgctgctttgtatctttatcaaatccctgaagcatcattaaaggtctgacagacatcactgcctttgctgcctcttcccacctggcaaagtgactgggaaataatacccagatgaaatgacaggctataaaaagcaagtacagatcctgcaaaaagaagcgaaattcaccaggaggacaaggttacttgatcattttaaacttgtctttaattgaaatctgcttgaacaggtttcattgtccagagaaagaaaaaaatgccctttgaaaaacacttcaactaaattctataattttgtcatctgaggaaatcaggaaaacaaagaaacatctaacacattttcctgatctaagaccatgtcagaaagtatgttgtgaagttttgataaattattttataaagtaaatttttctactaagtgttttagtagattacatattccttatcagtttttttttccccaagccagggcattgatattgtggcatctgcaataaatgggaaagatttactgctgcctaaaagcatcattgtggccagtttgaccagatgcacagctgcaacgttttgaagtgcatcggagataagcctagagaagcagtctgggaagtagttttctcctgaaaagttaggggtagacagttagttggttaagactttgaaacctataaggaaactctgttaattttttagactagttccttaaaaaaacatcaaatcttgtattgtaaaaattgtgagactactttttttgggggtggggagaggttgttgtggggagagtagtgtttgaaagggattggtccaggcagctttgtttttagagacttgtaagtggttgtttttgttgttgtttaaaaaggttgtaaccactaattaatggaaagcaaaaaaaaaaaaaaaaaaaaaaaaaagcttacaaagggattgtatttttcaactaagaaagtattgtttagtcacagaaagaactgggacgttccttttcccgtgcatgtttttgacataaactaagctgtcatggcttatatttgaaaatgacattatcatatgtgaaacatgctcttcagtggttttaggactttattctcccgtttccatttttttttctgtctcagcatattcagcacattatgcacagagctgtagccttcaaggtcatagactgttgaaggctaattgattcttctttatcctggagcctgagagagtagaagagagacaatcccagtaattgtgtctgcagcgttgctccccaaaccaatctacctactaatgttagagttttattttataaatactagaattactccctcactgactcttgtcaaattacaacattctttgtctttgttataataaaaggcaaaatatgacattttaaattgccttaaggtatagtggctatgtcgaattttctaaaatgggtatttctttcataaagtaatatttcatattttcatgatattaatctatgcattcatgtaggtcttaagaagtccaatgcagaattggaatgaaagtatataagtatatatttttattctaaagtatttctaaatatggttaatggtttcccactaccacaatgattatattgtcatgatactaattaagtttttacttctcaatgagtcacataatacttgcactattcatttgttttgtctgggctttaaaatttttcctaccctgactgttgggagattgcaaacttagattatcataaaaagagctgattaattaaattatagccaggaaacagtggtaccatcttgaaagaaaatgttttctggatatgagatcctccctgcttgacaacagattcttggatgcaagaatgtgttggtattttcatcttgggccaactttgttttgctttgtcctaagtcttattatgggattgtatgacaaaccattgttaccgcagtgacaataagaatcagtaaccatttgcaaaagatcaacatgatgagttggatataccataggatttctttccttctatttgaaagtgccgttcatttaaattctaatgcatccttcttctagttcttggtaactatgtttgtaggtatttcagaacagtgattttaaataacttctccccactttaatcatagccgattacagcctaaaatattaaaaactggaagagactgaaagatcttctattggaactgaataatttcataaatttaccaatgaagaaacccaggctcagaaatgcctattgaaattcttttattaaaatatactaaactctgaaaaatgtggcaaaatccaaagtattagaaaatgtctctgtctctgagaatttaaacacacacactctctctctctactgttttcttctatcatcgtatccttactgtagagagttggagctagagacgaatgtagcatcagactgagaattagggaagtactttaagtgggaccactgttcaggtgtgtgtttagtgcatatcactaaaattaaattttcttctcgccttcctgttttgctcttattaaattttcagtcgtggtggtcttttccctttttattagatcatccatactttgttcagcttgcttctgaaaacagcatgggttgcctagggtgagttcttccctcatatatagcagattgctctgtggctcacttcttttcttcataacccattttgttttctcctctctattcttttgtgatacccaactcagacttcttctcccctttccttcctaccttcccaattatgtattgactcttttttatttttgtaattatgtcattttggctttataggtcagtatttcattgcatcatatcaaaataatttcaactgtctttaatgaaactttattgcattttaatgctgaatggcactttcatatattacaaacatacaaaaaaaatctctagccaatgaccaatataccagtttcttaatgacataattaaatcaaatttttaccttcttcttgatcttttcctcttttttttctttagtgtgcttgattccagtttttctgtttttggacatcagcatttctgtactcccagaaaacgatgttccaaaccatacatctgtgttcttcctccttccctcttccttttaacaactcttcatagtatccttttaaagtatgaaggaagaggtattttatagattgaaaaaccaaagcataaaaagttatgacttgtttagatgcccctgagaaccaggaatataacttgtccacagagtccattgaacgttctactacagcataaactacattccgtctacttttatgctcatgtttctacttttattacttttgctctacatcaatgctttgtttttcttctattatttcctctttggtttttttttgtttgtttgtttgtttgtttgtttttcattcagtgaatgtacgctaagtgcctactctgtgccagactctgttctagaccggttatatgacagtggaaaacagtagagtgcctgccctcagggagcttatgttctagtggattttaagaatctaattgcataatgcaatttgagatatttcttgctttcttatacatataccctcttcattcagcatttcttcttctttactgtcatgttattcaccttttgacttccactcctgtcttttcttaatatgttttcttctccatctaccaaatactgaacacttgcccagcaatgtcctttaactgacagcaatcccacctctgctaccaacaggctgagtagccaggggtgattcaccatatggcactatctaatcaaaccattggagtagtgagaaaaatttgatctgtctggccctttaggagcaccctcttaagatgaaaaatatatacataattcttctagcatgtacataaagattctaagattattttcagattctagagagttggtagctgtaaatatttttgtttctatattttgctcatatttttatgtattgttttggcttgcataacatcaagagtattaaaatattcccaagggtttttcatttcactgtacggacaaagactagaatctgccattaagttgtttagttcttaaactgaataaagacatgagttcatatactattcacatgaagagtgattgactagcagtgagtgaagttaatcctcatcatctcaaagctgattgtaatctttactgcagtgaattttatcgtgtgtatgcgtgtgtgtgtgtgtgtgtgtgtagacattcaaagggtgtttctgaataatataactagtatcttataatcatagaattttatatgctgaacatttttagagattatttgtgtcacttcctaagtgagaaaaggcaggtctggaaaagtgaagtgacttgcccagtgtcactacaaccaatcagtagcagtgctgagactaaaactgaagtcatccttacctttgctacacttgcttttcttctcaaaactgtttttagcatttattcaagtagcatatgttacgttatcataatttaaaagatttggttttcccatttattatttaaatactaattagtaaaacttttatcaccctatagcagatgtcttctttagagaagagaattttggccaggtgcggtggcttacgcctgtaatcccagcattttgggaggccaaggtgggaggatcacctgaggtcaggagttccagaccagcctggccaacatggtgaaaccctgtgtctactaaaaatacaaaaattagccaggggtgggggttcatgcctataatcccagctactcgggaggctgaggaaggagaatcgcttcaacctgggaggcggaggttgcagtgagccgagatcgtgccactgcattccagccagggtgacagagtcagactctgcctcaaaaaaaaaataattttacctttataatattgatatgtataagacacccctccggaggctggacatctgtctcccaacaatataatatatgagaaaatgttttaatgatcaacgttatcccaactgaaatgcgttacatacttagaaagaaattagttccttagtgcttaaagtattcaagcagtgacactgttgagggagatttatgttcctagcagattattaactatatttacttctgaagtctcttacaactctggttctctcagtttattgtctcagggtgttagctttccagtgggtagacttgactttcaatcctacttgtccctcttcatggccttgagcaagttagaccatcatgttaaatctgtttcctcatttaaatgtgataataataataatatacatgtcttgaggctgttaggagattaaatgaggttttggaaaactccaagtcctaggcctgagacataaaaaatatgaaaccagcaccaattttgtccctcattctattttaactccctgcctcactttgttctttttctcctttgatcttgacagtggtttggtaacaatgcctggagaatacattttggggttttaggggaaccttatgaaaaactttgaaggaagtgaagagttgatgatacatcatgctaaagtaggaattatgctagaaactcgagatcaaataccagctctacctcttgcatgctgtgtgactttgaggaaatcacttcacttgagatttagttttacatccaaacaaatggggatgttaacatctaaaactctcaagagattgtgataaggacaaaagtggttactgtacctaaagaaaacagagcttaaaaatatattgaattccttctttgccctttctatcagggttcgtgtatgcatatattcacaagtgctaacatttctagaaataaattgtaggggttctttaccagtgaattaatttgttatgccttaaaatggtctgtaggactttactaatttcttgagcccagtgtcataaaaggagtattttttcccttatacaaattggttagaatacatagattattacctttgagttacatagattattactttttgagtaatgtccaaaaatcactgcatgaggggcttcattatagggaaagcgataaggagttacttttgagagaggaaaagactgcatggtatgtaaaattgtgtttgtcaagtaagtactgtttttggaaagattgggacaacggaaaacaatctatacagtttagatgtggtgcaggggaagaacttggctagaaataccatgaatcctaagattatgttcaccttactctttttattgttccaaactgggatttcctgatctcaaaagatgggaattaacgtctatgagttgttttcagcatttgacaaaaaccatggaaataatatacatcaaataattttatatgagccaaatcaaatgtagaaattctttgagtatactacatctatgtgtatctatgtgtgtatacatacatacatataattcatacatataatattctaaataaaggggaaaattatttgacaataaaatgagcagataaaaatatttttaaatttggacaaacaggttgtttattaataggtttgggaggggtggacaaaaaaacttctagccctatgcctaactgctagagtaaaagagaaaaaaaagtgttttaaaagtaaaaaataattggagcttaagtatatattggagattctgttgcaagtaacttaaaatgaaatcttactagctggattattggccagaatcctacaaaaagggaagaagccagtgctgttctagatatacacacttaagggattttggtatttttgttgtataccttatggtttttctaacagacagatataagtttgtaagagcttgccatttacaaaaatgtatagtagtgggcataatatatgtatttttatttattctttaaagtagaactagaaatatgtgagatcctttgttcatcttgattgttattcactcaagtataatacctttgctgcagaaattgaactctaaatcaatactggagcaatgaggcagccccttcgaagcataaaatatttgataacaatctagagtatgttttgcctgggtataagttttctgactgtacaatggaaataagctgatggacccaataaaacttggtgaaataaaatggaaagcttcctcaggtaaaatattttaaatttttcatcagaaacatgataggacaagacttgatttactgtgattttcagtgataggcacttagtgtttgagttgcatttcatgaggtggttgtctcccagccaaaggagaaattcatgaactctctttgaagccagagttagcacagaatttaatatgcatgtaattatcaaatgtaaaaatcttcataatttattttagtttaaaagttattaatttaaaattaaaccaaatgtacatatatgcatatgcatttggaagaaagatgagagcaacactgaagacaatgatagttgccattaggaagaaacttaattcataggcaagcagaagaccctatatcttccagttcctaactgtgttgcctgtattggtgtacaatgtaatataattttgtttcccccgtttaccttccttttccctccctttgtttctttcatacttgccattcacagttactcttctctttcctctattctttcataccccacctattccttcttctccagcgatctcagggcacatggctccacacttctctctcccaccctgctctgaagccagtgtcctaaagcatcagaggttatagagtagatggcccagacctgtggtttctcactggatggttagtgggagagagtgaatgagaccttaaccacagtcttgaccatgattagcctgatgactttcagtgttgcctcttcctttgctaagtaacaggaagtaattgttttatgaaatatgttggtgtcacagcaataaaagctccatacataaatggaatgatctaaggatagtagaattgaactcttgttagcatttgtttgtaatcccttggtagagcttcctgggtcataattgcttgctcttctgggagcaaaaggaatcagtaaccattgattgttacatgatgctaagtactgcctacaaagcaaatcttaagaatgattagtggcagagttcagggttactactctgatctctttttactataatctttaaagcaagctgaatttcacagtttttcccatcaagcaactcctatgattcttcaaaaggaagagaaaaaataatgtcatgtaatctataaaagcttcagttgacatcaaaaacaaacaaaaatatgtaaaataattacttcagtttttttaaatcttcctacttccacgataacagggagacatctaaattaacccctgaccagtaactttagtcttgcatgaatatgatccttataatcttaattgatctgaactatggaacctgtggtacacagtcaataacctacatagccgctgcctatttagtaaactatacatgtaatcagtgggatcaatacaaggattctcaaaatccttgcaaaattcattcttcaagattgctgagttttctgaatagctgatgatttgtcaccttgaaacttttttatctattttggattgaaatcttttaataacttacaatactagtgactactgtcattttaaatgggatttattgaatataggatcttcacaatgttgaatactgtgatgtctttaggacatagttgggttatgttataactttgttgacccctgttatttcgttaggacatactgagttgtattagggattctagctcttttactaaataacccagacctacgtatgttctgattgtattttgggttattacataatcaaaattagcattacagagctttaagccaccttagagacactttgaaccaaatctcttattttatcacagagagacaagcccaaagatgttaaccttcttgccagagaccacatagagccagaaaatgttgatattttcatctcttctaggctttcagctaccaggtcactttgcaaccagtgtatgttaattgaaacattttttctgcacttctgatgtatagttctggtctcctgcaggtttaaaaggcaaattttaatcaggttaaacatttgtattaaacatttatataaaggataaaatctctctgagtgagattctctccttgaggaaatgcatacattttggtgacatgttttggtgacatattttgcttatatgtcactcttgctctgttctggatcaacagagttcaaggatgagaggtgaatgacaaatgaagaggaagagtaactacttggttctgatggtccttggatttatagcgcagatttaggggagctgagtttaattcctagatgttttatttgttcacttgttcctcctttcataatatgtagaatggcagtaataaatcttttcttttcttttcttttttttttttttttgagacagagtcttgctctgttgcccaggctggagtacagtggcgtagccttggctcaccgcaacctccacctcctgggttaaaccattctcctgcctcattctcccgagtgctggggctacaggcatgcactatcatgcctggctaagtttttgttgttgtttttattagagacagggtttcaccatgttggccaggctggccttgaactcctgatctcaggtgatctgcccaccttggcctcccagtgtgctgggattatagccgtgacccaccgtggccagccagctataaatctttagaccttgatcatgcacctaattggaaattgttttttgaatgtatgagcactactaaattagtcagtgggcttcatgggatctgttttgaaatttattgtgaaaccttatgatttataaagcacaaattacttttattttcatttcttgaggacaccatagcaccaatatttacaaagcacgtatctcataaactctcttgtgatattgaagacacgcctgcagcagaaccccaaacttcctgtcttccctaactccagctgtctccccagtcttcatcccgatggaccatgttttagccaactagaactcgaccctgaatattattttttctcttccatgtttttgctcattctattttttctactataaatgtgctcttcaaacagtctctcctctcccaaattctacttaggcctcaagactcacctctccaaattagatgatgggacccctcttcttgaagacctcctccaaccccccataacctattgcttgtgctttatcacatttagatttgtgtgttcttatttggatgcttgcttattgctcatagtagactgaccatttcctaaggcccagagttatagctaactcatttttatgacctgtatagtaccaaacagtgtacaggttgagcatcccaaatatgaaaatttgaaatctgaaatgctccaaaaatccaaaactttttgagcatcaccatgatgttcaatggaaatgctcgttggaacattttagattttggattttcagtttggagatgctcagtggtaactataatgcaaacattccaaaatccaaaacacttctggccctaagccttttggataagggatactcaacctatattttatatgaagtaggtatctcattcgtatatttatggaataaaagttacactgagggtaacttgcttatgggagtggaagaggaagaaaataatctgaaaccgggtcttaaatcactgacattttaattttgaagaattcaatatagagtttagtcattacaaactttgttgagacatgcttttggacattttaacatataatttgcaaagtcggacgtgatttaaaaaattcacatcatggagtttaagagacttcaggcagcaaagaattttatttcatgatagtatggtgattaagagcacacactttggaaccagattgtctggctttaagtcccagccctgtctccggctgtgtgacagcatgcacactatgaactatctgtgccccgattttctcatctgtgaaatggtggcaataactatactttcctcaggggctttttgtgaggatcaaatgagttggtgttcataaagtgtttggaatagtctctggctcatagcgctatataagcatgagctgtcgttactaggcagttttaacaattaaagtgcatttccttagatttcaagtttgatagcttgtgattacaataacaggcttcaggaaagggccaggaattccaagggacctattgacacagctatggatgtgctactatttattttggtttggtttgttcatgtggtttttcctctgtgtgatttatgtgttaccatcatacctgcattgttctcaggatttaggagaacagaaaaggataatcatcaatctacctgtcagtcagaaatagagcgacatggatggtttgaataaaaatgctgccctctctggcaaaatgccatctgttgacattgacatggacaatcatatatgtgtatatctgaatttattgctgtaacttcttattctgtcataaaatggtggacaaattcacaaggagaaaagtaacttatcttagttgttgaagaactgttgcaaaggctttgaattctgcaatgctatcattttaccaagacagaaatctactcattatccagatgcactcaataaattaatgcgatgatgggtcctgtcattgataagataacagtgatttggaagtatctcagtgttattaaacaagatcacagaagagccattaacattttaaaaacagagagatcttgtagataacctaatcaaaatattttactttactcatggggaaactaagatccagaattgtgaaatgactgggtcttaaatacatgcagctagtaagaaacacgggctggtctaaaaaacaggaatgccacttcatttagggctttttttttttttcaatatcccatgctgcttcttataaattagataattctttaatggtggaagactttattttttctgttgttctatattctttattgagtgcctgctcaatagagaagagtttacctctaaaaggagaacaaacaaaagaataataaaccagaaatcatatactatcttagcaggcagtacatcatatggggaaaataagtgtgaggagatcagagtactggtggaggagcatagttattttaaatagattaaaaggtacaaacatacagtctgatagaagaaataacacctagtgtttgatagattagtagggtgaccatcgtttctaagagtctattgcatgtttcaaaacagttataagagaataatttgaatgtcctagcataaagaaaaaacaaatatttaagatgatgcatatcccagttatactgatttgatctttataaattatatggatgtattaaattatcacatgtacccccaaaagtgtgtacatctcttatgtatcaataagaaataaaatttcaaaaatacccttaagaaatacataaacagaatggtcaggaaaggcttctttgaaaaagtaacagctgatgaaaggcttgaatgaattaatggagttaaccatatggccatatggaagaatgttccagactctgggaaaaggccttactgcccaggcagaaggccagtgtagtcaacttaagccaatggcttaagtgtagcatgggaggcaggaggtattaaatgagatcagagaggtgatgaaggcctgatcagggaagcatgccattcattgtaagaatgatggcttttccaccgaaagagatgaggaattattgcagagttttgagtgaccatgggacttgatgccttaggttttaatgggatcactgcctgctgtgttgagaatagcttgtggagaaggatcccaagatcccggtggaaatagtcggaccactgaggagattgttgctgtaatccagatgtgtttgtaggagttgtaggagggaatgtaaagacattattggattattagattctgaatatattttgaagatagatttagaatgatgtaatgatgaattggatatgggatttgagtgagaggagtcaaggctgatttcagtctaagtagttgaaaggatacggttatcaccaactgagatggagatgatctaaagatcattttgctcagtctcccaatgcataggtgccaaataaatcaaggttcttatcaaaattagaactgtggacattaccttctcataaaaataaagcgagatatgcctgagagcctcctgtaaatcaatacggctttatgtgtgactagagatccttataaatacaaaagaaaagttgcagtgaaattgaggatgtctgcctagactactcggtaacactatccagaacccacaacacgtgatgatggaatgaagtcccagggggatgtagaataggcttccaacaaaccactttattcctattttatggtttctttttaattcatcttgttcagcattcaaacctggttcaagttgttcagtttatctaaagcatattgccccatccctctcagctcactttcagtcatcttttaaactttatttcagaagtctactcatcttagaaatgtgcactttatccctaaggtgagctaagtactttcctctctttcctctaggctttgacagtatccagtattttccacccgtttcccatgtactctgctgacatgcatgtattcctcaaggtcaagcatttcttttatccatgtacagatgcttcacatagcaccatgtatactataagctctaagactttgaagtacttgcatgtcccaggtagaggtttttctcctttctctattaagctgtcaattttctatatttatgatgaaaatacacagcaaaagtagtgtaaatgcttattttacttctcaaattactcgtcaagttgccaaggtgccaactattttttgttccacatattatatcttctctacttcactttctggaaagtaaaaagcagcaaaaaggaggttatcaagagaggagaagcaggaaaagttctagacagtctacttcatttttctcatattctagtactctagacagggtgaaggctcctgttgcagaagtgatggtcacatattcctgcaaataccaagtactcagttcagcccgtgcctgcagtctctttacatccctgtcctcctctgcttctcaaattttacctactatgcaaagtcttgatcaggttccactcttctttagagacatttcctatactctgtggtcatcattaaactttcctccttagtctctattccagcagctcgaatcatctttaatactcatgtgtgtatttaaacatccatcctaccacataggtgtttgattcagtcatgtgtgttttatattatgaattaggttttaagtctcatctttggttttatttacctcctcatacctagaaaaacagattaagcacttgttctctacaaggccctgggttcagagtagtagaattgagagagacagaaagagctagtttctgtcttccaggagcttggtttcatcaaagacataaaagccttgccattaactggagtataaggtagtatatgagatgtatgaagaaaaaatcctttagtttgaggtgaaaaaaaaaaaccaaaaaggaataaggctaagaaggaagagaatcagaggcatcttcatattgcatggatagttgaggtgggccttgagagtaacatatgattctgatgggtgtggttatttcaggtgggagtaaaggcccaagggaaacagacatgttaagtgcatggtgagtcggccagttgagtcagtatgaaggaatttgctgatagcgaacatttattaagcacgtattgtgtgttcagtgctttgcatgtattgtctaatcctcacacacacaaaaaaaacattgttcctttttggaaataaactgatggtgtagaaatgatgatgatgatgatgatgatgatgaagatggtgatgatagtgacaatctgaatggtgcagaaggaaatgggatgccatgcatgagtctaaggaagactatgaggaaggaataccactgaactaattgaatgcggagaaggaaggaaacgattccatgcacattagtaatttagcggttgttagattaatgaatctctgagtgacaacctcatacatttattcaacatgtatttattgggttctcctaagtctttatgtatttattaatgtgcaaaatcagtagatttatgacaggaagtgacttgtgctccaatttccagaaaacattcattacttcttcctgatgaagctgctcagttaaataatattaattgttcttcccctgatgttatacaaaaattaaaattgatagaatacagaacttaaaagacatttttactttactttttgacattattcattgtttgttgctgatgaatgaaacctcttttcgagtgtgtgttccctttaataggcactggtaatttatgtactaagatttatttctgtatggaaattacaagtgaaatttcatattgaatttatatttagcctgttctagtacatagtctctgcatagtatatccatggcatcctacttaatattacagattcttttatattagtgctgctacatgtgtattctcaagcttttaattgtacaattattacaaaaagaggtaaaaatatttcccctacaaaattgttgctgttaattttttcctgtttattcatggagtattcaaagaagagctgtgtgttcattacattccacaagttagtccattcagtttgttcaaaatatgaattctgatgtccagcagttaatataagattttggcaggctattaataatggcatactcaatttgtagctctttcatccatgtaattttggtgatgtatgcactatgttccagggaaaggaatagttcaagattaaagaggcaatcagtgtattggtgcttattttcagtgtgtcaaagctgctaaatgaaagggtgcaatttctacttgtacaatttccacttgtgctgctcaaaaacaagccattgatattagacgtgtatcaagcatacgtggttgcagatgtaaataattaacattaaaaacattttcttctttagttgtgtatttagaacagtgatacttagttaatatcaacagcttatttttagaatctgaattttaaaagtagtgaaaatacttctagtgattaaaacaatgtatgaaaagaaaaaaattagtaggctattttaatataattagtgagtatgctattttaacataattcaaagatgcattcctattttaattaaagctcattcagtatgcaagaattccagtttccattacttcttgctgctgctgtctgatcttgtgtttcttgagggacacttcttttatgagcaattcttttgcatttgcacccagattccttcacgtccaaagcagtagtttaaaagagaaggctacatttttccattttggcctggaacttagatttttgttctgcttacttcttctttaagtatagtgaatatataaacttgtaggcactcctttgcagacagacttcagaatcacatgttcagatgaatgtgggaatgtaggcagaaatcagaaacctgattgtgcttcaccgcttcagaccctgccctatgaggccctccttgtagaagaagaaatggaactgaaccaataactgaagtgaaaaacccttctggaaactgtatatatgaaaagattccatttagatccattgaattttgcctttcattttcaaacttgcaaatagaagcagcattttaatatttttcaagagggggaaaaaaaagagcgtggttccctggccctattgtatcacttccattttgtctggaactgatttcatgcaggagatgcactggaatcagcatgcaaattctatgtggctgttgttcagtctgtttttgattcatcgtggtaaaatatgcataccatgaaatttgctgtcttagccattgttaggcgtacagtttggtagtgtcagatgtgttcacattgttgtgagaaagagctccagactttgtcatcttgcaaacatgaaactctgtacccattgaacaacaactcctggttttccccaccctccagtccctggcaaccaccattctactttgtgtttctgtgaaacatcatataagtggaatcatgcgttatttgtctcatgtgactggcttatttcacttagcacagtgccctcaaagttcacgtgtattgcaacatgcatcagaatgtccttcatttttaagactgaataatattccattatatatacagtcatacgtcacttaatgacaaggatatgttctaagaaatacgtcattggaccatttcatcgctgtacgaacatcatagagtgacttaacacaagccttgatggtatagccaactacacacctaggctaatcgatagaatcttttgctcctaggctacaaactgtgcaagtatgttactgtactaagtagtataggcaattgtaacacaatcgtaagtatttatatatgtaaacatatctaaacagagaaaaggtacagtaaaaatacagtattataatcttatgggaccactgtcgtagatgcagtttcctgttgaccaaaatgtccttatatggcacgtgatggtatatgccatattttgtttatctcttcttgcatcagtgaacacttgggttacttccacctcttaaccggttaataatactgatatgaacatgggtataacattctaattatgttttgttcatctgtggtgggtgtgaaagttaaaccaatggaacctttttttagtgaatttagtcaaatttctgaaaaccaagaattcctatggaaacatactgataaacatacttttcttattatatattaaaaatgcttgtagggaaaacccagcttctaatagtactctgggtttgtgaagatgcagtaagtgcttgctagagagatgtttttaatctagagagctagagcagagacttagagttcacttgtttcttctctttttttcaatcatttataagatctctcatcttaactcattaaaactggctgattgactttgattactgacacacccaaactatttcaaaccagttagttcaaaaatgcagttgcctctttgaattatttataaaaaggatctcattacatttttccatagataacgatgatggcaaaggggaagaagggatcattatgccactcctttaaaatgcgggcttctggcctggcacggtgactcacacctgtaatctcagcactttgggaggccgaggcaagcggatcacctgagggcaggagttggagaccagcctggccaaaatggtggaaccccatctctgctaaagatacaaaaattagccaggtgtaatggtgggtgcctgtagtcccagctacttgagaggctgaggcaggagaatcacttgaacctgggaggtggaggttgtagtgagccgagatctcatgactgcactccagccagggcgacagagtgagactccatctcaaaaaaaaaaaaaagtgacatgctggttaaaggtccctgtccatatcccccttttgcaactatttaatccccagcaaagtcctagccaggatttcctggtaagagtttttctgctctgcgttgtcaacagactattttctccaactgagctcatggaagtaacctagtttctatcactagtgggtctcagtcagaaaaatatgagtgtaggttattgaagtgtcagggttgtggtggccctcttggctgtgtgcttactggggatgaagtacatggtggaatgaaggctcttactagggagacttctgagttactagtttcaccacacagctgtctcacccagtatcttggaactgtttcttgcttcatgtgtgtgaaaaatatagtaaatttcctggtcatattttagcataattaattataccaactattaatttaatattttgtttgatttttagtttccagggtaaaacattaattttctctttaatttccattctataagattcctattgttttcagcaaataggagtttccttctctgtaagcattgctgactcaagactatataatgttagaaatagaaaaaagataagaacatgttagtatcaatagcctttattattataatcggtatgggcctaacttctgctagcaacattaaaaatcttttcttttactctatcatttagtaacggattttcttttggttgtgtcgaatagaattgtttccttgatgttccttgatagagagtgttctctttaatataggaatacagtaaagaaagcatccacagtttgtgaggcagagtttagtgctgatgtgtacagaaactcaagtgatatttagacaactgagtccttactgggaatcacttaagccttaaaacatctctgccattatgctgcttattttacattgttctggatagatgctcattatccagttctcattcatgatgagcatgggattgataagggagctgacatgaaaattatggagaaaaaatgcaaatagcaaaagatagaataaagcatgtatacctcatgatcattttccccattgatattgatttggactcactcttgatgtatcaggtgtgttcaatctttggcaaacatttagggttttcgtttttgctgaggtccacttgaaccctggagcccaaaagaagtaaccaaaaatttctatagcttagtaaattccatgttctagaacttttaatgtggacctcagaaaaaggaaataaccaagagtgccgaaagctacatgtactttgaattgttcagcatgtataaaacccaatggctaaccgtgtctagaaagaaggagataagtaaagtaagattggagcctggcgtttggagttcagcaacttttctctgttgtgcgctgacatttaagttaatagagtgatttctggtggatttctttgaaacaagacagttcatctgagatttggttaaaaaatatttcattactttgaggaagtgattagggttggtcttatttagttggggctttcaaaattgatagttttgcctgatggtatatgctaaaacattgaattgtgagtttcctagccagactggaccctaagcccatcatttggaaatagtctttcttatttttgttattcttgtatttattaaagaacattggactagtgaaaattacaaaagaaaggaaaatgacacaatacactacattctgttgtatcccatttctatctcagggaattatgtgtgtttaccaaactgatgtctagatgaacattcaatttcgtatcttgccatttaaaatttaacatcatgtgcatttttatgtcattaaatgtccaaacacctggaatttttacgtttgatttgttattgctaaaaagtacttctcttgatttttaggggttttcacttttaattaaaacatattcttgaaactccttctcttctccttggctaaacctgttatgctacaggacttcaggataacttgagctgctttggctctttgattaagtgcagatgtatttagggtttgaggtgaaagggtttttaggacaaatcgcattccagtttgagggaaaaagagagagaggaagttttggaagttacaaattcattaaatttttgcttccacatggaatccacaacttttccttttccctggctgcctttctcttcttcattgagttttccaggcctctcttccttctgcacaggctccaaagagaatggctgactataagggttattagtgatattttgggagttattccgttcttatccactctcccaccaacacacacactctcacacctcctcccatcaaagcttgggatctctgggaacagggaaacatatcaagatattagaagacgtcaatgttatatatgcagaaatggtgaaaaatcaatgaatttagtaagttaaatttgtttgggtagcattttaaaaatatttaagtactttgacatatgttaccccctaatacacagagggtgctcagacagcatttgctacaggagtgaaccctggccaaagctgttttaaccaagggacagtggaggcccagagaggttcgttggtttgcttaaaatcacacatccatgggtaagcaaggtgatggataatcagctcaattgagtcagtttacattgtatacacataacaaagcatcatgttgtgccctgtaaatgtatagaattatgatttgtcagttaaaaataatattaataaagtaaataaaatcacacatctcacattgagaggagggcagcctagacccagatttctgttagccccaggaattgaggcatatatgggagactagcagacaacacacataggaaacttttgccacttaattattattctttttctcaagaccactatattcatttgggtttgttcttatgcttttttttttttttagcaaattaaaaaaaaattatccttgaatgattctaggttagctttttgactaatggatgttggaaggagctcagtgacaaaggccagggattattttgcttttcctcacctcttcctttgttcctcctcatcatattacaaccttctgcttcaggattccttctgctttttagcaggattgacatgctgggccttacccggaaaggcaaaggctgatttgattagggaggtctttgttccaggtatctcacatcagagagccttcataacaaatgagaggaatggattagaagtttcctggggataattttttgtctaccctttaagggaaatcttgccttcattaattacatctcaaatggaatatgtggaatatagacattttcataatcaacaaggtgattttcattttaaaatgcttaaaaaatgttaagcagcatgtatgcacgcacacacatgcaaccaatttcttccacctttttcttgttttaattcttaaaatatgaatttttaaatataaggaaaatcctaaaagcagaaactaataaatactaataaaatgttaattacattgattaaatcattagtattttaagatgggcccctgaaatgtctccataaataagcttaatgtgctttcatttaaacaacaattcagttagtaaattcaataaaaagcaaactaatgtgacataaacatatttatgtgattagaaaatcattatatccactttaagtgaaaagaaaaagtcttcatttttgtgttacttttccaaacctccttttggcactgaattgtactttatgggggtgtcttgtcatttttttctaaattaactacacctctgcttgcctggaaactagagccattctgacttctattccgatatgtgtttttcatctcctactttttttttttttgagacagtcttgctctgtcgcccaggctggagtgcagtggcacaatctcggctcactgcaacctccacctcccgggttccagcgattctcctgcctcagcctcccaagtagctgggactacaggcacgtgccaccacgccccactaatttttgtattttttaatagagatggggtttcaccatattggccaggctggtctcgaactcctgaccttgtgatccaccctccttggcctcccaaagtgctgggattacaggtgtgagccaccatgcctggccttcatcttctactttttttatttttaaatattttttattcactattgctgacatcactctcctacctactcggtattctttcattatgagaatctcccacatgaaaaatagtggcacctctggaactcccaaattctagtttagacagattaatccacatttatgttactatttataacagcacaactctgtaaataaatccaaatgtccatgatttattggttacatgttatgatattctgtagaatggatattattgtagccaaaaaattaatttacataggtacacagatgatgacatggtaagctttctttaattagaaaatgtttctttcatttaatatctttcatcttaagatcaaaaacaatcttgcaatattgaccttacagcactgttcttctgttatcctcattaaaataatatcaataacaatatagtaataatggccattgttgttgttatgttctctgaggcatttagctcagagaatgttgagaaaaaaacctgacaaagtacttaaatattcttgatgccatctctctcactcttcataggttgtggatataaagaactctgtttttttcattttttataagccacaaacaatgaagtaatcatttctttgttaaaacaagaatgtgcagattattctcactgaaaagttaaaattgagttgtatttaagaataagcatctagtcttgaccatagtgtttatgcctataattaaaacaaaccaaagccaaaaacatatctttcaaatggtttggtgtcacaccacaaagcgagttattttaaagccattggaggattctagcaactgagcaaataccgctgatctagtcaatatcaattgataatgtattatatgaaggaaagtaaaatctctttcaaaactttatacatgtttcaattcagttaattatgtaataatagaaatggcactatcatataagagggtagatgatataatttatagatcattttatcacttaaagcacctctaagtgtagaaatagaatcatagaacctcatattcaaaagcctttctgtttatctatagtggaatcgattaaatcatatttgtgtaataaatgacagtcataacaaatacagtaattaaaatacagttgttttacaaatcactgtcttccactctttccacttccagcattttcttttgatgggttagaagattaaatagcaagttgtaattttaagttatggctctttgacagtggaaaatggattaaaaaaacacacaacaacctactaagtcttgtagtttcttccatgtggtcttttcttatctagagatagtaagtcaggcatctacaggaaaagaatccactctagtgaattcgtgcctgcctttgaactgtgaaaatcctttgcattgccccacatttctaaagacccatgaattgtgcggtcagctagaaatatcctgtttcaaaattgagattacgtgacactgccctagaatgacacttgagctgaatgctcttgtccactgctgtagggtacacatgaaaccttttacttagaaatttaaggttcttcatgtggctggaaaaatgccacaacatgacttttatcaggctaaaatttactgtgtcatgacgaaaattgaataaagtaatcttgactcattttaatttatttcacctatgtctgactccagctttatcctaatatacaggacaaaagttatttccataggagcatctattatttgcctctatttctaaccctgtacaggtatgttagaaacactgaacataattttatatatgtctttgtctcatcaatacagtgcagttttattttttaactgaagaattcgtgttttgacatataaggggttaccagagctatccaattttattttatgaaacaaaattgtaattattcaaagtccaagacatgaacagaaaataaaaagtaatgtttaattcatgtaagaaagcataactgaagctcattagtcaaactaaaaagctcatgaaatttctcacctgaatctttcctcaccctgggcagagacttcctttcaatttgtgctcaattttaggcaacatttaaggatctgaataggcaaagagtgagagcaatgattgtaaatgtgttgttttaaaaggtttctccactaaattcgtatatgacaactgaaaaaaaccttgggacaatgtcattcagaccacaggaaagtgcttgaatatgttctctgatgctctttttagagcagctgatataaaaagcaaagaattttatgtccaaaagacttaggcaaaatatccgaacggaatgctgaatgcatggcttttcaatttatcacagtttatagacactttacatctatagtagtaatttaatttaatttcttagaattatggaaagaacaaatggtatcatttagtataaatggttctctgctcccctcacctccggagttttaaagatggtaaaactaggactcagagatgtgaagtggctcacccttgatcacacaaggagacagtgatatattttggttgagcccaagtctccttctgaatctagagctatagctgttaaactaaggtacttctcaatcatatccatggagcaaggatgtgagagtagttggcttttgtattatatgggataccactgcaaaaaagtaagcatgacagtttcaccttaggggtgaatttcatgctttgcaccagttcaatacaatgatgagagaatggctctcatggtactgaattggacactgtacaaattcatggtgttattcatattactggccataaaaagagcaagatcacatttatatatgttctggtgaaaattactctccagtgtttctgctgtcacctacccaaaccaagctgtatatttttttcttgagaattttgcatccatactgtttcttgtttggtttgcactgacgaagaacattcttcctccacagcacagatctagttatttgcaaaagatatttttaaaattataagcaaatgttgatttagactccttacacattaattaagagaagcacttttgtggatgttctttggcttagttcaagactttgtcaatctgacttttcattaagactttatttattattttccccaaaaagtacttgttgctcagatttgaataagagtagtttacttgtctacagataaaaacaccttggctgtattcaaagagtaaaatatttaattcaaattttaggctatctgaattttatcctttctgcttagaaatgataaacaaatatttattcttttattgagcaacagctatattccagaactgttttaaatgcttgagattggggaatagagataagtgatactagcttggtatgcacgtatatgggtgaccagggggattgttaggaagaggaagaaagagaactattacaaacacgcatttataaggcagcttttaatcatcaataaaatatggtaaaatatgttagtttattaattatttgattaaacacatacttttttgtatgtgaaatactcaagttaatttgtcttgtttatttggccttgcttgaatttactaagtaaacagaaatttctagccattctcaattcaaatgaccacaaattgagagaatcaggaacacttagatacttagccaacacttttcactaacttatttaggatatatgcctgagatcatgacaataataataatcatggtaaaagtagcaattattgttattttaatagtcataacagatgagtgttgccatggagtcagtatcacaacacagccaagtccatctgcctcattttgatgttttagtggccacctaactgataccgtctggtgacactcaggtcagtgactcccgctttttctaagggatggcctcagtggtttggggaaggtgccaaggaaagctaactggggacttgctcctgataagtcagtgatcatggaccacaacaggtggccatgaccccaggggggctttgcacacttggaaaggtggagttgtgcaacattttgctgtctggctgccaccttcagtggcagatctattgccacttgggttgtctttctcataattatgttccgtatttctcaatatgacagaagtttgttaacctagttttagttctaactctgccatttactgctcatgtgacccttggcaatctgtttaaattttagcattttcatgtttttcccacctataaaattaatatacttttctcaggttagctgtgaaggttaaatgagatgatatatgtgaataggattttgtaaactttaacaacggctgacacttactcaatattggctatggttttatcagataggcatggattgagttatgcagcttctctgttctcaccttgtccttggtgcctggggaatgtctagtattcgtagtcagtgcagtcatcccagttcctgcaacgtggtactgataggaggaacaacaatcaacatttaagttttgtctaacttgcctaagtttcttccatttacagtaagtgatgagaaatggggtataagtgtgagatttatgtcactattcaagtggggatggttaagtcaattaatattaagtaatattatttaaattaattattgtctccttgactctaatgtaggaatacattatataaaaagtaaagattttgtcatctcatcatccacagtgttttgcatgtgctaggttcttagaaaatacttttttaatgattggcttttgtgtttacctcaagagtatagagagagactgaaaaatatgtaaaattatgataatcctgaagtttaaggttcatgaatcaaattttcctcttcaaacaggtgaataattttgaaatttattagtaaatatttaagttgactctttcccaaatactgcctaacttcttttcttctataattaagtcagataattttaggaaattggacaatttagtcatctttctatagcatgtacactacagatgactattaaattatgattccttcagaatctttattttacaagaatataattaagcttggctcagtggctcatgcctgtaatcccagcactttgggaagctgagcggggtggatcacttgagctcaggagtttgagaccagcctgagcaacatggggagatcctgtctctacaaaatatacaaaaaattagccaggcatggtggcacattcctgtagtcccagctacttgggaggctgagataggagaatcacttgaacctgggagacgaggttgcactgagctgagatcatgccactgcactccagcctgggtgacagagccagaccctgtctcaaaaaaaaagaaaaaaattattcaatcatttatattttctggaattttttctaaaatttctcccagatactttaaaaatactcctgcaaacaatttccacttgcctagcaggccattcagaccacagaactaaaagcaaaatttatcagcctttccttccaatttgccatacccccacaaatcgcacttataaagtcaagagtaagcacatttctaacaaggaccaaaacttttttctcaccaatgacactttcctatatcaagtgtacctaatcaggcctatcattaagaaacacaacctttgctgtcctctgctatatcacatcatcttttcaattcagattctatttacaaaaatcctctaaactcattggtttttctacaatggtttttgatcacattatattactgacaaatgctatttttatctcctatatgggtgaatcatgcatattaactctttcctgggatgatggacataaaaaatctcctttagagatttaattacatttaaattattttcaagtcaagtagagtataaattcacattttacaacagcccatcatagaagtctcactggatttgttttctttccgctaatgtcccaggtcacctatctgaaataagctacttaaaaaggacagggtggggagatggcagagaactgtgctgcaggtttgggaagcaaagaaacaaataataatgtaaatgtcatctgtgatctaagattgctatcagtatcagatattttggcttttggtcctctagcctacctaacatagacttttttttttctattcaaaaaaatattacacttgtaggaaatgactagtgttgactttctcactctgagtccaattacgggttctttaaactgctcatcgctagtattatatgatggtcagctttaatgagtgctcagaagcactctcattatatacaaggcttttgaaataagctcctgtctcgatcaattgcttcaccttcttcagagcaattagcataagaataaaggaggttaaattggacttccgggctttggtgaaattaattaataccacttcaccggtaaggacaataagtagataaccattttcattactttatgtgaaagacagattatcacatgcacagcacccagactagtacaaaagtaacccatgctgaatgtgctatcttttaagtccatgtattatgaaagatttttttcctgtaattttaatagctcaaaaaaagttttaatttattggtgacgagctgggtaaaggttggccattacatactggcaactgcttgggtaggatgtaagttgaaaaatataagaaaaagaatggcattaaaaaaaaagtagcctgactgggtgctgtgcacttgtagttccagctactcactaggaggctgaggtgggaggatcgcttgagtccaggagttcgagtccagcctggaaaatatagcaagacatcaccccaaaataaaataaaaggaaaaaggaaatatctgtactcagatataataagctatctattctagacaaatgactgattagtattttcatgctcattcttgtacataaaaggtaaagtgtcctataaccatcatattttttggaattccagagcataatgccagcgatttaactgtatggatagtagttaaatccttaacaatatatagtacatgttcattttctaaatagtagttttaatgttataaatgaaatgcagcttttgcaaattgaaaatcatgataatagaagtctgtaccctccctttatggcccattaactatctttgcatcataatatagttatctttctcaaaaaaattaagcatttagctctctcaaagatgctgtcacttttttaccctaatacgtaacaaagttgaatggactcctttcctccactgttgtataaatttaatctacattacaagataccacactactattcaagatctatttgagtgtttaggcatttcttaccaaaataatctgatacctactttttaaagaagtcaactggtcatgtcagtgaaaatggcttaattttggcatatagttagtaaaggctaaattgcaagtccaatctatttttctgatcttatgtgttcacctgaaagcaaaataatgagttcagatattcttgcatggaaacatactcattgtgatcagaatgaaggaagttattgctaatgcacttacaaatatgtttatccctgcgagctaatgtgtctcaattcctgaaagtcattattaccttgctcctttctagtattttaaaagatgaaaaagtgataaatttcaaaataataaaacatcattatttttgacattgaggatgtcattttgtaaattaacctatgacatttttactttttggttaatccttcagatttactcttcattgcttttaactatgaattaaagtaatgagttgaattaggtaaatgtctaacataattaccatgtcctcagtaaaagatgattgttaatgtgtctgatgatggctggttgactagaaattatcttcagttccacattttcaaaatgaatgcaccgtgggtggaatggaaaataataatttaaggcacattaaccattaatatagatctagggtgaccaattgcccctgtttgcccaggacagggaactttgggttttaaaactgataccaaggggtacctgggatgctgaatgttcagtgctaaaaccaggaaagtccaggcaagtgctgagtggatcaggctacatagattactgcacaattaattatagtaaattgattctgtatgcaacttaaataaacccagtttattgaggcatgatccagtttgcccgtgtgagaacctgatttctgtgaacatggagatttagccataggtggctgaaggagagacataatatagatgatgatgttaatgatagcaatggtaaccatttattgatgacaggactggacttttttaagacttagccaaagataacattctctgaaatctttcttgatatccttaccctacccagaattttctgattcttcctttttactcccaatgtaacctgtgccgaagtttattataatgcccttaaacttccttatttgtttatttgtcttcctctgctagaatataagcttctttaggaggatagaggcattatgttatttatctttgtaccccaagcatccagtatatttagtgaatgaatgaatgacctaggtatttttttttactcttcaaagtaatacaataaaatacatgataccatcctgttttactgatgagaaacaagtatctaagatgttctgtaacaagcataagaatacgttaataaattatgaagccaaagatggaaaatcagatctgtctgattgcaaagccagttctctttccattactctgtattaaataatgctggccaaacatagtgacttggaggaccctctcctttcagtaagagagtaggaatcagatatacaaatgaagactatgtcagtcttattatggatactgatgaaagttttctggtaatctgcaaaatagattttatagataattgctgtggaaaagaagtgactaaatgtaaaatataatctctgctggtatgtttagaccaggaaatcaaaatgcatgacctagtcagacaaagcaaaaggttctttacgtgttcttcttgtatcatcagtgagcctttttcatttaagtacaatgaagtgtctctgccttaagaaattcttcagaggcagaaattcattattctttattaactcactgtgcccttctccttcttctgcaccttttcctgtgtattgtctcccattttaaaatgtattaactgagaactaaagatagcaaagtgttgtcaatattataaagtatagtaagacagcatagaactacatggagaatatattgataacagcatcttttacacagtgatgaattaataattaaaccaaacaaaaccaaacaacaaaacagttttacagctacttgggaaatatctgtaaacaaagtttcataataattaactcttggaatatcgtcacttgtacaaatgctgcaattctagcaagtttgggacacttacaggaaactgtctgcaaataaacatgtataatgattttagtgtatatgacatgaaacagacggcgacccatttattaaggtccattacacagatataggagggactttaaaggcatcacaaaatacttgccaggaagtaaatgttgactatttccaaatctcagtgcaaaatgagatagataacgttaacatgcacatggagtaatacattctttaagtacctattcagtgaggacctgctatgtgcaaggcacgtattccagatatatattaatgaaaattgtgatcagttaaaaataaatgttactattttcattgatctcattttctattttcaataaatcaattacaggtaaaatgtgttatgagtgacaaaatgactggaaagtttttgccttaatcaaaatttgtgtaattattttttgtaggtaatcaggtgatttagaagcttaggaaattatgatgctatttttatagttattatgctattattatgatgaatcacccattcatgtgcattaagcagcattgattaatatttagattttcagcgttttaagtgtctgtaccttatttacatattattaaaaagtcaccttggttgtaatcatctgtcttcccatgatcacaatacaggtttgtggttttcaatatgtcatgactaagaagagattttatggtgcttaaatatgtagtaaattcattaaaccttagtcatgagtaaaatgatccctgtaataccactagttgcataatacctgcttctgatgcctgcttttaatttttctaaatacattggctggtttctagaagataaatgtaatattctacagagctatagactgttttgccacttggaatatctcgaacagttgtcatgggcaaggccgcaggtgctatatcccaagtgtatactgcttttatttttacatgtacaaaatattagaataataaatatatggtaaggcttctagaaatgaaaactgttgtcaatctgtaatttatagaaaatttatgtaagaaaacttatgttgtcttttaagcaattctcctgcataataacttagtttagagtaagaaatatgcatcttatctaaactgatttatagaccacatgctatttttacaaatatttaagaaaattcctagataaactttggaaccaaaaacaatgtagcctaataacaatgtcaactatacttacagtataattttatatataaccttttatctttataataataaatactatcacagccatttagagaaggcaattttagtttacctctattgcttaaaggctttagctattatttatgcacaacaagaattctgactttttaaaattagttttaaaattttggatcagctttataaagaaacacattgttgttaagtgcagacaaatgagaaccttgccatttctgcatttatgaccagaagccaacagagtcaattttcatgtttatttattctttgctttagaatgttatgtcagttgacagtattcagggcttgtgttgatgtaaattgccataaagcaaggaaacacgggctatagtactgtcagggaggctcagcactgcagaacaacacaatttaagaaaagcatttgcagaaagattcagtgtcagtcttcggaaattgactgtagatgcaaattggcatcaactacttcacaatctccctctaacaaaagagatggaaagggtggaatcaccaaacagagtgcacttttcggcatagtagctttcatgaagacaaaaataggatcccatttgttcattcacaatggatattcagactccacattctgccacccccatgttttattggagcctgcaattctgccaggagaagggttgcctcatgctaattcatcctaatgtttctcctccttcctacataggggaagtcttccaacccttcctactttttaagattagaagaaaagattcctcttaagccaaccatctctttggttacctttctgtaatgcctttatactgatgaaatgctgttatgttttacctaagttcggatattgtcattgtctcctgctgactcaacatgcattgtagccaggatcctggtctaaattcctgttatacaaaaccctgagctcttctaatttgcttcttgaaaaaaaaaaaaaaaaagaaaatctggccaggcacagtgggtcatgcctgtgatgccagcactctgggaggctgagatgggtggatcacttgaggccaggagttcaaaaccagcctggccaacatggtgaaaccccaccgctactataaatacaaaaaaactagccaggtatattggtgcacgtctgtgatcccagctactccgggaggcggaggttgcagtgagcagagatcatgacactgcactccagcctgaacaatacagcgagactttatctcaaagaaaaaaatagtcagctctagaattcttagggcatagaggcaatgttaacaaatcagaaggtacattaccattttaaaaaattttgtcaggcttatactcagatctctttaaacattacctacatttaaagaattattgtatgtaagagataaacacacaggaaaaaatatttgatttttgcttttgacctgtgtcattaaaataagatgattctccttatttctcaagaggcattccaattttaaatagagtggtagggaaaaaagtgattttagcagggatttacctgttcgtttgtactggtaagttatttttgtgttgataaattatttacactttaatggaattgaggtgtcatcatcttccatttatattattttgccttcctttttcacaaattttttactattaagaaagctacaagaggtgttatttgaggaaacagtcctataatatcattctttttttaaaattgacagtttcctcaaatatttatgggggaacctttctacttctcaaatttgaacagacaactttagtcaatgcttagcattgattttttgacaactcatgtccatttcaacattttattgtgagatagctaggaaattagttgtaagagcagaaaggtaattaggtaggtggtataaaatttttgacagttttgacactactgatattttcaggaaaaaaaacgcatacatatcctagtttagagtaagtctagctgaaaatttaaatatatttttaactgaacataatttttgagtttgagataattttagatatacatatagttgtaggaaataatacagagagaacccctgtaccctttgtccattttccccaatggtaacattctgcaaaaccatggaacagtatcacaagcaagatattgaccttgattcagtcaacatacggaatattttcatcagcgcaggaatgtgactattaaaaaaaatttaaatttttgaggattattctacctccaaattctttagtactaaatattcttacatctagacaaactaaaataggatttataggaaaaatgatttgactagagagtcaatatgcctgaattcatatctcagctctgccaccatcactggtttaattacatttggggagtcacagcgtggtggggcctcaatttattcttttggagggacttagtctaaatcagtgattgtcaactagaatgaaagtgagggaactcctcccttggagacttgtcagaatcttggaggagacgttttgcagacaaagcccaactcttttccctccacactcctacctccaccaccatcacaagcaaattctgatgtttgttcctagacttctaagattttgactccctcatcttccattgaggattgcttatggaaacaacgtaatagattcctagcaaatcttcatgtatagtgtgtcagcaactagtctcaagtgtctaacgttcttttcaactttaaaataataataagaaaaaatatctaccaagaacactaaaaatctttgtgcttcacaccatctagctgatgacgcataagagtagaggaaaatgtggtcaatacatgagccaaattcagagtggtgcatgcagaaggcttcctccaacagggatttgagagaaaggagatctgaggaaatccagttccactagggaatgatcccacagaaatggaatcttccagcttgagaacctgaagaaagtgactcacactacatgagaatttgaccctatctgatgctactttcaaacatatttgagtatttatagtttctaatttttggaatacgtagctttctctataattttgataccctatctccagaaaagatttattataaagttagagcacaaagaaagaaagatacagttgtgtttttatcattacaattgctgccttaagcatttctttctgtggtctagtctaagttattaaacctcattagttttttacttctggttagtgctgtctccttgattgtggcaaatgcaagttaccaatatgactctttgctacttctttccataagaagacaaaatatatggcaaaaagagaaaaaaactctaggattccaaattataagcactactcatattgaaagttagaaaaagaaaatgagcctgaactgaaaatcaaacaaaaagacgagaaaaggaaatggaaataaagtttccctgtatcccattagggttgatacattaaagaaagagtgaggatagctggaaataatattttccttcaaatgacagctaaatgagatctttggagctgtgccacaatgagtgaagtcagggagacagggccggtagtgacaggaggagaaaagtgcttcttcatgtgtcagccctgggtttaaaataactcagaaggtataaaagaaattccctcctcagatacaagattatttgtgggacacctgattaccatttaagagatatcaacagttaaaggaaggtgatttaaatctggatagctcccttttaaatccagccctctgattctataaggcaaatgacaaggctgtctagacatggagtacattgagcaaggtttagatgagggagccccggagactgtgagacagacctgttctgtgcctgagaatgtcagtgatgactcacaggaggtggagaaaagtgtgctcaatgtatgggccaggctcagggagctccttgaagacagatcatttggtattaatgatacagcgataccacaaagcacaggaggtgtagcctgctagcattgaagttaggaactgatttgaattaacccagtgtttgaatctggatgcaagagcctgtatggtatcttgcatgctaacttcttcataatcttgttcctgaatgggtgccagattgaggagtctttgggatagttgatatttcttttaaaaagcctgatctatataaagctgtatcaaccacgtgcaaccactttagcataccactctatattaatagaatagaaaagataattagcagagaaaaagagccaaggaaagctaccaagaattagtgaaatataaaatgtgttcttattatcccttcctcaataaaggggcaaacaaggttgttctggtatcatctgtgggaattttacacaaactattttaggaggaaggtgggtgactagatgatggatggatggatagctgatggatggatggtggctgaagtgggtatgtgcattgaaagaaactgcaacagagcactatcttctgaagtcacttgaagttatcccaaaggtcaggggaagaaaagggaaaaccagaaaccacatatgaaattagcaaagctgagcccgagtctgaacgcactgtgaggaggaagcaccattagggaggtgatccattgccagtggaaagccagaagctcagaaccattagctgagaccgtgctcctcccaggcagggaccctctagttgcctggggagatgatctgaattcacataggaatggtcgttgcctcttccatgaggatcatgagaacatcactaggtccaaaccacaagctgttcttgtaaaagatagagtaaatggttacatcaaatataatcataactgtagtcaacctgcagctcagagatatgtaagagtacaagtaaagctctttatccacgtgctgaacatttttattaaaatgtgtgaatgaaaaactattttaaaaaatagaccaggcatgatggctgatgcctataatcccagcattttcagaggccaaggtgggaagactgcttgagatcaggagttcaaatccacccccatgagctagtcacctcccaccaggtcccacctccaacaatggggattacaattcaacatgagatttgggtatggacaaatatccaaactatatcaggtggttactgtagagaaggggagaaatgaactcccttaacgttccagctagatcttacagaagaaaataggaattagttttgatggtatacagaaaggaaaaccatgtgaaaacaaggcataaggctaccaatatgtttaatgagaataaaaggaagaaagaataagtgactaacatacgtacgaaacatgcagctcttagatccatgttccttcagtgctctttatacttttcatggcttttcccacgtaagccgctcaactcacctaaacttctgtgccccataaccagtttccattaattgacattataaccatctttcaaagcatggagcagatacggccctttttcccagctacgaggatttgtcaaaagcagctttttaaaatggttatcttcgaatgtgcctaatttttcttatcacactgtaaactttttaagtcaaaaatcttatgatcaaatcatcattaccatttattacttttcatcttcacctgtctgcctcccctctgctcaaccccagcccctcatgcagtacgtgcacaataaatatttgttgaattatgaatgaatacctaatattgacatgcaaggagtttcatgcctcagttaaaactcccagaaaatctttttccagtccccagttagagccagtgtaataacagtgactttttttcaacaattacttaaataacattattaaagcaattgttgctttaggttgttcattaataaaaataaatgtatattttctttactgttagaacagtttgattctgtatgaattcctattcctgattttattatactcctgaaaccacagcttgctgctggttcatctattaggcatttgaaatgttgaattactttgaattgcatttgttcttatattgcctaggctctggttggcctcctagggtcgtcacaccataatcttaaacacaacatgtgccttgtggcccagatgttttccaagagggagtgctgcagccaagaaaagcaagatagtatcttgaatacccaaaggggttgatatgactaaaaagcaaccgtacagccaactgtagagctgtccaagaaaaagtgagcctattatttgtatagtttaggtttttgtgatcaaatagtaaaatttgcaaaagtttcatgataagatcttttgcttcacagattctcgtaatatctgcttttgtagtgtggactccagtgttcagcagtttgtagataaaactgggatcgtggcaacaataagagaaatcaaaaaaaaaaaaaggaagagttcatggactcttgtttcttcataaatgtgacatgataaaaattacctttctttcttaatatttgaaaataacataaagaatgaacaaagattgcttctagaactaaacttggattgaggcaacttaataaacggctgtttgttgttgtttctgttcttttcttctgacaatatttaccttttatattcttgtggagagctgagatacctgcaattgtgcttttaaaaaattgttctgtcttcttgcagtgaggtctcttttttggcttacttattaacaaagaagcaaattacatatatacatatactttatgtaacatgtatacacatatgtatatgtaacaatgtaatgctatgtgtatacatatatgtatgtgtaatatacatatacatatttatacatatgaaatataaatatctatatttttatttcatttacctactagctgattcacatcgttttcataaccaaaatatagctcatggcttgagtatgaaaccctgacaaagtatggaatttcacatacatgtcatgataatgtcctagtcagattcagtcctacctcttgcttctgaaaatgtgctagcttctgttctaatcctaattgcatgaattagttcattgtccagtttagaagagaggaacgagtaggaagctgctttggttctggggtcaatctaggacttcaggtctattttagggaaagcattctagaatgtccttgcccttcctgatacactttgatataccttcaactttgagatcattgacttagtgttatcttgaatgagggggtccaatagagccagctactccatgctgatttagatctcaatgcttttgaaattcaagtttttaaagcacttgactctctgttttctccaaatgaaatcctattttgtatttaaaacagtaagaccagatttccccttttgaagtaattataggatcccaagaacccttaattccactggtcccatggtctacttatccccccgccccccacagcaagtcccttacccctgaggcagcttcagcgactcctccactcacccagcactgtaggaaaatgtctgctgtgctccagccagagcagacctactgtattgcaaatttatcgtggctggaccatcctccagagatgtatgccataaggacaatggaggcctcagctaagtacctcctgctgcattcattcccagggtagtaggtggtatagctgcaagacacggaacccagtattaggccttgctccattttctctaggcttcaaagctctgagccagtgatagtttataaaagcccaggactccaaagaattaaaatcagcacctgtagatctcctggtgaagataaactccatgggcatgtaaagaaagcaataaagatacacacatagtttttttttttcttttgaatatcaacagtaaccttgagcagagtgactctttatcagggctcttggtacttaggctgagctggtgatcacaaaggaaagaattagaaatttaaggtgattttattttattttatatttttagtaggagtatctggctgctatctaaggaatctcttctattagttacatggaaacttggagattttattgtttccctctcagtgtgtgtgtgtgtgtgtgtgtgtgtgtgtgtgtgtgtgtgttagccatttattaatcctaactcccccaagaaaagacaatctataaatttcattttcactcacattaaaaggtgagatgcaggctgggtgctgtggatcacacctgtaaacctagcactttgtgttgacttagtgttatcttgaatgagggtggacagatcatgaggtcaggagttcgagaccagcctggccaaatggtgaaaccctgtctctagtgaaaatacaaaaaattagctggacatggtggcgggcgcctgtgatcccagctacttgggaggcaggagaatctcttgaaccaggaatgggaggttgcagtgagccgagattctgccactgcactccagcctgggcaacagtgccagactccgtctcaaaaaacaaaacaaacaaacaaaaataggtgagatgccaattctcttcctgactctgcactccagtgcagtgctccatttcccctattgataataccaccccaaacatacctatttttccaggaccacatttcttcaaattgcactagtcatgctgttaagaaacacagaatctaaaaatgatctgagaaaaagagaattgcaattacaaccacaaaattttctatatactagtgaatggataaagatatttattgtgacacattgagcaatttttttgaaagttcatgtactcttgctcaactgattgaaactttgggaaaatgtaactttttgagttgtaagatcatgtaaaagttaaatgaaggaagaacagcaaagaagttatgggaattgttgttgtgattaagtagttaaatttgtatatttttttcctgctgattagggagttgttactgaaatacgttagcaggatccttcttttagcttttcacatgaatatttgggttgctttctgccttgataattaaaagagaattgtgtatatcttgttttccctaaagaaaggtgatactgactttatcatgtcatcataatcttcacagctagtagtgaaatacctttattgaacatccaccatatatataagactgttctaatctaaactcaataaacctttaaggtctatttcttattcttcttactttatttccataacttaattagccttcaaagcccaattctaatatgcataatgacttgaagtattttccaaatacaatcagtgatttttttgtgtgtgctaagtgttctcaggacagggtcaaaactacctattacatacattcaccatgagaatttagcacagttggcctctggcaacagactcaaagatttattctgtgtagctattttctagcctgctggattccagccagttgcctaatggatcatgagtgagtcagtttcattcagtctcttagcaaagtcaatttgtccagcagcacacaattttctgtcatgtagggtctttgcctggcattgctgtgacaaacacaatctaactgttttgcttccctagattccaactgagctttggccctggaaggctggcttagataatcaaagtcccctctaaggagggaaagatggtataatgaaggcttcctggaaaaattagaccctacaatttacccatctccaaaagtgggtcatggaacaaaaatatccatgtattaagttagattaatatttgtgtgtgcaatgaacaacagcatttgccttttgattacttcgggcccaaatgagctttctcttttaagtagcagaaaaataacaaaagcagagtacacctggaagggacagaatagtcacaggccagtgttgtaagagtcagtgtggcacttctgaaggaaatctgccgagtgcatgggatactagagcaccatgatgggcaggaggagaaacaccctctttctctaccttccttctctaccgccactccttcgagatggccaagtatggaatttctctgtcaggggtcctgccacctgacatgtgcaggtccagttaggtagttgaaaaggacacattactacacttatcagggttctcactacaaacaaattttcatagtccttctggaaataagccacatcaccgaatgcctttccggtagctgacatgattgattgtggacaacgaagaagtcacttattcctaaggaagagactggagtgagggttgctgtttgcacatacataaaatcctagaagagataccaaagctacattatgcagaaagattattattttagccagtggctctgaggacaacctcatttgtcttctctatgggtcactctttttttttttttttttcttttgagacagagtctcgctctgtcacccaggctggagtgcagtggcacaatctcggcgcactgcaacctccgccttctgggttcacgccattctcctgcgtcagcctcccaagtagctgggactacaggtgcctgccaccacactggctaattttttctatttttagtacagatgaggtttcacatgttagccaggatggtcttgatctcctgaccttgtgatccgcccacctcggcctcccaaagtgctgggattacaggcgtgagccaccacacccggccaggtcactcattttttaagtgaatattttcatttccaaaaaaaaaaaaaaaagcctcatgtttccaaagtggcataaaaggccctggcatgtagagtgtagaacagaggctcctcctttttagccagtctctatttcagaaatcattagatagaacatacttggtctgaaaaaaaactatgaaattttgatcccccttggagaaaatgtactttaatgtgtatattagttttcatttccttcctctgatacagtaaagtcaaaattttgcgaaccattgtgaaataaggagatatgaccccataaacacaaacaattttcgttcccttgttcctacatatgtttgttaggagtacataaaagacaagttagctctatagaccctctaattttgagaaagagaagcacagcattttcctctttgattctgttttgaaagagtgcacataatgatgcatacctcatgcttgtctgccttcccctggactttaatttcttcctgtccagccaaaggagaaggtttttggcttggtttcagctgtgcttccatagctgctacacatcaaacctatcctaccaggtagagactagtgtattcttttcactgagggtagatggtcttctaactttaatcttccattctgcctgtcacgtctagaatctatctggttaaaactcacgttttaaaaatgcatgtcctaaattgtatccaacacttgttagtatcaattattatcataatttaaagcctagattgcagatgttcatcgtaatactttgccaatattcttatgactgtttcttttttcccatagataagtgttccaatttaagtgtgttttcctttccagaatgttctgtatgtaactcttctgacatttcagagattgtgttattactaatatttagtctcgtgaggtgcttcattttttaaagtattctttattgtgttttttcttcatgacccatcatggtgctcgatcagttccttgttttttcttttgagcatgactaataataataaagtctgagctctggtctcatatcacatattttaattgtataaaacaactatgaagacccacactgacaagatcctgagcctaaataaaattaggtcatgtctaaaagatattgtcctttgaattaagcagaacgtgtgggtgtgtgcacatgtgtgagagagagggagagtttgctcacacacagccttgacactgataatattttcccagacagcttctactcagtgactttgtagtaaaatcaaaggagctttagtgtgtactcattttacagattagaatagtagagcccagagagagtaagttatttgcctgaaatcccacagcgagggtccacgggagctaggactctggctttcaggaccctccttgttcagtcctctttactttgagtcaactctgacgggacctggcatggtgccctgcaattactgatgatgcgaaaggtgagagcggatgaaattttagcacactgatcaatcttgagatactaaaatataccagcaaagttgtgaactcgaaaattactaaacaggctgggcatggtggctcatgcctgtaatctcagcactttgggaggtcgaggaatgagattgcttgagcccaggagtttgagatcatcctaggcaacaagaacaacaacaaaaaacaattagttggggatggtggcgcatatctgtaatcccagctactgaggaggctgaggcagaagaatcgcttggacctgggagttcaaggctgcagtgagctatgatggtgccactgcactccagcatgggtgacagagtgagaccctctctcagaaaaaagaaggaaagaaagagagagagggtgagagagagagagaggaaggaaggaaggagaaaagaaaagaaaagaaaaaaagaaaaagactgaacaaaacttgagaaaagcaatgtacccttatcacagttttatgggaaagtacacaaatgagtaaaatgcaaaataatggcattttctgtactgagaacagagataccacagagcaatcgaggaagaattagttatactgttctctgttggattacaaagcagaattctgaaaagcacacgttgtttgacacgcagtgtgaagttgcttgacgttcactgtgatgttggctgggacactgtgccgggtatgtgtgggtctacagattcatcaaatggcacatggtcagaacgaccttctttttgctaatgtcattaagtgccatctattaaaaatcaggtgcttacaaatgagagtatttaaagaatcagagggagcaaggtattatgtgtccccttgttatcaaactatattatccaaataaggatatgatataatcaagccaattctaaacagtccaaaggcaaaacaaaagaatgtgcccagtgctttcagccagtgtctggatgctaaaaatcagactgactagtcaatgaaagcgaccacaaaattagatgattttgacccaaaagaatgccttggcctcccttcccagagtgtttgccagttttccatgtctgctcttcccctcttcacccccagccccaggtggaaatgaagatggttttccattttgttttgaagagagagcttcatgtcactgatctataatgtgaaggaaaatatcttcatcaaaaccaacattcttaggaatacatagaaaataaaaagactactcatgtcttagaaaagttttcccaaaagttggatcatgttggataatgttatgatccttttcactttcaaagttccctagttcccttagagaggggaaaattatattactggtagaaatcaacatttccttttctttagtgaaaaaaataacacagcactctttaattgaaacctgtgtatctttgccctccccactttctgcctttgctttttcattcacatttaactcctgcagcaacaataacctctgggctgttctgcattagagagaactcaagagccctggaaattataatttcagaagtattgataatattaaacaacatcaaaaatttttaccacttttgcctgcccttcttacttttttcacaagttaattgaagatggaaggcagtaaagcctcgtgattctttttcaaaaaggttaaaatacaatataatctatcttttttttttttttttttttttgacacagagtcgtgctcttgttgcccaggctggagtgcaatggcgcaatcttgactcactacaacctccgcctcccaggctcaagcaattctcctgcctcagcctccaagtagctgggattacaggcgtgcgccaccgcacccagctaagttttgtgtttttagtagagacggggttttaccctgttgccaaggctgatctcaaaactcttgacatcaggtgatccacccacctcgacttcccaaagtgctgggattacaggcgtgagccaccgcgcctggccaaagtaatctatctttaaagatggtctgctatccttaattgtgtatttggtataggttaatagagtgaaagtcctgtaagctataggattagatggacgttgcctgcaattcaattccatctgtagagcagatttcattgtcacattaaacattagaacttaagaaacaagttcttcagagaagtggattgagaaagattgaagtagtattgtgtgagctgagcttgagtcagctattctgttggagaatccctaggttacatcagagaagatagccgtgggctagtcacctctatgagctttgtcatggctataattttcatcaccagtcagtccttcaaatagatatttcttagagatgcatgggtaattagagaaactctcaattcagttattaaatttttcctactcatatccagagttaactgctcatttttagcttgaacaaattagaggattgcttagtgctgaatacttgtctctttgttctataagcttgacagagctttcttattgcctatatgataatgttggaccatcttcaagtgtctacagtctttcctggggctggtatggtgctccagcataaatgcataaatgtgtaatgcagtggaatttcaactcagtgataaaattctctaaaagagagaactaattaattttagagccagaaagaggcctatatccaacctatttatgtatgtgctagagctggttactacagagcaaattagagaccaataaaaagacatggtgatcacttcaaattgaactgtcttaacagaaataaattgcagaagcagataagattttcacaaatcagtgcagtatggccctgttactttttatagcatctggattatggcttagacttattaagaattagaaaaacaaatttcagtgccatcactgatacctcaatataatatgggacaagctgttagacatcaatatgctgaaaaatggccaggcatggtggttcacgcctgtaatcccagcactttgggaggccaaggcaggcagatcacgaggtcaagagatcgtgaccatcctggccaacatggtgaaatctcatctctactaaaaatacaaaaattagctgagcatggtggcacatgcctgtagtcccagctactcgggaggctgaggcaggagaatcacttgaacccaggaggcagaggttgcagtgagccgagattgcaccaatgccctccagcctgatgacagcgagactccatctcaaaaaaaaaaaaaatatatgaaaaggtaacagcaattttcagtgagtaagcatataagtaaaggataaggagagaattgcctcttttctgtcgcattcaaggaacagctggaaaatggaagaaacatagaaggagagaaacatcaagaaatacgtattagtcattccactgtaggaaaagttcattacaggagagtcatgcaggcagacagggtcttcttagtatcaaggactgattttgataatgtgcccacatttcagcgagggcgttttaagacataagcacagcattaaggtgtttcaatagcagacatacctgtctttattgcagtggggagaaagcccaggctcatgaaagaggcgtgagcattcacgggaaggaagaaagaccaaataaaggcctaggaggaggtgagccggggaactgtacaagggagcaaaggccccttcttcagatgagttcaggatggccttagcaccagtgcttggggaagaatggctcacatcctctatggcttaccctcttcttccaaggctaattttggaggctttctagtctttcttttgggatcaaatatatcatgaaattgaaacaataaaaccaccccccatagagctgttacttggttttcacttttcatataatattaaaatctcaggactaggagcgatttccagaagctattaagtctaaccactacctccagacagaacttcacctagatagactaagggaatgtattccttattgaaaatatattccacctcattcatttacaaataaggtgtaaaccttcctggaaaaaaattcacaagtgccattataaatgcttctatggataaagaccttaaagctaacccaaagttattttgccacatatacttaggtgtcttaaataaataatatgcattctctcgattccatccttgtgaatttgcatttgggttcccacttcttcaaaagagagtgtgtttgttccatggccaattagtttgatagtacatataagtaattttgcatggataaaaactaaccatgcaactttaactctgcctttaattaagtaatcattaaaaatgaaacttgtctacttcctcctgttctgtagttgacggtgattgaggggcttggtatggctgtagtggcacaaaaatggaaatcagtaaattagagcagttgtcagacccagattctgattagctaaacagcttgcctgggttagtgattaatgcagttgtagggaatgaaatctgctttcctagaaaagtcaatagagaacgtttaatgaagtagaattatgtgacagttgtccagttgtgtgaaccatctttgaacttagtcaaatgcagatgtaattttatattaagactttaaaagaatggaaaaatggcttcaaacataggagaacaaaattttctgctttctttgtttacttcttattttatgtcaccccataaatgtgattggtacggcttttgagattattggtttagaatttcttaccctttgttgtcttgagccatcttttctctagaaacatgctaatattacagatggttcaaatgttcctataatgtcaatgtgtaaatccatattgagcaatgtagaggtccggctgtgaataggacaaagaaaaaattaagaaaatatttaaatgtacatacctccttttctaggatttaataactcgaattatttataaaatgttattgacaactttattaaaagtataagttacacgttataagattcacacttcaaagtgtacgattcagtgtttttagtaaagtcacaatgttgtacaactcattaccactatctaactccaggatattttcctcattccaaaaacaaacctcatacccattagcagaccccctcccatttcctctttccaccctttccccagctattcaagttattttttaagcagatgttctgattaaaactctgtatctgtctttggtgctttagctagcaaaaaaataatgaatataaaacaattgcctccccatatatattggtatatataatttattagaatgtttttcttttcacttttaatgaaataataatgaaatttcaatatgtataactggtgaaataattttggcaatactgtgagtgaaatgatagggcaaaaatgaatgcttttatttaactcacaattgatataaacaaaaaaatcaaatgatccagtcaggtcgagggtaaattctcttaaggaaataacaggtaaatacttttccttgagtgtaaagacacttatgtgtatttattaacacatacatagaatttagataagaattatctttaaaaatatgcatccttttaaatttattcaactagtattatcttttcactacaaacacaataaatcctggttttgcttgcctccactagtcgatatcttgagttaatcttgcacatcagctgaaagaatagagttaaagtttgtatctatgaatagaaggacttgataaactatttgataatgtaaataagagtagaaagggaatatgtagtgtattatgctaagatagtatatgtaattcatgtgagtgagcacactgatacattttaagataagcaagtgccagattaatgcatattcttgccctgattccttttcatcccctttcccttcatttcctcccctttcccatcctcttccctttagacccttgtcacactgacctgcattcacttactggaactggctatgtcccctcctgcctctgggtcttcaagcaaggcctctcctctgcatgtcttaacccaatccgcacacctcccacaccatgctggccctttgcttacttaaattaacttatcatccttcaaatttcaactcagtagtacttcccctagaagccttttggaactttccagaagtcgggtcctgttcatgttctcagagcaccctgattttttggaagtaacattcatgcttctatcctcatcttctctattttcaaagaagaatcaaagaatgtatgtatattctaatatatattgtgtaagtatactaatgattcaatatctttttagaaaatctgcaattttggactttttagtaagtcagacatcttttgcttctgagaaatctgaactattttattttgttatgactgtgacattcattccatgtgttgaaatcaagacacaagaatgcaagaaatgacgacttgccagtaaatgcccagttttcactattaaaaaaagcctggcattgctctcccagaagaataacaactcagtgatagaggggcgtaaagaccatggggccagcatatttgaaggtgatttttaaatattaactgttgtggtcttcaatgtgagtaagcctgcatttttcaaaaggtttcatatcttacaaactcctgatttctccctttattaaaatctattttgaagtaggccaagctgtcaactaaagtgaatgttttcaactaaaagatgattcactttctaacttgacaaaaataaatggagaaaattatagattatagatcaattatcactttctaatttatctctatgatttcaccctgatttattccatgaacaatttaaggtattttaactatctgacattcatttagttgaacaaaaagaaaacgtgaaaccttggtaaataagggacccccttaaactgaaactttcctaagtacatttgaaagtccataaactgacaatggataccaagatcatgagatcacaaatgtgacttttccttaagatttcatcacaagataaatcaaagtgctaggaattgtattttcccttttcctagtaatcaagtatccttctcagatgactctttttgtaaaagtaacaacttctcatctttgagacttgactcacataccaaatatcaaaaatggaaaatctttgaattctttttcctgttgtgggaatacgagtcatttataacaacaaaaaaaatcgataggaaatggatgttttagggaagtgtatcctgagtgctgtctttaaggcattgattggagactgcccacatctaaaaaatgactctaggacatcactctcatgtatttccgtgaaaaagctggtggaaaaatgtgttttcttctaaaaggctatgtgtgggacgtgtgtcagtgttcacatgtgcctaataggcatacgtaaaatcacacttgtatgaaaatcaagtaaatctgctgaaataaacagcaacccatgtttgggcatttgtgttggtagagattggcttttaaaggagaatggattaatatatgattctcttgtcggtattactatgaattgttcttttttgaggaggagtctcgccttgtggcccaggctggagtgcagtggtgcagtcttggctaactaccacctcctcctcctgggttcaagcgattctcctgcctcagcctgctgagtagctgggattacaggcacatacaatccacacccggttaacttttgtatttttagtagagaagggtttcgctctgttggccaggctggtctctaattcctgacctgatctgccttcctcggcctcccaaagtgctgggattacaggtgtgagccaccatgccaggcctgaattttcacttgcaaaattatcagtcagttcttaaaacttgaggaagggaggagtcaagaaaatgaggtgaatgagaaggctgtttagactgtttttattgtcttacagtcccatttttgtctttcactcttccttctctctaatggctgggttttcaacaataatacaggcaagcataaaagttagcaaatgagggctaacctagaattgcaaatttgattgggtttcatgttggttttccttaaataaatcaacagttttaacagggtggcatttaattatatttgtttacagaaatatttttatatttgaatttctttcataacagtgtttattgtggtcaaaggatgggagggatgaggaaataatatttgaagaccacaggggcattcctcacctctgtagtcttattatctggccttgaaacactacgacattctttaactgaatttattaggggctgaataccaacaacataagtcagaaaagggtttacattgacccctttggattctaaatattgtaataaatattattagttccgaaatatcatatctgtttgatttcccaaatgattgcagaaatgctttgatctttttagtcctatgatattgtagagatatctcactaatgatgttttttttttttttttgagatggagtctcgctgtgtcgctcaggctggagtgcagtgagccatgtttgtgccactgcactgtagcctgggtgacagagcgagaccctgtctacaaaaaaaaaagaaaagaaaagaaaagaaaaaaagaaatgtaattcactttcttctggtcagcagctgacaggatagaacacattggactagaaacctgttgtattcttacttttacccatgacatggcttcttttagaatacaaactgtttagaactaagacaggaaaatttaacaaagcattagatataaaaatgttcacaacatgtatggtctattctttaatttgagaatattttaagaaaatttgtggttgaaagctattgctgtcattgaggtggtgttacaacacaatcgatctttgaaaaagtattggcttcaccagggaaacactagacctctaccccagtgactcctgctaaagaggtctttgccatcgctgccctttctgatacctttgtgtgtgctcagattggcacactgattaatttcagataccatcagcaaaaatggaatatgctgaacaagcacttacaaagtagtggttcttcatagaacagagttgtagcccttcagtaacaaagaatgagtcagaggaaatgagttaatttaacaaattgctagttgcctaccagatatcatagcaaggaatgatatatgcaaggtgtgttaaaggcaatgtttccttaatttcttctttctatctcccatctcccaatgtcctctggggaggccgtagaggtgggagggacatattaagtaaaaagtgtgaccacttgctgagtaatttttagtgatttgttgagctggattaagtgaatttagagttgaatcttcaaaatgatcatttcctttttttaagagtttatattctggatattttcatttgaagagcagtgatagtatccggctaaggtttactaaattgttcaagtgagtttgcagaagactaagtgaaacaacttctgtataatgaactggaagattaatctgcatatcacataagcaaataaaaaacaagcaatcatatattttataatggaacaaccgtaagataaacaaacaaaaggcatagttaaaaatctgtatgaaaaagcaaattcttggtttcccaagaatccttggtttcccaaggctcaagaattttatgatttgagaaaaatacttaagtgttgcctgcacttctgtgcaataaatctcattatttcatactttattgccactactgtcatgaaattaatggatcacatttaagtattccttcttggaaaaatatcactaaaatgtaatgttcctcaagtcatagtgcaaacaaaattatatttatcatttacagacaggttttattggtcctggtgcattcatctgctgatggccaataaaagctatacaaagtctcatcaatgaaattagtaatctgtggggacaaacatgccattagtgcctgtcattcgagatttgtgatcattgacgtgctttttatggcatctgaaaatattagtttgactttaaaaaatgtagagttgtttctattgttggatatatttataaaattctgaacataaaaatgctctttggtagccacttgaatttttaaaactatatttaataaaatacagcttttaggaatagcaatcagcatgggataggtgacaatgaattttttttttttttttttgagacggagtctcgctgtgtcgcccaggctggagtgcagtggcgagatctcgctcactgcaagctccacctcccgggttcacacctttctcctgcctcagcctcccgaatagctgggactacaggctccagccaccacacccgggtaattttttgtatttttagtagagatggggtttcaccatgttagccaggatggtcttgatctcctgaccttgtgatctgcccgcctcggcctcccaaagtgctgagattacaggcgtgagccaccgcgcccggccaagtgacaatgtattttaagtagcctctgctatccttgacgaaatgtgctaaagtggcaaaatgtttgctttagagatgtacaaaagtagaaaatttgtgaaggacattaggtgtttctccactttgagaggggatctcctcttgatctactctttatttcccatcccagagtgaacaaggtactagttgatgaattcgaatcaggatacttgaaattaagacttagatgtagcactttgtgatctgtaaaaatcatatcagatcttaaatatgaaaatgtttgagtttagccaaaatcaccagcatcattggtgtatatcaagtttaatcctatccttggaataatagaacttcaaggttggaagatgaatcttgaatagtttgaagttaaaccctacctgccgttgcaatgagtcccattgaaaaacatttcctacatgtcctcgacaagtctttgctttctttagttacaaggaattgcccaacctaccaaggcttccccattttatctttgactatttctataaatttctttttaaaaattgtggccatattttaagacacagagggagggtagacacctagatctaaaggatattaatctacttaagaggaatttgcttatggaaagatgatctagcaaatgagataaactggactgataaaaattatccaaactcaggtttagatgcctatagcagtttcacaaaaactaaatctttgtctctaatggatctgagctgatagcagtgtagtagagaccaaaggtctgtgactgtcgtggagaagccccttttggatgaagctttacggaggattttcaaatgttaattatatttacaaacagatcagatgtaggcatagatatattagaatactttatatcttctctcatttatttttctactgctagataaatgggacttataagtagctgagtaggcaaacaagaaagaatgcatacagttttatcaatttatctgagattttgtgataagctacagaccaagtcaaatggactagttttggcaggggcttgctgtccatatgatggtcagttagcttttttctgagttaaacttgaaaactaagaactttaagaagtgcatgggtatatataggtgtgtgtgtgtgtgtgtgtttgtgtgtaattttacaagactgtagaattataaaatgacatttgttttaaggaatatttgattgacagtttcacttaccaacgttagcctctaattatgacactgaggatacccaaatttaaaaatttcctttataatggtccctgagacctggtgattgaggtcataaaaaaggaatggtagttttctttcagaattttaaattttctcaaataatatttcaccaaatattagccacacttgtatactttgactctgttggtcgttaaaatgtatagtcataattactcctatggaatagggatttcaatagaaagaaagctttagaaatgaatcttctttgcagataaatgctatttaattttcagagttaatataattcaaattatttagaagtttacaagattctattataaagccagtttatttatttttttaattccattatcatctgaatattctaaaaaatgtaaaaagaaatctatttgtagagaaaacaatgccttttaaagaaaaatgtattttgtgctgggctgcagtcttattcatcacttgataaatgatgcttttaattcagataattagagtaatttgtaacaaattattagatatagcagacttgccattccatttctataaaataaaaatacattgtaatgtttacattgatgagtaataataacaacaccttagtagttgtaacaatatatgacctaaaatcagtggtaataatgtcctatgataagaagattgtacaaacttaaaagctagattttctttcaaatcttttgtcatactcctgagagaaagatatgaggggaaaaaagtcactatagcaaaatgccttctcagaactgtttcagagcaattgaggggagaaggaaagaatcagtcagagattgtttcaaatttaatatgaaataaactgttacctttaactattcagcaatgacacagttatatttcattccaaaggtgtttacaatcatatgagtgggtttctgtattcaatgttacaataagtcaacttggaatttcccattaaatatgatattaataaaagatttaggtacagtcccctggtgtgtttgaagctgtgcactctgcaaacacataaataaaaatatatctaattggtttgtggcattttgagattttttttttcagaaggaatgtacttaaaaaaattaaattactgcagttttctttcagaaaattgggcttttgtattaaataatgctagtccaaacttaaaaataagaatatttaagcctggtaagcatctttgttctctcaataaaaagaaaaaaattagagactctctttctccctggcctcatacccccatcatcttctgaagttatatgtatatgaagtattttttttaatctacagggataccttttaaataaaatattcctttattatcataaataatctgtaaaacaaaataatagtggcagtatttgtaataaagtcctaaaagttaaatcatccttattatacttaacataatccaaaagactcctaattaagttttcctttcctaacttatattatcttatgatgatctacaataattttgatgatgttctcaaatgttcttatatctgcttctgaaatagttaaacagattattgaaaaagacctctgaaacaaagcaaataaaataatgcatagaaggaaacagcttttagtcttatctctaatggaatcatgttattgagttttctaaattatggaagatgtcaaaggtcatttagagctagacttcatgtgaagaattcttaacttgaattggcttcagaaaaagaggtccatgaaactccaaaattgtatgcttggtttttatttgtacatgtaaacaaaaattgatagctttccccaaattctgaaaggagtccttagctctcaaaatactgagaacctccattgaataagacatttgagtagggactttgtggtcagagatctgagtttgaatcccagctctgctattttccacctgtagggtcttggcaaactcctaatctgtctgagatattgtttactttctaataagtgcaggtaaataatacagaatttacaggttattgtgagagcctatgagatcatgtgtatttttgccctggcatgttgaagtcacacaataattctttcctttctctcggtttctctcttttaagatgacaggaatggttagctaaagcaactgagtgttaacatgagggttcctgctctattgcttgttatcacacatgggtacatataacagtgactgcctataggaagaagtcattaccccgggacagctttcactggtggatttttatgatggaaagcaaccgcattaactgcaatatggcccagggtgacacttgacatctgtatgttttatttttattaaaaaagtaatttaaattattgccttttctttttattatggaagaaaatgtaagaatgttgactgttcactaagccgaagattccctttttgctttcaaagcttttctcaaggacattaaacactcttcctaattactttttattgatttcttgacatttctactcaacattgactgcttatttttaggaaacaaagaagcctaagtgaaaaatgttaatggtgcatttgaaactacaaagttcaatattttagtcacgcctcttatatgtaattgtaggtaaaaactatataatatttttgccatgtgcctcagctctcttatcaccgaagtaaatagaaaattctgtgattctcagatttcttccatagctttaacttattttgaacaaatctgtgacttaccttgctatatttcaaattttattttattattattcatttttatttttatttttttgaaacagggcctcactccattgccccagctggagtacagtggcatgaactacagcctcaatttcctgggctcaaatgatcctcccacctcagcctctcaagtggctgggactatgggcccataccaccatgcccggctaatttttaaattgttttatttgtagagatggggtctggtactactatgttgcccaggctggtctcgaactcctaggctcaagcaatcctcctgcctcagcctcccaaagtgctgggataataggtgtgagccaatgagcctggcatattttattatatatatattttttgtctcaagaggttctgagaacatgtgtgcctgtatttcaaattttaaatgagtgaagataaggcttggcatagtcaattgaataaaatttagtaaaaaatcaacggaatactgaagagactgatgaaaattacacaaattaactcacattttacattgttcttccaattttgcagttatttgccattagtaaacactttaaatatgtctgccactctgatttttagcattatttttgttaggagtaactatgtaaagcaagtctgattagatgatcctcatatgtaatttaaccaaacgaaagatgtcttatgttaactatttagaacagcccatttatttaaatgttgctcatttaaattacttgacagtcaggaattaacttttaattaaggagtgctaccatcagacctatttttaagagtttcttgtgtgtgatttgcatgttatatacaaatgaggttaaagaaaattacaagtcaacaaaatgaacctaacatcaaatgtccctggagataatttttttattttatgtaatttatctgcatctcttatagaaatactttttttgtcttttctccctatctctttgttgtgtacaatcagcttttaaaggatccagtggtattaattttgcattgcggtcaatcagagatcttatgcaaatattaaatattgcacaggcatcataactaaatttagcatttcatttggaatagttccttgtgccataactccctgatggtgtttataactcagcatatttatatttgtatgtgcatttttatgtatatgcatttctctttggtctcataaaaaagtaaagtgtgtatttttttctaactctacagtcattactaaatgaaaattaagttgtttttaaggcatattttttaaaaggaaaatgatgttaatctgaatgaaggttaaatagaatcccttataacactctggcactatgtggtcacatcattgaatttctgataactttcatattatactttagtctaactactcaagatcagtttagttttctagtgtttaggaaagcttaatgaaaaatataagacaacagacaactagaaaactagacagataaactgaaacagacaacagaaaactagataatatagacagagcgttttccgtgaatgaaaactaaaatgcatcagtttgactcacagtggcctcctgccttctgctaagtatgcacaacctaaaggtaatattttaagtctcattctctgacaatgtagtttgcaaacatagagaaatattcagatgtagaagaatatggcttctctaatggccttgtttgtttttagctacaaggtgacatatatagttctggaatgaaagaggcgtcatcgggcagaatatttcagtggctgtattatgggcctagcaagtaacctgccttggaattcctctttattattttgagaacaaaggcatgccatttaacttttttcagcctcagttttttttttttttttccaactgtgagaaagagaaagtgtcacctatttcttgttaaggactaaaggtgttaaaatgctagaatgtctggcacatagtagatatttaatgaatgtcagtttatcttgtcttagctaagaattttcatgctttactatacagataactcttggattttatctgcattcatttcttctccaaaaaaagggaaccaggaagaagagaagcaaaagacataactttacaatgcctagctaacattatcaatgccaaacacctactggtcgtggtaaaaatgatttctacttcaaaagacaagattgctgtaaaaaatcattgctacactatgaagttatgctgtaatgttacgctatgaatttgttgtgctataaagaggaaagaagatgtttaagaacaaaacatgctatccagagcacacctccatttttgcaattacaaaatgtcttctttctttgcttctcatttctccagttcctccctcgtgacctaccttgaagatcacctataagcagaacatgataaatagcatgcccagtagaaatggtagttgtgagcacatttaaagtgctctgtgatgttttactctcagctgtattgaaatatagttggtgatgactcattctagaaatatgactattaagaatgagtacatttatttcttcaataataagaaaaccaacagaatggtaatcccagaatcttagttctacttttaacatttcacacccagtaagttggataacggatggcagagtgagcctgcgtaggtaataacttattattattacccttaccgtacatggcccttttccttgtacttttctccttgagccaataatgactttgatggttcagtctttctgcactttgtagaaaccatatcccaaacagtattttctagacatcaattctagcatgtgaaagaatctagacagcctctccgattttcatgcttctgggacagaaaagtatttatcacaggtaatgatgataatccagttaaatttgttatgcctttccttactttcaaagttaatttccatttttccattttggatgctgtgttttatggaaattgtctgtaaagagtctactagccttacatgtaatggtcagcagacatatttgatacctttctttttcctttagtaaaaggagttgtaagtaaggagcaagtgaaaagtgaaggggaatttagtatgtctcctatttggcagcaactgcgcatgctattcaatctttaaataatttttaaggaacttgtctcttattgtaaattatgtctggagaattagaagtgctacacataaaaattctgtctttggaatcagtacagatccatgttaacctcgttaaaatgatgacttctcatctaacttcaaatattcatttttaccttattaagtcatagagtttagctaagcactgagggtatgtcctttttgttattttgattctgaaatcctcctgatggtttttagggtagttatggttaagattttggtgccacgcctgatatttcctaccattactgtggtagtgatggatttcttctgtctggacctccgcttctagtggttctctgatctaagcatggttggaactttgtactgacctcatactatgcctagtcacagagcttgtaaaatacagccaaaattttattaattcagctatatctcttatctctagaattggatcatccatggctcctctgtcagagttgtgaaaatggtcagctttgttacgttgagcctgaagcactgatcccacaaatcaaaagaccacgtgactcaattcctagctcagtcatcttttctctttcgacctttgtgtatatacttagtgtacctgtctctcgaaagtgattccagcaacatagattacataccccacttaacagattaaatttcattagacttatcaacgaagatcctttgttgccatattgctgctatgatagtcctatataggaaactccagcttcccatcaggatttgaagctagactttaccataaattgcaacagctgccagcctgttgacccaagaaatgtggtgcattcaaaaagaaggaacaaactcagacaagtaaccagctctgtacatcaaaaatccttccggtttcggtaaactatcctgtgactatctaactttagtccctgaagggtattacgccttatttaccttacaaaactggcatcctagaccttcctaattgagttgaacttcaaattcattgtctaaatcctaagaaatgttgaattttcacaaaccccatttcctgcctgctctctccttttctcccatacatccaccatcagatttttttttgtttactttctctctgataattcatgagtaagtttaaaaaaaaaaaaatgtgtggccagagttttctgttttctgtagatattgctgtgggtttgcccatgcctagttccaacttttaaataaatatatataataatatatttatgttataaatatataatatatttgttataaatatattatatatttatataattaaaatcttatatgtaattataacataaatatatatgatattatatacatatatatatttctttttttttgagatggaatctcgctctgtcaccctggctggagtgcagcggtgcgatctcagctcactgcaacttctgcttctagggttcaagcaattctcctgcctcagcctccccagtagctgggattacaggcacacaccaccatgcccagctaatttttgtatttttggtagagacggggtttcaccatgttgagcaagcttgtctcaaactcctgacctcaagtgatctgccgacctcggcctcccaaagtgctgggattacaagtgtgagcccctccacccaaccgaaaagaaatattttgatgctatgaatgcatttgtcatttctattctgtttcatccatgtgttcttcttgtttacctttgtagtagtcatttacagtgaaaataattgacaaatgacatggtgttatgttcttgaaaacaaacatacaaacaaaaacaaaaaatgaaagcagacaaatgaacaaaatggccaagtaggtgtttaaaggcttaaattgagcaaagaataaaatggtattttttaaatgttaaagaatgatgatgtgttttaatagtattgttaactattgaatcaatttatgtttagtctgcttaaaattatatttggattcaagatggactactgctatcaattgattagattgaaaacaagcaagcaagaatctagacaacacaaatgggggaaaaaataatgagatgtattggacactttcctggctgtaggaaaagagctttgataaaaggagtgatgagatataattaagcacaaagtaacctacatgcttatttatcagtgaatctttcagttccagatcatttcttctacaaaaaactaaagaataaaaatcagtctttcagtcactgggtgacaggatgcactttgatttttccaggaaaggaaagccaggatcacaggcatgcgcatgcacacacacacaaacacacacatgcacactcacacatacacacacaagctcaagcgcgtgcacgcacagtactttggcaagtagagtgttagctccccaagcatgagcttcaggccagactcagtggctgtgatagacccatgcagccatttgacagattttgataacctttttattcaaagcagcatgaagggccaatgaaggattgctgatttttttttaagacaggatcttgctctgttgcccaggctggagtgtagtggcacaaacatggctcactttaactttgaactcctggacctcagtttcccaagtagctgggaccacaggcacgcaccaccatgctcagctaatttttaaaattgttgtaaagacagggcctcaccatgttgcccaggctggttgaactcctgtgctcttgccatccacccgcctcagcctctgaaagtgctgggattacacgtgtgaacaactacacccaactggattgctgaatttttataacatgtctctggtaactaagatcctttgaactatgaccattgaattcctaggacttgtgtgatctcagtagagcaatgactcacttccctcaggttttcagacttagaggaaaatccaaggatcagtctgtagtataatgctaggcatgaaaggcatgaggaaatgatgggagcctccagacagaaaaggtctcccactggtgactgatttctattcagagacaatgccatccctgtgattgaagctccaacacactgaaaaggtgtgaaaccaagaaaagtctctctttcaataaaagttttccatatttcaaaaattttcagaagtaaggatttcttaagggaaaagccatgaataaatcaggccctttttttttttttttgagacagagtcttgctctgtcgcccaggctggagtgcaatgatgtgatcttggctcactacagcctccgcctccctggttcaagtgattctcctgcctcagcctcctgagtagctgagtagcctcctgaggcgtgtgccaccacacccatctaatttttgtatttttagtagagatggggttttgcaatattggtcaggctggtcttgaactccgaaccttgtgatctgcctgccttggcctcccaaagtgctgggattacaggcgtgagccatcgtgcctggcctaaaccaggcctttttaaagaataggatcagaggtctggtttcttcttcttagcaaggtcttgttttcctggtaaggccttgttttctgcttagaggcatcactacaaccagcctgtcatctgtgaactcttcccttggtgggattcagaagtgtagctcctgcatatgtctctccattatgggagtcactggattctgtggttatttaattagaacatgcctcactaggtgttggctacacctatttgagctgaactagaaatgcaaattcctgctacacatattttgcattacaaagtgttctactttttgaaagcttttgagtaaatggcaaatctcaactgaagactttgactcttctacaggaactgcatggaaatgtgaggaaccgaattggaagaatgaacacagcctaccatttggttttcaatgctttgatttttaggtggctttgtagtaatggatggaaagaacaaagatctgtattaaacacatgcttgcagcgtctacaaaaatggtttatgttttaaaagaagcaggggaagacctcagtcattctgagttattacagctccaggagatggaagtgttttattagcccatatatatatagatagatacagtgctaccaggaaaaaactaatgaattataactaaggtcctatgtatggaccttaatattccttgtgtctgacgatgcaggaatttagccaggcaagctgagataaggccctaacctttgctctacttttctttttatgatcttcttccacatgcccttttttggtttaaatataaccaagatgatttccattagatttttctaacaactgcatgatgtgtgtgcgtgcgtgtgtgcatgtgtgtgtgtgcatgtgcgtgtgtgtgtgtgtgtgtgtgcatagcagcaaagccagatgatgatagcaggatgcagaaccccaattttttttaatattatgtaatgtagaaaaggagtgtgcacacctgtttgcttccttcccattgaacaacattaggttgaaagccaacagtagaaaaacaggtgcttgttatgtttgagtgtggagccccaaaaatggaaaaagaagaaaaagaaaaagcaccgggttttagggaaggcttctttaggcataatgtaaagttaatttatcattttggccctgttccactaaagacacagaatttgcggcaatactacctccccatggcctatttctctgaactaaaatgtacattttctttagagaagcaagaactattatgaccagctagtcctggttttgggtggcgggggtggcaagaaaaaaaaggaaatcgttttctttaagtaaagcacttaaaattatatgtttttttgaaactggttttattcctgttcagattggtcatgagtgaaatgacgtagagtactttaaaaagttagattttcatgtgttatttggttaccatagaatttgtactggaaacctaacagcagatatacatttaataacacaatgtattacagggagacatgttttgctactctgatcgtgaacttgggaacaaggaactcctgggagttgtgggaaaatatatggactgaaattagccaagtgttatggagcaagattcatatgctcaaacctacttttactgcttcgttgctttccgtgcagcaatttctggcctcagtgaggaaaatgttgtgtttgtggaaacataaactggctatttatgtccacaaccatcacacaaacacagaactgcagtgatttggctaaatggtatatagcaacgtgcagtctggggttttagagaggcgtgtttcaagctgcatgggcgacattctaaggaatattaggctttttacctgcaaagccactgttcaaagaggcctggctcaaacccgaaacacttggaagattgtgtctaaatcctagaacccactttttgctacacttttagggaggctccttgcctcaaagtactgaaagtttagattgtttaaaacatttgtcagaaatcatttcctggagtgaagatgcttctataactcataggcacatcactgccttcatcatctctgtaaaaaacatatcatttcaagccaactatggtattgtccatcttaatgggatcctttatatcaacagacacgtagtctagtgagattaggaaagcacagtgacagctttacctgtaacagacgttttagtgttaccggtgagtattgcatattgagaatgggcctcagttcctctgttaacatgatgagtgtttcctagattgcgtgaagagtaatgagaaaatgtgtgataagcagtttgaatgcctttgaaagaggtgtagtacaaggtgtgaaatacaaaggaactccagcagttagctcttctcaaattttcatgtatataaatataaagtagtgtcatttcctgaatatgatccctattctttttccatcattttcttgcaaacactgttatcctcaaaccctcttctactctcacctccttcactagtctcatctccatgttttcccgttccaaaggctgcaggagagaccattagtttcattaattatggccctactcaaaagcctaactctcttcatggcctacatattaaacattaattccaaccagattatcaatggcttctctggtatggttgcattattattttatagcttcattaacttcacctccttatttataatccatgtcctagtcaaattgaactgctgcctctcaccaccaaacatgacatttactttcttacctccgcatttatttgttttttccctttagtggaatgccatcttctcccacaaccataggccaaattcaccttcttaatatatgactcttttaatatagttcccattctcacatttattgttaaattcatgcctgactgacctaactgattgatattttctgttgctgctgtgaatatgatcacattatttcactgggttttcttgatggttactactggtatccaaccatatcatctccagatcgtgattattttatcttctcatcttctaaagctgtatcataatttttttattcctgccttactgcattgattagaacttttaagagcaatgctgaatagtagcactgatagtcaatatcctttacttgtgtttgacagtcatggaaatctcccctagagtttcactgttaaggatcatttagattattagctaaaagcagatattcttagtgatacagaatatcattctagttttacaatataaagacatgttttgaaaaacctaaaatcattatatttttgcatttttaaattttaaatataaatataagcatatatttaaacaagtacatatataatatccatttaaacatgcatattaaaaacctgaaaatacaagggattgtgtaatgaatctccatgtagccatcacccacttcagccgttatcagttttgtttcatcttcatcccagtcatttcccttctctcttactattttatagcaaatcccagacatcttatcatttaatgtataaatatttcagtatgtatctctaaaagataaggactcttctatttttaaatatatccataacatgtttgacacacataaaaattaatgataaccccttaatattattattcattatctaatccatgatcagatttcctacatttgtaactgtttgaatcaggatctgaataaaattcacaaccattttgattggttgctatatttcctaatgctattttaagtgttgatattcgaatttttctccttttttcactctttgtttgattctagccctagctccctttgtctcttttttctacgtttaacttttttttaaagaaaccaggttgtttgtcctgtaaagttctctgggttttattgcatcccctcttgatgccacttaatttagtccctgttggttacatgtatgtggatgtttgattaaattcaggtttgatttttaaagataatactgaatagttttacaaaaattgactttctaatttcatcaaaggttgattcggtatccattgaaatgaccatatgacttttatttgttgatgtgccatgatgtttttttttaaatttgttgaataagataatgaatttaccttatgatttctctcttttgacctttcagctactttcatttctaagtgggctttagttggtgaataaattaacatgtcattaaatgtcacatggtaatttcagtagcttgttgaataactgaatccttgattcttgttggatgttcagtcctctttgttttgatttgttttgcttggtacgaaagatttgactagtttggaaagtgacaggttaacattttctacattgacttgaccttcttccacccaaaatgatcctggtagaaaatgcagagtatagtaaagaatgtgtgccttccacatttagcctggtgaggtctataaatatatcaaattaagccagtcagatggcctgctgatatttgctttgcaggctagacggattgtactcctttagaatctaagtattgatggaaaaagattcaagggacagcttgaaagtttgtggactccggctatggaaattttatactcatataaaactgtcagtgattagtagaaaatatgtagcagaactgtgtttctggaattggcttctcagctaagaaaagattattggctttgtgaagaagaaaatgtagctttcttgtaactccatttagtcaattatccactatgggaagatacttttcttcttctttggaaaagctatgacatcctccatggtattcgtatcattgagatgtttctcctgagaaatagtagacttaggatgattagactgtgccatgagtaaaatgcactgtctgaaaaaaacagaaaaaaaacagcaacttgtaggtttgaaaaataacctttcctggcaatcttattattctaaggataacactgtctaatgacaccaaatcatttgctcagccactgctgggaacttagaatctgctttctgtttagctacaaatgagatcagtgttacaacaaaaattataattttgttttatcaggagaaacacccaaaggtcacttttcattctgctgaataggaagaaatgatatcagggtctgcccagaaagcttgtaagggagaaaggaatcttacccacttaggaagcattttctaattcacttatgtgaccttgggcagccttcccctgtgcacttttgtgaattcttagctagaggtattttactaaagactgcagaactattcttttgagatgatctgtatcctcctttaaaatataggataaactataaaatgtgctaagatccttgatagtcctatcattctatatatgtttgaacaatgccaaagcccaagttcatcagttaaaccagttaatctccattggcccttggtgtcaacttgttctttggacaaagtgtcaccttgtaggaagtctacaaacctctaagtgctcccagcgtattagctaagtcctgagctccatggagttggatgccctaattctgctttagaaagtcctagttccattaaccgtctcctgagaattctcctggcttccctttttgtttcttgagcagagttcagtcaaggagaggtcaagagagatgatacattacttccagtcactgtattggctctgggaacctccaactctatgcaggttctttgatctcctctggccactttctttctttttcaagtacatatttgctattcagcaaaggattgaatgacttctcaggaaaaaatgccaacccagaatgacaaggcttccgtggttctgagcctggctctgaacctttcctttggaaaactaatgactccacctatcattcccttggcatctagagaagctacattaggtggcacagctctttctgctcagcttctgctccagagcttcatcttcaggaaccacctaagcatttttttccccagtaggagttcagtctgctcattatacctaattgcaaaggagctatattcagagcaagaataataatttcagattttttaactggacttcaaagagcaggaaagtatgcagattcctaaacacataagcattgaagatattacaggtaaggttaaaaaaaatctgtaattttgtagtgactagcagtttaatattcaaacatttaaaatgtgcatattttattaagcaaatggcgtagagttatttggtttaattttctgtaagtaactcgtaaagaattgtcctaaaagctgtgggtgaggactaattcattcaagggaaacaggatctaatgattgctttgtgaggtatatatacactgtatactcatgctaattcctgctaattgtcaaagaagaatagtggctttttatcagcagtttgcatttgtgtaatggtcctggtctactggttttgtctacttcactgataaggaaaacaccacttaaaacaagcaagaaaagcaagccatcctttacagtattattttctttttagcctgtcttgagaagaaaaaaacctagccttctacaggaaatactgtttgattccatgggaaaatatttagtaacaagcagagaacacttgattatttctcagctatttattctgagtatttacaaaatgggcaatagtattatttccaaaatcttaagttgtaaacgaagtttatattacagtctacatgctatggatatgacactattttaaaatattttatactttaaaaaattgttataacacataatacataatattgtaagtaagtttaattcttgtaatttggaaattcagtcagaaatattaaagaattatgtagatcttgaaagggtaaaataatcctgcatttatgatattaatttctcttaaattgttcaattttattttataaggaaattaagtggttatacatttttgacaagtagttttgataaagttaaacacagattattgatatttacttaatgctttataatcactcaatgattgtcactccaaattaggccatcttttttcacattttgcagaagaataatttcctaagaaacaactattgaggcttggttatatatgtaacatttcagtctgggcagaatttctttttttacttttgtttgctcaatatttatgtcattagtaatagtaacagtatcatatatttgtgtgcagtgttgcaactgacaaagtgttttaataaacttggcaacaaccctttggtatccatttttgcagctgaattttctaagacaggtagatagagagaagtcccacagctaataattggaaaattgtgccttggacctgattcttcccagccaacttcagtgttcatttcagtacattttatctatgaagggtttcttctagggagagttggtcatggtcttacaatttttaaccccagtgattttggttgttatcattatgtcttgcacataataaacagtcactaaagaattgtgggtcaggcgtggtggctcacgcctgtaatcccagcaatttgggaggctgaggtgggtggatcacgaggccaagagatggaaaccatcctggccaacatggtgaaaccccctctctactaaaatgccaaaaaaaaaaattagccgggtgtggtggcgcatggctgtagtaccagctagctactcaggaggctgaggcaggagaattgcttgaacctgggaggcagaggttgcagtgagccaagtttgtgccactgcactccagcctggcaacagagctagactccatctcaaaaaaaaaaaaaaaaaaaaaaaaaaaaaacaattgtggaaggaggtgaggaaggaaggacggaaataaggaaggagggaaagaaggaaggaaggaaagaaagaagggagggaggggcaggctgaaaggaagaaagaagaagggcatgaaggaaggagggagtccttttgtgtggtaaaggatttttggaacctctaaatgataatagtagtcccccagttctcagctatttcagagaactgtccagcttccccagcaatgatcatttgtcctgaccttttttgccaaggcaaaccaggtctagagtaaaatactacaaaatacattctctggtattaaaaaggaatggccaaaaccgtaattacttttgcaccaacctaatagtaagtttctgctttaccttatactttcttccttataatactgtagttgttgacataccaaggaaagtgtgtttgggataaagtggtcacataaatggcaaacatcaaagtaatgtcagattttgtagtgtttctaattgctgttcattttgtagtcactagaagacaacttacaaattgtgaaaaactagtcataaatcagagggagacaaggtttagtgagatccagttcacctccttcctggaacaactattggggggtatcatcttttatatattgaaacatattttatcttccaaatctttagtttacctttaatacaactcctcccagcccccccagaaagaatgctgtttgctctgattggcataggaccggctttgtcggtttcattacatcctggttgaattaccaaatggaaactgatttaggaatactgagtgtgtacggcacagagaaaaaatatcactgcgaaatttataggcctgtgtaagactgtcagggccctgtgttcaaataaagagagcaaaaggaaacctggcgaaaatcaccatctccatcccggcttcttccgacaattacaacttattcctgtgcttggctgctggtttggagcagctgcatccactcaggtaacacttcgcatcacctgggagctcattgttgccttacaattcgtgatcattttttgatctcactactgctaaaggataaaagtgctaagcataataatccataactgtatgagatacttgctacttcatttccctccaagaatcattttgctatgaaatatcccattactagtttcaggtaatgatctaagaattttttaaatgactatgtcagagctaggggcttcaggatagcattacaaggataatcatttcagagagttatatttttaaggccttttaaaaagagggttgtttctagtttttaacatatttgttaatcttattttgatgatctcataaaatcagagtctaaggaagagatgtgtctatgtgttgcttatgtcactgcttttttttattgtttacattttataaggagtgtctacatttgggggggagttggaatgttggttttgttgtttttagcaaaagccttggcatttgtcctgagagagctcatgcagtgtttgctgttcaggttgcatgaagggcaatctttagcaacctgtcagagatgcaaaggccactagggtctgcttgaggttcagagttcctctgcaggactgcgtggtgacagcacaccacaggtggcccattcagcactgtcatctgggacagcaaggataccctgctccatttgtcatcctatggaattctgtcagcagttgaaagcctttcagcacaaaacctttaacattcgaggcaaacttcctaatttttttttttttttttttttttttttttgagacagagtttctctctgtcacccaggcttcagtgcggcagtgcaatctcggctcactgcaaccaccacctcccaggttcaagcgattctcctgcctcaacctcctgagtagttgggattacaggggcacgccaccatgcttagctaatttttgtatttttagtagagacggggtttcaccatgttggtcaggctggtcgcaaactcctgacctcatgatcctcccatctcggcctcccaaagtgctgggattacaggcgtgatccaccgtacccagcccatttcctgatatttttaaaggcaattgccgtggatgaaaatattaatacatagcacctaaataagtagttttttacatgaaaggatattatgttaagattatatgctgtgtgatatatagaaatgttgtatactccatgattttacagaccaaacaatgcaaatcatgtttcccctcttcttaatgaagatgttaaagtataactgataattgatggtaaaaatcacctgtctactcattctttcttattccttttgtttagtttgtttgctttgtaagcctggaaaagatgccttgaaatgtattttgaaaatagctttttgttggagtaataaaaaattagtccaattcttatttatccatagtaatgattccagaataacatgcacatccttaggaataaagttctcctttaaaaaaataaataaatagcatacatctttgaagtccccagatttccattgtcaagatttttctctcttatacatacccaaattaagagccttccctgcttgcccattaatatttgctattattcattgaatgccaatttttttttgccaattcctttatctagattatttataacctctacagaattctgtaagagtgccattacccctcttttcttaatgggaatattgagcatctgagtggttaaatgacttattcaaagccagtaggagacaagacttgaaccacatctgtctccaaatccaagttgttttgagtgtcttttgctgttattcgaaaaagccatgctgagatcaatgaaaggggtccaaaaacatgccttagacaggataataagaggtaagcaaggccatgagtaattcagaaatggaataatcagatattgagtattccagtcagatagaataaaaatcaagcaggggagaagacaaaattaggttatgtgtcacaacaaaatgtagactttcgaaggaaatgaacaggaaaggcagaagaaaatggaaaagtaatacatggcaggtcaaataaaagtaaacaaggtcatatgaaactcacatgcaaataataaagtagaaactagtaaggaagacagaaaggaattaaaaaggaattaaaaattcataagaatgttatcagtagacaagacaaaaaattgcctctaaagatggatttttttttttttcctaaaagagtatatagaatctgtactggcttgatatactggttttgcttttcatcctgaaaatatcattgataaacattgtgtatattagactatttttggttgggactgagtattgcccatggtgttcccaatgatatgagaagaaacatcctggtactaaatgccctggtggcctggggctgagagctttggctttgtataattcatgcacccactttcatgtaacatgaagtttgacaagtgaatattaagttcattatatgaaggtgttgcaaaccaaacttgaaacttatttctacctctcattctaaatggagatattttgtagtgctttagtctacatttacagtgatattagactctttccatttccttaaaagtatgatggcgtttggacattcaaccatgttcctctaagaaattagagtagaaaagaaatttagaagagaatggcttctaatctgcatgttgatatgtatctgactaataatctataatgttttcatttggaacaaataagccaacttgtgtttctttttcaatatatacatcatgtctaaaaaatgtaaagtcaataggcatgtaaaacatttcaaaaataaataattttatcaattgattgccattaaaaatagatgtctaaattgagctgcactgacatgactttataccattaccttgaaccttcctgagaaatgtattttgcttaatgacaatagagcttctcttttccaactacctggaagataaaatattggttaaaaaatgttgagcctcttttcctatttagttatagtaaaattagttaactctataattctctcttttataatttgattctatgtagtgagaccacaaacagcttaacttctctgctattgtttgtaaggtctgcaagtttagtgaaatctgtaccttatatgaactcttccttttaggataatttaagattaaaggctgcttagaagggggaaaaaaagtccatgttaacctttctcctttctctcctcttcagctacatctacatccaccactgggacaagccatcttgtaaaatgtgcggagaaggagaaaactttctgtgtgaatggaggggagtgcttcatggtgaaagacctttcaaacccctcgagatacttgtgcaagtaagaaaagaaatcctgtgtgtcgcttatgtctataactccttgtttcagatgattctatgtctcatgatgtattgttgctttttttccaattttgttgcatcatgttgaataatgctgttttatatgtagagtgttttaaaacattcacaccattcgtcatcactcctctgtcatatgcagaattgttttttgctcttttcaatgtgtgtgaggtgttttttgtttttgtttttgttttttgccatgttatttatagtgttgctttccttgtggtttttcttgttgttattcagaaaagatgtgcagatatcacagaggcctataacttttggtatctacttctacatccaatgtatgaattaagctgtaagataatgttgctttcttatcccagtgatcacctgccaaatgaataagacaacaaagagaagcagaagggcagaagattatttactgacatatatctattacacttgggattgtcttactgttgcataactattttttaaacggagtttagttttatattgctagtaaaaaaagagaaaaaagtaaattgcatatatttggaaatacattgtatgtagcatccctgtgggtgacagcagtgttctttcatttgtctatagatatatctagaatagcactgtctttccaatgacctgaaggagttgatgcaccattaagaagtatccaatttaggcctgggcacagtggctcacgcctgtaatcccagcactttgggaggccgaggcgggcagatcacgaggtcaggagattgagaccatcctggctaacaccgtgaaaccccgtctctactaaaaatgcaaaaaaaaattagctgggcgtggtggcacacgcctgtagtcccagctactcgggaggctgaggcaggagaatggcgtgaacctgggaggtggagcttgcagtgagccgagattgcaccactgcactccagcctgggtgacagagcgagactccgtcccaaaaaataaaaaaaataataaaaataaagaagtatccaatttattctctctcaacaggcagcgtaagatagtgatagtatcagtacattaaatatttaaaccttgtagtaaaaactaataggactcattaaaaagtatgtttattttgccatgcattttaagtttactgttgatatttagtctacatatggtatatggacttaaaatttgatgtgggcataaaaatatatttaatattttattgaaatgatgaaaatacacctttgttttcctctttaccaacagctatatcccaaaagcaaggtattttaaaagtcgttccttaaaaaatgtaatgtagaacatctaataaattttgccagcagtccccagcgaaaacatgcagtggggacattattctaaagcagcaatgcttgttctaaaggagggaaaaccattttgtcacaaaaactgttttctgctagaatattggcgtgtgacttaaatcttgacaaggaagaacaagtctgttagagaggcaattgaactgataggagcaattagcaaaatgaaaaaggcaccagaaatagtcaacaaagccatgtcccttttacatcacagaaatactatataaatatttaggtgccaattctaataaaatcttaattatatttataagtaaggaagtgcatcttaaaaaacatatgttttaaagacaaaaaaagcaacgatcgaaaatgccattttgtaggccatgttttgctgctctctgagctgtggtagattgggcgtgtctgtagcgtgcctgatgggacctcatggctctgaacaagcaccttccagaacttctcctttgttgcactctaaagctcttctttgaaaaaagtagatacagtgccaagacaagtgttggtggttgtatagctgattttatcaaagacagacaatttgtaaaagtaaatgtaatctgttagagtgaataaaagacttagagccagaacagtaaaattctaatctcaattactaaacatctctttcacggaaataaataatttttataagccaaagtgaaatgataggtaaaagtcttgcaaaaaatattaaagcaagatgaaatacgagtatgaggccaggtgcatgcctgtaatctcaacactttaagaggccgaggcagacggatctcttgagcccaggagttggagaccaacctggacaatgtagcaaaacaccattgctacaaaaaatacagaaaaataattagccgggcatggtggcatgcacctgtagtcccaactattcgggaggctaaggtggggggatcacttgagcccggaaggttgagcctgcagtgagccaagatcatgccactgcagtccagcctgggtgacagagtaaggctgtcaaaataaataaataaatagaataaaaaattaaaaaaagagtatgtagaaaagatcattccttttagatctgaattatctcatacgactatgtttattgtttaaaaaataatcttagagattcacttcttggtcactaaaatattcaaatctatatgcttgcagcagaataaaaatctgtctgatttagtctttagttctgctgacttgctgtgaatacagcacaaatatgagacatccccatatttatcatagcaaattgggatgaaccaggtttttagtttgtaaggttttctctgatcaaaatagaaaatgccagaagctgagaattgtaatctataaaatatgaggttcatttgttatatggggaaaccttgttattttttcctaatcttaagcatacagtgtaattgtattttaataaatctccttgaaaaagcatttaaattataggtccttaaattcttctcctttttaaacagtgtacccatattatctatgtctcatatttttacttcttcagaaaagcatctgagaccactatattttaattatagtaatgaaatatgatcatttttcatcatcacttagcaaagatttacaagctgagtgagtgcatatgatagtttctgcatacctctaaggaaccagggcagttcttttccacatattaatttcagctattctttagccctcccacgtccaatacaaaacatgcaatcgcgtaagtgctgttcagttttttcattttaatattgtgccaacaactgcaatttttcttcactcaacacagtttctcattaaatcttaagcctaatccagtagtaaaaacgtgctatattttaaaaatcttgaagtgaaacatttgttactcttctgataattattaaagccccaagccatcctctgagctaattgtctagtggatcattcttgccttctagttctaagaaattacaccttttttttttttgtaattaggatcttttaggtaagttatttaaattattactggatcttatcagaaagaaaatctttgacatctatgattttgataacttccccctcctttgagatggtgactttattcacatattaaagcaagccagaaccttgagggaagaattggagagtatattttacatccaaaatacttcaaacctttctcgttacatgaaactgtttttatttttttaaatcctgtatgtaaaatatgtatagcattaaaaataatcactagtcagaatttaaacaaagacataatatactaggtcttatgataatacattgttcactagaccacttgaatagaaacagaagacataaaaatattgcattggctcatcatggtcctgtctatgaagccagttcatagtttccatatggtctatctgtctagagctaagcattgctgaagcatgagccacatcattgaaaatcagctttatccctgactaaagacatgactcagaaacaccacaagcatggaagtttccaagtagtctctctggtcacctaatctgctgttgtcttcttgggagttgaagtagaagatgttacagcaaatctcttttgtctctctgcttagaacaaggtgtttcgaatggattaaacatattaacagtgaaaaacttctctgaggagaggtttccggattgcttggacctcctcctggggactgtgtgggaatttcagtggtagttctcatcttttatattttgtttctctacagtaatttaaaatttattctgtggaaaaaatagttactattccagattataaaaagatgagaaaagaatcattccattttgtaccctctgatgctttatgtagtcctgtggttcaaagaaacaagacacatgaaatcaaacatgaaattgtccagatttcctcttgcatcttttctctattcttgtgtatctgttcttctgaacagtttcagtggagaactactttggaagatgttgatgtgattttttttaatctaaaaattattttatatcaggctgtgcttataagtccaacatgttgtccagtggacagatgtgccttcatctggaggggattagagttttaaactaccaattttggtgaacagtcttatgtcctttcacttcaactctctggacaatatatttatttataacatgaagttaatatgttctccaaatttcttcccagggagtcagtgaaattaaatgagttcatttctgctaaagtacttttaactctggggaagcaaaatttatttttccttataataaaaagtaaatggtagtattacattctctcagtagacattggaaaaatatatacacctgttttaacagactgtgttatcatgtttaatttctttttttttttttttttttttttgagatggagtttcatgctcttgttgcccaggctggagtgcaatggtgcagtctcagctcactgaaacctctgcctcccaggttcaagcgattctcctgcttcagcctcccaagtagctgggattacagacatgcaccaccatgcccagctgattttttgtatttagtagcgacagggtttcaccacgttggtcaggctggcctcaaactcctgacttcaggtgatccacctgccttggcctcccaaagtgctgggattacaggcatgagccaccatgcctggcccatgtttaatttctaattctttattttacttaagagtagcagttttatttggtttgttgggaccaccaactatctttataacttttctttgacagatcgtttaatatttctgatcattagtttccttataatgcaaaaacaacaaaaaacaaactaaatttggaaagatggaaggtatctgtaaacatagacttttataattttgtataatgaatgtttatgaagccatgtagggccttattatattatacattattataagagacaggtatgaaaaacataactatgggagacaaaatcacagcaaatataatactttaagtttgatagataaaatatttatcaaacgtatttgataatatatataatgtaaatgaaatatttatcaaattatgcctgaggtcgcaatttttttaatttttgcaatcagaccttggcaatgaccttgagcagtagggtattaaaatcttccacaggcttagcgtcccaataatggaacactaagcataaatggattaacatttgtttatagaacagctatttgccaggcactttttaaaacacagagaaaatataaggaatggtgtctgatctctgggaactcagtctgttaaagaaaatgaaattgctaaaatagaaaatcaatgagtgaatatatgccaaatggtacaatgctgactattaaggtaatacaaatttaaagaagggaaagaaaagactgaaataagttagagaagactttttaaatataatcatcatttatagagtctttcctttataccaggaaggcattgtggttgtaggaattctttctctgagacacggtaacatgcagcttaattctaggaagtaaaacaaacaaatgaacaaaataaaagaactaagttaaacagtggagccacttaatgacctctgaaggtcaggcagaggactttgggtattgtaatagctaacagggagccatagtaacatctggagcagaagagtggcaccatagacatagcagatgtttagggaagcgagtcttccttacaggctagaagaagtctggggactaagtaagatggaaagagaaagtcaaagacatcaaaggcactagctaaggttaacattttataaaatactgacataatgatgctgatgatagtaacttttataatatgtattagtagctgaattaatataattaaacaagggggcaacggtacaaactcacagttgtgtcctgcagtctcatcatcatggctgcagaaagagaaatttggaaaaaataaacaggactgggttagaacttccagtctataagaacacacttttgttgtatttgtagtatttgttgtatttgtagtattgctgctaacaccaataccagcctagaagagttctttctttagaatcagtgttacacttgcctgtggtacttctctgttcttgaatattgtaacatttaacagatatagacagcatttgtgagagcaagtggtgggactcatgtggatctagatagtgcgctcttcagacgactgtgtcctctatttctttcatgtcctcatatatctagaatcctactatgtgcttatgaggaatttattaactcatttagacttttaactcactgaagtagggttgaagaaaattctttagtttttataggattcagtttaggtgtagttttacctaaaatcaggtgcattgtctaagtgttctgaatagcttcattcctcacttataaaaatcagttgagcagccatgtacatttattgaactcatatgagacaggctctgtgctcatgctacagacaaagtagtgaacaaaaccatactggtctttgcctgatggagtctgtaggctactgcaagtaacaatcatgtttcatgtaattaattgaattataaatcacaggtttgccaagtgctatgaaggatattaattgagctaagggaatgtacaatgaaagacctagtcagaggctgactctgctctgtggaaaaaagaataaaaaaagagtatgcagtcatactcttcagatgtatatagagtcaatttaaaatatttcattgtgtatatataccacattttcttaatccattcatctgttggtgaacacttaagttgattttataagttggctattgtgaatagtagatttttttataacttggctattgtgaatagtggattttataacttggctattgtgaatagtggatgaatattttagctagattgatttaattattcaacgttgtattcataaatcataacatcattttctaccccataaatgtatacaagtacaaattgtcaatttacaggaaaacgaatacacaattttgaaatatttatattgaatgatttaaggaaaaagtgaatatttagatgttttatcacagaatgaggctggtgaagtggataaggctataaagcccctcagaacccctaagctgtttgacgagacagggaaacttcctcaagagaggaaaaccaaaccacaaattagcagtcgatatgtcattgtgtcacaatgacgtggagatgtatgggatgtagattgatcccacatccaatgaaattgtttgacccccaacttaaggattcatcatgtagagtaaacatgggcaagggttttagtctttctgcagatgagcatttcagagcaagctgtgcaaacagagatttaggaagggcaccaaggttcaaacaagaagttaattcacaaacaccgccaccctcattattgggattatatgtcctggacattgaaaaacaacatttgaaaaggcaggacaagttaggtttggtttggttttgtttttttctcagcatttacccatgagtctagtgtggccactctatgtatcctcttatctcatggattggaaactagtccccagattgtcattaaaaaaaaaatggaggatatatactgtctgaacagtggtggtgagatataggttggatctgaaggaaacattactggaacattttatatttaatattttctttaatgatgttaaagaaggcattcccttggggaaataaatgtcttttgcagatgatgctagaaagaacgctaaaacacaaattagaaaagcatatgcaaacctcaagaaacttcacttaaaggtagataacagaatgaggttcatcttggaaaaatgcagactaatagtaacaatacctttgggaaagaataatctacaacacagatactcagccagtgagtgggcgagttctgggcagaatgctgagctggctaagaggtgagaaaagtcaatgtttgcaacacgatactgtaggaaaacagaccagcatagttggagctggcgtagacactgccacctcgagtttacacagagagagagcaaaggctttggtgtctgatactttctcaccaatattccttgatagagatttgttgatatttctatcatttaatatttgtaaacataggcatcaaataatttcaaataccacagctagtattgaggaaaagcagacagataatagggacttttcatttttcgacaaggtattttttaaattgtccaaatatttcactgtggaatgatgactagagagagaggaaatatcagctgtatttttttttcttcctcttgttcctgatcaagggagggtttgatgaaaatgaagctgagaagagaaaggatgtctaaggatggtttataaattgaccataaatgtgtggtttataaaattagccaaccctaactagaagtttcttggggtccgtgaatatctataaaaacgtctagaatctccaccaagaaaaaatggaaaataatttattcaattggaatataaaaaatacaccaagcattaagtttatttcaaaatacatacatctatgattgattacatagtaagcatatcaggatattaacagtatattgaagttattattaaccacagtttttattatactggtgctgggcagaagtttggttagtagaatgcactgctttattgaatctgaagtaaactggtatttcactaatagtatttaaattcaagataacagacttacttttaaagaatcaaagaatcttttccaaattgcaaacatgatgttaaaggattttattggagggagggagactgtgagaaggatactgggaatttctgtaaaaattatttgagggcaggcacagcagctcatgcctgtaatcccagcactttgcgaggccaaggcgggtggatcacctgaggttcaggagtttgagaccagcctgaccaacatggcaaaaccccgtctctactgaaaatacaaaaattagctgggcatggtggtgcatgcctgtaatctcagctacttgggagactgaggcaggagaattgcttgaatctgggaggtagagattgcaatgagctgagatcttgccactgtactccagcctgggtgacagagcgagactccgtctcaaaaaataaaaaaaaaattatctgggagtccacagaggagagtgtatcataaactataaaaataacagacagatgttcaagattgacctgtgcttgcaaatcaattaactgtatgacaatcttcctttttttttttttttttttgagatggagtctcgttctgtcacccaggctggtatgtagtgttgtggtctctgctcactacaacctccgccttctgggttcaagcgattctcctgcctcagcctcccaagtagctgggattacaggcgcccaccaccacgcccaaccagtttttttatttttgatagagccattcaccatgttggccaggcttgtcctgaactcctggcctcaagtgatcagcccaccttggcttcccaaagtgctgggattacgggtcttagccaccacacctggcctgaaagtctcctttgatacaattgtggatcagatacggacgctgtggtctgatcttaagttcattttcacggacattttgtgagagcctattatgagccaggcattgtgctaggcattagagatacaaaatgatcagaatgtgatcattgtctgacagaatgtgatcagtgtgtcacagatcatcacaatacagataagtgcagtgaaagaggtcaggatagggtgcaatacaaaaggcaaggagagaattctccccagagcatagaagtgggtgatggggaggtggaggacagggaaagagtgatgcctaagttcagaaaaaactgtgaattttcaccccattaataacaaatatagaacaaacatgatcatgttaagagcaaatactaaaatttttaaaaaccctgatttccatcttctaatctgattaatgaaacgaatggtatatacatacacacacacacacacacacatatgtatatatatttaaagctacaacaagtacttgttattcagatccttagattgttctcagacataaaattcttggaatttgctcaaactcatgccaaagcttatttttcaaactcaggtttgatttactgttattcttatcttccaggaaagtgatggattgaatgtttaacatacaatgttgataatagaaatgtatcagaagccagtctccctagtctgttagaagtaattccacagaatttcacagagcttatagatcaactgggttttcatttgcatgtgctttctctacacaatcaatgcagtgtgcagtttgcatatgcagaaactatctcagtttctgcttttcccttccatctcatttggcaacaaatttagatgtctctgaaggctacatccttttgttgctgaacacttgagttgcttgggcacttgcagtttgttttacctcaacgattgtcttaaaaatccattttatcaagaaggatttttagaagtcattgagttctgtcgtccctgactggtaatgcattcagaagaaatgatgttggggttttctagcagtgattccatgtgttagaataagtatcatttcccagaaccttagtgggaaaagaggtctttgataatcacttaattacattccttcattttatcactgaggaaaatgagaccccgtaaagcaaaatagcgtgtccatgtgcaaacagcaagataccacagtgccgagagagggcgtttgcctcccttttcccagttcagggcaccttacgtcttgaactttaatctacatccacatctcttagggatcttgttaaaatgaagcttcttattccatagttctcggctgtggcctgcgtttacactagcacactcctaggaaatgctgatgctgtcagttctaagtaataacagggtcttataacactaagaaacaatgctgagaaaattcatctcccaaatgaagacaaacactagcaaaaggatagttctggttgagaggtagctgctatttccaaaaaatgactttcatacctcaagtagttctggtgttagtgcacccagttttccgtatgattttatgatagagataagccatcatcttatgctagcttcctaggaaacatcatgttagaaattcatagcagttagaaaattgattgggtaggatttctgactccctttacctagttgtcttgtgccttctgatcacagaactggttataagatgcctaatgacaatttccttataaatgccttccttctcttaaggaactcgtgattccttagctatttgttaatttaatgattcttactaacgtaagggcatttcctgccttgagcaattgtgtggtgtgtgtgtgtgtctctcttacacatacacagcgtgttcacatatcttatactatgttcttttgtaagaaacaaatggattatttgtgctcagtatgagaattttaacttttatcaagaattcaaagaagcaggatggaatgataattactgaatacatcattaattctggaaacacctgctttaattatagggtttgtctatatgaacttatagtcctggtagagaaacaaataaaaaccctatttacttcagaaataattttgtcaaataagttatatgaaaaaagttcccatgtgttttttcttatatacgttcagtaagaatgtgaagacattcttattgaagcatatgaaatggcgtctttttgagaaatgacccaacctcttttttttttttttttttttttgagacagagtcttgctcttgtctcccaggctggagtgcaatggcacgatctcagcttactgcaacctctgcctcccgggttcaagtgattctcctgcctcagcctcctgagtagctgggattacaggcgcccgccaccacacccagctatttttcatatttttagtagagacagggtttcgccatgttggccaggctggtctcaaacacctgaccttgttgtgatcttcccacctcagcctcccaaagtgctaggattacaggcatgagccactgcgcccggccaagcttatacttcttattgacatgtttctcaaggtagctcttcctctattccctgcagcaaaaatattctaaacaaaaataatccgtttacttatatgaaggtgtttccaagagtttgaaagagctgtgtcaatataagatgtttgttgtttaagcttaaacacatactcacagggcaaaaaatctgaaactgctagtattttatcgcgcaggctattttcataaagtaggagaattacatataccaagtcacttggtgaattggtttgaagggaaatgaaattacccctatattggtaacaaggaacagttttgttcatatctctttgatgccaaaaatatagtatgtattcttatttactctgtagtgaaaagggttgtgtaaaaatcactagggatgagctaccagagctaacttggataggctctttgcttgatggttgctgtatagatgaactattaataataattatgatgatggatgttgaggattcaaaatgatggtctttctatctgtaagtatattgcttcctagaacctttcagtggccctttttattagaggatatactggtaaaatcaatcctacttaaaatgctttagttattagagtaacagcaacagcaacaacaaaaaagtggtaattataaagagcttccatatttaagcacagccccattgcatgaccttaagaacaatattatatcaagattctagaattttgatagttaaatatatgtgagtgaataacatgaaaaatgttatacagttttaaaaatagtttttccttaaatgcaaaatgacatgtattaagtaattctgcataagaataactgatctaaattttaaaatgtatttgtctttgatttgggataatgcaattaagtgaaatttgtcttgataaaaatctgcttctagtatctttgaacattaaaaacaagagtttatttgtaatgtctttttaaaaaacagggaatgtagtttttcttgtcaataatcattatagtgtgaaagtacttgacttctattgtttaatgacttaacttgtaacataaaacacccatgaaataaatacacaattgaaataagtatataaaagaaaaagctcaagatcatttattgataagagacagggatggaatcatgttagcgcttatcaaaaccagtgtttcaacatagtgagaatcaatgatcagtggcaaatagggtcatgccaaagggaaattgacagctctccgggccatgctgcctcttattccacatttcaacttcactctagttaaatttcagttaaccaatcatttgaagactgaagcaaacaacaacaaaaatctgtaacccacagttttcgtgggacatggttttctaaatgttgtgtcttttcttttctttatattgcttggtaccagatcatttttaggaatctccatattccataggaggaaaattgccagtctgaaagctcagtgtctttagcattttttttttgcttaccacatttttgccctctaggtgccaacctggattcactggagcaagatgtactgagaatgtgcccatgaaagtccaaaaccaagaaagtatgtcaaaataatctgaaatttgctttctcccccaactacagcaacaatcactaccacttggtgcttttacagctcagtcgtaactgattcattttgttctaattatggcttaacctctcaaggcataaacccattcagtgttaccttatttaactgtctctcaaagtgggtccctaagtcatcaatttacaagaatggccagtcacgatggcccgtgatgctgacaaactattgcaggcaagccaaccgagaaacattttcttccaacgtgtgtgaccaaagccatcatatggaaaactgagatgaataaaacatcggatttcattttaaggggttccctttgaaagaaggcaaccacttaaagtgctgggatctttccaccataccaacttaagaactgcattctgtccaaatttttaaccatttgggggaagtgccagagcctgaaagccatgatcagggcaaagattcagttcctgagggtgaactcaccaagtttcagtcaaatgacactgaaggagcttctttctagcatatattcacctcttctctttttctctgtttttctaccattgtttttttgtttcttctctcaggtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaaggagttcagatgtttttcttcattaaccaa

SEQ ID NO: 910 - DNA, 216831 bp, Homo sapiens; identical to SEQ ID NO: 901

SEQ ID NO: 911 - DNA, 1103503 bp, Homo sapiens
tttttttttttgcccttatacctcttcgcctttctgtggttccatccacttcttccccctcctcctcccataaacaactctcctacccctgcacccccaataaataaataaaaggaggagggcaaggggggaggaggaggagtggtgctgcgaggggaaggaaaagggaggcagcgcgagagagccgggcagagtccgaaccgacagccagaagcccgcacgcacctcgcaccatgagatggcgacgcgccccgcgccgctccgggcgtcccggcccccgggcccagcgccccggctccgccgcccgctcgtcgccgccgctgccgctgctgccactactgctgctgctggggaccgcggccctggcgccgggggcggcggccggcaacgaggcggctcccgcgggggcctcggtgtgctactcgtccccgcccagcgtgggatcggtgcaggagctagctcagcgcgccgcggtggtgatcgagggaaaggtgcacccgcagcggcggcagcagggggcactcgacaggaaggcggcggcggcggcgggcgaggcaggggcgtggggcggcgatcgcgagccgccagccgcgggcccacgggcgctggggccgcccgccgaggagccgctgctcgccgccaacgggaccgtgccctcttggcccaccgccccggtgcccagcgccggcgagcccggggaggaggcgccctatctggtgaaggtgcaccaggtgtgggcggtgaaagccgggggcttgaagaaggactcgctgctcaccgtgcgcctggggacctggggccaccccgccttcccctcctgcgggaggctcaaggaggacagcaggtacatcttcttcatggagcccgacgccaacagcaccagccgcgcgccggccgccttccgagcctctttcccccctctggagacgggccggaacctcaagaaggaggtcagccgggtgctgtgcaagcggtgcggtaagttcctcgcccttgggggcgcgaacccgcggcgaggagggcgcatcccgggcgcgcgggcagcggggctcgacggccgcccgagcaaggcagaggcgctctgggtcccagttgttggtttcagggtggtgggttctcagcgatcctcagagagggaggtttcgctttctccagcttcccttgtcttaggctttgccactggagaaagcccaagtttagtcctgggttggggcctcctgaaactttttaatcctttggggtttggctcaccaagtagatcggaaatgtgccggctgctttcttgtgggtgatatgaacttggctttggttaggagttgctgattctgggcctcctttgaaggaggaagggtgagtcccgcaggattttaacgccttcccttcacttggagtccagagtgtggagatggttaggggtttgcttctgtgtctgtgaagtctctgcaaggaaggggcagtgcactgacattccccgacagatgtggcagagttttttggcaactcaatgtccagcagagaggtgcagtctgtaccttgtgaatatgtgtaatatgtgagaattataaagttgttattggtgggggtttttttttttggccaagtcatctcaagaaattttgttttcacaatattttggtttggaggatgtttttgcacttcactgcatcagaacagatgaacgaaattatggaatatcacatgtaggccctgaagaagaagaattttggaagtttagcaattatttgctacaccttttcccacttaccactgaaaagtattcttcccgggtctgcttcatatgatcaggtttgagaaattagctgattatctcatttcgttgctgaggtagcattatgtttatgccattcataaactaatttctatgatctaaatatctgtataatttcctgattactatataatcactaacacatagcggggtttcttctcaaacagtaaattaacacgattacacatcacaaattccaacatgcataatagcttttccccctggtctttatgtatccgtctaatagacgtttgggttaattgaatttttataaaactcagcaccatgccaagcagagtctgcctgtgatggagagtgtgtcagttcttttaaatttgtgtctggtgggggccaattatttaaatttctggttggcatttgtggtggttaagtcctgctgttaattaatacctgatgatttggttttaatgacagcaaagatcattgttcacccaccattcccttatctgaacaatgtactttgtatgccagagacctgttaggattgcaccactcagtggacagaagctgttcagagagtggtgctgaagaaagctaagtggcatagggattccccgagacccactgatagatgtcactccaaagcatgggaaatgctctgctgggagctgtcttattaggcaaccgaaaagctcagcaccatcgtactgcagcatatgttactctgttacagaatctgaaacaaaaccttttaagcaacaccactgtccagttttcatatgttttatagtgtgtaattcaggaaggatttttcctttatcccaagtcatgagttttgaatcattcacaccacatggtgggaagttaatataaaggggattgtagttagctgtgatgcctaggattgggggtgcattactacattatcaattgtgttagttataccttttaactagaaataaatgtaagacttgagaggtaaagttcttacaagcatccagagaatgtttggaaatggaaaactcatgttgtttggaggaatcatattctattcttgtgcttctaaggggaaaaaacttcattgaaggtacttagttttgtccctcagtttgccagtcaaaagaaatataatacatagttgtaagttgtggcacgttttaaaaaaatgggtttttaatgagctggagatctttttgcatgtaatcgagtatgttaagaaatcacaaagttactgccctggatttctgtagctattgtgtgtgcttggcgatttttgtgttatatgatttaaagtaggatattgcttttaacctcaaatagatttagctaagttctaactgaaatcatgctaaaagtttctcctcgcatttttacaaacatagtgtttcttgtaaaactggaggataaaagcaaataatatcagctattttatatgatgtaaattcagtaaatctgcacttggaatattgagtgtaaaagtgtgtgtgtgtgtgtgtgtgagagagagaatgaatgaatgtgtgaattcatccagttgtgtggtgtcagataatgccattcagaatttgccaggcaaagaaacacagaaaaatggaaaagagagagagagagagaactagcaagaggaaagaatgagaatgagaatgggggctgatttgttctggttgagctgcttctggtcagaagatttcagggagagtgatggagcagaaggccctcacctaacatgaagctgccctgggggcgtgatggttgtgtgcaggcttgagccataatgctaggctggagaaggaatagagcaaagtcattttgtgatatcatacccaggggaacagtttccagctctgctgctctcagctgctgtgttgtttcctacaagttgtttgctagtgtagaaactacacatgcaacagattagccttagggttgagttaataaaaatctttcctcttgaaattcctttttctctttccccctcatctaatataaactccggaataatgtcgataaaacaagaagctctttgaaaaatggacctttggaaacagaaactatgagtgtattttagaagacaacatggaaattcatagcttaattgctttgtagttgaagtttgtataaatgacacttcctttacagttatttaaagtgtttgtagtcttcactttttctgttgctcactgaacgacctaagaaatatccttgggttttatgttcattggaatgcaggataatttgctgtccgattaaatctctattattcaaacaagtcattgtttgatgtgctacacttttagcttccaaagcattgtggttatatgaggcagaagctgatttccaaaaaggagtacaaacactgaggttgaataacatctacaattgggctatgccagatttgtacatcaattctgatcttacaagccaatataagtattttatatcatatgatggtagaatgaagatgtatacatgtatgcatgtattgataatgtaaacatctttatcaaatatttatgatacatagcacttgctctttttaatatcttcagtcactatttaataaagtgtgctaaccttatggtgttttgaaaatgaaagaaaatgctgcagagattttccagtcagcattaaagaaaactattcttaataaaagctatattaaggaaatagaaacagtaacagatatagcctgactgcttgtatgttgtaaatacacatgtaaatttaatttcccaagtgtttgtgactgctctttttaaactttataaatcttgctgtcaaaaatctataccggatttaaaatagctacttctactgagtagagaaactatgtatttatttatatgtatgttaaaaatgaaaccaacataggtcatttgggagaagaactccttagaataaaaatattttaaaaagtggatttaaatatctgagttagaatatttcactagcactaggggatcgttcttgttgttgtggggtatctataaatcctctgaatgtagggaaagtcttaccatatgtcctgatgtattaagtaagactaggagctttagacaacagagaattaaaacagtgagctgtacttcctctggcttgtatatttatagcaaatgagagcaaaagatgtgattgggcgggttattgcccttgtcaaatataatctattcattcttccggaaatctcctttgcttcgatacctattttcttcctgtttttttttcttaattataaacataatgtcttttacaaccctcttgtacatttcaatgacaatttatgaactgcttagatatccaaagatctctaaatcctcatagcaatacttagccttttatttgttttaaatatggttgaatgatctgaaaaaataatctcttttgatagctcttaatgaatgggtattttgattagctttgtatagataaatgataatgaaaacaaaaagtatacaattagggttcttactgattcaagcaatttgttaccaccccaaaatagtgcaacatggcttagtgaaagtcttcataagaaagtaaaaactaatttacaatgttcttatttcctaatcacagaaatgggcattgtggacagttttcaaccaatatatgaatactctaaatttgtgcatacatattgttactccgcttttatgttataacatgtaagttaaaattactattatgaaagaatatataacctggctagtttacccccaacctctccagaatatcagtcgctttatagtacttgaacgtttgcttagtgacacattctgttgaaatctaatgttgaattatttgtggatttacagaatatacaaattcacaaataattgtatgactaagacaaaacttggtcattttaagttgagggattgtcctagttgagaggttgtgttttcatattgcctaagttgttgagtgctgtagtgcacttcaagtaaatctgtttctgaagacttgccccctggattttcgtccctaaattatccatacaggttgaagcagataaaatacaagaaattttggtgaagttgaaggttaaaaatagattgactagtctcttcttggcatagatacaattattaggaaacagttctccctaatacagacttgccatccaggcatcctagagagagatgcatatgtggtaatttacattaatttttggtcttcttcaggagaaccaggatatttttccctacggaaaatagtttgttaggaagttctttcctggcccttgatttacctcatttggacctagtaaaatttatactttgttttaaattacaactaaaaaatcaaaaagaagaaatgttacctacagtctggatggaccgtaagagactgtcctactactttctaactcagacttctgtgttttttcttttcttcttctttatttcccctatgaagatactacaggggaagccttgggtaaatgatggggcccaggagtggattgtagtgtatgagtttaggattgctagtcattatcatatggactagccttctctcgaaaccttgaaattcagctgtccgggtccaaggaatgttggaaaatagaggtcttagatcacaagactgtgaatgcaaatggtctttctgtttctgatggagtctttgtccatcccatgaggacgtggatggtaacctgcattgcatctctagttcagaggctttctctccaaagcccaaggctctgtctttggacatctgccctggcttgctgggaacaagaaaacagctctgagtggtgcatgaatccggagctagtagccaggtttatgaggtagcaatggtccaagggaacctagaggagggaattgtttccttttcttttgctctgctgtgctagaatatgtgagctgaatcaagcccagtgcaagggaacatacctgatgagggcactagagtcttggtactgggtatacctaagagcccaggggatggacgagggataagaaatgtgaagtactgtcagcttcactaaatttggaaaatgcataccagtaatactatcatcccaaatggttgtcttttatctgggaattgccattaaggcaaagatagctaaaaaaattgagggcatactaaaaccacatagttataactaccacttatggagttggtaaatttttttggcctctttgatagacacatagagtttgatttttatgtgtagattaaattcctgttgaataattaatgaataaatgactgaaggaccccagctggttggatagtggaaatcactgttctagcctaaatttagaaagataaaaacatacttttgatttttttctcttctcatctctgatatggtgagtttgataccaggacactgttcccttctcttcccatccagagccttactgtaatctggatcgacctttggggcttcagagaaaggttgtttaatttcccaaaacttttccctcacttatttttagaacaatatttgttctgtgtagcttatagcccagcaggaaaaaaaaattccagtgttgtaaatgcttaaaagtacagaagagttttgctgtagtctatgaacccttaccactgttttcagcagaaccatttgtaaaccatcccagtttattttgggtgacagacttcagtattcagaaattttgtgttctccttggatctctcttcacaggtgtttaaccatctcagtactgtaagtgatactttatgttgaaattcattctcataactgaagatggaaaaacacagcttatatccctaagaagtaatacaaagaggttttagatcagttcctctttacttatttttcttgtttccaatatcacaacagctcttggtttacctgcaggtggggtggcatgtgcccatttgggctctgatgaataatgaggttctttgccttcacttcctcagtcggccctggaggcactgtgggagatgatgtgttatcagtgaagcagcagatgtggtggcagcattttcctccactgcagggagcatcccgtctgtacctctgtacagagcaggggagctgtctactgagaaggaaatggatggctgtgtttgcttcacatagaatttctcattagccttgggaagtggttctggcagttggggccccttggtggttgccaggatggagaggttctgctcagagtgggtgtgctcattgtcctgtcatctgcacaaagggccacagcattgagataacctaggcatgctgctgctttgcaagcccggacacctccggacaatcctttcctctgttgtcttcattcccatccatagagatgggtcacatcttgtcctcaggaacactagcacctttctttttgttggagcagaaattttataaaacaccctagcattttggaatatagttttattccgatgagcagtttagaaaaatttatggtaacataaaatttaccattttaaccatttttaggtgtgcagttcagtggcattaagtatttgcattgttgtgtaaccctcactgcaatccatctccagatattttatcttcccaaagtggaaactctgtattcattaaacactaactccccattccctttcctccttttccccaatcaccattctactttctgtctttacaaatttgactactctttttttttttttttttttttttttttgagacggagtttcgctctgtcgcccaggctggagtgctgtggcgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctagatctcctgaccttgtgatccgcccgtctcggcctcccaaagtgctgggattacaggcgtgagccaccgcgcccggccctacctttcttaagtgtagagttcagcagtattcaatacattcgtaatgttgtacaactatcaccatcatccatcgccatactcttgaccttgtaaaaccaagactctataccaattaaattacaacttctcattttctcctcccccagccactgacaaacactattctactgtttgcctctctgatttttactaagtgcatcatttaagtggaatcatatggtatttgtccttttgtgactggcttatttcacttaccataatgtcctcaaggttcatcatgttgtagcatatgtcagaatttccttcttttgaaaggctcaataattttccattgtatgtaaataacacattttgtttattcatccatccatccatcagtggacacctggtttactttcacattttggctattataaataatgctgctgtgaaatgtcttctcaaatccctgctttcaattttttgggtatatacacagaagcagaattgctgaaacatatggtaattcttttttctttttttcttttcttttttttttttttgagatggcatctcactgtgtcgcccaggctggagtgcagtggcacgatcttggctcactgcaacctccacctcctgagttcaagtgattctcctgcctcagcctcctgaatagctgggagtacaggtgcatgccaccatgcctaagttttgtatttttagtaaaaatggggtttcaccatgttggccaggcaggtcttgaactcctgacctcaggtgatccgcctgcctcggcctcccaaaatgctggattacaggagtgagccatggtgcccggcctcatatggtagttctaggtttgctttttggaggagctatcatactgttttccatagcagctgcaccattttacattcccaccagcagtaaacaagggttccagtttttccacatcctccctcacacatgctattttctactgttttgatactagccttcctaatgcacgtggagtagtggtgagcagtttttatattgttgttgttttctatacagagttagtgtctctaattacactgtcattaacaagaagcaaaagttctcagaaaagagaggtgttcatttattcaactcttagtttaaatagcatgtaagatcctgaatctgaaaccatgaaataaggaaattacaatggataacagcttaataaaaacaatgatttaaagagtaagcttagaaataaagaattgagtaagcttcgatttaaagaataagcttagaaataaaaacaatgaaagatgtaaagaataagcttagagaatggacttacagaaaacagtcctccaaggtcatcatgagaatattgtatttttattcatattgctatcagtgtagtccagaaaggaaccttatcatactttgattagtttcagaaccttttaattgatttaatgtattcattaattgcctctaccccagcaatttccctgtctgtattcctgtccattgccccaatccccttctaatcagtacgcaccagaggctgagtcattctaaaatactacttttttttttgtttgtttcagacagggtcttgctctgtcatccaggcgggagtgcagtgggacgatcttggctcactgcagcctcaacctcatggactcaagcagtcctccacttcagcctcccaagtagctggtatcacaggcccatgccactatgcccagctaatttttgtattttttgtagagatggggttttgccatgttgcccaggctggtcttgaactcctaagctcaagcaatgctcccacctcagcctcccaaagtgctgggattacaagcatgagccactgcacttggcctgaaatgctacttttcttaggccttgttccctacttagaaagtttcaatggatgcaccatagttaactcaagatctcaacattcaatatcctccttagcctcaataaagccttatctttctcaccttcccatatgaacacttcatccactctgactgctccctgaacaggccaggcactttcctaaccctcctgtttttacatatgccatttcctctgcctcgatcttcttccaccctcatttctacctgtggaatttctgttcttccttctagggacagctcaaatcctactgcttccataatgaaactagtaatgattcctaccagggatatgcactctagaatttgaacacagagctcctctttcctgtgtaccttacacaaggtactgttacaaattttccttctgtcatattgtgtttgttacaatgtatgtattttaaaatttttctctgtttctgtgtgtcttgcctcactggcagccaacactattcttgtgtttggatactagcagggtcttcagcttacttgccagtgaaaagtgccctggcctcgagtcagaagaatcctttccactttcagctttgtagttagtacctgtgtgattgtgggtcgctgactttattcactcatttgggtctcagtttcctaatatgcaaaacgagaaggtaaaatgcttttcaaggtccgtttaaactgtatttggtcctcagaaatgacccaaacatagaaatctccttcttctggagctttttctggagcttattttctcttcctctcctcttatttagtgttgttctcaggagaacacatgtgggaaaacaactgtgaaacttttagacactctaagagaggagaaagagagctgaatgagagggaaccttcaagggaaggtgtctcttttctccaaatcttatctccatggcctttttgtgtcatttaaaaaaatattaacagttatttgcattcgctggcatcgtcttttcaaaaagcaaatatgattgcctctgcaagcctgtctttgaaatgataaagtatgattaatccacagctgtattctttagaatgagaaagttcagtcatttgtggtgctaaaatgaaaaaataaagatttgaatggttttactatttactgtgaatttatttttacaatgtagatggggcattgttttaggttctaataattagcactgttgctgaaatggatgaggtcagcacagagagtgtggagagcttggttttcaggggggtggcagcagttctaatggctgcagggcgaggcttcctgctgagatgccagtgttgggttctttctcaaattatgatttttatggtttgggcaagaaaaggatgcatttaagctcttttataagtaaaatgagcaatgctgaaacagttgtcaaatgggaataatttgatctgacttttacaatttctgcatgaagaggtattggcagctccatggcattggggcaggatgggcagggcttagctgggctaggtccattttttttttccttcagtttaacgtctccgacccctggtggattcacctactgcagaagagccaatgctgcttataaattatgtttcctcaatctatatctctagcccagacctttctttttggctctctatctgaacatctaactacttacctggtaacttatgtcctacaaacactttatgtgaaatattttaaccagtgcctcatctccactgccagtccctctgcacatttgtatcctaataatgactctaccctcactgctagtatgatcaccacagttattcccagtgacttccttggtcgacacttatttggtgccagagtagtaggcgctgagataaattcagttaacccctcaccatatggcagcattaatattttttagttacctcaaaccagatacctctcctgctccataccagattagtgaccacatcccactgattctacgtccttaacaaatctcagattcgtcccgtcttccctcacttcaacttctctgtaatagattcttactgcaactgtaacagcctctttatgcatggattctttccttctcacatccattttctatactgttgctagagtggtctttctaaaatagaatagatggtactgtgcttttacctaaagcttttcggttgacatcaggataaaactcagacccctttgaatggcatgtgagggcttttggcttttgtcccaagtgttcttgtccagttctttctcctatccagaaccttgtgctacactgatggcattctctacatatgccaggcagctttagggctctgtggatttgcacatattgttctcttttcccagaatggtctgcttctctatctacctgtttgttgtactgtcactacctgtcatttcagattgactgtccttccgtggaatggttaaataacactggatagccctataacggattgtgctatagtctttacaaatcttcttgtaggagaaaatatgatgacttagagatatgtttatattacattgtcaagtgaaaagtgttgtataatacatgtgtgattgacttttctttctttgcttttccttttcttttctctttctctctctctgtgtctccctttcctttcttccctctttctccctcccttcctccctccctccctccttcccttccttcctctcttctctcctctcctctcctctcctctcctctcctctcctctcctctcctctcctcccctcccctcccctccccttctctcccctcccctcctctcctctcctcttgtcttcccattgatctttcaataaaaataaaagcctagaactctatgtagctaaacgttaacagtgtttatctctgggtattgggattattgatctttagaatgatcttcattttgtattttctaaagtttctataatgaatgcacattactttttaacaagaagtagtaaatgctattttcaacaaaaaatactgacttgtggcaagtactatgtcttacttatctttgtctttttagaacattgccttcctcatggaagatgtattagttagggtaggctaactgcagtaaccgatgatacccttaatatataacaagtaaaatgcgatagtttatttctacctagtgaatgaacagaacacaagatgttctggtcctgactttcccctgaataaaatctgcactaactaacaccgaggcatagccaaacctcacctccagaccaaattggctgaaataggcagggttccaatttgtgacggtcatttatttttaatggcctttctattccctgaaatgtagacaaatttgccctttgctgcctcattgcagtggaagagcctcatacctgtgtgcagagctgatgatgaaaggcatctatgtgtgtatgtgtgttgtagataaatagtgtattaactatgtgtaattccttatttcaaagtagcattttatgggtgagttttgcaataaatcttcaacgtttaatgctcactatgtcttgtttcatttgatatcactgaaaatgcagagggtcaggccacattcactctgtctctccctggcatgttaggttgccttctagagctctgtgtttcacaaatcattttgatgtagagactgtggagaaatattctcaggctttatcactgctgacttaattgagtttcatgatgcgcttttttttttttcatagtaggataaattaaaaatggctgataaagctgcctgtaaaagcaaaattgttaggttaaacctgcctggtgtattaaatgtattgataagtaatttggccaccatttttaatcacttttattaactctcaagtagttttatttccagtaacttgcaaaataactgtcattatggactcagtcatatttctctttaaaatactattgaaaagtccatgaaaatgattaaagtgccaatatcatccacctacttcctgttagcaagaattgttggtgattttgtgattagctgagtatatggttgtgctctctttgtgcaacccaggaggaaatagaaccagttcatcccaggtgaatagagataatgaatgggtttgaagccgtgtaacaggagtagtcttttgtgcatctgtatcatgtatgttattgttatgctgtctttaaaacattttattaaatattgagaagacaagatacttgtgaattatgtgtaaagtgtaaagaatcatgatacgtgtaatgtgcctttcggtgtcatctttgccatcggctgttcggctttgtaaggatcttgagttcaaggtcactaaagaacagcttaacacattgtcttgctcacaggtcaataagggatatatctcttcattaaaatggatgagaagtttgtcattactttactgcttcttggctagatgtgtggcttatgcctgtaatcacagtgctttgggaggttgaagcaggagaatcgcctgaggccaggagtctgagaccagcttgggaaacatagtgaggccctgtctgtgcagaaacaaaaaattaaatttgccaggcttggtggtgtgcaccttcagtcctagctactctggaagctgagtcaggaggatcccttgagcccaggaatttgaggttacagagagctatgattgcatcactgcactctagcctgggtaacagaataagacctgtctttaaaaataaaaaataaaaaagaattccctgtattttttccaatccatttgcatagcctccaaatcccattcctttcccctcagatttcggcattcccaccctatgggagaaattattatagttgccattcttaggatgtttcccagataaattacaggaatcataagattgctaaacaaatgtaggtggctaatagaaaaagagaagcagtaagcctacttttttcatttacttattcagcaaatgtttatcaggcatctattatttgataggctttgtactgatttctggcttgacaatgatgaagaaattagacatgcccctttctgagctaagaagataggcaaaagggttacacaaataattatataattacagttgtgctaagcctcatgagggaaaagtacaaggtcccagccaggtgaacatataacagaagaatctatcttagtctgaaagatacaagaaggtctttttgagaaagaagcatttctgttagggtagggaggaggggaaaggaggagaggaaagatttgcatttccaaccttggggcagagaaggtgaggaatagcagaaaggacagtcagcacaaaggaagcaaaaatggggtctgagaagtaaggaacaatcagacgattctagacttccaggattccagattttatcttaaaaacaggggaacccaatgaagggtttttaagaagaggagttatatgcttgtcatttcaaaaacatcacaactgctggttataaggagaatggactaaaagggaataagagtgcatgcagggagctgaggtggggccccagttgagactggatgtgtgcctggactagagtgggagctacagaagtgaagagaagtgaaagatttgagatgatttttggaagcttcttttagccttggctgtgatggggcaatgcctacaaagggcggtggggaggatggcccccagtgttctggcttgagcaaattgtatgcacagtaggtgatgcgatggcaaatactgcaggagaagaagcccttgtttagtgtattgtcgacatatccacatggaaataccaaggaagcatgtgcttgtttggagctggaggtcagaagagaattccaggttgtcttttgagtgtggtggttttggacaaggacatgacatttctagctccatgaagtagataagattgcttagggaaggtgggagagtgtaaggaaaagtgaagagaaaaggaagcataaggaacagccacctttaaaggtgaggcagagtgatgggaaagaagcaattagagcagtgaaaggaagacccaaaaaggattcaggagggaagagtggctgctgcatctgtgtccctcgaacatcctgatggaagaggaggaagacagagcccaaaccaggactttttgagtggtgactattgccacacattttaaatgtaagagtgcacattgcatttaggaccagtgaggacttaggacagagttctggccaatgccagaggtggagcccagaccaggagcagactgaagtactatttgccaacttccggttaagattgggttttagtaatatttttatttatctggacataagtagcacaaagctgttttaaatactctgaggctttctttggtggtgggggataagactgggaagaataactaatttgagagacccaatggatagtttgtataaagatatgattttcaaaaaatcatcaaaattgattaagtgttactaacgtgttgctgaaggtcactcgtttatgtgtttttctcctgagctaagaattctttcctatgtaccacctaagccctttcagtgacaaattattgttcaaatttttcttggcacactgacttgagaattaactaccattcatagctggtacccaggtcctatgagaatacaatgccttgtcacataaatacttgtgaagtgacatctatcaatctaatttagaaaaatatttgagtcaaaaggtccttgaaccatgtattaggttgacacaggagctccctttatctgaagctgtgactgagcattttaatgaatggcagtcaaggaattcaaagttattattctgatagtaattgcgtgcatttttcctgcccatctatatgcagccttctcattgtctaggaagctgctgatttgatgcattcatagctattatttgcatagggaatttgaaccaccatgggaagaatgattttgaatttcctgttttcatttatttactttgggtgcaataacagtgttttcatggaaggattttttatattgggtttttcctaattttaatacagtgtaaataagctaagtgttatatttctgaaaaccacacgttacaaatttttaaaaatgggggaaagatgaaaatgaaataaaaagatgggaagacaagttctgaaacctctgaccttacctgcgggctcctccctctagttgaccatggagaaccatagatgacttactgggccagatattctgatcttggacagaccaatggtttgtaaaatgggttgcatattatagtgtgcaaattcctggactagacttccagagatgatagttcatgtggcccagggtttgtcctgagaatctgcatttttgaaaagctctccaggtgatttttagtgtgcacttaagtctgggagctcttggaattgtttttttcaactaataaagttgaagacaccctgcacaagattagaagatggataagaaaagagaattagaatttactgagtttctattatggctgaacatgtttacatatcttacgtcatttattctttaacaccatcttgcaaggtatatcattttgttccaattttaacctgagattcaaaaaggtttacagaactttaaaggtcatgcagctgctgggaggcagaacctttatttgcctccaggtcatctgatctgctgtgtagaaccacgacaaggctgggaacaagaaggtctggatagaattctagtcacaccatcacttgggtgaggtccttttgccctctctgccaacgtgggtacctgttgctaaaggtagactttcctgtttatcatcaaagagtgcctataggtagatgagtggggaggactgcatacattttgagagtagtaaaatcagatccacttggacaaaactgtcttcaatattctacaatgaacatgccatgttattgtgaccagaattgacattgtatctctaccctacgctgacaagttgattgtctgagcgaggaaacagcactcatcatacatttatatttctccaggaaggaaaagagacatggtagagtctagtggggaaaaatctggcttcagattggacttagtacttgaattaagggtcaggcattggcttctacctctcactctgtactcatgaccttgggaactccatgtttctaaactttatttttagttttctctttgtaaaatgagaatgatgtgtctctctcagatcagtgagtaccagctgagatcatgtctgtcgagcacttaggcagtggtaagtgccttctttctttctttgttttgagacagagtcttgctctgttgcccaggctggagtgcagtggtgcaatcatggctcactacaaactctacctccctggatcaagcgattctcgtgcctcagcctcccgggtagctgggattatagacatgcaccgccatgcctggctaatttttgtattttttgtagagacagggtttcactgtgttggccaggctggtctcgaattcctaacctcaagtaatctgcctgccttggtctcccaaagtgctgagatgacaggtatgagccgccacacctggccacagtaagtaccttcttaatgttaatcagcagagggaagggagagtgactctctgcagcaggattcagtggagctagagatccagactagcaatagcagcagaatgaagatgaatcttgactacttgattgctgcatttttcattattttaggaacccagcggttctcctaaaatgcatgccaaaggtcctttgacagggtgctgctccagctgtggtttgtcggtctgcagtgttgtaccaccctggtgctcattaggactgcaaattcccaggtcaccttcagatgtaccactctccagatgtttctcatgctcactgcagtatgagaagcactactttaacaggcaacctccttccaggtgaatcatgtctggagaagttgcttggtcagagagatatttgtccaggctcagccatgctggctctgcagcgagggttccttcactagaacaccatgcatttgtggtggcagcataggtagaaggcactgagcggaaacaagaggagcgagatggagaaagaaaaaaaacaactttcccggaaaagttaaaatgatagcatgacctttctgaatggactttgggacatggcaccaagaatgagcaataatgaaataccaaggaaggagactccttaggagagcatctgggaaccatgcaaccatgcgacaagaggtgatgcagggaagctggtgagagggtgaactgaggctcccccaggggcgaggggggatacctcctttctgaacctcatgctgaacccgaccctcaggagcaacagattggggtaggagcttttggagaggggaattgaaatggccttgttggcagaatgactctgaagggaactttccagcacacccaggaaaaaaacaaaacaaactccccaatctgccagactccactttcttaactggagggcagggtggttgctcaaatattttgggctcagggctttggaaagatttcttgtcttgctgcatgctctgtggaaccaggctgagagcaggatttttgcatttagaatatcttagcagaactgggcaagatgaaaaccaatctttttgtagctaccaaaaagtggacatacttcagctttctgtcttctccctgctgacttgggtgtatttggtgtgcttgctctgtgctaggcccttcctgtctcttatctcactaaatcttgacaatatccccagagattggcatcattatactcattttacagatgaaactgtctcagaggggttacggaatttgcccaagacacacagctgagtggtgaagctggaattcagaaccaagttcggcttattagaaagtattcttatatactacatgtagaaatgaaacgcaacgtatgtgacagccattataatgtaaataataaaagtaacaggattttctccctgccctccgtaattcagtatacttgttgattatttgctgcttctggcaagctatgattgattgctgttctgtgggatatggagaagtttgaggaatttatgatacagctggggagaaaagacatattgatgcttgaccaggattaagccaccatatctcacaggtgtttagacaaaggagaaggcacctctgctaaggcacatcagggaaatctctagggaagatactgatttgacatagtactttctgggtatatagaattgtttcattttgtttgccgagtatgttaaaactgtttgcagggtgtgttaagatgatttgcagaagaatgttgcatatattattcgttttgatttggaaaaacaattaaaacaaggagagtcttattatttgccctatctttgggtaacttctgtactaacaaaactccggctcaccagccactagagttaaaattctcactaaagaaattgactaaatggaagagaatttatttctgatttcctttttaatgtaaacatatgtattgacacttttccttggaagaagtgtagtttctcttttagtagaaggaaatagaattatactctggcttaaattctattattataaacatacttctgtttttatcttgagataaggctttcctatatactgttgggagtctatagtgatatagtcattttctatattatttggccatcatttattcttttaaattcatttataattgtttttgcatgttttattgctaacatttaatagtgaccacccattaaagctattgcagtacctaagtatttataaatttttctgacatgttattgcttctggattataaactgggaaataattaagattcttgttcttgttgtaatgctgttatggtgatgatttagtatttccccaaacagtttatataatatggtctttttccacattggtatgtttctttatttgctggacagggtattttaatggttacatctaaatggaataaactcatagagctgttgatttgagaaaaccttctataatgccatattaatctatttagctcccagacctttcttagcagatcaaaggaatttcctggccactcccagaggtctgaccgccttttatctgttttaatgaaggtaattaaaattcctcagcttatgaaggtctggtcctggtcctaagtgaactagtccccagcagaatctgaaagaggactataagcaagccatttatttctaaatttttaaccttatatttctgtagatcctgattaaggtagttcctgcagtgtgagggcaaacttaggttgccagtattttagggaaatatgagttcttctttcataaactctgatgattattttgattcctgtatcattcatttgaaatgaacctgcaacactttgtgggtacataggaatgaagcaaatgcactctaaataattaaccagttgtgtcattgatttctactgataggtttatagcaaatgactttacacaaagttattaattaaatgctgtgttctgatgttgtctaaaaaatgtcatctggatgtccacagtttaaatcctcaacaaaatgttaaaagtcacagaaaaagtctttgacatagcatgacttaggatctccatattcatagttatttgttgagtaaatgtgctttgagcacttatcatgagccaaacactgggctaggtgttacagagacagtgctgaacaaagacctcgccaatatggtgcatattcccattttacaatctgtcagctcagccagtctcttaaaggccatcttttcctcaaacgagtttctgaaatgaaaatgaaaagagtcatttaaggatttaatctgagttctagtctataccctgaccacacaatgggcctcagggagaagaaggaacaagacaataccttactagagcaaaatgacttcccattatagaacatggtctggcactttcaagataaatgaagctgtaaagttaagttgtgcaattagtggacagagacaggtaatttgtgggcatggaggaggtttccaaatattcacagcaccaagtgatcaaaagctgtaagtagcatttgtgcacttttcttcatacattttacattaagaaaaaaaccatataggttgatattaagcagctaactgaaaatgaactgtccttaaaaagtaagtaaataaaaaacagcacttttcctgatgaatgaaggactgtgaaaaagctgttatgggcttagcctatgtagttcccagcattattttaaaaagatgaagaaaagaatgttgaagtctttgcattttcaatgcctaccaggtgcacctgccactcctgcatttctgggtttcacttttgtccattgctagctctcatttggtctgcaaatgtctgagtatctttcatgttccaggaactgtttgtgtgagatagatgcaatggtaaataagtcaaggtcgtcaccttttaggacctcatcctaccaacttaataggtgctagcagagactcgttgtgtgtctattataggataagtgagtgaaagtcctccttaggtaggtttcatcatctgcacttggatggaatgaatttatgaatgttcttagagacacttatagatctgagaaataaaaaacacataccaagaacttattgttgggatgaagaagagtaaataggggaattttttgggttcctcttctcctcatcctccttacaactcctcctgctgataagatatttagtcctatgattgacccagactgtcattttttggggcccttctctccatgcctgtggccaagccctgcctgggcttgtattaccagggatgactccacatgcttcttgcctgctattcacagaaggccctcttgtcttccgtgctcactgcgtggatggaacacccaggcaatgggacaccaggggtctgtatgtgctgcctgtgccagtgttctgagaagctccctgagactggtttggtgtaagggctgtcagtctgctccacaaacccagaataaattggattggaaaagtaggaaacctcatttagcttttgtgcctaaactttgtatacccaagcactgtttaccaaaaaagttctggatttggaagtagttaagtattcaaaacatattcaactatttatgaaaatgatgcttattattctatgtttatttctctcagcagggaagcccaaagagtaggggagatgaggagtaggttgtggaatcaacacccttcctcctgcctccaaaccacctgcactgcccaaggaggggccattcttttttgggagcccattatgtacttagctgtggatgagggtgtatgtgtgtcttatattcctgcttacattatggatagaagattgaaggtcacacttctgtgggtgtcctactgcacccaaaagggtattttacataaagcatgaataattgcaccttttcccccaaatgtcatatactttgatataacattttgtagagttaggagtcaggctttcatggggaagagggctgggttatgtccagttaatgggcaggcatgtagattatactttgcttttgataggtgagggactctttcaagtactattctacttcctctgtggttagtttttttctcccattcttctattctttttcatctttggggctgtacatcaggggaggagggtgctgcagtttgctattataatgggaaaaaatgagagagaaagcaaagagagtaggtaactgtactcagctttatttattttatccacacctcaagctcttattaggaaagggtgggttcttcttttctttttttttaggggggcggttttcttatagaataattactggtattctctggttgataagctaagagaaaagagagtcagggaaaagtactttactgtttttctatgttgtgttcattggttgtttttgtctgtctagtaccaaactttccaccaaccacataccctcttcacggttcccctccttccttctccaacagggaaaggcaggcaccagtggattcctctgtagtcaagacttaacataaccaggaattcttcctaaaggaagaagctatcaattagctaattatacttttcccatcccaaatttgttggacttctttgaagacaggatgatttaaatgagtggagaaggcttacctgggtggagggaagcagggagtaccaacgcatagagtgggaggaaggttggaaatatgagtgagagaaggtgttgatagtggaaggttgcagagaagttgtctgagaacttattcagagccagatggaggaattgttctactgattctcaagaagaattgagagttcttgcagcaattgttattatgtggttttgcaacttctctataatctcttataagagtagtttctcttagaagcctagtcagtatacctgaaactttaattccacttaccattataatgagaaaataaattgtcttattagattctgtgcaccaaggggcaagacctgaaaggaggatggaacggtgtgtagcggggatggcagttgatctgcaaaatcaggcatggaaattctgaactgttattggagagggaaaaggaacaagctacagttaactggtaaaactcagtcatattataggttaatcaaggccatagactgtgtgcttggtactatggaagataaagtgatatggaaagcatgatcagtgaccagtgggcttgtaatctaaatgtggagacacccagaccttagaaaataactatcccataggattatttttggcaaaatgtcaaatgaacaggtcatagataaatgatttaagaattcagaggaggtagagctcacttctacctggaagggtaagaataagcttttgttgacggggagaggctggaggtggaccttcaagggtgggtgggacagagatttgtcagcagacatgaatatggggtgctgggttgggcactttacacatcacagtgtggatacaacaccctggaaaaaccctatcactcccattttagagtaaggaagcataggctcagaaagtataaatatatgacccaaacttccttaaccattgacaggacaagttatagctgaatttcagacttaagccctctggctccaaacccatcctattccagtaccagtttgcctttatgaccttctatacacagaaatgctctgagaacaagaaagcaagtattttgcacccaggatggaaaccacatcattttggtaagggtacaggtcatttgggaaaaaatgagtgatgagtttaaacagtggtctaggtttggaaaaatagtctagaactattgaaggaatttcaggcagagaatgaggtcagccaaactatgttttagagagaagagctgcaaaaggaatgattttgtagatatggcaaatgtttatttaacttgtagcattttaaactagattacttttagcttaggtctgcatctgaaaatcagtgatttacgtagtcaacctttatgaaagttttctttgattagtcaatctagaaaagcataggctttattttttttaatttttatttctcatgcttgtgttttgttgcattgcgtttatcctggatgccttaatgaaatggtgcgatatgacccagggctctcatctgtttaactttgctaatttgctccattttcaaatgagtttccttggctgcaggagcagcagcagagcatgaactctgctgaaaggaatttcagttacaccgctactgccacctctggggcccccggataattttcttatcgtctttttgccgtttgggaacaaagccacgttgttcacgactgaaatacagtttttaaatgtgcctcctaccgtgtttttatagaaagagagcctcttctcctggaaaataaaacaccattgattgaaccaacagcccttcgaaagggctttaattattgcattaattacaaacttcaggacaaaccagggcccagtagtagggagccattgagcagatttctgagcggctttaaagaaaatgttaaaagccttttagatctaagaggctgaaattgagagaaggaggtgggcatgtgggagacactaccttcttcaagttataagctttgcattaaaaaatatcctcttccctctctgatttgtgtttcctgggaaagctccaatgactcattgctccaaggcctcaacattttctaccctgacattgatgagagagaggaaagtggggaggtggtctaaatgtcatagagtagaacttctccaaaaaaataggtcactggggaaaaaagaaatactcttggaataatcctttaacatgatcatcttcaaaatgctcactttttattctgaagaaaaagaagaaagaaaaaaggcaagtaatttctttctctggcaaaacattcactgaggtgttttcattcaattactttgatggttggctgttgggaaaattatcaaaagtgaatatgggtttgggaactactagaagattctcaaagttgctttttatgatctctttcccagggaaaataaatcattaaatactgaggtggctagatgaaattgaatgctacatctcatggtttattcagaatgggctcttccatctgacatccttttgacaggttctaccacatgtggcatttctggcaggtatgagggtaggtttcacattctaaaatgaaactggcagtcacacgtttccctggtttaaaacattttagcacttattatgtgccaaatagtgctctaagctgtcaacatgttaactcatttaatccttacaacaattttgtgaggcaggaactattataactatttagcagataaggaaactgagccttagcaaggtcacagtggagagcaggctgtccggctccagtgtctacttaattctaaccgaatactctgggagacaaagacgttcgtctcaattcatatcaccttgaatattcattgccagttgatgattgttattcttaattccctgcaaagactcaaccagtcaaacaattaatcaaatactgatttaccaattttctgggcacaagattaggcattaggagatgagtaaagatcccattcctacattaggagttcccaatctaatacagaagatggataagcaaatagggtgccagaggttggagtttgtggctcagatttgggagggttcatttatcaattcattattttaacaaagtgtagtgctagtatatgccaagcactgtgagtgattcccccatcccctgctcctcagtggttgcagtctgatcaggggagatggataagcaagcagcatgttgcattttggtgtgataattgctgtaattatgggcaagtacatgcaggggtactacatttgtaaatgtaccaagggaggtaatggcctgttcaggaaactgcactgtgacttagcatggctggagggtccagtgaaagcacagagaaggtaagaggtgaggctgcagaaggccccagaaagggttgggagtcaaggacattgtctgccatttcagagactctggactccattaggacattgagaatgttacttggtacccagcagtaagagttccttttcatccaagctctcatgtcactttaattgaaaagtagaaaagcagaaagaaagagtatcctaaaattaagcaatgataagacactgcaaatttccgaagattggaaattgccacttttatgtagagcttatggctattttctcgctggagacagactgaaaaagtgaggtccatatctgtgtctatttctgggatattggctcagcaataaagatgttagaaaaaataaaatgatggggttaaaaatcaacacatgtcacattaatttctgattcttctattggaagaggatcacatttcaaggtcaaaagatggagcagtgagatttgtagagagaaaatttatgggtggatatttgaaaattttctataagtaagcattgagaacattacgaagctaccagattttgtaattttcaaaattacaaggaatgtagtggaattggataatggatggtggaacctcttattcttggatcattggtttagatagatcccagattggcaataatggaaatttatttcaattttatgtctgctcagtggctgaaatgaagtgggttaataggtgcagttttgctttttgtggaggaatgccctagtcacagaaacccctaaagcaaactggcctttatatccccccagatgtttttccaggatgggtagtaacagagagggatatctctttgtcttggatttcctttatattgtgtgtcaaaatggacagtgtacaaagagtactattcaaaagtgtgagactaatctcagtttattgtgaaattcaatggatcacaaagtactgtgtccccaaaccaaaacagatgattggaaaattgaagactagatatttggaattgcttgaatgctggaggatggtgtgggcaggggtggaggcctgggtttctggcatgtaaccctaaagtcctttttatctttagtcttgtattctacctgagtagtaggtattgtgaaaagtatgttttctatgagtttacagatacagttcctggcataatgtacagcatatagcaggaatcctgtaatcattgaaggagttaataaatgatatcatcagcatagaacagtttggctgctttatgtataactcaggctactacagattgggtatctcttatgggaaattcttaggaccagaagtgttttggattttggatttttgtggaatatttgcttatacataatgagatatagaggggacgtgatctgagtctaaacatgaagttcatttatgtttcatatacaacttatacgcatagcctgaaggtaattttacataatatttttctttttctgttttttgagacaaggtctcgctctgtcaccccaggctggagtgtagtggtgcggtcatggctcactgcagacttgaccttctgggcacaagcgatcctcccacctcagcctccctagtagatgggatgggtctacaggcctgcagcaccatgccaatgcccagctaatttttgtattctttttttttttgaaatggagtctttcccttttgcccaggctggagcacaatggagcaatcttggctcactgcaacctccacctcccaggttcaagcgattctcctgcctcagcctcccaagcagctgggattacaggcatgtgccaccatgcccggctaatttttgtatttttttgtagagatggggttttgccatgttgcccaggctggtctcgaactcctgggctcaagcaacccttccaccttggtctcccaaagttctgggattacagacatgagacactgcactcagccttatacaatatttttaataattttgtgcatgaaataaggtttgtgtacattgaaccatcagaaaaaaaaggattactgtctcagtctcccatgtggacagtctgtggttttttggcatcaccgtcactcctgactctgaatttatatgctactgataagctttgtgttcttacacttattcacgcataagtacttaacagtaaaaaatatgacatgcatatctggtgtgcacagaaaagatatatcacagatgaaggaggctgggagggccttttttcccttggggacattgaataaagcatgtgtgtgcacctgtgttttgattgcgactggtcacatgaggattgggtgtggaattttccacttgtggtgtcatgttggtgctcagaattttcagatggtggagtatctcaggtttcagattttcagatgagggatgctcaacccataaacccatatagagataaggagtcttggtacaacatgtgctttatagaaaggaaaattttaggtctcagttgtagacttagagaaattcaggactaagacatttctgtgcatttagttccttttcatttttattttcctaccaccttcccccagccagctttcatctttttctctcaaagctctgcaaatcattgaaaaaattttccatgttattttttaggacaaaaacttactaaaagtcatccatccagcactgagttcttactcacgggggtcaccactgctgtgttctagttcctttgcttttgttttgttcactggcccctcctctccaatccctgagctcctacactgcaggccttcctttttattttacgttttacactctcccaacctgactttatcctttcaatcaaagatcattaataaatcttgtattgccattacctcataaaataagtattccatttaatcacattatctatgtatctgaaatcaggaagataccgaaaggtggtaaacaggaaatgggaatattggcagaaatgtactactgtacagctgagaattgtcattctctttgtttttttttttgtcgaaaataaaccttctgacagagatgatcagagaaagggatcataagtggtttcatatgaatatcaagattggctcccattacattttggcactaggtgttaagtttttatctctctgatcctgataggtggtggtacttggtgggcagtgtcatgaaaaccaagagaaccagggccttatatttcttttattttaacttgggtttttattttttttctttgcaacttttatattatgttcaagggggtgcatatgcaggtttgttacttgggtaaattgcatgttgcaagggtttggtttacaaataatttcatcacccaggtaatcaacataataaccgataggtactttttcagttctcacccttctctcgccctcaatccacaaataggtcccagtgtctattgttcccatctttatatccaagtgtactgaatatttagctcccacttataagtgagaacatgtggtatttggttttctgttcctgtgttaattcacctaggattgtggcctccagctccatctgtgttgcttcaaaggccatgatctcattttttttaataactgtaaggaactcaaatcaacaaacaaaacataacttgagttttgagaggtgttttctaccagatacttccctttgaactttgtatgtgacttcctagagagaaagtgtgttgaggaagttcactattctattctgcagtgagagaagacgacaggctaccagggaaaaatagaagatcaaaacctttttatttatttatttttgtttgtttttaaagtatctgtttccatatgtatactattgtgcaaccaattagttggggatagcggatttttatgtagctggcaaacttatcaggcagaagagaattatcatgtatatttcagcagcaatttatgaacaggtttgtttctaaaggatgcacatgtattttgggtttcactcttagtttcactctgattaatttgcttaataaatcttccttcttaaagacagaggagaggcaaacacaagtcaagcttttgttttagccagtagatttataattaatgacttttgttgatttaagaagctttctgaacaattcttggaatgcagtggtggcatcatgaaaggagcaaagggaacattttcgtgggacataagtaagatttaggagagggaggagttcacagactatcattaattttacaggaggagaaaatcaatgtcagtaggaaaaaagatacgtacaaaagatgacttctggatttgaggaaccattctcaatagcagaaaatagagctgttctcaagacatatgttaggtctctcacaatctatcagcaataaaaaaagatagcaatatagagatgaaagaggaagagagaagaaggattaagatcagctgtcaaaatgttgcatacaaaatgtattgaatgtcactattataagaggtcttactgtaattaaatttcctgtctatttggatttgctcatcttaaagctttttcagttgtcagtgtgagaaatgtttcctatctaggtgttttttcctccctgttaagtatcagcacagtgtaattcaccatagttgggtagggtggtactgagaatgtttcctacctcagcaagcctaatgtatatgattgctttttgtgaagagttttttttccatttctaccattaacaaggtgttagacacttagcttggtagtagacaaaccattagatcaatattcccagaactagagagttctgatattggcaggcattatttattccattaaaaaatgtcatattcatttaacaaagatggaatgcagatagtttcaccgaagccatgagtgtgataaaggctatagacaaaagattcctgtgaagtgaccatctggaccagtttaggtgttaggatttctgaggttcttgaacaagagctgttcctgctagctcatgttttagaacccatgtacaggaaaattgaggttgtgtttaaaaaatatggcatgtagcacaggaaatatgtgttttcagagcaaatgataacttaatattggctgaataatttgtaagaatactgatttttttgtcatataacctatatattttcttaaggaagataggtttataaggaaaaattgcaataattaaactgagcataccaacaaggaaaaataatttaactattatgatgactcatttagttggcatcctcgagtaatgaggtgctctagattaattttcctgagagcagaaatatatccctttaaatgattaagcattttatcttcatcaatctttgaataatatatttccaagatatattttacattcctttgtgtcataaatatgctttacaatgtatagggctagaatcatagtttttttttttttttaagagtttaaagaaacactgggagatcttggaaaataatattaccacattggagtgcaacattcttgtctctgatatatgaggttttgattagatgatcatcaaaattccttctctttctaacattctctaaataaaaagtcgtttatgttttaaattgtagtatatataagaatcagctagggtctttgttaaacttgcagatactcagacatcatccctagaggttctgatttagtagatttggtgggagagaagagaatccgtatcataaataatcacctagagccattctgatgacctcatttagagaaacactgattctctttccactcttgtataacagacaccattactcttgctggccacgtggtccttgaaaagatcattgctgctttaccctcagtggcattgagttgtgaggggctgatgagactaataactatgctttgatagtctttgctttctgaacctttcctcagtattacctgtcactttgttaatggtagctactgaggaaaaccagatcatcaagcttattaaatcagatgccctgtacttgtacatttaataagtcattgagttctaatcttaggtctgggtagaggcaggggaaggactgtctattttctcctgtagtctaaagtgcatgcatttagcagtgatgattatattccctgtttggaggtcttttactcttttgtcatgttctggttgttttaagaaagtcaagttttctagaagcatgacgtcagaataagtggcacattactctataaatatcttaattttcatggtgagattcatagtcaggatggtctatgactttcaaatattaaaaatttaaatataccataaaattctcctttaaagtatactgttcaatgatttttagtaaaatctgtaaatttagagttgtatgaagccaacaccataatctaattttagaacatttccatcatcccccaaaagaaatcaggtaactgttcccactcctaaatccagtcaatcaataatttacttcttatctctatagatttaccttttctagacatttcatatgaatgagatcatacagtatatgcccttctgtgtctggtgtctttcagttagtgtaaagttattgaggttcattcatgttttagcatgaatcagattgccaaataatattctgttgtatgcagttactacattttatttatccatttaccagttaatggacatttggattgtttccactttttgactattatggctagtgtgttcaaatctttgtgcagacatacattttaattctacttgagtagttttacctaggagtagaacttctgggtcatatggtaaatctgtttcaaggtagcagtttcacatgttacagttctacccgcaacgtataagggtttcactttctctacatccttgccaatacttattattattattggatacaagtcccttattggatatatgattttcaaatactttcacctagtcagtgagttacctttttactttctgaatggtgtcctgtgaaacacagtatattttattttgatggatccccgtttatctttcatctatgcatctgggtactttttttttttttaaagaggaatctttaacccaatactcatgccttcttgaggcttactcaagatcttgtaagctttgtttagtatgaagtccctagtgatacctagcatatagcacctagtttaaacagattacagatgaatattcaaagtttttgacctgaatttactgtagtcaacagttaccctaaagccttaaagattaccaaagccatgatagactcagccaccatcatgcaatggctatgtccttcgtagcatcctttcttcacattcatctttgctttcagcatatgaaggggggaatgtaggtctttaatttaccttgtactgtggggtagcactatcctttccttactccattttcaggcccttggatgcaggacccttctctgaggtcccacagaggtggaggcccagcctgagcttttacaggttttagagtaagatgtcaggacagcagttcacactcagccacatcccattaaaagaaataaaaaagtggctgggcacagtggctcatgcctgtaatcccagcactttgggaggccgaggtggatggatcacttgaggtcaggagttcaagaccagcctggcccacatggtgaaaccccatctctattaaaaatacaaaattagctgggcgtggtggtggacacgtgtaatcccagctactcgggaggctgaggcaggagaatcacttgaacctggaggtggaggttgcagtgagctgagattgtgccattgcactccagcatgggtgacaaaagcaaaactccatctcaaaagaaaaaagttgctgctgtagagttttgtcataagaacatactggctgcagtgtccataggcaaagatgaagctttactgagggctgatatactcaatacttctgcccagtccacttgagtctgtctttgcctaaatactaaattgtttgaattctcctttagttttagattttccctactgaattgacatggagaaatgttatcaagtccaatttgcaagaatgctggatttccacttggagcttttgttttcttgggcctagaaggcatctcttgtttataaaaaaacactgggcatcattgtacatgagaaacttaaagacagtgcatatctggtagcagttgatatacagtgtattattcctaaatgtagtaataacaccttacaattggaaaaaaaatgagttatagatgaccaaatgcttccataaatatgatcacatttggtcctcccatctctgtgaagaattattattcctcttttacaggtgaagaaaatgacttgtcagaagtcatttatttccaaatataggacttctgataccaaattttgtgccttttctgtagtgccatgcttcctctccaaagcaatagttgaatttctgcaattttaagaaaatcatatatgtcgtgttatattagacccgtggctaatctataagcagtcatttatattttaaatgaaatccattaatgatatattcactttctagggcttatttccatctcaagcttccatttctgattgtaatgtgtaatgttgcatttcctgtgaaaggaattccaggctttggattgtaggtgggtaagattagtggtgggtcttagagagtcgggagatcctgagcatgggaacagccttttgcccgtaagtttatactgtgctcaaagatagtctgaatagttttaggctgcctggggtcccaaggagactttatgcctcccgatagtaaattttgggtccccaaagacccaacaatatttccatgcgatcatagcttgaccccaatttatggatgcttccttcctttcttctttaatccttgacaactttcttccccaagatttcctcgtgtcagggacccagaggccattcttactatgatctctttcttttccatttcattccctatggcttagaccatttaggtggggcagtggttctcacagtgtgaaccactcatcagcagcaacagcttgttaaaaatgcaaactcaggacccaccccatatctgcttaatcagaaaggcctgggaggttgaaccctccagtccgtgtttgatataccttccaggggttctggtgcatgcgcacatgtgagatccacttgtgcagtggttaagagcaaggattctggaatcagcagccaggtttcaaattttagctctgccatttggcagctaccacttcctgccatccatttacctatatgatctttggggaaattactttcctctctagactttaatttcctaatctgtaaacttgtggaataaaatatgaattacctacatgggaagttgtagaaatgaaataaggtaatgcatacaaagtgtctcacgtgatgtctggcactctgcaagcatccctgaatgggagctttcatggttgatatggactctgaccctagtcattgcctgcacagtgcttgatgaccttcccttgcttgtctctagcagcttggcatttaactactcaattctaaacctgaatgtttgccatgtgctccattttcagtagtatgaaaatgagactagttttcacactaaaatccctgtatgaaatatatttgaaattttgcttaggtcttgcttttgttttctgccacccagccagtttcctatctgggataggacatcgcttttgataataattcaatatttaaagcctttgtttaagaatgtgtcttaagacatgtttaaaagtctaaataaacattatatcctgtctcaatttatctaccacttaaaaaatttcaagtgttttttatctatctatgtctatctattgatatagaatctatgtagggatatagaatctatggattctaaatagattctatatagatatggataggtttgatatccctatctgtggcttttctcctataacatttttctaacttaattgtcagaatctgttctctagtagaaaatccaccgatgtcagaggatcacttgagtctgggaatttgaggctgcagtgagctgagatcatgccattgcactccagcctgagtgacagagagaccctgtctcaaaaagttcatcaacatacagtatacttccaacaaatccacagtaaaatttaatgtattggatcattttcagactcgcggcagccagtccttgggctatttctatgagtctttatgtaactttgactacaaattcgaagttgtcctcaaatccactagaactcctggttggataccattcaatcctggtgatttattttacttttatttgtcagttaggcctagtacatcccttgcatttatttttcctgaatttagcatatttagactgcttacttcagaagagaatttgttttcaaatattctctttggtaaaatatacctcagaagttggatttattccctttcctatcttttattcatctatgtactgcacttatttttataagttcatctgattcttcagctggctttctgccaatgataaattaaaaaaaaaaaactacacataaacgaaaccaacaaccagaaaacccttttaacttgttatttatttatttatttattagcaacctttaaactctttgaattatgtcatgaatttcctctgacttacaagctcacagggcagcattttctaatagtgttttgttttagcctgaaataaaaggttccatggtcaagttagcataggaaaggctacatacttattctatgcccctttatcccctagcctctgaaacagtttagtaattcataattcacagtagcatttgaaacactctgagatgtcctgcatagacaaaccagattaacttggtttgacctaatttcccccccaacataaacacttattaacaatctgtgaactagtgttccttagaccacctttgtgtccattgaatttagaagttttcttattctcatttggcatagcttaatgtttttagatgtgctttagttttttcctctttacctatttgtttctatttggtttcttcacttacgctttttccatatatatttttttgacaagtctgtgtgacccaatttaaacttttctgatgacatttactttgaattaaaaaagattttttgttcattacttatcttcctatattctatattgaaatgattattttaatatttaatgttatagcatattaatttattaaagtattaaatatttatattattaaatttattttaagttaaataatcaaataatattgatattaaatatttaaatatttatatttaaataatatttaattttaactttatattgatataaaattatttaaatattgataaggatattactttggtagtactggtggttataatgtttttaactgtctttcttattcactgaatatattcactgactatttcatggtaggtttttaagctttattgcttttattagggaataaatgactaaagttatatattaacatttacatttgtaagttaatcttcaccataggtaatttttgctttttaaaatttgttgcagtactctatatttccttgcgatacttactctctttgcacatgcttcttcttttgcatgaaggctcttgttccagatatccacatgtctgtttcctttcctccctcagttctcttttcacctgttgtcttctcaatgaggctcatttttgctgctacatttgtttttagatgtatttgtaaacatctagacaccctaccccaacactacctattccccttcttgacttcatttttattttttgtgttgatcaatatgtaagatactatgtatttcttgtattcattgtatttatttgttctttcttaatagaaagtaaacttcccaaaaacaaggattttcatctgttttgtcactgctttgtctctgctgtctagaacagtgggacatattttaggtgctcagtaaattttcaattggatgaataaatacaataatctcagaagatgtaaaaactgcattccataaaattcaaaatccattcatggtacaaaatcagtgaactatgattaaaaggtaaaaacattgagcaaacatgatatttattggtgaaacattgaaagtattcttttttaagattacaaacaagttaatacatctttaatcagcaagataacatttctatgcagcattattatataggaaattctagctaaaacaatacaataagaaaaagaagaattattagtattgaagaggaagaaacaatgctatccctagtcttagaggatattttgtctgcatagtaaccatcccaaaaaaatacagattaagtattagaatgaataaaagaggttatcaaatatgccacaaacaaaatcaatgtacaaaatcaattgcatttctgtactttgctacaaatatttggaaaaggtaacaaaataccatttatagtagtatacaaaatataaagtacctaggaaaaactcttagaaaaacaggaaaagacctgtgtggagaaaatgataaaacaaagatccttgagaaaacctaaatgagtggtaaaataaatcatagttctgagtagaaaaataccaatctacaaaagatatgattctcctaaaattgtttatttttattttttatttttttattattatactttaagttttagggtacatgtgcacaatgtgcaggttagttacatatgtatacatgtgccatgctggtgcgctgcacccactaactcgtcatctagcattaggtatatctcccaatgctatccctctcccctccccccaccccacaacagtccccagagtgtgatgttccccttcctgtgtccatgtgttctcattgttcaattcccacctatgagtgagattatgcagtgtttggttttctgttcttgcgatagtttactgagaatgatgacttccaatttcatccatgtccctacaaaggacatgaactcatcatttttatggctgcatagtattccatggtgtatatgtgccacattttcttaatccagtctatcattgttggacatttgggttggttccaagtctttgctattgtgaatagtgccacaacaaacatacgtgtgcatgtgtctttatagcagcatgatttatagtcctttgggtatatacccagtaatgggatggctgggtcaaatggtatttctagttctagatccctgaggaatcgccacactgacttccacaatggttgaactactttacagtcccaccaacagtgtaaaagtgttcctatttctccacatcctaaaattgttttagaaattttatggaataaaaatataaaaattcctgcacctttttactcaccatggaccatgcaagctcattcctgcccgcacacagaacagcgaacagggagttttgccctcccagatattaaaactgtgtactactataaaaatagcaattaacacagtatagtattgagtagaaaaagaaaataatagatgatttcagacagactagaggacccaggaagagacccacacatttatgtaaaattctttataaagacttgactcttaagacaggtaaatgcaataaatgctacatgacaattggttaactaagtggagaaaaaaaatggatactacctcacatcacacataaaaaaatcaattctggttgcaagacaaatctaggaaattgttagaaaaatatatataagaagatagctttatgacctcagataatgaagaattttaaaaacaagatacaaaaagcatgaaccatatgggaaaagatttagttttactacattactaccctatttatccttgttaaaatgttcagtagctccaaatacaatggaaaaaagactgggaccagtgtctcacaaaagagaaaacacaaatggctaaaactaatatgagaagatacacaacctcattagcaatcaaagaagcttacatttaaatgacaatgacatatcatgttccagccagtatattggagaagctaaaatgagtaatagcaagagctgcagaggtatgggagaaacagaacattgttagaaaggaagtaggttgttagaactaatttgcaaagtactttgactttatcttgacaagtttaagataccttaaatcccatcaattccattccaatgtatagactctggagagcttttatatttatatatgtttatatttattatatattatatataattatatgcattatatatattcacacacacacacaggagatgaccataatattcacagaatacttgcttggaaaattttagtagactacttttagagcaggtttaggatcacagcaatatagagcagaaaatagagttcccatatagccttcatccccacaaaagggcaaccttttcactatcgacatcccaaaacacaattgtgtatttgctgcaattaatgaacctatgctgctgcatcagtattacccaaagtccatagtttacattagggtctgctcttagtgctgtgcattctgtgagttttgacaaacctttaatgacatgtatctgtcattgtagattcctatagaagagtttcacttccctaaagagcctatgtgctctgcctattcatccctctcttcccactaaaacctggcaaccactaatcttttcaatgacttcatagttttgccttttccagaatgtcatatagtggcaatcatacagtaggtaaacttgtcatattggcttctttcgcttagtaatatgcaattaaggttcccaccagcactgaattcccatcagcaatgaatgagagtttctgttgctccacatcctcgccattatgtggtgttgtcaccgtttggattttcaccattccaatctgtagaatcattgttattaattggggggagagacaaccaacaaataaaggaaataactcagaggttcgttagcagaatgattttaaaaattgagggctgtgcatataataaagtgacataaaactatatacacacattgtactaaagtcgatttgctgttttgatattgtactgtaattaggtaagatgcaagcactggggaaactgggtggagggcacatgaagcttctccatactatttctccaactttccgtgtgcctataattttttttcaaaccaaaatgttaaaaaaaattcgagtgttgttttctcatagataaaatactgtccagctatggaagcaatgaaccacagataaaaaccacagggctacatctcacaaacgttatatggaataaaaaaatgcagtcgaataaaaacagatgcagtataatgctcaaaacatacaagctaaatgatatattactttgggatacaactgtgataaaactcaagaaaaacaagtgaatgataagaaacagaattggtgataatgcttatctcaggggaacccccacgcttttgtgagttttacatgcaggagactatcaggtcctcatagtgaatatcggagaataattcagggggattggaaaaggaacattttgaaatataccagagcattctgtgtattcttattaactaacccgccctcgggagaaacgatcttcctagagtctaacctgctgaggttttattagagcctaacatacctgggctaagagaaaggaaggaggtttcatacaaaatgaagcgttctcttaccacatgatccagaaatcacactccttagtatttctccaaatgagttgaaatgtccacacaaaacatgcacatggatgtttatagcagttttatttatgattgtcaaaacttggatgcaaccaagatgttcattagtaggtgcatagagaaaaaaattgtggtacacctagacaatggaatactattcagtgctatcagtgctaagaagaaatgagccatcacgtcatgaaaagacacaaaagaatcttaagtgcatatcattaagcgaaagaagccaatctgcaaaggttacctaccgtatgattgcgattatgtgatattctggaaaaggcaaaactatggagtcgttaaatagattagtggtttagtggggagggaagcgtgagtaggcagagcatgtaggatcttcagggcggtgaaactattttttatgattctgaaatgatggatgcatgtcattatacatttgtcaacacctataaaatgtacagccctgagagtgaatcctaatatgagctatggactttgggtgataataatgcttcagtgtaggttcatttattgcaacaaaggtaccactgtgctgggggatgaccatcgtgagggaagctgtgcatgtgggtggggcaggggctatatgggaactctcactactttctgttctatgttgctgtgaacctgaaactgctctaaagtataaagtttaaaaatttaaaaaactctgatctttagtttagcattttacaatctattttattgaaaggaacaaataaaagttaggattaagagaattaaacatttttcatagagcatataaatatagagcatgtaagagaagacttgattctcatttcagttctgatctgtctttaactttggcttagctggttttagctgatggtttttgaaggatggtccccagaccagcagcatcaataccaactggatatttgttagaaatgtaaattctcagacctcaccccagacctattgaatcagaaactctgggagagggactgctatggcttgaatgtttgtgttccctacaaaattcatgttgaagcttgatctccaatgtaacagtattaagaggtggggcatttaggaggcaatgattaggtagtgaggtctctgacctcatgaatgggactagcaccttatgaaaaggctggaaggaactacgttggcctctttggcccatcaatctcttctgccatgtgaaaacatagcatcaaggtgccatcttggaaacagcactcgtcagacattaattctgctgggaccttgatcttggacctcgcagcttccagaactgcgagaaatacatttctgttgttattattacaaagtgtcaggtattttgttatgcagaaggaacagactaatacagggactcagcagtttattttagcacaaggcttccaggtgattctgatgtgcatagacttttgagaaccactattactttcaaccttttcatctataaaattataaataacactagatcactttttttcaacgtgtgatgtatatattactgatcatgtgcaggacagttttaggtggcataaataagagcattttaagttttaccagctctgtatttattttaaagtttgttagaaaaatataaatagcataccaaatctacaagttcactggtgtttttgcctcatatatggctaagttaaaaaaaaaagaaaacaaaaagagaatcaatggaatcaatttgaacttgatataaatagaaatagccaaaatagtaaggtgataggagaatatcacaaggtgcatggagtaatttctcaaattttgaggccttagtaaccctgcactggattaatctcctacgtattttcattctaaaactatgagatttcatatgctcgtttttcttacagatttgcctccttaattttctttttaaaattcaagctcacatattaaaaatgtagtcgatgctgtttgagcttggaggggaaatggcctattagtgtgcttttgtactgggggatacttatctgagattcatatttaaccatggttaatggacatggggataattcacatgcaaatcatcaaagttaaatatattaagaagaaatctgtcctgaaaacaccatttaattttagaagcattttcttcttttcactacttgaagtatttatagtggaataggcagatgtttttataaaaaggaaatgaaacgacatttggggacagtaataaacatattttggttaattagggatttatactttgtaaaagttttcacattataaatagctaaaacatagctggcctttttaagtggcagtttaaacagctttattgagatataatttacattgtcatagagtccatctacataaagtgtacaatttagtggttttgtgtattcacagagctatgcaaccatgatcatgagcaattttaggacatgttcattatcccaaaaagaaaccccatgttcattatcagttactccccatcccccatgtagttccaaccctaggcaactacttacgtactttttatttctatggtttttctcattctggagattacatagaaatggaatcatatatgaagtggccttttgtgactggcttctttgacttagcatgttttcaagattcatccatgttgtagtgtgtgtgtgtcagtattttattcttgaataatattccatggtattgatatatcatgttggtctatccattcttcagttaatgaacatttgggttgcttttactttttgctatataaataatggtactatgaacattcatatacaagtttttgtgtgaacatatgtttttatttctcttaggtgtatacctaggagtggaattgctgggtaacaatacttaatacttgatggtaactatatttaataattcaagaaattggatataaagcactcttattcaaagtaaaattgcgattttatttaaaactaactacatttctgttttaataaggtatgaattttgtttgtcaaggattttacataaaatctgtctccaaaatggtgtttggcaaaaatcattattaaaatacatgtttttgaacacagcagcttacagactgctattctacatcacagtttatcatcatttatcaaaattgtcatgtcctctgtgacatgtttctttttctgaatattttattgtcacatgtgtcattaagcatttagaaaaaaaatggcctggaatcttcttcctgaactgatgaaattcatgatttttgtgtatagacatttacaaataaattatatgttgttaagaaactaatggtagttttttttcttttaaaattctcacttcaacatcaataaaaaatgtttctgaaatggaaacataccattttgatgtctaactgcatctgacacttttaagttttgctgtcctattattaatattttaaagttttaggaagggctactttttatataatgagattttatattccataaattattatttgactttgttttactttgtcacaatgcttcttcaaagcttttttgccaaattggctacctttagattcctttttaggaaaggtcttcaggatggtcttttttgttgtttttgtttttgtttttgttttttgagacggagtttctctctgtggcccaggctgaagtgtagtggtgcaatttctgctcactgcaacctccgcttccttggttcaacgatttctctgtctcagccttctgagtagctgggattataggcgcccaccactacacctggctatttttttgtatttttagtagagatagggcttcaccatgttggccagactggtctctaactcctgacctcaaaggatctgccagcctcggcctcccaaagtgctgggattacaggtgtgagcctctgtgcccggcccaggatgctcccttttaatagctacttaggaaattaggttttggtaccttgttgttagaagagaatattcctgaaaaaaggaaacaactaaatgcatcgactatctggggtagtagaaagagaagcgacagcacagagaaaagatgccccttagggaggagaaagaaacaaatatcaattagacttgaacgaactaggtttctttattgatgaagaaagttaagccacactttaactttccttgccacactaaaagcaaacaaacaaaccccaaagaatagtcaagcagctgagacattcagtagccttgtaggcaaaacaagacatattcttattgttggagtatagttgtgtaaggcctgtagcccctttcttttgactaatttattccttttggaatgaaaatatttactcaatgcctgtacctgatctgcagactgatcagctgaaatcatccttgattttatttctgatagggagaacctgtcctgcacttaccatggtagagtagtgggtgtttataatgaagatgtaaaactttatagtttggatcatgtgggaggtagactctgatacagggcttagagtgtttattagggagtgctgttggaaacaacacaatggaagagaaaagaatcaggatcagacagatggaagagtcaaggtgtttctttggccaacaacatggaagctttagaactgaaatggttaatcagtttagtgccatgtttggccaaagtggccaggtctttgtaaaccacctccattagtaaatggatgcggctgtcacctcccacccaccagagcatgaccttaggtcaggcgttctctgcagctcagactgttccagcccctaaaggggcttacagctgggattgtcctctgacaacactccctacatctgggccaagaagttcttccttgaggattggtcttgatggtgtttctcctatgtctgctgcactacatcagtcattgtccccttaaccttcacaaaagcttttgaaaatatttatattttttgtttataaaagtggtacaattagacaccaatctgtattcaacagggcaatggttaaatccatgactttggagactatgtgtgctcttgtttgaatgtttctatctcccccagatttatatgttgaaacctgatctccaaagtgatggtattaagaggtaggacctttggaagatgattattagatcatgagggtaaggctctcatgattggattagtgcccttatataaaagggccaacggagcttgtttgtcccttccaggacatgcgaaacgcagtgagaaggaaccatctgtgaggaagtgggccctcactcaatctgctggtaccttgatcttggacctctcagtctccagagccatgagaattgaatttctgctgtttgtaagctacccgtcaacgatattgtcctagatccgcccaaatggacaaagacaatttagaattaacataatgaggaaatctgtgtgtactgatgagaaaatatgtccatcatgtcatagactaaaaaaaccagtttgccgactatacacatatatacactatgattatatttttatttacaaaagctatacaagtatgtaaaatacacaggtacgtgtagattcactaaagcttttaccttctgaagactgggttgggggtaaacaagaagagagaatgatagttttcaatttttgttttgtatgctcagtttatatgttcatttttctgttgctgatgtaacaaattatcacacatttggcttaaagcaacacaaattgtttatctcacagttctggaggtcaaaagtcaaaagtctgtcttactgggctaaaatcaaggtgtcaggagggctgtcttcccttctggaggttcaggggacaatctgttttcctgccttttccagattctagaggctgccttcattccttgacttgtgacttcttcctccatcttaaaagccagcagactcacatcttcaaatctctatctaactctctcttccgcctccatcttccacttcaagaatccttgtaatttcatggggcccacccagataatccaggataatttccttgttttaaggtcacatgattaacaatctaaattccatatgcacctttcttaccacttgccatgtaacataacacattcataggttctagggctttggatgtgaccatgtttggtggggtgttattctgagtactacactaggtaagtgaaactacagctttctcacaacctatgtgctagctgttcatgcttcctgttcagataataccaggtaaatgagagaagagaaacatccgtgggtaaacaattataatttagtacattattattctttaatttctatagtatttataataaagttcaataagaatttatctatgaggaagtggcttttctaaacaagtgtaaagcccccttgtttggaaaaatgtcagagagactgcatactttttcttcttgcccgcttttcccatgctggcctctgttgcagctcttctgaaatgtaatcattgctttatttctttatttatctctttcctaattttcttggaggttctttaagatgggggctatatactttaacttaccaacctattcaatgaatattcattaagtacctattatggctaactatttttctgaacatttgggatatataaattgataaaaaccaataaaaatttcacttctttaatggaggaaagacatcctatatagagggtgatgaatggaaataaactagaacaggtcaagaagaatcacaagtgccaggtttagggattgtttgtaactttaaataggttattagaataggccccattaggatggtgatatttgagtaaaggctttgatgtggtttgggtgtgtccccatccaaatctcatcttgaattgtagttcccataatccccacgtgtcgtgggagggaccctgtgggaggtaattgaatcatgggggttttacctccatgcttttctcttgataatgagtgagttcttgagatctgatagttttctaaggggcttttcctccttttactccacacttctccttcctgctgccatgtgaataatgatgtgtttgcttccccttccaccataattgtaagtttcctgaagcctccctagccatgctgaactgtgagtcatttataaatttcctctataaattacccagtcttgggtatttcttcatagcagcatgagaatggactaatacaggcttggaggagtttaaggagttagtcatggggtgtcagagtacgcttcattaggaagatgctatttgagtaaagactttgaggacttcaaggagttagtcatgtgggcaactacacaactgcattggaggcagagggaacatttactctaaagtccttaaggcaggaaaattccaagactgatcaagtaacagcaggagagcgtgtgcagacgccttgggccaagatgttgaatacatactgaagggagccaagggtgggaggtgatccgagagagtgatttttctggtgtggatcagggtggtagcaatgaacgcgatgtaaactcatcagattgtggatgcgctatacttggaagatagggcaagtaaggtttgtggacaggttggttgtgggatatgacagaaagaggttccaaggatgatttcaaggcttatagtttctctaattggaaggaggaagttgccatcaactgaaataaggaaggctatgatgagcaggtttggtagagaagatcaagagtttgtgttgggcctgttataaagttgagattctataagacttccaagggtagatggtgagaagacaatctccagatatatgaatctggagtttaggaaagaggtctggaatatgtgtaaatatgggagccatcagcacataatagatgctgagtgaacgaagagactgcctgagattatcaaatgaggcatagatggcttgagaatgagactgaggttggagtcctgggtcactctagcagagattagggtaagaagggaaaccaaccaaagagagtaagctggagccctctgcaccctttttgacagcagtaggtagtagatgtttatttagtggataaatgcccaaagaggaggtaaagtagcaaatgacaaaggggaattttatctgtctatgtagaataaattaaaaggtgaaaaacagaatcaactgtatttatctcatcagtgaatgggtaggaagcaagtgatggaaattaacataaaagtagatctgaggccgggcgcggtggctcacgcctgtaatcccagcactttgggaggctgaggcgggcggatctcgaggtcaggagttcgagaccacggtgaaaccccgtctctactaaaaatacaaaaaattagctgggcgcagtggcgggcaactgtagtcccagctactcgggaggctgaggcgggagaacggcatgaacccgggaggcggagcttgcagtgagccgagattgtgccactgcactccagcctgggtgacagagtgagactctgtctcaaaaaaaaaaaaaaaaaaaaaaaaaaagatctgttcctttttactctataaatatatttgtttataaaaataaccgttaattttaataagttaaagtgtttttttcttatgcaattacttctttttaatcttcatgatgcttaatgtgctggtgtggctaattctttgaaaaagtatgtaaaaaaatcccttctctacagagatgaatctagttcttcagattggttattcctatactttttatttgtttttgtttttgtttcagagacagggtcttgctctgttgccctggctggggtgtaatcacagctcactgcagtctcgacctcctgggctcaaggaatcctcctgcctcagtctcctgaatagctgggactacaggggcacactaccacactcagctaatttatttattttttgaagagatgaggtcttgctatgttgcccaggctggtctcgaacttctgggctcaagcaatccccctgcttaggcatcccaaattgttgggattacaggtgtgagccacccatgcttgaccatgtgaatatgaatatactggagaatagcaacactaagtagttgaaactcattttagaaattaccccatgaacatatctaaattcttcataatgagtcatagaagaatttctaaagtcaacttggtaaaatgtactgatgattttcattgaaaaagcatgattttgctttcatatatttaataatttgtagaactttcaactttcactgtggtcttaactggtattaaaggtgatttggaaattgtattgagcatgtatcttgctatagtataaaagaagtagacattttccttaagaactttatattctaggttaaacagttaaaacacttatataaatatacatataaacagtttagttgagaaaatataagatgatgtaattgcaggtctgtttgactcccacctatctcttttgagagaagaatttataaaagaatagactgaaaaagtggcaataactataaacttgcattttgacaggaagaagaatagaaaaggaagcagaatcagctgccttgatatggatacaagttctacaaataggacagccactatgcttgaatagtagtagttcacatacttcacgaagtaaattaaatgtgattatattgggcctgacctgttggtgagaagtggatgtctcagcgtggggaggtgtgtaagcttgctcaggaccaaaaagagccctaggtagtgaaatctttgtgaggggttggaacctgaataggaaatagcatttaacaatgctcatcttaaaaccgaaaacctcagtttttttatgagtatgttaagaatctctgaagatacaacctgggttggacgattacccaagatctgttacatatttaacatcagggaagttatgcaaagcttattattgtttcttgtgtttattttgggtgctgaccttcagaaaggccttagctaatctccaggtcaaagcctatagtgaccacccttgctgccgctgcatgccacacctccctctctgtgctatcttgctgcatttagggactttgttgtcatagttcctctcttactgcaaagggattccaaagctcttgaaaaataggaagtagctcatccttttctatgggctgaggggagcagtccttgatttacgataagaaaattctataatctttggacctttgatagaggtgacaaatacagagatctttcttggaatataatttgtccaaaactattttgagaaagcacacaaggcattaacatttacatttccaattaaagcatagggaaactgtttacaacaaggggacagaagttgatgctgttgtttattgtgttatatgctggttatagaccctcgttttacagttatttctctaaaatgcagtaaaaaaaaaaaagaatgcctagcaacatagcaacctctatgaaatgaggcatatgctgtttctaagactcacaatatgtttttctgaactgtttgctcataaacatgtttattgtaggtgctgcttgggcagggacggctttcctgtagaaatcctctcttgaatacactaggttctggttcctcttgtggaagaatgaagctctttttgactgccttggaaaatttgatactttcaggtatttatgacataatcaatggctgatatgtgtcttcaggatttatgactgtcctgtcataaattgccgtagtttcagagtgcatacaacatcactgtctttttattactgttattattggagacaggctgtcactgtgttgcccaggctggagggcagtggcgaggtcttggcttattgtaacctcctccttgccagctcaagccatcctcccaccttagactctcgagtaggtgggactataggagtgtgccaccatgccttgctaattttttaaaaaacatttttgtagaaatgaggttttaccatgttgcccaggctggtctcgaactcctgagctcaagggacccacccacctcagcctcctaaagtactgggattacaggtgtaaaccattgtgcccagcccactctgtcttttgaggtggtgggaaggtgagatgtagtgacacagatattctgtgtaccatagtgataccttatttatgaatcatcttgctctctctcttgaagtctctctatgctagaaacatcatctgatgtggtattcgacacgggttcaccttctggttttgtcactaaatgctttatgactttgatctcagcccttctctgtgtctagagaattgttaaattactaaattaaaatgaatttttgagagtcttttgatgtcacaaaatgtaatagctgctgagtgcccaagtatatatcaatttttctttagtgaagaagatgcagaagtggtaaaggagaggctgcttttggagagggcagagtgagaggagatggaagtttggaaatatgtcttataaggaaggccaatgaggaggcaatcattctgtaacatgtacttgtgatctagtaaagcttgtgttttgtatagaaggctatgtaggcttttatgactgggaacgtgtgaaaataatgacctagagccaatggggcatagggacatttgcggcatctaacccaggtctttttcattcccaggctagggggctacaattctcttctgaaagttacttggcatgatcatcttgctgttcttaaagcaaaatagcccaaattttgttgaagaaatgttttagagaaatgattgcctcatatttctaacaccactcttggttatttgtttactaaatagctttttattgggggaaaagtgtatggaaatttaagttggggaaattacttgggagaacttcttaatgtattagtctgttcttgcactgctataaagaattacttgaaactgagtaatttacgaagcaaagaggtttaattgactcacagttctgcaggctgtacaggaagcatggttggggagccctcaggaaacttacaagcatggcagaaggatgaagaggaagcaagcaccttcttcacattggcagagcaggaggaagagagtaaaaggagaagtgctacacacttttatttatttatttttttgaggcagagtctcactctgtcacccaggctggagtgcagtggtgcgattttggctcgctgcaccctctgcctctcaggttcaagtgattcttatgcctcagcctcccgagtaggtgggattagaggcatgcaccaccacgctaggctactgtttatatttttagtaaatacggggttttgccctgttggcgaggctgatctcaaactcctggccttaagtgatctgcctgcagtggcctcccaaagtgctgggattgcaagcgtgagccaccatgctcggcctacacacttttaaatcttttaaataaccagatctcatgagaactcactcactatcacaagaacaacaagggggaaatccacttccatgacccaatcacttcccaccagatccctgtcccaacattggggattacaattcaacatgagatttgggtagggacacagagccaaaccatattactgaggaacaacttaatgtagatagtttctgtgtatgtgtgagaataaagttttcttataaaccattctattttttaagttcaactattttatcttccttaaagataggggggttgaaagttgattttatagtttgagctcttgttatttttcaaccattagccaataaatataagtggcaattatttaagaagaataacataataatcaaatatgagaaatataagaagcttagaattgtggagttggaagggacaagtcacctcaatttatagtcagcatttatctaattgttctgccccccttaactgtaaaatggcaaaagtaatacttgatccataaatttcttttaaggattaaaagataatggattaaaagataatgtatacattcaaaaatattttttaagtgttttgtttgtttggtttgttttttcaagacaaagtcttactctgtcgcccaggctggagtgcagtggtgctatcttggctcactgcaacctccgcctcactggttcaagcattctcctccctcagcctcccaagtagctgggattacaggcatgtgccatcatgtccagctaatttttgcatttttaatagagacagggtttcaccatgttggccaggctggtctcgaactcctgacgtcaagtgatctgcctgccttggtctcccaaagtgctgggattacaggcgtgagccacagcacttggtctattgagtgtttagtatgtgccaaggcatatgctggttcagaggatatatctgtgtactagaaagaagatcctggctttactaactaggagggaaaaaaactttacccggtgatgacaaaggtgataagtacttccacagtgctcactgggacaaagtgtcagaccttacacagtacctgatactaggggagaaagagggatggacctgatgtgtcttgggtgtaaagtatacccattatataatcctaacagcaattctgtaaacctggtcttattttccttccttttacagatgagcaaacttgtgttcttgtaggtctgtgtcaagtaatgtttgttaaataagttaatgtgtaaatggaaacctgagcagttgtgcaacatgcccaaattcttcagcaagttagtgacagctgggaccagagctgtttctgacttcagcccaggggtcctttcattattctacactgcctctcagagtgtgcataggtgtgtgtgtgtatgcatgggagataggaaagttgcagtcttatatatgctacacttatcaatataaaaattatttcacaaaacacaaataatagtgaagtcagggctcctagtttaatccattttaattcctatcactagttacaggtatatttaattatccagatacgttgactttgtgctgtggatttagtgtactaaataacaggatccaaatctgtgaagttttctttttctggaaaactactggctctgaagcaatttaagccagaattcaaggccattcatccaaaatttaaggtgttctgaaatagaaggtgtatatatcactttacttaatgtgtgggttgtgtgggagacttttctttgcaaattgaatcattggagaccaatgatcctataactgcatttgaaatccttcagctggcaaacctttggtagttttaatttctttctcaaagaaaacatctgttataggtgtctgtagtctagttgtgtgtgggctaccatttcaattagtaaagctataatgacagtcttgggattttgtagaaaccctagtaatagatagaagtgaacatttctaatcctttattatgatcccgttatcaatttcaagtcagtttcttccctatgccatctatccaccaactcccagctgtcttgaaagaacatatataatatttttctaactttagggaatttcttttaagtttgagggcctctttctttttgctaggaagggaagccgggtcaggaaagcagaggagttagttttggagggccctccttttgtgcatcatttagttgcagacctaagcaatgtctttaatcccaaggaaatgatacaacactcctggagtcttccacggttttcagaaggtgagtattcactaacagtacctaactctgtcccttctgtaatttatgtggactctaaacattgctgtaaagtactgctggagaaatacaagacttgtacatttttcttttcttttcttctttccttccttccttccttctctttctctctttctttcttttttttttttgatggagtttcactctttgttgcccaggctggagtacagtggcacttaaaagtcaacctgaatcgcatttttctccagtctgcaatagtttgcccaaataattacagttttaagtcttttaaatggttactagtccttccagcacagaaaggtgatgcagccccaaataatgtgtatgtcggtactgtcactacagtgctttgggtcgaccaatctcatcctgacttctgatctggagtctactgtcatagaaaggtataatatgcttataatttttctcccccaatatttctttgcttctctgtggcagtatttctcccccaaaacacttagagatgtttgattttatccttgcagctgttataaggcagacaagctcgagctgacacacacagtttctctcatgacaaggaccaattgtgatttatgaccatttacaggatgctagtgatgtggggaagggtgtgtttttagctagcaaggctatgtcctttcacttggaaataaacaacatgttaaaaatatgtagcagggttaaaaagaggaagcttcactgtaattttcgtttagtgaagagcccttaggctaactttctataatgttcagctaatgtgtttatatcttcaaatcatcttaacaaatatttattgactgcctgcttcttgcaaggtgttatgctggctgaaatgaaagttttcatgaaaattctaatgtatagaattaggaagttagaaagcggggttattagcatgggtctttgtctgctttagttgaatagaacctgttatgaagcaatacattttcctccaaaaatttggcttctttagcaagcagcatatcaactaaagatgaaagaaagaagtggaaacatttattcacttgtaatgttaatataaatctttgttttcatcagaaattcctgaaaagctagattataatatgttacagtacaaccttgggtttggcttttagcaccaaggttaaacaaagatttatgaacacaaaagatgctgtgaaagctcagattcctgctaaaccttgaatgtcctatagtcctctaaatggtcctaaatgtggaaaaatcagtcttctcattggttaggacccactgacttccgtcattgtaattactgtgatataacctgtagggtatgagtgattaaataatttaatatcactgggagagttacttattatgtgttttatttgtatatttgcaagcagttcttcatttctcatgacagttcttgcattcatcatttactaaaatggggttctgagttaataacatttttttcctcattataaaaattctcagaacaagtcaagatctaattagacatcttcaatttattaaatcagacctctttacagagcccttttagaagcccaggtaacacttgttgttttaaatcactggcccaacatagtcacatgaatataccttgatgcaaagaagacggtgaagatgtaattttttagcctttgcatattaaaaaaaatcagaattctgatagtaagaaaaacatattgtttagttgcccaagttgtgtctttttctccacctctgatttcttcccaatactttgatgaagtactctgatgaagtactcccaatactctggcgattttctttttcttacccactataaagtgtggtgtttgcacttcatgcctgagtctttctttctgagaagaggctcctgcaagtctttggcagctttcaactacattaattttacaggtccatccttgaagcaaaactttaaaaaggtattttatgcttttttccttcctttttttaaaaaaaaaatttttcaccttttaattgtcagttctaattatctgtgcaaactgattcaggcagaaacatacaattctgagagaaaaagggaccctgggactgacaacctaggtttactgagtgggagaggcagaggtgcttcccaaataaaaactgtggctgttaccagaagaagggaacagggatgctggaaaaagaaaggacagacatccagttctggaaggtttatttggcttttattcataaaaatacgaaaacctttccttggttttctgctcttaatcttcctttaaatacatcaactagacatagtcgatataggtggttcttgtaagataaaacctccttggccccatgcaggtactctcctgatatttatacacagaattgcccatgtctcttaaaaaagagaacatctgatttgcctttaagaaaaatgtgcaggatggggtgggaatgagggtgggtgagggctttacatttcatgcagttgcagactttttggaggcagcttttactctctgggtcatattttaattcctgatcctgaagtggaggggaatcctgatgttagtgtctgggtggtattcttgatagacttttagttgaataagtaaggaaggatgcttacatgaacaaaccttattcagtgtcccagtttctgagcagcccaaggcaccaaagcctaacctaggatgaggatggtttgtgtggagctggtgaaactacagctcccgatctcatccaagattgttgttttccatttgctgctgaacagctgtttgtttggctttccagcggcatgaatatgcccacataatcacaaactcctagatattgaggcatcttaatgagaacatagcctgattttggaaggaatggaatgaaggaggccaagtgaattgcatcagggtgcctggtagaaaaactggcattagaacctcgattctatgctcactgtccgtgctctgctccagtacatgaaatttgtcagagaaaatgagatgaagcaccatggtttcctatgccctccctgtttgttcctggtacttaaccaacctaaaatctactcatggatctgtcaggttttagatttagtaacaggctcattgactatggaaataattgggtgggggctgaggtctttatggtagattcaagtaactagagcaagagtagatgggttattgtggtagaatgagggacatttgctagtttaaatcacatttctgcagtttgtggttggacttggagcttctttttctctgtagcttagtagcagatgcgcttttcgctgctggagcaaaactacctacagtagtgtgaatcagcaagtagggagtattattagtcatgtgaattcagatacttcctattgccaaaggcttgatatattcatatcttacattttatcttctctgtgacgattcattacatgtagtgagagcatatacttagtcttctgtgtggctcaactgggggcacatttggtctagtccaagtaattatatgtaacgtaaaattacatacagcacagtcatcaaagaagctgtccttccttcccctatcactaagatctagggtgactctggagtgccactgtgtgaacatttctcactcttgtgagcatgtttctaaatcccaaatcaatctgacaaaggattttctgtgaatttcttgttaatttcttgacataaaagctcttatgaacatacatattccgaacttaattctttgtttgagtcaaaatcatttttattcaagagggaacaattatattaatctagatttgcctggtaaatccataacatacagacctgaagttcaagcagaacccgaggtaatgtgagccctgggtaaggtatagtaaggatggagaggtaggtaaagaaaggcgagaatgattcatttattgagaaagatgagcaaggtggtcaaatagatttgcttctcaacaaagcgtgtagtttaagcacttagttttggtttcttttgaagctgccttccctttttcccatctctctattccaacataacagaaaaagaaggaaaaaaaatcaatacaaaacaaccatttacttatttcccagagtaatgcttctcaaactttagcaatgtgcatgcaaatcacctggcaatcttgtaaagtgcagattctgattcagtagtggtcaggcagtgattctcaaagagtgttccttggagcagccttgttggaacaactgtgagcttattagaactgtaaatttatgagccccacctaacctattgagttacaattttattagatgggcccaaaaagtgttttaggaagcttaccaggtgattcttattcacctgaaagtttgagaatcactgacatagaggagattctctggagtttttctcaggactctggtattttctactgtcactgggcttacagtatacagttgatctttagcagtggaaacagttggacagagatctttatttaggctcctgaatggctgtcggcatcttgaaagttgactggcttcattaaagtctctatttcttggtcctttgacatctattatgataaccctgatactttctaaagcagacatgccacttcatggaatcacgcacctcatggaattccatgcacttcatggattcatgcacgttagcacagctagacacctttatgtggcaattgggtaatacttactttaaaagatagaataaaggaaaaactacctaaaatttcccataacatttttttttttttgcagacttttcaggggtatggatactatatgggctttatatcttcatatcagcttagtcctagttaattgttattttcaatcatattaatggccattggtcattgctagccagtatctatgactggctggttctaatggctacaagcatgcttagcagtgccctcatgaatgttgctattattgttgaaggaggaaaacattttaataattggaattggattttctcagtattcagtattgcaaaaggtggatgtaacttcttatgatgtctcaacagctattactttattttttaatttatttttaaaaatcttattgtcacaccccatgattctgcaacagctataattttaatttctgaaagttttgatgatttcctccaaggctatagctggagaaatgtacattgtctattattagtaacatttctcaaattgtttacaaggcctgcagtatagatgggctgagactgtgtttatgctttttcattgagaaattttggtcttgcagaaggaatccatttgttctgtgaatctctataaagcaaagagaagagttcaaaatttataagggagcccaacaagtgttccaaaaaaggctatttaggcacaacatttaggtgcttatctagtatgttgtttctatcaatacatagcttaaatataaatagatctaagaaccttagttaagacgaaagggtatagcataccatgctataaaatctgtcatacagaatacacataaagtgtctgctgtaattttgtaatctttccaaaagcaatatactgtgtctacagccctcatttacaacttatagaaatttactcattttatgcagaaaattggaaaggagcagatgtttattcctaagctagaattttgaaggccaacaattaaaataaacatgtctctgccaaaacttgaactaaattgaaaaatttagcatataaattaaagctcacttaaaactaaatttatcaaggaaatacatttgttttgcattgctggtttcaattattctgaaaggacttttatttttatggaacactgaagatttttaaaagtttcaaacaatttattggacaattgcaccatttaaaatgagttacaaatgtcttgcttaaatgtatgagctattagcacatagttgatgaccttatagagagacattaaagcaaccatatcctcaagtttatgtctatattcccaggggagtacaagaaactggtctgtagacctgaaatagataaagctgtgggcagcattctcttctattcatttgttcctttggtcaggaatctgaattttgagacatattcaataaattatgcatactcaaatatttgtgctcttagcttattgccacagaggaaaagagattatttcctactttttagtatctctctgcttttgtctgatttgtacaatgttgcctaattaatttttcttaaacactttgccctccacacattttgcctaaaaccttcattggctcttgtaagatgtgctagcattctagggtctcagtttactgttgctaccctacttaaatgaatctccaatgcttcctaattgttacttcttggcttcaaccaatccaatgagtttcctttctctgacacatatcagatttatgcaaagtagtttcttggcttaagttgccctatatttctacaaaggtctagtcagatggtcagatgtgactatctctacatatgggtctgaaatctagtttaggaattctatgctgtgaatgttttagcttaaaactctaaaatttaactagttttttgaattctctctattatattacatgcttctggaataaatataaacacaatgaaatcctttcttgaaaatttaggaagatgttatacacaatataaataagttgtaagatagtgatttctactagacagttaaggtattaaggactatttgtccttgtattaaatggacccaggctatgcctttctagtgtttttgtatactctgattttttagtggctttccattaaatcctgaaagctcactactaagactcatgacattttttggggggttagaaaaattactatgattcagggctgggcgcggtggctcatgcctgtaatcccagcactttgggaggctgaggcaggcggatcatgaggtcaggagatcgagaccatcctggctaacacggtgaaaacccgtctctactaaaaatacaaaaaattagccaggcgtggtggcgggcgcctgtagtcccagctactcgggaggctgaggcaggagaatggcgtgaacctgggaggtggagcttgcagtgagccgagatagtgccactgcactccagcctgggcgacagagtgagactccgtctaaaaaaaaaaaaaaaaaaagaaattacttactatgattctctctctcaaataaaattctggtgacttttctttaactcaccaaaagtagatacatacatatttctaattcattgtttgaagaaaagccttaagatattttgaaataaaattctacacacattacacagaacttgtagctacatgaggagagcaaggtttttttgttttgttttgttttgtttttgagacggagtctctgtctgttgccaggctggagtgcagtggcgcgatctcggctgactgcaacctctgccccgccgggttcaagcgattctcctgcctcagccttccgagtagctggaagtacagtcgtgcgccaccacacgcagctagttttttatttttatttttatttttagtagagttggggtttcaccatgttggccaggatggtctccatctcctgaccttgtgatccacctgctttggcctcccaaagtgctgggattacaggcgtgagccaccgcgccccagcctgtttttgtttttattttgtaaaacggccttctccacgctgaaactctctctcttttgctctttcatctgtcatctcctccccactcccacaccccacactcctttacccaatcttgccactgcaggacaagagataggatgaaagttggaaaataataatttatggagaaagcctgtgttccttgctttatgaaagtaaattgtagataattaatgttgtgacaagatgattctattttgatgaataaaatcattgaaaagctatcaagccccactgtttctctgctgagagaactttttttcctctctgttctgcattcctattcttggctttcttcccaattagtctctgctaaagagtgataattggggagataggattttcacctaccttgtgaacagtaaaaatacccatttttccaccactgaagctatgtgtattaatattctatgctttcagaaagaaaatcccacactactgtgattcctgcttaaaaaaggaggtaatctaatgcccaagtaaaaacaattttatggtacttttatgagcttctgggaacaatggccatgtgatgttcagttgcgtgtttcatgtctgatgactgagttcacgtacgtcttagaggctaaatttggtttaaaatatcttacatcttctcaaattccttataacaagagcagtaaattaaaattaaatttcgaccttaaatggattgcatgttttccatttgtaatatattcgtatggttcaaaaatctgaaagagtaaatgagtacatagtaagagatttccttcctacatccccatcttcccagctccttttactccccctcccttctgcatgaaaactactgttactagttttttatgtgtccttccagagttttttctgcatatacaaacctaaaataaacatagattcttattctcctactttttacaaaaaatgtagcacattttataaatattttgcctcttgatttttttcttgcttaacataatatagagttatttccatatatacatacatagggacatttcttaatttttttatagctgcatatcatttccttgcactgaagtaccataatatatgtatatttcacaattacctgattcatgtatatttgactagtttcaaatcttttgatattataaacaatactgcaaagaatattatatatgcataattttatacagtaggataatttcccagtattggaattgctaggttagagtacaagtttatgaatgttgatcagcattgtcaaattgcccttgtatagggattgtgcttagttcggctcttaccaggcttatatgagattgttcctttttcctcagccttaccaatagagcatgttgtcagcctttggcattttgccaatgtgataaatacaaaataatacattagcaaatttttaacctgtgcttttcttattatgagtgaagtaacatattttcatatatttgagtgatgttcctctatacatgatttgtatcttttatttttttcaacattcaaatattttattgttgatctttttattatttatttctataggcttcatctaaattgcaccttttcctgtgatataaagtaaaaaatgtttcagaattatatcatttgtattttgactctgagtatcatctttttttctatttttgtttttttgtttgttattttctgaagaattggttgaatttttctagttcatttttcttcgtggcttctggatttttagtcataattagaaaaggctttccccttccaagattataaaggaaatctcctgggattttttgtacttttgtattatctttaatatcacataaatctctgattcatctggaattggcttgtagtaagaagtttattttttctttatatgacttaattattgaattgactatctttttcccactgatgtaagatattacccttattatacactaaattcttctctatgttgagcaatagttttgaattttctgttcaatctctttggtctgtttatttatgtgccagtattcagggactatatgttttaacatctagaatttctaaactacctttaataactgaaattgctaagctgttttcctatttaaaagtttttctgaatattcttttcttcttttttctttataaacttccagattaacttgttttattcaaacagctggtgttttaaaaatagaattttattacattttcaaattaaattgctgtctttatgatctcgaaatttattctcaaaattatgatattactttttcagttgtgtaattccctttgtttcctctaatggtgctttaaatcatcatataaatcttgcacatcaactttatcagctttatctcttggtattctatctttttcatcactgttgttagtgatttctatatgttgattttgaattctattttactcatcttttattgcttgtagttgtttttcagttaattatcttttatcttccaggtgtataatcatagcttctgtagtaaataattcctttgttttcctctttccaaatttgtatagatttaatttggttgtaactcgtctaatcgctttggattgtacctagagatcagctttaaattttatcagtgatcatctttttcttgtttctgacttctgggattctaaaattttgtcataaagcatgataatggtttttggtctcggttggctgtattttattacgttaatgaagtatccatctgtacagtcctagagttgtagctggacctgtgaacaccaccttaagacacgcatttctcagccccgcttgtatttaagccttacttgtatcacctagtgattcatgtgtgcccatgttcttgccattgtaacgtaagtaaaagtgatacttgccatttcttccacatcctttcttttcccttcttgctggcaggaaaccagaagtgatggcaacccagcctcaactatgtaaaggacaacaaggccttcagggatggctgaccatgagatggagggaacctgggtcccagaatcacttcgtggaacagactactcccctgaacaacaacttccgattattacttgagaaagaaaaataaacataattgtttttttttttttttttgagacggagtctcgctctggcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaacataattgtttttaaagccattttattgttgagttttttgttacacaaagccctttattaccatgactccacatttatagttgacccttgaacaatggggttagagggttaggggcaccaaaccccagtgctgttgaaaatctgcatataatttttgactcaccaaaaacttaagtactaatagtctacttttgactggaagccatactgataacctaaatagccaatcaacacacatatttcatgtattcatgacacacgtttttcttaaatttttctatatttctagtctgcacagcaaatctccaagcaatttttatgtatatttattttttaaaatctgcataaaagtggatttttggagttcagacccatgttgttcaaggttcaactgtagtccttttttttttaggtgattttttatttaatcaaatgatttatttttttttaatcaagtgatttttttttttggtcaaaaacctttttcatctatggaaattatcttgtgctgtatctctagatatattcatataaattatattaatggttttacaatatttgaccattcttgctttccctggaataagtcacatttcatataacgaattatttgttcaagtgcttctgggaatgtttcaccgatattcatacctaagattcgtcagctgtttttgtttcctgcagtctttataaagttttgatattagtgttactcttttttgtagaggaaagaataattttttaaaatttttccttgttctggggctattttaaaatgctggaattcactgttctttaaaaatgtggtagaattttcctagaaaacttccaaggccagaggtttcagagtattaataattggcacatttctctaattcatttgttgaaatcagattatttagagtttctatatcctttggggtcagttttggtgaattatacattactagaaaattacatatctcatccagattaaatttattttggcatagagctgaataaaatagtctcttttggcttttttatttttctttgtttttgtggctttttaaattcttattttcatgtttgtagtttgttcatatttccttgaatagtttagctgtgcttcatacattaaatatttttcttaaaaaataatttttaaaatgtatttattctattttttccctaactccataaatattaactaccctcttctccttttccattgattttttgttcttttctataaatttcattcagaaactcaatttccttattttctttattcttttaaattttttaataaaaattaaatgctctgagttttcctttgagcagtgctttagctatagctcatgaattcaggtatgatgtttccattaatattatatattcagatatatcagattgcataactctttgaagagggaattgttttggagggggttttaaaattaccatgagaaaatttttatttttctccagttttatcaatttctatatttaatgtatcatattaagagtatgttttcgctgttatttctagaatttgcctatttctgaaattttctttatagcctcatatgttatcaattttaataaatattccataaatccataaatatggattgttgaaaagaagataggtctttttatttctaatataaagtatttttggtatatcaaacatccataacacattaatgatgctactctattctcatagcttgagagaagagaattactctcttctcactagtgtgtttctgtctcttatttcctgtaatttcaggtttgtgaacattttgctattcataacaattttttgtgaattacactctcttgagttatacaatgttgttttttgcatcattttgggcctaaattcttgcttgtctaatatgaaaaataagaccatctacttggattcttttctgttttgccagtatatctttttccacattttaattttaattattgtgaatcagtttgttctagctattcttttaaacagtattgagcttggttttactttctcattcaatctaaatatctttgattttaacaagtaaatttaattgattgatactgatatagcaggtatgtttgttctgagtgctgccatatgttaaattttttgctttcatgtttgctttatgttctttaacagtctttcattatgttgtctgtgtacttccctttgttttaagtatacttctgatatgtgtgaaggtgacatatttattctattggctatctttataatttagttgttaaccttttgtaaactatgtttgtacttctatcagtttttttgatctgctttaatgatattacttgatttccaggaattttagtaaaataatcaacaaacattttcaacttcctaatttcttttcccctccttcgcatttttaaaaattttaccagttctgcttggcagagcacataatattaacattcttttttggtcatcccaaccctcaaatcttttctattatttccccagtcatatttatttggctgaagaccacctactactgtcgtcaagaaagattaaatcatttttgtaagtaaaagctgtttgttgcctttattcctaaaggacaacttgactcaaactttctttttctgaggatcttgtagatggtgctgttaatacatgttttatggtgttaaatgcaactgtagagaaatctgattttcatgcttataagtaatttactgtttttgctggactaccttacatattctttctttaccatttgaagttcaataactgtctgggttgtctacactgggttagtttttccttgcctccagtgtacctttcaatatgtatagtattattttatttcaaagacttttggggagcttatatctttaagttgtctttatgtctctctgtttttcctttttaagtactctgtcttcttctgttaaggctgctatcacaaattatcataatctaagtggcttatgaacaacagaaatttatttcttacagttctggaggctgagaagtctaagatcaaggtactggcagatctgtgtctggtgagggctgcttcctggttcatagattctgtcttttcactgtatcctcacgtaatggaaggagcaaagaaaccttcgggttctcttttatgagggcggtagtcccatgcttaaaggctctgcccacatgacctaatcacctcccaaaggtcccatctcctaataccatcaccttggaagttagggtttaacataggaattttagagggacataaatagcacactccaaatacgtttgttgtatctactttgcctgtcttctgtatccgtcatctagtctctcattcttttcaagtctttattttcattttattttgttctcctttttttaattagcctttatgttccttattctattttctgtagcttttttttatcatttctgtgatttcacgctattatttcttgagctctgacaggttatatttgagcatttcctcttgacttcctgtttcttcttcatgatcttttttttttttttttttttttttttttttgatggagtctcactctgacacccaggctggagtacagtggtgcattctcagcagctcactgcaacctctgcctcccaggttcaagcgattctcctgcctcagcctcccaagtagctgggactataggcacgtgccaccacatccggctaattttttgtatttttagtagagaaggggtttcaccatgttagccatgatggtctcgatctcctgaccttgtaatccacctgcctcggcctcccaaagtgctgggattacaggtgtgagccactgcgcccagcccatgatctttcttttaaaggcagttgcttcatttattttacaaaactaatgacaaaaattttggttagacttttcattctgtcattgaagaaattcttgtgctctttgtctgttggtaagtgttactgctcttttttttcttatagtaaccgcatatcagtgttgttccatctcctttgctaatgctcaatactgaatgaattgggtcttcatgccttaggtatattagcagaggtgtttgtgaggtgggaagatctaggcagtcttctaaacttcacatctgaaaggtgttctcattaggtggttccacagagacagtgtacttgctgctaatatggccccttcttcaatctgtctgtctattatgaatcaatcaatcaatcaatcaatcagtcatctctctgtccatccatccacccatccatccatccatccatccatccatccatccatccatccttctttcttttctgcctctctagtctaaactgtatttaggaggcttcagcagccagccctactcactgccatactccttctaatttttttttttttttttttttttttgagacggagtctcgctttgtcgcccaggatggagtgcagtggtgggatctccactcactgcaggctccacctcccgggttcacgccattctcctgcctcagcctcccgagtagctgggactacaggcgcccaccaccaagcccggctaattttttgtatttttagtgtagacggggtttcactgtgttagtcaggatggtctcgatctcctgacctcgtgatccgccggcctcggcctcccaaagtgctgggattacaggtatgagccaccacgcctggccactccttctaatttttaacacatggtgaggtgttgcatattggtatattctactgttattgtaacttcttttccatggtggtgtatttttgttggtattttctgagaactgttaatggtaagctacttaacctcactcttcacttcattttctccttaatttatttccttttgcttctatcagacctttgccctattgacaggatagttgagtataccaaaaatacaattttagcattgcagggtgccacacatgttgagaaaatatttttgccagtgtctttggaaatttgcccttgaagaaccaactattctctgtttctttttttttttttttttttttttttttttttttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagatggggtttcaccttgttagccaggatggtctcgatctcctgacctcatgatccacccgcctcggcctcccaaagtgctgggattacaggcgtgagccaccgcgcccggcctttctctgtttctttataatgatttttctgtacaatatcagttgcctttgggagactatgtatgcttggaagtgtgaacattatatctgttctaacttttatgattaaggagtttatttttttcctcatttttttcttttctttgttgcttttgtgtaatacccagcaagtggaaggttatttattctgatgccttgtttgtactgtaatttgaaaactgacattttgggataattttatttattttattaagattttttttgtattggtggtcatgtatgtagtttaaaatgaagtgtggatttttaggctataaaattagccagggtttagaatggtaaggtggataaagcacatttactttttttcctccatttttccttttgaatcctgatgagtattatctagttttcatttttggtaagttctccacattcatggactgctttgttactattctgaccataaaatgcttgaatttagagttctatgtgagaaaagtgatccttgttgtgctgttatgactaagcatattgtataccacagttaggaaataaaaagcactttgcttcctgagataaatcatctatatgcatctatccatgtatctatcaattcatctatctatctgtctatcaccttatctagtactattccctcaaattaaggaaggcttgagctctttcttataagttgctaactctctcattgaaataattcattccctgaattttgcaaaactgacatccataaatttgtgatgacccttgaagatatgattaaaaaatgaagaaactgttctaccatgaataggctaattgtaactttagtagccttgtgatttttttttctctaaatacccgctgtgtccatttgtcaaagatccttgcaaatatttaaattttgcatataaaaaatacctttcaaagaatatttttatgtctgcatttttcttttaccagtgacatttcactgatcatagaaatgaaacccagagttattgctatatttatgaaaggatgaatgtataattgattaaggagatctatttaatataaagcttataattagggtcatgataaagtcttgaattgtaaatatatgttgtatttattgaatagaatgcaattagagaatacaaacctataaaatatgtaatattagaggtggaaacaagacaaagtttctttgacaaaaaggtgcatgtacatagatttaggtcagagattgactaatgcttaaaaataaagaaaaaatgaatcaatttaattgagataaatgatccatgattaggataagagaaagtctagctattcaattcagagttcacttgaatgcatgggctgctgtcaagtttttaataaaagtacagagcagcttcctaacagaggtatgaataataagtttatatgtctctgaaacaatgttaatataattgaatcaaagaaataattaaatgtataatagtcttctatttaaatttgttcttaacagtgcaatttcttatttaaattctgtattatgaatttaattatttttgtcaagattttaaaaaatcattattataaccagttggcaccataattacttttagggaaggaactgtgttgggtgcggggagcaaaacttggtaagtcacttgggattaaaggtgtgggactttgaggatagagcctccgtaacaggataagttattctacatgagaaaatgggaagtgtttattttgaactactatatggattgggattggaggctgaaggcagtcttctaggtatcaaagggcagggaggttttacctgacatatgaattattgtttcatgtaaatatagttgaaagtcatatatatttagaattttaaatacatagtttcaagacagtgcttttaattttttaagaaaatatgtgtcatttattttttccaaagctagtggaagtttctttgtgtcctaatagcaattgcgtgaatgaaatcgacatgaataatacttccagttagattttcataaactgacagatagtttcataaatacccaatatgtaatgatagtcagagggagaagctatattaagtgtgtatttcaggagagattgtcctctggagcatatactagcatcaggcagctgctttatggaaccacccaccaattcccttgggttgttgttattattgtttgttttttgtattttgtttagtttctagggaacataattttctttgtgtttctttttgcatgatgctgaccaagtcatgttcataaatcacatatgttgatatctacagtgctttcattggccttccaactcgagcatggcaaaatatgcttattttccttcagaagcgcatctttgtgttaactaggcattaacaatatgtgcttaatagcaattatcttatttctaaggatctcagagttggtttggcacattgcctcagtgctcttcaaacattatcagagaaggacaacataaacaataagatttacactgtaaaattagcctccacttacaaattcttttatcagccaatccttatcttaataacatatattaccttttattaaagtaaatatgtccctcagctctagcttttttctctgtatttttatgtacatttatggagttttactgaaatatttagaagactactgtctaaatacggttctaatttttaaaatgcataatctttagggtaaagtcttggagagtggcaagtttaatcaaacagtaacgctatcagagataaagatcataactcgcattaaattctataatttaaaataaactatgtctggtatgtattcagaaaatgtcagagctagaacatttagttcagtctctatttcatgggttaaagaaaagaaagcttagaacagtgaaaatacttcctcaaggtaatacttacagttcatggctgaagtggtaataaaagtcacaaccaactttttcctctctgctttcttttctttctgttctgtcattttaagtttcttaaaggaaaagcttagagaaaattaagtattgatgatagagcagatacaggattttcaccgggtgcagtggcttacgcctgtaatcctagcacactgggaggctgaggcaggtggatcacttgaggtcaggagtttgagacaagcctggccaatatggtgaaaccctgtgtctactaaaaaaacaaaaatttgctgagtgtgatggtgcacacctgtaatccctgctactcgggaggctgagccaggagaatcacttgaacccaggaggtggtggctgcagtgagccaagatggcactactgcactccagcctgggcgacagaatgagactccatctcgacattaaaaaaaaaaaaaaaaagaaaaacaaaaaaaggattgtgttaacatgggggcctgggtgagaagagaaaatttatttataggaggacatgtaggaagggcactgaagattactgtttaccattttgaattgtccctgctccagtcttacaaagtgggacatgcattgtgtttcttgggcatactcacttccctaagaataagctgtatcatccaatgctatttgcacagaactcacggctttatatttactgtcctaaaataagtgatttacaatcttttaaactttaaaacagtaaatttgattttcagcgatgcctttttttttgtcattttaaggccccctccaaagtgttgtaacctagctgaatgaaaaataagtggcatttttgttgttattgttggtgatgatacttttcatggcaatctttgagatacctaggaatattccaagtttttgaaaaatcatggttgggaattaccactctggaaacagattgccatggttactgtgttaatgctgtgattaatgcgtcttttagtcttgtatgtgtgtgtagatgtagacataattctatattctagtttggttaacatgtttgatctttttctatcagtcagagacataaaaatgtcttgactctcttaaaaacaagactgttcccattttttaacctaatggatatttgttgctgaggatcatttttttgtaaggagtgaaatacccagaaaactaaagtggtctagaagataactgctagttctacatttttttttttgtctgaagttgtgtttgaatttacttcctttcatcacttagtattaaaagaacagtgtgtcaattatagataagaattctacatcccctgtctttccctaagtacctgcttcgaaaaatgggtgcaactagactcagtagctagatgtggtatgtggaatgtggattcgttcgtatcaggcatgcttcttataggaatcctttaatgcactcagtcacccagagcagtcaaaggcctaagctgcttcatactttatagcagggcacagtcacttccataaatactgtgcactcccaagtaaatccagaatgtttgcaacaggatttgtgtaccatccccaattctctgttttcttcaataaagtctttgtacacaattgtttgattgtttttatctcttgatactcacaaataatgccactggagaaataaacctaagacatatccaactggatcactttatatacagagatataacatttcaacaacagaagcctttcttgttgaggggatgcacatttggaatactctcaaatgattattcgaaatcaagaaaaagagccaatgagaaacagcaaaacacaaatatctctaataaggaaaaatatttctgcaatgagatttttcttagatatatatgtgatgattaagagcatttgtttatattgtaggttcttgtcctaaacttacaatagtaagtgtagacaacactaattgttatggtaaaaggtgctacatgtgtgtatgtatgtatatgtgtatgtatatgtatacatatattatttggatattccagtcagtggtacttactgcccttggttaatgcataattgtcttgagaaaatgattatatgtatcagtgtgatctggctaaaacaactctctccaactgatcacctgattttgtttcatttccccgggtaatctggtaggtggccatttcttttctttctagtctatgttccctcctaaagataaaacttggtcaaacatctatttatggtaacctgtctttaagatagtttcaggcataccttcttcctttaatctcatttggttgatatgttagatcctttcctatcagccagagaaataaaaatgtcttcagtgtcttaaacaaaattgtttacattctttaattaaatggtcattttaaggagagaaatgctcagaaaattaaactgagtatagaaggtaactgctaattctacatttcttttctgaaattgtgtcttcatttgttttttaaaaatcatttagaagctgtgtagcccacagagaagttctcaagtttgtggaaaagaaataattaagtcccgaagttaggggtagaagagaatggagctttgttggtcaattctgacatcttagaacacctcagtaatgtggttctttgaaagcatcaaatcgctgcggttactttagaaaggtcatttttagaatgcttatactacttttcccccattttgaaggtcaactggggtttattttaagttagtattgatgtaaaagatggcacaccctcttctggggcataaatgcttgaggatgagccatagtcatgcatgacatgtgtcaagataagaaatggaaatttatctgcagagactaccatatgatgtatgtgtaaattttcagtccctgggattatgatttttttttttagtgaagacaaatgttttttgttagttagatcctgatttttggcatgatttagtaggagaaagaaggttttagtttagacatagcttttcttacatcttgtgtaaaattgtcagttatagggagggtaaacactgcactctggaaaggccttctggaatgtccttatttctgtgtgagtgtgatggaaaaaaataacttttaaaaaaatacatgtttaatgaaagatatttccaggttattccttctggattttaatttaacgcttgtttgtatctctatgatagcatgtatgaaaatgtattttaatgatttaattatctccccatattagatgatcttgctatctttatcatatgccctgtttatttttctattcctggtgataggtggagtgactgatacattgcaggtacataatatacatttttgagtagatatgtgtatgattaattgacattttgcaagcctttttttccaacttttaagttctggggtacatgtgcaggatgtgcaggtttgttacatacgtaaacatgtgtcacggtagattgctgcacagatcatcccatcacctaggtgttaagcccagcatccattagctattcttcctgatgctctccctcccacccctcaacagtgtgtgttgttttgacagaccccagtatgtgttgttcccaccacgtgtccatgtgttctcatcattcatctcccacttatgagtgagaacatgcaatatttggttttctgttcctgcattaggcaaaccgtttttttgtttgtttgtttgtttttgtttttgtttttaaagaaaaaagaaagacatgctatgaaatggccttggacctaattcaagaaacgaaagaaagtcagagatcaaggaagaaaggaacaatgcagagtttatggaagttagatgttaagatgacagctgagtatgcttcttttctcctcacccttgtttagccaggtgcttacttgacaatttgtaaattaaattattccttgaacaatattttgcacaggagtaaaggaatgcttcatggataaacagaggcaatacctggagctaatctttgtggataaatgtgtttattttgattcctgaagctgggatgcagaactgatagagggaagccagggggttttctctgctccaccaaataaatcacatatgactagaaattgcaaccagacagcaatctgtgaagcaagtgataggagctccaccgtctggtgcctgctgtggatgtctggcacccattggtaccagatttggtgtaagtggggcttctgtttaggaaactttgccaatttttttttcttgaaaagtggattttggctttgtttctgcattcttatatgggaataaaaaaatctcataattgcaaatgtgtttattatgccccaaacattagatctaggctattctttccataggatattgtaatcctgtgtgggtacatttgctgctgcatttgacacagtaaagttgtattaatgtttttcattctgctatcttttagaactaagataggcataattcctaatttatctgtgctcccccttatgcatacatttaggtagtcaaaccttgagagtttctatagaatatttttaaaacttacctttggtctgtcttatccttggaaatgttttcacgtttgagagcatcacctcctatcagatcattctgttccttgaccctctccctctgacaaatttcacatctttcttcgcaggaaaaaagaaactaaggctatatcatggctttcttcactcctcttcattctgatatgaacatttgaagcaagcattgatttttttcttccttcttcttacttttgccagaacccatgatgctgtttattctggtggggtgtgtgtgaaacgcatgttgcagttccatctctcttgaccttttctttgtttgctatgtatattgcatctcctcagttgtccaggttatcgcaagaaattgtgctggatttctactcgctcaccttctatttcttactaaatattccttgttgtatcataatccctctcaccagaattcctcctgtgtgaactcatagattacaatctacattgctgcaagagactaccaaattttccatctttctcaggtttctgcaccttcactcactcttatatctttccaaactttcctttccatctttcttaatgtcaaacctgattagtcattctcctgcttaaaatcttccaccgagttctcagggctttcaggttgaagttcaagctcattagtgtgacatacaaggctcttaggacctggtggtctcagcccctggctacttccctaaaacactgcccactcagaccagatctaactagttttagttccctatatcatggtatactactgcgattttccatgtgcgcttactttactcccaggtctctctatcctcttcctcttcatgtaactaatttcttcctggctctttgacactgggcatcagtgtcatgtccccagtgtctaatgtgatgtctttcatctgttctcttataggcttggatgcatctccttcctgtcatcttactagtattattgttcactgtccttccacggtggcacagagtccccagggtatatcatagtattgtttgcaaaggtctactaagagtaaatgagtaaatgaatctaataattttttattgctttaagtgctctgtattttaattcactgcctatcaagccttgctctctttgaattatatttatgtctaaatgttcatgatagcatcagattgaattaattgtagccttatatattgactctcaaacatgaccaagactgttattgttgactctatattcagacaaataaccagacacatagagtaaaagagttaacccatagtctgtatgacctaatgaaaagagcttagacaagaaccaaggagcaacagtctcaaatgtcagatgcctttgccatattactcccatttctttttttatagttaaaaatgttaaattttaaaggttaatgtgatgctgctaagccctctgtagggtgattgatcagcttaaatgtaaactattttggtgaccatgatatataaagtcatagtgttgaaaaaattcaacaatagttagaatcattttaagaaaacaacattgatatatgaaaatattcacaattgagaaatcttatattgatgaacttagagattatacattttggtcttgaggcagaactcatcttagtaaaactgcttaagaacttaatcttgatcttataaaataaataaagatggtattttgtattttaaactattgagtatgatttcttgctgggatctatcactatgaaaagtgattattggtttagagtggtgttctcgttattttgggttttgaaggagcacagttcatcctgttggtctgtgttaaccaggggtaggtaaagaggacagaggacacctagcaatggctcaggtattatcagtgagcagggtgagaaaatccttgtgtaccaagaggaattttgtcatggatttgcagaactttcaaaaacaagaaacattatttccacttttcgtgtgattcctctcactttttaacctcttttctcttttccttcttttcgagatggagtcttattatgttgtccaggctggagtatattggctattcacaggcatgatcattacacgctacagcctctgaactcctggctcaagtcatcttcccatctcagtcttgagtaactgggactatagatgtgtgctgtggtgcctggcagagcctcttctttaactgtaatagacctgcttatcatgcatgaaatgatctacaaacacaaagtaccctatcatcattatctctttggagtactatgtcctttaaatgtattttcttactgtaactaactacctaggctggaggtcctatctctaatttagaaatgaagaaagtgagacctacttggattgagtgagcattcgaagtacattcagaagtggaaattatttttaaaagttaaatggcttctagaggtcatgtagtctcttttgtcatatagtggagaaaacagagaagttcaagatttccccaaacgttcttagttactggcaaacaggagctaaatgtcattcttcctggattttagtcagtatttgcttggtcacttttcttagtagagctttttcttctccttgcattcataaacacttaataaaagtgaattgataatgatcatatatattatataattaggtaatattagccgggcatggtggttcatgactgtcataccagtttcatatattagaagaaaagtacaaattgtgtagctactcaagtgcaaaatgtagagagaaaacctagagaagacatgaaactctctccttgactaatatcttcaggctggggatactatgaacaatggtgtgttcagaaagaatgaacaaaattgctgtagtaactcaatttcagaagagtttgaccctgtcagaatcatctactgtatttgcatgagaaatatgaaaggagtccaagggaaagatgatgtgttcagtgttcttttccactgcattggagcacctgaggagctgaagagagaaacttgtgtttcttctttgagtggcaagtgtgttagttaatatcatcaggcagaacatgctttccaagagtttagtttgctccttcacaaactaaaatactctgaagtgcctgattttatgcaaattacttttggttgttgtattgagaaatgaaaggatgccaacatttttttttataaaccaaatactaattagcattaccaaatttatctgttgagatacaccacttatttgtaagagaagctctttgacaaaatgaaagaatatgaataaattcttcacactggctatatgagaccttggaatgtcattttcttttttttctgtagaatttgtgtaataccctccactttgttggactgaatgagatgcatacaaaacaaccttgtaaattacagcattctaggtcagaggctagaaatattttctgtaaaaggcaagagagaaatattttatgcttttgtgaaccataggtctctgttgcatctactcaactctgccattgtagtgtgaaagcatccatagatagtacataaacaaatgagggctgctctgttccaataaaactttatttatagatacagaaatttgaatttcatgtaatcttcacctattgtgaaatgttatttttctcttgatttttgtaaccatttcaaaatataaaaaatgactcttagcccacaggctgtataaaaacatgtagatttggtccaaggtctgcaattcactagcctttctccaggtgactgcctcactatgaaacagttccaagtataaagggattaggatatgatgctgatgttgggattgcatttactgagctatctaggtgattgactccaggctctctctctgatactgagaacatgccttggcatatgttcccagctaacgtttgagaaaactcattttcggaggaataattttctgttgtttgttgctgggagttgggcagaatatctcaggtagtggaaggaggatactgcaccacacaactcatagaactgaattgatacagatagatgtcagcatttctgtgcaaaaacaaatgtttcaaagttttgaggtctcagcacttttccaggcacagcattctggatcttggcacacagatgactctcagtttgaatagaaaatgctcacctttctttttgctagttttattccagagccaatctctttataataaagaaagcaactgaaaatggaaaactcactgagcttaaagcagccaaaggaaaaatatgtgctcattttaagttttttcttttgcaactcttggccaaataggtttatttttaaatacttttcacaatttacaaatgtttgccttaggactttgtgtaatggcattggttttatacagctattacagttagggtgaagagattttcttcacagagatggttttggaaaatgtctcatcacacaagtggtaagtgtagtcgctgtaattgtattgaagaaaagaaatgactaatgggaatcacaaaattgtgaaattgatgatcatttctgtttttattgcctttattttaaacataatagtgacaaagtctgaaacaatatttggagattgctacatatttaaatatttaatgcaacaagcatcccactttattataggagatagaacatcgactgtgcctaacctaaattacttttccagggggttttagtggattattttcctattaaaaaaaggggaaaaaagaaaagaacagtctggtacaaagtataggtgacggcttcagctttgtaattacctattaattgatatctgtatataagtataacaaataaagttttaaatactgaaaatgagatgagagatactaaaggaaacaatttcctgagaagtattaggttagactgtacaaatgtaaaaaacatgtcaacaacctggcagcaagtagtcttgagaccttgaagttcaatgagagcagatgaattgtctgctcttttaatagtaataaaaactatctaaggcaaaattttggcatgtaacttaagaaacttaaaaagtttctcatgctttaagacactttgattttattagatctagaatgaggtctgggaatgtatatttttataaagctccactggtgacctgggtcaagttttgcaatacagaatttgaggcagataatattatgtaggaggtaggagatttattggggagtgctagaagtaccaataccagtgggggagtgaaaaaagcatgtctgtagagcagaagaagctggactgcagagcagttgcagtagaatcccatctgatcctaaggagccctggagctggcattccaggccctggagagttgtcctggaatgaggcaaggaggagggtttgtacccttgcattcatcagtcatgggatacaggatgccccagggagtgggtgaaaacttgagggagatagctctttccaacagagggtagtgtccagagaaggtctggttatgaggtgtcagaagccaacacttgcaatcattggacgaatttcagtcctgaagttgtttctaggcagcacaccagtgtgtccattacaacaggctattcttatgattgaaaaacgattgtctaaggggttgttgggaagaagtacttggactggagggtaggcaaggagtatttatctgtttcttaaacatgtacggagtgcctactatgtataggtactagagacataaacatgaagagataagttccctacatttaaggagcttaccatctagtgggactcagatatgtaaataaataattaaaacataattgtcaaaacaggagggtatgtggtatgtgcatgtttccaggttttaaaaaagctttacttcacaaacaaaaatgttctgttcattctgcttattttgatttgatagattacagctcgcagagctaatattctcttaatgtaagtttcttccccttcacagatgtttttccatctcctctaatttctcatcgttctgtgatgagacaaccagagtctttaaaaaataaatactttgcttttctatgattaaatggtttgatgaaaattaagccataagcataaagtgctaaatagaataaacccctggcacataaaatgggtaggtcctgatatcctctttcaattcttcaaatgtataggtagatactgataccctgtctcaactgtagtcaattacactatatattttcctctataaaatgtatcactggccacgttcagtagccctccattactgaatggggcaattattcaagaatgccccagtgaatgcctgaaactgcacctggtaccaagtcctacatatattgtcttttttttatatgtacatacctatgataaagtttaatttataaattaggcacagtaggagattaacagcaataacaaatacaatagtaaaacaattgtaacagtataccaacatcactgctcttgtacttcgaggccatcatgaaggaaaataaaggtgatttgtacaagagcactaggatattgtgataacgcagacatctcctagacaggatctactggacaaagggatgattcacgtcccgggtaggagggggcaggacagagcgggacagtgggagacttcatcttgccacatagaatagtggataatttaaaaattaggaattgtttacttctgaaattttccacataatagtttcaaaccaagggtaactgaaaccatgagaagtgaaactgcagatatgggaagactcctatagaaaatatttgggctgggcatggtggctcatgcctgtaatcccagcactttgggaggctgaggtgggtggatcatctgaggtcaggagtttgagaccagcctggccaacatggtgaaaccccgtctctactaaaaatacaaaaattggctgggtgtggtggtgcaaacctgtagtcccagctatttgggaagctgaggcaggataatcgcttgaaccccggaggcagaggttgcagtgagctgagatctcgcaagtaattggttatttactacataaaaatgttacgtagtattcatatttatgtttgattgcatcacttttttttaaacttttggctcaaatattggtagttttcaaggaacttttctgcagcattatatgaatatgatgacaagtagaaaaaccaaaagggtgcatcaatgtatgaaagctggtgtgttaaattgttatcatcattaacaattcactgctgcatgctaaattcatagctcacacaattcaatttatgccttataaaattacaaactattacaagtcatggactttaaggttgctcaccaagttatcaagaaggtcaaaggtaaatgcaactgtactattctatggtaatttttcacaaatcccattgattcttgtttatgatactatttcataaaactcagggtcatataataatgttctgtttcaaaacatgttggtgtatttcaaggtctcagaaaaggtattgaaattttttggtgagccaaagagaacaggaaagatgatgttttgtctgtaaattccatgttgactctgagttagaagagactctaagggtcatctggttctgggctgttagttttgaggtaataacgttttcatttacaaaaagaacattggtaaagtaataaaagcttatttttgtatatatacttatttacgcacagattatacatgggaaaaatggtgcccaggcagtttgctttcagtgatatatgttaggtgaaggtcaggaataatattgacataagtaaatattggaatagaaggcaagacttggaggtgggatttaaacaaataaacaaagttttttttttttttcctttttatgctactttgcaggaaggtcatgtcaaaattaaaatagattctgctttctaccttggcaagtaacatgtattatgcccactcacatgtaggtcttatctgctttggcaaatacttacagaagaaagtgtaatttggaaagagaagaacataatgatattagacaaaatagggtcacaaaaatttacaattggaaaatgatttgtaagttaataaaattacctagagccagattctactgtctaaatataccactgaatgtaaacaagcttttgctgagctagtatagacaggtttgaaaaacttggttttctccagtactcactcttatcaaggaggaaaaaggcccagaaaaaaaattctgaagagtatttttgtatcatttacttatgccccatctttttctcaaatatatttaagacagtttatcagaatacatactatgtaagaaaataacataaataaggaaatcagggcaaacagaatgtaaggttttgaaaatgaaaaaggatctggggaatctgaggataaagttaacacaaaaaatgcttgaggatctgttcatctgctgaatgacggttacaaatctgtaaatattctgatagccaactctaagagaaaaacacagttatttcaatgtttatagttatcctggaggagcccaattctttctctaagtgggaccagagaaaaatttcccctttgtcctaagaaagaattcctacggagtatagggtaatcaagaactcatgaagctgtgtgtcctgtaatgccccttaagtagttagatgattgcaggccaagagcaatacagtcaaactgattttaccaggaagaaaaagcagtcagtccaaaaacaacattcttgtggtttgattaatccaaaattggttagattcaggaatggaaatctgcatagactttaggcaaacctcaataattatttctgtaaccaagattctgataattgttgaggaagtagtgaattcaagcttatgctctctgtacttcctgacaaatccttggagtgcatcactgctatgttgttagtgcgtgtggacccatatgcctttgatatttgccaggctggggatataaatgacatataaagatgttctaatgagggctactcactctcttttctctctcacagacacattcactcatgcccatgtatatacagataatcatatagacatatatacacacacataactattgaataatttgttgtttaaaaaatatgtttcaaattaatggggaaagatagattggggaacagatgggcgtcagacaatttgctatcaatttggctagaaatcaagttagattcctatcttacaagatatgcaaaacatagaaggattataaagtcaaattaaaaaacaaagtattagaagaatatatggagcatttttatactcttgcagtagggaaagatgctcagagcaaacatgaaatccagatcccataaaataaaaatacgaagtacttaggcaaaaaccaagaagaaataacaaactttggtaagacacaaatgatagtaaatgtataaaagtcaatataagtaaaattaaaagagaagtgataaacttggaacatgtattctaaacatacaacatgaagaagcttagtatctatgatttttaaagaatgtcaagatattaatatacaggaaaaacagcagaatagaaaaatgagtaaagaacatagtttttttctttttgaattaattgaatttgaaacagcggtttttctccttcgaggagtaggacttttcacaaagcttcagtggattgttctaaatactggaaatgatatggagaagcacgtctcatctttctggaaagcgatttggcaatgtatatcaaaccttaacattacaaatgagcagacccaacaaatgttcatataaaactcacacctaaaaatataccagacatgaaggcaaagctatatatacaaagggtgtttacagaaatattattcttatgtcaagtgtggaaaatactaaccgaagtccacatgtccaactgaagaggaattagggtttaatgatttaagaagatatcatgaaactattaaaattatgtttaatgttaattatataggaaaatccttgaggtaaagttttaaaagtaggatacaaaattatgtcatacacacacacacacacacacacacacacattttacaaaaaccaaaatatatgtatgatatgtattgttttacacatggagagatataagtatacacattataaatacaaattaatacttttggtcatacaggatgtctctgttttttgaaatacatttttcaatagttttgacatttttagccataagtatatatcaatagtgttatttgaaaaatatttaaacagaacataactcagttaatatatatgtactaaataaatttataatttttaagggcagaaaagcataaatatttcaggaaattctgaactaaaacacagttgaaaacttctaagactctatatcaatatgcaattgcaatgttaaataaaataaagatgttagcaaatagcacaatagtagttggcatattggaactagaatttcatcacgttatttgcaagacatctaatatgagtcatttgacccaatattttccttgtcttactctgggatgatgatacctctgtcatggggttgctgtgaagagtcagtaagatgtaatcaaccagcgaatgttaggtgctcagtacattttaattcttcatcctctttctctttttcctctcagcacagataccagatgtaaaaatgttatttatttttttcctagcactagtaaggagttgaaagtttttttccataaaaacagtgcccagttcttggtgatgacagcagggagacctttctcactcctcttcagggtgaaggtcagtgggttcgttccagttcattgactggttgttcacagctgacgttatcacgattagacaatgctttgccttaccaattatttaacgtaactgtgcttctgtctttgctcataaaaactctggtttggatacttcactcattgaaagcagcagaggcaaatcatcaggtatatatacagcttcaatgcctaagatattgggctacttttgctagttagcctgtggtccagtagccgcccccacaccccaccatctatttttggaacgtatacaaatggagaaagatacattaggttcctccattttaatctagttatttttttaaaaaaattataagtatgaattttaggctgtaagtgtaattttgttagatggatagattgtgtagcattaaagtcaggacttttagggtagttaccatccaaataacatatattggccagagacagtgtctcctgcctagaatcccagcactttgggaagttgaggcaggtagattacttgaggtcaggagttcaaaaccagcctggctggtcaacatggtgaaactccatctctactaaaaatacaaaaattagccgggcatggtgatgcgcccctgtaatctcagctactcaggaggctgaggcaggagaattgcttgaacccaggaggcagaggttgcagtgagccgtgattgcaccaggccactgcactcaagcctgggtgtaagagtgagactctgtctcaaaaaacaaaaaacaagtatattgtgcccattaaataatttctcattatttattcctctcctatgtccccacccttctgagtttctattgtctatctttttatactctgtgtccatgtgtatgcattatttagctcccacttgtaaatgagaacatgcagcatttatgtttctgtgactgacttgtttcaattaagacaatggcctccagtttcatccatgttgctgcaaaagacatgactttattctgtttttttttttttatggctgaatagcattccattgtgtacctattacatttttttttcccagtcatgcactgatggacacttaggttgattccatattctttgctgttgtgagtagtgctgtgttaagtatacaggtgcaggtatctttttgatataaagatttctcttcctttgggaaaacacccagtagtgagagtgcaggatcaaatggtagttctttaaactctctaagaatctttacaaaatcctgccactgtaggtataaaacaatatgtggtctcacttagaataaaatggagacattttaagaatgtgttgtttgaatcctggccatgttctttcccagaggctacagtttggtgtagttcactggatgtgcctgtggacactgaacttgactggctattggatttctgactcctggaagattttgaggagttgcagctcttgttctctttcatctcccacccatctccagaaaagtccaggttacacctgtggaagggttaccagccagaggacagagtgtgaaggcttgcctggtaatggcaaacccagttgccatccacatgtcatactttgcaccatgtccctgatttgtatgggttctgtacatgtcacagtttctaagagtgaacctctctgcccccccgcccacatgactctgctgtcagctttccaaacaatgagaggacagctcctttgaaagatgtaagttttccattccgaaagatataaatttcctggtcctgcagaggctagaaatacctcttgtttgggtcactggactcgggctaggtgatctgcaagatcttacacaatgctactctaatatttcctctgtctccagctgtttcatgactccatccctgccatgtgtgtgccttaccatctttttaagcagagcacaggcctgggcagtggctcatgcatgtaatcccaggctttgagaggattgcatgaggtcaggagttcaagactaacctgggcaacatagcaagaccccatgtctacaaaaaattaaaaaaaagccaggcatggtggcgcgtacctatagccctagctgcctggaaggctgaggcaggaagatcgcttgagcccaggagttcaaggctgtagtggaccatgatcatgccactgcactccagcctgggtgacagagtaagaccttttcttacaaaaataaagaaatagagtacagattgtaactggcaacagtgagtctgtctcctccctttcctcgggcatcagagtcaaaagaatgacaataacatttgctataattattttaagtttttttaaatgatatggcccacatatagaaaataattatcatgttgtcttctaaaggatttgattactagaattagataactgatttctttctttcaaaaagtggaagcttttttttgtttgtttgtttttggttaactgcattttaaattttaggaacaagtagattcttcttcagtcttaaacttcagcacctgctaaaaataaggattacgtattaaacattatattttcccccagttttctctggatgttactgcaaaaatttactcactctcatttggatcacaggggctgataaatgtgtgtgtttccagatgctgcaccaggactgaacctgtggagtaggaaatgattctaccttagatacacataccctcctctcctgtttttttattctaagtctccctagcctcttaggtttttgtttgtattaccctccctctttcctgcttccagccatccctattatgactctaagggtcccatgaaagattaggtcatctgtgatgctgtcagaggcctggagaagtcctccacctatgtgtgcgtcatggacacctggacacaggctaaaagcttcttgagcaacttggtaatggccttctgaaaaaaaatgcgctcagccaatgtattactaattctactgggggaatttccaagtcaatttctggggactgagagtggtacagaaggatgagggtgtttaggtacactttaaattcacagtgtatgatgtgccctgaccacccccatcctccacacacccactacttactcctaaaacaattttttctaagccaaaagtggtttatgacaaattgtatgtttgcagatttggagtctaaagaggagtagatttatttaagggccatatttagtgttagtaaaagctacacttactatgctaattgcaacttaaattagagctttacctttatcaccaaaaaaaaccccactgtcttcccttgatgttaaattgtaggaatttaaagtaatttaaatttctattttttctacatttccgctttttgtatctgtacaatatgattatacatgtgaatggttaacaaaaactgtatactttagtctttaagtggaacctcagtgcaatattttgtaggcattaaaaatgataagcactttcatcagactattagttttcattttgttgactttgtttgtttagttctttgtggtataccctgtagttataatgaaatgatgtaaatctatatatttgccaacacatagatgtatttctttttaacttaactttttagcattatgcaggaactgctgctcactcgctaattatcccacagcctcgcaagatggcatctcctgttttctagcagatcaggatcaaaactttggaatcatttctctttctcttacacctcatatcccatccataagaaattctctgcatgtatctagaacttggcacttcttaccactttaactgctaccatccgtcatcttttgcctggattattaaaataacctcacatctgtccttttcttgccattttatcctttattcattagccagaatgagccttctaagactgtagtcaaaagtcatacagctcctttactcaaaccctccatgaacttctgacctcattcagtgtaaattcccaaggtccttaccatgaccttcaatgccctttatcatctggtctattaatgccacctgacctctttttctaccaccgccctcaggtcactctgcttcagacataggggcatcactgatgtttcagaagcactgcagaacccttgcactaactgcttccagtgctaagaatgagcttactttgtataagcatggcttaattccttactttctttggtttctgtccacatgccactttctcagtgaggccttcgctgacttccctgcatgagctagaatccactctgcacctggcagtctggacattcttaccttggcttatcctctattatcctagagatgtctgtcttcatccccaacacctagaacagtgacggacacatgatagctacctcatgattatatttgaatgaataaatctttaattatccataattgggtagtagacccaatcttgcacaggcagccaagaaacaaaaccaagaaaaaaaaacttagtttctatgtagacctgccactaactagacatacttccttttgcaggtgtttaacatctctgagtctcaaatgtctcaagtattaaaatacaatagattgaactagacaatttcaaaagttctgcttgctctaataaaatactttacacgaagtaaacacaattccactgatgtttgttcaatattttctatggcaaggccattcctcattatatataactcaagtagataagtagcagttgttatttgtcatatgtatgtatgtacgtacacacacatgcacacacaattcaccctctcccacaatatcactgtgttacacaatcctcagtcctattacctctgagacccattgtaaataaaatgtaaaatctttagagcatgttggacaaatacatggttttggttctgcctctttccagtcgcagacatcactgtgagattatagaactctttccatctaggccaagactgggtctaagaattcttctcagacttctaggaaagatatcaaacttattagagttgaaactagagatgtaacatagattttattccaggttttgggtatctgagagcctagaagtggtgtgagataaagaatttgatacaccttctccagtctttttgcttggttttccttcaattcatccttccaaactcattgtagataccacttctcctaggatttttccccaaatccaagactgtgttatgtggcccttgttatctgattacctagggccctggtctcaattacagaattattatgttgtaatttctttttaattttaacttgactgcatcatctacctgactgtgttctctagaggttcagaccaagaattgcgttttgaagactgagagctgggcctgacacttactagggacacaataaatgttgacttattgaacagataaatgaatgaatgaatgatgcccaggatagaatatttggtactgctgtcctgtctagcacatttctccaaggtaaaattatctcccacatatgacaaaaatctacctttctcttggttaaatcccttagtaagctgcctatcagagaatttgagggttaactcattcttttagaataatgtaaataacttggatgggagcaggctgtatgctttaggtcaattagaccaccttctcatgcctgagggaaattgtcccttaaggtctgttctatggcacctagtcccctaagatttgacaagaaagcgttccacagttcaatatatttggaaaacattgctcgctggcctttccccttgaaatctggccatggacattagcttattagagattctgagtcatctagtaaagaattctgtttaatttttttatagctagaatttttcatttcttttgaacttaaggataatattcaacattatatatattaacattctactggactaatgctttaggaaacagagttttacacacatagaggccatttaatagctttaaataacagtgtagcagccatatggcagtgagcagattggatttggaaaggggtaaaaccagtagggaggatgttgcagaaatctagatggaagaggatgaggcctataaccaaagtcctcatagcggccacggagaaatgaaaacgtttatgcaagaaactgatctcgttactgaaaagtcttttgcaagagtaactaaggtggttagagaacaggaggttggtactgtagtgctttccctcttctgcctttcaaaggtaagagcttgacttcgtttttaagccagcaggggttcttacatagctgagtgtctatcactacttaatgcatgtataatgccctgctgtactgatattcatgataaaaatcaaggtatttacagtcaattataatttcttattctcaaagcatacattgattttcttaaactaggcttttctgaactgggtatgataatacacattattatcataccattattaggcctctctttccaggtctttcagtgaaatctgtgtgtgtgtatgtatgcatttcctaaggctgttggtgcaaagaaacacaaactgggtggcttaaaaacaacagaaaccaaaatcaaggtgttggcagggccatgctccctgtggggttctggcagatccttccttgcctctccctgttttctggccatgtctgtcaatccttggtgtttgctggcttgtagctgcaatgcttcagtctccacctctgtcattcgatggtgtctccctgtatgtctctgtctctctctgtgtacacattttcatctttttgtaagtacaccagccaaattggattaagggtctaacctactccattatgaattcatcttaactaattacatctgccacaaatttatttccaaataaggtcacattctgaggcaccgggggttaggactttaacacacctcctttgggggcccaattcaaccaataactacatctgtgtgtgtgtggtgtgcacgtatgtgtatgtgtttgtaagtgcacacgtaagatgcaccaacatagatgcaaagacgtttgtcttcccaaatttactagtagtatttctggctctactcccatgaaattacctttaccctttctctttgaaggatggacaaagccaggtctgataaagcgttagaatttgtcatggctggtcttcacgcggcaaaccaattatgtgaccacccaggccttttcatcatgcttggtacattcatggaatgttatctcacactggggttggtaatgcaatactaattctaaaaggctattctgattaatgtattcatcttggtttagcattttttatattgtttatttcagctctcctttcccttttgtgatctaaatatattttctttcaggttattttgctaagtggttccgagctaattttattacttttttgatggtaagggtctaggcagagtagcctttctgaaaggcaagctttaccgacttctccaggttcataaatattaataatgtgtaactacgactctgtgtgctaaaacattgttgtggagattgtacaaggaaggcattttatgatttcatggagacatggagtagcaagaaaatggagcaatgacatttggggggagcatgacatctaaatgttaatattgtgtactgcttactgagaatgagaatttctcttcttttgatgctcgtgttgtcagttgcacgagagtgttcttcaatttgtactttacttcttctagctattttttttctttataaaactgctagaaaagaagccagctagtattttgaataaaagagttgggattgtataaggcaatgtttttactcagctttcctcgaccttttgatgaaaattccagttcaaaataaaaagacacaggcactaccctctgagagagtctgtgtgaccaggctatcattcttaagaaacggattgaaacttcttagtacatctcataaaaaatttagttagctataaatgttttaggctgttgcagctgatatcatttgccttgtgggaaaaaaaaatgaggctgttttatgttaagtgttttgttttctcttctctctattctttttttatatgtattaggcaatgcaaagacttttactaccattgttatgatagtatttaaataagcagaccaaacccatgcatgggactgaagagtaaagtcaagaaatatttgagatgcctcttttaaattaaaggtatattcttcattgctaattttgagttcaattttttactgtatattaaaatgttaatttcaatttcatctatagcagatggtatcctgcttttattttctaaagggattcttcaagtaagccctcagttgtcttgcattatgagtaattagagaaataccttggttggtcctcagggcagagctaaaaatagagttcagtgatttttttctgtaattcttactatttttaaatagaagaaaatgataggcaagaaagaaaaggccatacttaaccaaaatgtccatgacttctttcattactaacaaaaaattgccaagcttgacagtttgcaaataactctcccttctccatgaaggtaacttggaattcgatgtgtgtgtatgtacctgtgtgagtgcatgtgtgtgtgtgtgagagagagagagagagagagggaccacaaagtctctgatgttaacaaatacaagaggaagagcagtagatgagggcagaggtgtggtaagcaattgatctggcaaaatcttgaaagttaagacaagaactctgggtgttactctgagatgggaagtgtttcgactcagcaatcccataatgggtatatattcaaaagaaaacaaatcgttttaccaaaaagatacatgcacttgcatgttcatcacagcactattcacagtagcaaagacatggaaatcagcctagggcccaccaacagtagactggataaagaaaatgtggtacatatgcaccatggaatactacatagccatacaaagaatgaaataatgccctttgcagcaacatggatgtagctggaggccattattctaagcaaattaacacaagaacagaaaaccaaatatcgcatgttctcacttacaagtgggagccaaacactggctattcatggacatatagatggcaacaagagactctggggacccttaggggcaggagggaacagggggagggttgaaaacctacctatgaagtatatgttcagtaccttggtgccaggatcatttgtaccccaaagctcagtatagtgcaatatacccaggtaccaaatctgcacatgtaccccctgaatctaaaataaaagttgaaagtaaataaatagataaataaatgcattaacttttttcatgaaaactaacaacaaaaaacctgagaagacaggccgcaaaaaaagaaatatggaatacatttaacctacaaagaaacaatatccagaatacataaggaacatctaaaagtcaatcgtagtaaataacataaaagcaaactgaaaaatacttcaaacgacattattcagaaaatgtatcctaatggccgataaacattaaaaggtgctgaacattcttaatcatgaaaatgaaaaatagaccatactgagatgatcatttatcatccagtattaacaaaaatctagaaattatgacaataagttttgggtaggatgagaagcaatactgctttggggtatacaattgctttggaaataatttggcattagctgtaaagtttgaagatagacctatttacaggttagtagtaccaatcctatatatgctgtctagaaacttctgtacatgtttaccaggaagcacatataagaatattcctagaattactgaaatggcaaaaaactgaaaaaaactgcaactatccaccaaaagtaggatatatagataaatcaatagactgatagattggcagatagataggagtgctatacagctgttaaaaataactgtaatgcagtgttactcatcaatctggatgaatttcaaaaccaaaatgctaagaggaaagtgcaagaagcagaaaagaccatagaaattattccatttctgtaaggtcaaaacaagcaaaattcagcaacatagtgttttgaaatgcattcatatatggtagaactatagagaattttaggagaatgattaaaagagattcagaataatggtcacctgtggagggaaggagggggctatgattggagaaggtcatgctatctacaaatgtgttgttccatttctcagtctgatagtagaaagatatttgaacatattattgttcttcaaattgtatatacattttaatattttataaatatattctgcattaaaataaaaagaaaataggaatgatatggaaccagcaacgacagacaacttttttaagaattttttttttttttttttttttttttaacgaaagctattgtcttctatggaaaatgttgtttgacctattagcacttgattaggttcccctccttttcctgaaacactataacttttccctatcatgtcttgtactaaatttatgctagctgcaatgctagataacactcctccagacaggtcttagtagattaataataaatgtttatttcttgctcaagtaagaggaaaaatgagattacctataagtagcagctcattttcaaaaggtaattcaggtaccttgtatctttaaatctggtggctctgctattttcaacatgtggcttctaaggtctctgtgagaggagaaagaatgggggcttgcacatgtgggacattttcatgagcaaggcctgcattttcctccatatgctgttgacagaactcaatggcataggcccgctaactggtaatgagctggcaagtgttgcctagctgtgtgtgcaaaagaaaaagagacagatttttttttcaatagctagccattttatccatctactttccaaatatccacttaaatctttcttctttgcttaggacccatttaccaagggtgacagtccagtcccatcaccgttttgagctcaaataacaatatctccaggcagtatgcagtcttctccatccattgtaaatgtgccttcttgcggtcttgcaatctctgaattaaaaagacaagttgtctccctttcacatcttcccctctctccagagtgggagacacataacattcactggtacatggaaagaataatattctgcaggagggtggaaggggtcttttcctagcagttctccttggctcttatcactgtaggctagtgcatagccccatgcctattgtatgactgcactgtgtcagagttcaatgagttcaagtttgtactattccctgttcatgataagaactatataatagttaattgctgatagtattattatattacaacaagctcaagtaccaagtgtctttgactttggctgaaattatgtgcacactaagactagttaccatggtcatcataagctataaatggtaattttttctatatattgtttaatatgtgtgtgtgtgtgggtgtgtgtgtgtgggtgtgtgtgtgcacatgcacacatccaggaaaaattattacttgacacctactttttcttgtaaacaacaatttatagtaaatatggaaggaaatttaaagggtctgtggcttgaacatgttggaaagtcttgctttaaagctccagcagatcctttctgtactaaggcacaaaagctatgatttttcatctgcccagaataataaaattatttacaaaagcactgagaattattctttatatgatttccaaccttcaagcttctgtagaaacattgtagctttgtaaaatgtggtgccttaccttggaaaaaaaagctttgttttgaagccgaggaatagtaaagaaaactgctatgtccctagcattaaaatcttatatcctcacaatgtgaacatgcaaattaactagaagaaactacattttaaaaattgaaagatttttttctgagatgcctttgcattttggttatctcttattggtcaaccccaggtcagagttaacacacctggctctagagtaatacacatgtacaggtgttgttaaaggctgcatgatggtattctgagcctctgctctgagctctgtcctagatataaagaatgtgcagccagctgtttgtctacttgtcctgaccctgttcaaggattaatgaagagatcctctatctgtagtccaatgtctattgggtagggaccagaaatgattgaacgtctttgcttcatgatacgctgtgccagtatacatgaaaatgggaacctaaaagtactttcataagcactttgtggaacttatttcttcctttaaaatgtcctagacaccttattgtcacctcttggctccctctggtttctgtattttcactggtacattggatcaccatggcagagccctaccctgcacccaacccaatagcaggaaggtttaccttcagcttgttccctgtatgctcagtttccggtggatttattactgtttttggttgtccccagaggctggcttatcatgaagttaaggatcttgatgcctcagggcttttcacttacatagaaccttccaagcccatgggtcttgaatctttgctaaatcggtccttgctctgtatggtactgctttaactgaaacacacacaggaagctgtgtccttactttgcacagatgtattattcaacactgtgaatactgtagtaataatttttggtattttccttgtaaaacaaagagaaaagaaaacaaaatacagaattgtgctgcttttattcactgagtagtgtttcaaatcaagctagctttctggcagtgtgacatcatggcttagcaaagagtccttagaattttctaacttttaacaaaatggggaccttaaacaatctattctctgaaaaataatgttgaggtttcacagtaggaatgaaaagggtgggacgattatgatataactaactcaatttttaatgaataatgaattgcagagttaatgcttgtcagaattttccaggaattagggagaaaatgaggaagaaaattttacaagtagagttaagaggaagaggtagatgaatgcacgatcctgcttttattttatgactattaggatagagatgtttgaaacctgctgagtagctggtggaaggggaaggcttcaaggataaatagtagatggccatgcttgtcccccgacacagggaacggcctgcgcaaacacacttggtttgaggatatctgatgagttcaaagtgctttaactactaagcaggtggaatggcaggatataggagtcgtggcggccactgtaaaactcggtggttcagatgtgggtgacatgatttgcaaatataattacaaagtgatacgaactgttaaattggacaagtttagatttaggtgacagtaggacttagaagagacatctctatatttcctatgctaagctggaggtaataggagaacaaactactttatccacccctgaaaatgagactgttttactgatggaaacatcatcgtcttgaccatgagaaaaatccaagctagaatcctggccctgtggtttactagccaagattctttgaggggcattaatatttctttatgtatacattgagactctgtgatgatacctaccgcttatgcttgctgtgagcatgaatgagccaagatgtactgaagagccatgttaaatacctgtagatagttaataaatagtatctttattgttatcaagtaaatggaaagaattcaaaagaagggagaaagagagaggaatagtaaaatgtcatgagagctggaggttatttgaaaaatacatgttaatcaattgacgttatcaatcaagtaatcacgagattaccacagatacccagcttggggacaggaccacagaagaataatttgtgctgcctctcttgacgataactactttggttgaaattctgtatccctcttactttgacaaatcagaatcaagcgtggttgaatcttaaagactttttttttttctgaactaactcttactagttggcacaatagttaaatgtgtaggaggaaaagaggatgacggagaatgcatattttggtttggagagaacaaaaactgccctaggataatgtttgaatacatggccaccaacaagcccaagcttttgtggaaaaacactaaaatggctaaagcctctcagcataactgctttgctaatttaagtgtttgctttgagagtatgtgaacaaccgaattttcttagttaaatttattaaaaatgactgtacaggatggaattggccaatcagacaaaaacagttcaaaattagacgacgtttttcatcacttcacacttttgcagtgtttgctacaatcaagacactgtgcttagatgctgaacgtgatgcaaaggagttaaagatgtagtccttaccattgatttattggaagcaatagcatattacaaatactttatcttgctctacaggtaggcccgatacaagaagtgttggctatgagtaataatttggaggttcttcaaaaaactaaaaatagagctaccgtatgatccagcaatctcactgctgggtataacccaaaagaaaataaatcagtatatcaaagaggtatctacgctctcatgcgtgttgcagcactgttgacagtagctaagatttgggatcaacctaagtgtccatcagcagttgaatggataaagaaaatgtggtgcttatatacaattgagtactctttagccataacacagaaggaggtcttgttatttgcaacaacatggatggaactggaggccattattttaagtgaaataaaccaggcacagaaagacaaatgtcacatgttcttacttatttgtggaatcttaaaatcaaaacaattgaactaatggacctagagagtagaaggatggttaccagaggctgggaagggtagtgggggctggtggttggggaggtaggggtggttaataggtacaaaaaggtagttagaaagaatgcataagacctactatttgatagcacagcagggagactatagtcaataataatttaattgtacattttaaaataacctgaagagtgcagttggattctttgtaacccacaggataaatgcttgaggggatggataccccattctccatgatgtgattatttcacattgcatgcctgtatcaaagcatcccatgtaccccgtgaatatatacacctactgtgtatccacaaaaaaagtgttggaagagtgttgtgggatttcacacaaggcactgcctgggtttgtgtcactgctctgctctcctataccactcttgtcacataagcaagagacacacagtctcatatggagtgacaaattcggaaatggaaattcttttacagttaattaattcaattcagagtgtctcctcatcatcatccagcatttcctgagggtacctgttttgtgtaatgtggtaagcatagtctcttctcttatattcttccaattaattactttttctagagtttaggcccttctgccggagggagatgcctgtgtggtcacaagaatatttttctccctgcctccactttgttttggtgaccttggccatgttagttggctttattaggcttccacttcacaatctgtcaactcgattaacacaggcctccctggaatacctggctgttttgtttaagatgaatctaggaatatgacttgtttcaaatccacatgtcatcttgaaatgagcttgtctgggtctttagggttgaaatatatcccaggcttcttggctgctgatgtatatttactattttaacttcagttatctttttagtctgaaggctgaatgacttcttacagtgatcaacacaaagattatccagtagtctttggttgaatttattgtcttgacttcaatactatctatcagcaatactttgcaaggtcaacttttaaccatttttgttgttctttgccaaacattgcataaaataaaatataacctttcttctaccatattgtaatactgttgtaaaaaattaaatgatttcctactattccagtttattctctgtcaacattcttttcatactaaaaaggttggttttagcttatagatgaaatgtttttctccaaacttatttatgataataacaacaaatacttttatagtgcttagtatattccaggcactattataaacattctaaacaccttctgccattaactcattgagtcctcacaataatcttatgggtactgctaattgtgcccatttcacagatgagaagattgagggcaaagaagttaagtattttgcttatggtcacaagtgattgggccaatgtttgaaccaatcacttgtctgaaattttgcctttaactatttcacattttgcctcactgttagattttagttctttgttctgaatttggaatgcgtataaccatacaagcaaacacaaatttttattttttaacttgtaatattatggctgacctagagcagtgacatttttagtccaagacctagatacagacaacaggagatcatgtgtaaagaaaatagaataaaggtccttttttcttatgcagggccagcccaagataaaattttgtaataggttgaagtatatctttggcatcttttcacctttctctccctctctcaatttttggcactcctcctttcactttcatctattttttgctccactttgattagcagtagcctgtctaatccctgagagtaacccatacatcagacagaaactccaagtacagtgatacgggaatcaatgtaccctacctctgaccctcaaatttctcctctcagattctagcctgagaaaatatactgaaatgcaaaggtttttgcataaagatgttaatcacagcgactttcttttcagtaataaaaatttgaaaactgcctaaatgtacaacattggaagaatggttaagtaaattgtgcattatacaatacaatgcagcattatgcagccattaaaaactatgtttatgaaaacttctccatgacagaggatagtacataagtttaaatgctaagaaaattcaagttgaaagtagtataatatcaactctagaaaaatacatataaaacaaggaaagaaaaagctccaaatattaaatgtatacagattggatataaagtgattatttatagtttattccgttttctaatgtattagttttacaatctagaaaaaataaatgatcagtttttataaaaaccttcattcacaataaattgcaattttttcttaatcctcctagatatattgtcattttcaaaaatgatacttgccaatcccagtgtctttaattagtaggattctaagcagcacaagaaaatatagaaaaagattgaagaagtgtagagggaatatattcaaagtatgtagtatgtaagctgaaatagagcaaccgcaattgaattctcagatcactaaacttttcttgctttacacaaattttatctttcttaattcaattttttctttttcttttgtgctttctatttaaaagttaatgttttgttttgcattatattttttttcctctctgtgttggaagcaaagacagtaatgggaaaaggggacaagaaacggggcaaggatacactgaaggtgatatatatgatatatatatatatatatatcttcatagatggtggaattataaatggattacatatatcagatagaattaagtgtttgcaaattaaggcttgtttatactcttttgcaagcaatattttaaaatctgtttgtttattttttttatttttggaagccaagccagcagttgtttaaaattcatgcctctgcataatatatgaagactacatagatgagttttctggagatttctccttgacacatttagtttctccacgttgcttgtagaaaggatgattccattctctcaataccaccttccaccaggagaagccattttctttcctgaaggtcaacctacagccacagtagaagaggaaaccagttactgtgattccaaatataatttcccaggaggtgaaattccctctcctaaacatgaattggttacaggaaaagaaaaaagaatgtaattcgtaagactgtggagccattttcctaatccaatttctcctgtcccctagatcgatatcatgtgaattgcttccacaggggactgtgctagcagagaggggtctgtggaaagaaagaagcaccgtgctccaatggaccattattattgtttccatatcacagggtccacatatgcatgtaaatgtttttatagtacacatacacaaatgcaaaactgaatgtctaactaatgtcaagcacggtcacatacacccacactctctaatttcctgtccaaggtggtgatctgtaaaagagaggtgaactgtaagagctgaatgattagaaaataaattctaaaactcaagtgcacttaacagtggacgtaatcagtagagagaactaagacctttaggattctgatgcatctgtcacctgtaagtaaactgacagttctgtttttttaattattattaagcatgagttgctatataaatcacatctcattacaacaagccacaagtgactatctacatttttatgcaaaatgaatgctatcctactaaatgagcattgcctaatattgggagtcttttcttggtcatgcagtgatatttgctgataggggatttgacctgtcatagctttcttctagttttgtagacatttcttgttctctacctccctggttcccagcgtgcttatataatttgacaatatcttttggagcaatttgaaaatatgaatctcaggtcattggaatttgtgtattctaataaaaactggcataataattcagaagtggaattcattgaagaattatgggctcccaaatgctagtcaaattattttttatagaggtggaaagaaagggtcattctgtttttatttcaatccccaaagtatagattaaggcagcagtattctaggtcttacacaatcataggaggtgggtaacattgcaggagaggaggaaataatattcgttgactgtttactattggcaagacatcttaccaacagtttaatactctttgcaactctgagccagttggctctctctgtatatcacttttggaaaagctgaaatttgtaaattagtcccaaactctaggtcagagggtaggggagtgaaggaaggtttcattaaataaatggcccttgggctagtaattaaagatgactatgagttacctgagtaacaaggggagggaacagtgttcttagtagagggaacaacatttgcaaagaatcttcagtgggatggagcttaaaaataaggcaaacatggctgaaggacagagagtgtgggagagtactatataagctaagagggaggatataggcaggagctagatcaggcagtgctttgatggccattttaaggaattttaagcaatgggaagcttgaatcaaagactgtaacatgagcagatgtgctttttcaatacattattatagttgtggtgtggagaactgactgtgtggacacagacagactttcacttcaatcatctggatgaaacagtggtagcttagatggatgtttgtggtagagatggagagagatagagagtttggggacgatgggcagaattaatagaattcattgatatgaagatgtgaggaggtgaggaagagaaagatgtttaaggtgacatagaactctgcatcatataataaaatggatgggggtgccgtttatggagatacggaatgctcaaagacctgagttttatgaatttgatcatttttctaaataagtgcttgattaggagcatggatcacctatttggttttgaacatgtatttgccattcctgtgactcatgtaaaagaaatgtgaaaaggcagttggatctggactctagaagagaaatctagattcacaaactcgggaatgagcattgatgagaggtggagaactacaacagttattagccacatccaggagaatgagcctacaaggagaaacagaataatccaatagttaggaggaaatcaggaagatgactgttttgtggaaggcaaggtaattgatgtttcaaaacaattttgttggtttttgataatgtggaagttatgggcaagagaatgcttgggatgctcaaagaccagcaagaagaacagagtgactggagctaagtgggcaagatgattagatttaaaggttgattttaggtgtgatgagaatgcattaagaggttttgagtgaagaggggatatgacctgctttacattgtcactggactacagtgatagacagtgaaggaagcagggatggaagggcttggggggagaccaattaggagactgtgcattcaacattcagctagtatttatttaacatccagtatatgccagatatctgtaatctaggcttgtcatttggacttggacaaggaagaagtaatcaaatttgagatatattttgaagtcacagccgttgggatttgccaatggattgaaaatcgggatgtgaggaggagatgaatcaaggataatttcatggttttttggcttgggcaatagagagaattgcagtggggctgagactggtagccatagacaaggaacagaggtgaatagggagaggagcacgagttcagttctggatttgataaggaaatggtaatttttgtttataagattcttatgaggataaatgaagtaatgtctgtaaaggactttataaagagcataaacacttatcataagattattgttgttactattattagagtgggccatagtgaaaaccagtattctgatttgttgggccacctactgtgttttattcttggctttgtcactaacttgctgtgtcactttgagcaatttattggttctttctcaatctcaatctcttcctctctgaaagtttccaaagtgaacattagagatggaattgactagaagatcaggaagatcccaatcagctgtaacacccctatgatataaggctgattagtattatctcagtattattttttacattattgatattgatattttacttttatacagaagccaccttccaaagtagatttatcatattctaatgagcattgtgaatgatctcatttcagagataaaaatgttgaagggctttaattatatttaaagaaaaacagcaaaaatgaactcttatgatgaaaatcagtcatcaaaaaaaaaacctgagagatgagaaactacaacaattatccaccctcccaacatgtatgcagctattttgaaagaaaacatttggtacctgttgttagattttggaaggttacacacaaacttggaaaactgtctaaagaaaagccaagggatttttgagttttaattacttcttttaaaaagtaaacagtagtcaattaaggagccataacttgtcttctattattaaattaatggaatcatgcagtaaaatatcagtggagactgcggcattcacctggacagacactgctgttttaattatctatagagtcaaatctatccaaacaatcactctcataatgtaagagaaggaaagaaaaactaaaaactagtccatctctaatttttctcatatatcagggtttttttaagtttacttgctcttcttgcctccctgactcaatttcatccctagattattgcagcaatatcagcaactattagttattattttagttcataactatttgttattctttggatctaagttactagtatctagagtggttctgaatgaccaggtatgagcagtgtggaggattggaaagcacatattctgaagaggtgttgaactgaaacacatccttctaggtacttagctgttttgtttctaacaacttaaagatgttaaagtatgttgttcacatctgcctcaatataagtggcagaagcaacattcctggtatgaaaatatgcacccagagaacttaaaatttccttgatcaatgttaacctgctgttgcagccaatgacatatcttttacctagagctagaaggtactaaggatgaaatcttgtgggattcccatgtaatatagtctgaatgtgtgtctctgcccaaatctcatgttgaattctaattcccaatgttggaggtggggccttgtggcaggtaactaaattatagggatgagtttctcatgaagagtttagtactatccccttggtactgtcctcatgatagcgagtgagttctcctgagatctagtctttaaaagcgtgtgatgcttcgcccctctctctcactcttgctttggccgtgtgacgtggctacaccctctttgccttccaccatgattgtaagtttcctgaggcctccccagaagctgagcagatgccagcatcatgcttcctctacagcctgcagaaccatgagtcaattaaatccccttccttcaaaaattaaccattctcgggtatttctttatagcaacgcaacaatgaatgaatacaccatgggatgctgctgatgtttggatatcctctcacttctaatccctggaaagaaaaccttgcattccagagcattccatctaagcagctggaaccactccttaggtaggatctcagtggcccctgtaacaagtactatgattatagtggacaagtacaactgctcctatctattcaaatggaagaatgaagggacaatgttatagttacaaaaagtgcaaaattttattgcaaaacttcctagtaatgattctaattatctttattgaatgtctgccattttctaggcactggagtgggggttgatttggtttcccttatctacctattcaggtagataagggaaatttacgtggaagctgaagttccttactagagagagcattatcacctctaactctgaacccagtgggcactgctagttttgtagttcctggagttgcactctgcctttttttcctcacacttataactacttctccagctcctgccctggacaggcctgcactgctctgggcattctgcccactaatgactagtttttggctcatttcctccagaggctgcacagggaagagtgacctgtgtggccttatctgtaccatagattttctttcttgtgtccagctgtaatcccaatttatataaacatgtctatacctgagaccccagtcttgataccccaacatataacgtcttgctaatcaccctcacatagccctttaagaaggtattttataattaagagacttgaaactgagaggcttacttgcccaaggtgcttgggaatgcattcagatccacactgtgtttactgtactgtgctgtctccatcccattgtacattactcatttgtaattccagctgcttttgtttgagtgactagcaagtgttcaagtttcactcacatgccatactcttagaggaagtaaataacgtgtttcttgaacctcactgtgttcaggaagtactttatttaaccttgcctgcgggttaatgaatccttgctctgcttcctagggctttatgtatgattaaccaatatacctgactatatatttgaaaagttggccaaatactatatctggggcatggggttccactgcactgcagcagcgcgtatttacttgctcccagggctgtccactgttatgagagagagagaattcctactctgcattctaccccatcaccaactgcaatgtgagaagcgaatcacaattattttctcagtccctgaagtatttgctccagaaggctttatttgatgctagaaaaagattttcccataggatcaagcttgtttatggtggttaagaagaccaagaggggaagaaaatctgttagggcaatgtcagcttaagagagaagctgaaattatttattttagcaccttatttctacatacccctctgtttgattagctagacatctaaatccatgcaaagcattgtttatataacacaatctgcaagatccttacagtcatagcatcttcatcctccctcccctatgtaggcttacacaattgagaggagacaactgaagtctcaattcacgtctcacatttcacacaaagaacatcagctttttgtatcatttactctttacaaacatactattgattgccataaaaaattatctctgataacacactcataacatcctatctgttatttacccatctctgtgaaactgattatgagatttttcccaggtgactagcaggaagcaggtctgttaagggcaaaggaggaaggggtacagcttgttttgtgctgaaagaagaccagagaagtcagtgaagtcaacctcctggacacagctttttcccaagctgaccctgttgactgaggaatgccgagttacattaatgatggacactgtctgcccatcatggaaagcggagagctacatgtgtgggaaagggtagtaaactcctcctccacaactgtgcctccttccaagcttagatgacagaatattagtgtctgttatccttacgacatctctccatctggtcctctcaggatttactttatggtctgttttatttcccttttactactattagaaacaaacagctgaaaggattaatcaaaaatgttactgcttcaaagagtaaaaaacatgttacctgtttgactggtgcccatatatagttaagagtttctgaaggaagaagggtcacgcttaatagatttgatgagtccattaagcctggcttccatcttgttgctttgtttgtgcatttatttccattttggtatcttagcagtcatcttcttttagcaaacattgaggtttcagtctattgggtcagggtattagcaatacattaaccaaaccgttgaagacaaggggccagacatattcaaagtgtgatccgcattcaatatcaccattctcttgcaattgcaaagttataggcatcctttggatttttgcagcacttattttataagaaaaggagtaaataaagccacatctctgggatatgctttgagatgtttaagattgggaacattttcaggctgtctcaatactggaaatttgttgtccttttttttcacacattttctccctcttatactactctttaccaaaaggtgggtaaagataaggagatgaaaaaaatgttgcttaagtttttggttgccagctctgttttaagcctgacatagaagggggttgaaatttattttcatcattcagttaagagctattcttggctttcacaaatctcagtcctaattctgttattgtttcagataatgtagaatttgtcacattggctaaaaaaacaactccactaaatcaggacattagttttacatttcactgtgctacattctaaaataaaatgaccatttgtgctggggatgattttagaaaagcgaataagtaatataaagttttcctggttttctcatgggcagcctagaaaaatgccacaccaagactcaagaaattacattctgaattttgcatgaagataagacttgaagaaatcttatttcaacttatactttcctcagtttatgtcctgtaggaggaccctgtagagggggaatgcagaagaccagagggaagaaaatagatggtgtcaattgttatcaacacacgatagtatcacatttttattgagatataatttatatataataaaatatgagagttaaagtattaagttcaataaattttgacaggtgtatatacttgtgaacaaaacttcattaagatacagatgaattctgtcattctagaaatttctttatgcaccttcccatcctttcagaaaattcctcatgcccctcactcctccttctcctctatcactcatagaggcaaccactgatttctgtcactatagtttagtgttagctgttctcgaacttcatataaatggaaacatacagtgggtactctgttgtgcctggatttatttatttatttatttattacacctttaagttgtgggatacatgtgcagaacgtgcaggtttgttacataggtatacacgtgccatggtggtttgctacacccatcaacctgtcaactacattaggtgtttctcctaatgttatccttcccctagactcccaccccacaaaaggccccggtgtgtgatgttccccgctctgtgtccatgtgttctcattgttcaactcccacttatgagtgagaatgtgcagtgtttggttttctgttcctgtgttagtttgctgagaatgatgcaatcccattactgggtatatacccaaaggattataaatcattctcctataaagacacatgcacatgtatgtctactgcagcactcttcacgatagcaaagacttggaaccaactcaaatgcccatcaatgatacactgaataaagaaactgtggcacatacacaccatggaatactgtgcagccataaaaaaggatgagttcatgtccttttcaaggacatggatgaagtgcctggattatttagcttggtgtaatggttttgagatttatctgggttgttacatgtactagtagtttatatcttccattgtgtgagtatgccacacaatggatatttgggttgtttccagtttgggaatattatgaaggtgccatgaacattcatgtacaattttttatgccaattggctttaatgtctcttgagtgagtacttagaaatgggacggctagagcataagctaggtgcatatttagatttatgagaagtggttagttttccaaattggttataccattcttcactacctgttacccactgaatgacatactctgtgttctagccaatgctttaatgtcatttacctttttaatatgttaaagggtgtgtagtagtaactcactgtggttttaaatggcatttctctgatgaataatgatgttggataacttttcttctgcttattggctacttacacatcttcctttgtaaaatatctatgtcttttcactcattttaaaagtgaatttgtcttcttatagatttcatacatgttccttacgtattgtggatatgattctaatatgggaattgtgaatattctctcccagaatgtagcttgccttttcaatttcttaaaggatgtcttttgaagagaataattttaaaatattgataaaccctattttatcagtgttttctgttatcattagttttagcatactgtctaagaactatttgcctatcaagtttatgatataatctctttttttttcttctaggatcttcagacttttagcttatacatttatggcttatataatccatctcaagtaaatcttcatgtatagtataaggtcaagattaatttccttttcatatacatatccacttattctagtacattcatcaaaaagatgtttctctccacatttaattgcactggtgccttttacaaaagccataagtcacttatataagtgtgagtttattgatggactccatattttgttgtctatttgtctactgtatgccagtaccatactcttagttaaattttaaagttagttagcatacgttctctaactttgtttttctcttttaagatgttttagcaatttgaaatcctttaaaactacatatgaattttaacatcagcttatcaatttcttaaaaagctggctcagagtttgattggtattgctttgagtctataggttaatttagggagaattaatatgtttacaacatttagttttgcaacccgtgagtctattatctctctcaatttatttagatcatcactaatttatctcaccaatgttttgtagtttcagtgaagatagcctaagtcttttattaaatgtattcacaagcgttttctagtctttgatattgtaaattgtatagaattttaaatttaactttcaacttgtttttaatggttagtagcagttacttcctcctctgatatcctgaacccctcaaagttacccatgcggattggaatcaactttgtccaaactcttgtaaatgttaatattttgatttaaagtgaaagttgtcctgaatggtaacgcctaggttttcttctagggtttttatggttttaggtctaaggtttaagtctttaatccatcttgaattaatttttgtataaggtgtaaggaagggatccagtttcagctttctacatatggctagccagttttcccagcaccatttgttaaatagggaatcctttccccattgcttgtttttctcaggtttgtcgaagatcagatagttgtagatatgctaccattcaggacataggcatgggcaaggacttcatgtctaaaacatcaaaagcaatggcaacaaaagccaaaattgacaaatgggatctaattaaactaaagagcttctgcacagcaaaagaaactatcatcagaatgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggatatgaacaggcacttctcaaaagaagacatttatgcagccaaaagacgcatgaaaaaatgctcatcatcactggccatcagagaaatgcaaatcaaaaccacaatgagataccatctcacaccagttagaatggcaatcattaaaaagtcaggaaagaacaggtgctggagaggatgtggagaaataggaacacttttacactgttggtgggactgtaaactagttcaaccattgtggaagtcactgtggcgattcctcagggatctagaactagaaataccatttgacccagccatcccattactgggtatatacccaaaggactgtaaatcatgctgctataaagacacatgcacacgtatgtttattgcggcactattcacaatagcaaagacttggaaccaacccaaatgtccaacagtgatagaccggattaagaaaatgtggcagatatacaccatggaatactatgcagccataaaaaatgatgagttcatgtcctttgtagggacatggatgaaattggaaatcattattctcagtaaactatcccaaggacaaaaaaccaaacacctcttgttctcactcatagatgggaattgaacaatgagaacacatggacacaggaaggggaacatcacactctggggactgttgtggggtgaggggagtggggagggatagcattaggagatatacctaatgctaaatgacgagttaatgggtgcagcacaccaacatggcacatgtatacatacgtaactaacctgcacattgtgcacatgtaccctaaaacttaaagtataataataaaaaataaataaataaaaataaaaataaagtgaaagttgtgtgactcttcctttcacttgaaaacttagaggttcctggagggttattaattgttttaatttcactattgttttgtctcagggaatagggaggccagaggagagggagtgagataaggaacagacagtttgtggagcagttagaacacacataacatttgttaagttgaccatcttgcgtgggagtgatttgtggtgccccaaagccattatggtagtaacatgaaagatcattgatcgcagattaccataacaaatataatgataaaaataatgtttgaaatattgttagaattgccaaaatgtgacacggagagatgaaggaagcacatgctgttggaaaaatgatgctgatagacttgctgaatgcagggttgccacaaagatttaataggtaaaaaatacagtatctttcaagtacaataaaatgaggtagcttctatgtccttgtatgtttcatgggactttctatgtgcaccattatgtcttctgtgaataaaggcagtttaacgtctttgacaatttttttgtatagcattgaaaaagtttattttgagttaaaaatgtgtccttgtaaatttcttttctttttttaaaaatttcttctaaaaaaacagggtacatgtgcagaacatgcaagttggttacataggtatacatgtgacatggtggtttgctgcacctattgaccagtcctctaagttcccttccctcaacaggccctgatgtgtgtcattcccctctctgtgtccatgtattctcattgttcaactcccacttacgtgtgagaacatgtggtgtctggttttctgttcctgttttagtttgctgaggatgatagcttccagcttcatccatgtacctgcagaagacattatctcattcctttttatggctgcaaagtattccatggtgtatgtgtgtcacatttcctttatccagtctgtcactgatgggcatatggactggttccatgtctttgctattgtaaatagtgctgcaataaacatatgtgtgcatgtgtctttatagtagaatgatttatatgcctatgtatatatacccagtaatgggattgctgagtcaaatggtatttctggttctagatcctagttatgccttaaacttttattttctgtctaattgctctagctagggcctctagttacaatgctggatagcagtgatgaggtcagataatatagtaattattaaaacttcccatataaagaattcttgatccagatagcttcattaattctctaaatatttaagaaaaaaagatactaatcttatgcaatttatttaagaaaataatggagaaaagaacacttcccagcttgttttatgaggctagcattacttgacatgaaaacctgacaaggacattattagaaaagaaatcatggaccaataatgttatgagcatagacataaaaattcgtaataaaacattagaaaattaaacccagtgatatgcataaagacaaatttaccagggaatgcaaggttagtttcatatttgaaaatcagtagtgcaagtcatcatatttaacagaataaaggagaaaaatcatataatcatctcaatagatgctgaaaagcgtttgaaaaaaaggtaactcctgttcatgattaaatctctcagcaaacttggaatagaagagatatttctcatttgataaaggaaatctataataaacctacagcaaacaacacatataatgatgaaacattaaaacatttctctgtggaatttgatcttacttgcttatactttcattaaatgcatatatgacattttgtaaaatctcagttgctattattgtattattatgacctacatttagttagatgaaaaacacttttctggtacccaacaatttgtcattgccgtttagataccatttaacagtttttctgttgcatctacaagctgggtccacaccagattgggagcacactccaaagcaggacttctctgtttagcttccccctttccatgtttaaaaactttcaactgtcagaaaaatacagggaaaaatgttgtatcatgaaaccaagtaatggttcttctattaactcaaatactaaagtatgactatttgattagggatgctagatgtgagaatggaaataaagggatacaagaggcatttaaaaatagatagttggccggacacagtggctcacgcctgtgatcccagcaccttgggaggccgaggcgggcagatcacgaggtcaggagatcgagaccatcctggctaacacggtgaaaccccgtctctactaaaaatacaaaaaattagcctggcatggtggcgggtggctgtagtcccagctacttgggaggctgaggcaggagaatggcgtgaacctgggaggcagagcttgcagtgagccaagatcgcgccaccacactccagcctgggtgacagagcaagagcttgcagtgagccaagatcgcgccaccacactccagcctgggtgacagagcaagactccatctcaaaaaaaaaaaaaaaaaagatagttctggaattctgagtgtacacagaagataaaggatggagataggatgaataaagaataggagattttgtacatgttattttcttttctgagattagtcttgcctcttgtctttgactagtcaattcctcctcatcttgtttttaatcaacttttttgagataatggtagattgacatgcagttgcaagaaataatacagagagatactctgtatcttttactcagtttgccccaacggtgatatcttgcaaaactataatacaatatcacaatcagaatattgacattgatacagtcatgataaatagcattttcatcactacaagaatccttcattttgtgcttttacagccatgatgacttccctcctgaccccattccctgcttagcccctggcaactactattcctataattatgtgatttcaagattgttatataaatgaaatgatgtagtataatatgtattgaaggtagatagagtgattcctcccacttcataattaattttttcaaatatatttagcaattctaatttttctcctcatatgaattttagaataatctatatatacaaaatattttgctgagatattttataggaattttgttaaacttgtaatgtcaattatgggagaatttacatgttttttatgtagtatcttcgaatccatgaacacaatatgtatcctcatttacttacatcttctttgatttttttttattatactttaagttttagggtacatgtgcacattgtgcaggttagttacatatgtatacatgtgccatgctggtgcactgcacccactaactcgtcatctagcattaggtatatctcccaatgctatccctcccccctccccccaccccacaagggtccccagagtgtgatattccccttcctgtgtccatgtgatctcattgttcaattcccacctatgagtgagaatatgcggtgtttgatcttctttgatttatttcatcagtgttttatagttttcagtatacaagttagaactattgttatatttattatacctaaatatttttattttttgagtgattataagtgttactgttttcaattttggtgttcacatatatattgctagtatatagaaacacaatttattttgtatgtttatcttgtatcttgcaaccttactgaactcacttattagttctatgcactttttttatagattctttgggcttttctaaacagaaaaacctgtcatctggaagtagggactgttttctttctttctttgcagtcagtctaccatttatttcgttttcttgtcttcttggactggctagaacttccagtactatattgaataaaagcagtgagagcagaaatgcttgccttgtttctgagaatagtgaggaagcattcagtcttttatcatcatgtgtaatgttagctgtaggttttttgtagatactcttcatcaaactgaagttctcctctatgcctgtgtttctgagagtttttatcaggggtaagtattgaattttggcaaatactttttctatatcctgtgtagttttccaaacttggaaactcttctgcactctagctgccttcacatgggcaagtgttttcatatcattctgtgttcctctgtatgctttgccagaaaggagttcaccttaaattttaagacaatgttgtggatagagaaaagaaaaactttctgtgtcatggaaaagaggtcagaatttgggccaagattttactcctggctcttttatcaggccaggattttactcctggctccttctatcctttgcatagtgagatcatattctctttgagtctgtttcttcatttacaaatagaagaaaaatagctgcagtgatgatcaggtgacttgatagaggaaatgcttagtcaatgtaattggtttatagatagtaattaatgtgagagttttccccagatttttatagtcttcctttatcatttattgctttaccacaataagtcatttgtcaaggaggaacacgtatatttccctagagaacacaccgatatgagaacatacgaagcctacactcctcattcaggaacaggcaagagacaagtgtacatctagttccaccaagaaaacacacacacacattaacataccagtaatagtaagaaagcttttatggagattctgaaacatctattagaccttgaaagataacttagtatttacatgggaggagacacacttcaacctaccacgttaaaaaagatcccctgagttgtatcctgagctgtcgtagataagtgtcttcacccctctgttactagcctgtgttcagtctagtaaaaagcctgcaatgagaaaggaacaatgacttctttggaaagagaaaagtgtatatgttttggggtgggattaagagaaacagagaaaccaaatgttcctatgggaagctggaacttactcagcattcacttgagaggaaggacaacaagcccctgtgcaaacccctaggaaatgtcagtagagtcaatttctgaaaaatagataaacagcttggtaaagtaagctaaagaataatagtgatacatcccagattttccaggatatttctgattgaaattgtccaattcatttttggtgatgttttaatttttgatttgggaaacacgaacactatacttctatgtttagctttagtgatttttctgccacaagcaatactctagactttagttgagtttttccctcttaattaaataattcttatttgaatatatttatgtttattttaaaaaaggctactgagtacgagattaccacttgttacgatcttgctccttggagcagaacgtgacatctcatatgtatatatacttagctctcttgggcaaaagcttctccctttgttccacatggtcatctgaacattccgtgaagcatttctatcctcccaggatgttttatttcttgttttcatgggtgaagagagactgttttataaaagttttcaaatacttactggatttgtatcctaaagggagaaagcagcaggtcattttttttttctttcaagggcttgctgtaagttggtcttcctcttaacacgaagaaaagaatgacattcttcatgaccgccattgtgagtaggctgtattacattaaagccccattattagcaggctgtgccttggctgattttatagagagctcaggaacagaagtgtagaacaaaaacactgatatttttcactggcacaaactgcagatactttacttgttgattaatttgttaaaatgtgtggcagaacatttagttatcaggtagtcattctgagtaaactagagtcctatgctcctttaacaatggaaaaattatattttcctttttctaatatcccagtgttgtatgtatgctcatttatgttcttggtttaacaggaacattgaacattccctcactttgaatctactctaactcctgtgtttgtgtattttcaccacagtaagccataatatataaaatagtacaattaagaaaaccttagccagcacggtggctcttgcctataatcccagtactttgggaggctgaggcaggtggatcacttgaggtcaggagttccagaccagctttcccaacatgcggaaaccccgtctctactaaaaatacaaaaatgagctgggcgtggtggcagttacctgtaatcccagctactcaggaggctaaggctggagaattgattgaacctggaggcggaggttgcagtgagccgagattgtgccattgtgccattacactccagcctgggtgacaagagcaaaactctttctcaaaaaaaaaaaaaaaaaaacttaagtaatcttcataagtaaatgatatatacttaaatacaaattatcacatttataaaagaaattttctgtatttgtccaacatcggtcaaattccttaatcttataacaattgacacaagaacaagaactgccacccagtccacatttatcttctctatcatatttaagatattgcagggctggagtatcttcttaggatatactttcatcacaacagataacctattacatcagagattcaaagaagtagaatgggagagagaaggagttatattttttttaccctaaatgatgtcatcaagtcactatgctaatggagattgctgcacttgagattatgtgccttacaaaataatttaataatgactttagacagctgatatttcccatatagaaaataagaattcagcttatttatattctggaaagaaccatatctgctgcttagagtgaagcagacctgcagtttacacaacagttgagaataatcttgtttaccaagctctttggataaatagaaaaatatccaccttatcttgagttgctgtggtaatcagctgaattagtttactacttaagctctctggaagatgattggtgcatcatctgtgaagatgactggaatgttagcccactgaagttataacttgtggaacactgttcaaattaccgaaaagagtaaatcaactatctgctggtactcagttctcagggagcagtttacaccttgaaaaatcagatccaacacatactaaccatagtttctcatgttatgatttctggtggaattcctttagactcagccttattcttcaagatactgaatttttgggaaccctaagtacagtttctccttcttacatagagacttgatgttcctaactggtcgcaaacttgggttcatcagaagaatctgctccccttgtgagcacaaataatatctcagtgaagagaaagacactgtcatagaagagtcaacatttatggaatttcctggaatccacagttatcttaaactctgttccactttctctggacaccagctaccttcaatagtgccaggttcagtgtctaaccatggagtatctcatagttggactgggtgagtgcagatgcagttgcatgagattttgaaacatcacattataaaaaaaaattttcaggtatgcaaaaggcaggagagaacatgtactccttaccctgctttaaaaatttctcaacattttgccaattttgtgtcatctattccccccaatcataacattttttgctgaaatattgtaaagcaaatccaaaacattatttcattttacctataaatacttcaataatttacatgggtttttaatggcttgctatttattttcagggtttcttttagtatctttgacctctgtcacagctcatcttgcaaggttgcctatctcattgtcagagagctctagctaaagctcattcatcgttttgtgaactatgaggccacatattctgtgttgacccaagttgggccagaaagacagttttcaagagggcatggcttctaggtctctgccgcagcttgtccactttctttcattgtcagctactagaactatggcagcccatgctgggatataatttttcattgggcacagaaaaagagggtggcgttaggcagaatcaaaagtaggagctaagaaaatgaaaaagacaaggcagaaaatatgccaaaggtgcatatttaagggataaggggaggaatctgtgatgttgaggatgagtccccttgaagtaggggtgcacacaagagtctcccaacttgtgaattactaaggacaccaatggtgaactaatttataatagttgtctcctgtgactgagaaggctgagagtggggattatcagtaagaaaatagctcagaggcaaccaagttgtatggatctttagaaagggaagcaaggaaatagacaaaggacaacttcactgaaaacatttatgaagtattcagtaatgttttaacttctttttaatgagaaacagcaaaccctaaggggaaacactctggggtgtttatgtccagggtcagcaaggctccagggttatgtcttattcagacatattcaggagtaccggggagagagaatactccaggaaataggtgttggcatctgtggaaaggagagaaagtcagactgtatcctagagtcttagggataaatatagagtggaaaacatgaaatcatcttgtgaacacagggcagctattgaggcttggcaggtaggttggggttattgtgaaaaagttcccagcaatccaaagagatgttttatctttgacattgtgccgcctgtgccttgagttagaaaggtacacacacgtgtgagttaagaaaaacttctgatactaaattatttatagttaaacctctagtaaaaccctgaattcaaaaatatttgtagcagaatacaaatattctttttgttttgtcatttatcctggtaaaagtcaagttgctgcagcgtgatggttctggtactgaaatggtcttaggaaagtggaggaggagtggagttacatgtttttaaaaacttgttttgtggctgcatagtattccatggtgtaggatgaagctggaaaccatcattctcagcaaactatcgcaaggacaaaaaaccaaacaccgcatgttctcactcataggtgggaattgaacaatgagaacacttggacacaggaaggggaacatcacacaccggggcctgttgtggggtgggggtaggggggagggatagcattaggagatatacctaatgtaaatgacgagttaatgggtgcagcacaccaacatggtgcatgtatacatatgtaacaaacctacacgttgtgcacatgtaccctagaacttaaagtataataaacatatatatatatatatatatatatatacatatataaacttgttttgtgaattttgaaatagttttacacatacataggcattgcgataatgctacggacagttcccacagtccctgttacctagtgtccatcatggaaagcatataacgtaatcatagcacaattatcaaaaccaggaaatcaacattggtaaatgctattaactaaaccatagatcttttccagatttcagtagttcttacatgcaatcattttcctttatagcatatggttcactgaaactttatcacatgtatagatttgtgtaaccaccactacaatcagaatggagatctcttcaatcatcccaaaggaactctttggtgcagtccctttgtaatcttgtcctttccccaacctaatgcctggcagccactaatctccatcattaaaaatttgtcatttcaagaatgttatatgaatagaataataactatgcaaccttttgagattgactttttttcccattcagcgtaacacctgagatttatctaagttgtgtgtttcagttgctgagtaagattctattttatggatgtaacacagattgtgtatccattcatgtgtgttgaagggcatttgggtttttttcccccaatttggggctattactgaaattatattttactgttttttcctaaatatatgaatctgaaagtgtatctgtatcatttaagacttaactccatgtggaattaatttctagaagcgtgaagaacaggttaccagttctcccaggattgctatgatgactaatttttagctgaataaaatatgaatatatctattcatttttatatgtgtcaagaatgtgctgagagttataggaaaacagaaaggtaataattgttaccaaatcatgaggagtgcccaagttctaaaaaacccacaaagtcaaagaatggtgcatggctatagtttcagaattattttctcagagagtgccagagccaatcttcttggtacctgagggtaaacacccaacctcttgttcctcacttagactttcttctatacttggcttttctccatgaagggtactgtttcagcacattggacagaaaaatacaagcacagtgcaaaaataggtgtgaatgttgtactgattcaggtaccagtatgtgttttgaaagttaactctgcttttctagtgatacttactttggataaaacctaggtcaagcctgttcaaaactgttacccgaaggcaattattcaacattataagcacatggtttccagatcattcatcattttatttaacttcttgagtacataaagtttttatcccatttgtgagtcttgatgcacacaattgactaactgtgtttgggttattttctcttccacattgggaaaaactatctttcatgatctatctcccttttcaaagctgttaaacttttgtcttctttaaatgattttctgtgatgatccagtgtttcttgtcacgtttctgtacctatatgtgctactgttgtgtatttgtttgttcatcctgcctctcccacggaaagacctgtcttctgttcttcgtcaccaagactctctacacagtaagggctccatctgttttgactgttgacctactgaagggacatgcctttgcggacagattcaacacaaggttgaggattaaacccaggcttattttccttcggattttctcaacaatccttccatctcctagtagtatctattctcttctagcaactttttttttaaataataaaattgccttggtcttctaggaccctctgggaaggtaggtgtcaggatggaaagtaggttggtctgatcaagggagtcctgtcatgggaggtgagaagacctgggatctggtactggatttgcttctcactcctaacatgatcatgaaaatattttctgcttccttccttattagcaaaatcaggtagatataaaaggctctgaagcagactgggttgttgtaatggcaaagggggaacctaaaaaattctggactgagatgtgggagtcacaccattgtccactgcagacataccaaacaagccaccttaatttagagcacaggcttgtgagtctagtgatgctgttcaatcatacattttaatctctataaaatgtaatctcctatgcacaaaggtagtaccaatagcacttgagtgcctcgaagagagttttgcccaaaaagcagcagacttactgtatgatatgtccatctgtgaaggtcctggctcagactgagctgacagtatggaagtctactctaatgcagaaaggttggaaacctgtaattattgttaaaagtttagggttgtggaacctatttttatagcaagacaaacttgctctggtattggcccatggatgggtaaaagaaagtaaatgctttcaccttttaaaaaggggaaagtgtggcactgtcagcatggctcagtgctcactgtcatcctgctgctacatcatgtgcttgatgcactgtcatttgggtgataacatcacatttaagtcatgatcatttattcccagtgtcagagtgaaggagtcctgttcatttgagtttcagtattcctcaaactggatttcaaaaagaatttcttccaaaagaattcatcaaggactaccgtaatttcataccaggaagaaaactgtcaaaatatgtcatgagtccaactaaaaacctagctcaaaccatcatagtctctcatccaaactactaaattgacttcctaactaggttcctgcattgactcttgctcctccatagtcggtgctccacacaacagccagagggatcttttaaaattaaaattctgttgaaaatataatacccatcacaaagcctttggcagttttctcttagaagtgcatgcttttacttagcttcaagcaatagtatcttctacctgtaggtcttctctctccatatataagtccttcctatcttttcaaatccagattttacattcgaatatccttcaggagatgtttaatgatccccccagctgataaaagttaccttctctgagttttttatgacacagtatttgtatattttatgccatgtatcagttttctaccttgtatcatagtaatttacgtaccttcatcctttctctactttgaatttattgaggacagattctgtgttttacaaatctgcattgggtactcaataaatatttgtgaaataactaaataaatgagctgtgttaaaattaaaaaaaaaaagaaaaagaagtgcatgcaataaaaatggcttgctatggctcacaggaaccaagtgtgatctggcctgagtcagtcttttcaacttcccctcctgccactctcccctttgctggctttcctccaagtacactggggtttttacttttctttggatcttcctcagggcctttgcacttgtggttgcctctactgggcacttcatattcccccagatttttgcctgactcccctacttcatttatgatcaacatgtaatcactccctcattctttccttattctctatcccttaccatgctttatttttcttcatgacccttatatatcttagatcataatatatatttatttgttggcttatttcctgccttcctgtctagagtgtaaccttcttgagagcagtgacattgtctttttcatactgcatcccatgcctgtagtgtctggcacagaacaggtttttgattaatagtctttgaatgggtgaaagagaatagaggtatctggcatagtcgggggtcaagtcagcctgaggtcaaatccaaatcttgtagattcgggatattaatcatttgttagatacatagtttgcaaatattttctccaattctgtaggttgtctcctcactctattgattatttctgttgctttgcagaagctttttatttaaattaagtcccagttgtctgcaaggaacttagacaagaacaacaacaaaaaacaatcccattaaaagggggctttaaagtacacgaacagacatttctcaaaagaagatatgcaagttgtcaacaaacatgaaaaaatgcacaccatcagtaatcagagacatgcaaattaaaaccacaatgcaataccattttataccagtcagaatagttattattaaaaagtcacacacacaaaaaaacccaacagatgttgatgaggatgcagaaaaaacagaaccattatacattgttggtgggaaggtaaattagtacaacccctatggaaaacagtgtggagatttctcaaagagccaaaaatagaactactattcaatccagtaatcccaccaccagatatctacacaaaagaaaacaaatcattttattaaaaaagagatacctgtactcatatatttatcacagtactattcacaatagcaaagtcatggcatcagcacctaagtgtccatcatggaggactggataaggaaagtgtggcatatataccacagaatacaactcaaccgcaaaacagaatgaaatcatgtcttttgcatcaacaggtatgaacctggaggccattatcctaagtgaaagaactcagaaacagaaagtcaagtatcacgttctcacttatgagtgagagataaacaatgggtgtacatagacaagatggaaataatgcactctgaggaccccaaaagcacagaggatgggaggggtttgaggtttgaaaaattacatagtatgtacagtgttcgctattcaggcaatggtcacactaaaagcccagactcaccactacacagtatatcaatggaacaaaactgtacttgtacctcttaaatatattttaaaaatccatactttggccgggtgcggtggctcacgcctgtaatcccagcacggaggccaaggcaggcggatcatgatgtcaggagatcgacaccatcctggctaacatggtgaaaccccgtctctactaaaaatacaaaaaattagctgggcatgatggtgggtgcctgtagtcccagctactcgggaggctgaggcaggagaatggtgtgaacccaggaggtggagcttgcagtgagccgagatcatgccaccacactccagcctgggcgacagagcaagactccgtctcaaaaaaaaaaaaaaaaaaaaaaaaaaaattcatactttactagtgggcgattattggaatatgaagcatttcagtttaactttgtaagctttagtctttgtgttttaaaatgtgtctgatgctgtcttcttcatagtttgttaggagcactaaatgaatagtagaaagcctgccagaaagtgatttagtctgaatctataaagctgtttctgagcactgactgtaaagtgcactagaagctcaaatttttaggttttgtcattttgtgacaggttgatgtggaactcgaggggttggccaaagccctcagagggttgtaggccatgaaagttcgagaaccactgggccatgtccatgcaaaatgaaaaatagttaaattgaaaaacagatgtccttgtgcctcctaattcccagcaggggctcttgtctgaagcctgagatggctccttgggtttctgtgaatgttgtcaagggcgccaaggatgccggacttgcatttagatgcccaagcctctgtgctggaaatgatgggaaaaaataggaactcttgaacttgagcaagtattagaatatgtgaggtaatggagaagcctcctccctcatgcccatgctcttgtcaggcctgtttgttaaggtccaggccccacttcccactttttttatattattattatactttaagttttagggtacatgtgcacaacgagcaggtttgttacatatgtatacatgtgccatgttggtgtgctgcacccgttaacttgtcatttagcattaggtatatctcctaatgctattcctccccctccccctaccccacaacagtccctggtgtgtgatgttccccttcctgtgtccatgtgctctcattgttcaattcccacctatgagtgggaacatgcggtgtttggttttttgtccttgcgatagtttgctgagaatgatggtttccagcttcatccatgtccctacaaaggacatgaactcatcattttttatggctgcatagtaacagcaggttctggagaggatgtggagaaataggaacacttttacactgttggtggggctgtaaactagttcaaccattgtggaagtcggtgtggcaattcctcagggatctagaactagaaatacacgtatgtttattgtggcactattcacaatagcgaagacttggaacccacttcccacttttgtttcctttaattgcccttatgagaccacatccaaaatcccaagtcctgccaagtgaatgcagtacttaaagatttgactactggatgtctggtcttggagaaaacagtcaagagctggagcaagacagagagcagcatacctgtaatacagcttattaaaataatgcaaacacttctgtaatatgtatgaggtgccaggtagtctgccaagaacttttcatctattaatttgtttagtctttacaactgttcactccacttcctgttagggagatagctgttgttggacccaatgtagagatgaggaaacactgaggaccagagagtaggcatccaaggtcacagagttgggcatgcgtggggcagagccccaggctcaggcattctggatcccaggcccatgtgcctgcatggtagagggggagctggcactagcccttgtgcccccaaatatcctggctgcattgttcccctgttcttagttcatttgtgttactataaaggaatacctgaagctgggtaatttataaagaaaagaggtttatttggcttggaggtctgcaggctatacaagaagcgtggcgccacatcatctgcttctgatgagggccttaggaagcttccacccatggcagaaggaaaaaggaacagatattacatggtgaaacaggaaggaagacagagcgggggagatgccaggctctttttaacagccaggttggcagggggtgtgtggggagactcttgtgggaactaatagagtgaaaactcagtcattaccttgaggatagcaccaagccattcatgagggatccacccctatgacccagatacattccaccaggccccacctctaacattggagattaaatttcaacataaggtatggaggggacaaatatccaaactctattatccccataaatggttaaactccgggagagacaactatgcacctctcaatcccaaggtgagttgggattcacgattggttaaaacttcatcagaaccatccacattggaaatcacatctaaaacttgagtaattttatggtttacaaagcatattgacttccttgatttattcatgttgccagctgccctccgaggcagaggatcttttcacttttctcctattactcaatgccactactgagcctctgcactgaccctacggcttcctgtcgtactctctgcaatgctacatgtcccttctagtctagggcgatcctggtggaagcatgaagccagccagcctctctctggtcaccaccatcacttcattccttatatataccaggcatgggaatgtttcttttgcttgttaatttttgttcttgctcttatctgcatttatcttccttcccccaagtgtactgccagaccctggagaacagggaggggaattgtttttcctttattattctttcctcagttcctgctgtagaactgtacatctagtcaatgcttaataaatgctggtaagttgaattatcaacactgaacgtagaaatgcactgttgcctggcttgttagttttgtaagaatagggataataatagtagcaactaatgtgtacagatttgactatgtgacattatttaagggctttgcacacattaatccatttaatcctctccatgacctaaagcactgctatgctgaagtgcattttgcctatggagaaatgactggtttttgggaagccaatgtgcagaaggccttgtttcactacccctaaaacagtgcatgtgcaggaggactgttattgctgtgctttggaaggtctgtggatgaggaaatgtagaattgcagatttatgggttggaagttgatttagaagacacatgtaacagaagtaacaatcttatcagacttaccagtgtcttccacttatttccttaacttcagatgctcaggaacgacagcacctgcagaatgcatccactgctgaaaaatgagagctgtttcttgttggtactcttcagggacattttagcatagtggtggactccagtgttgacttttcttttcatcatctgtttgatcttggtggattcttaagaatctctggacctgagtttgttcatctgttgattggggttcatggtagccacttctcaaggttatgattgaggtgaaatgagatgctatgtgtgcaaaggacctggtagcaagaatgacatgggaaggagggcttgctcaataaacattgcctgttatagtgtgctggcattaccttaaaatccttaataagctgtaagttttggatgagagtcagaagtgttgggttggtgaagcattttgctacagattgcaggcttttctccggtgtcacaaggcattgaaaacgcttgttcggagacagcccagaagggaaaaaaaaaaaaattctggaaagcctggcattttgtgctatgttgtgagtaagacatttatagttattgagccaaaatttccactgtaatagaaaaagcagttgcttttaaacttctggtccaatttagtaattatgggtgagttaaaatgtaggccatttgaattggatttggaggatcaagtaagattctgtcctacagtggggatgactcatagaggaggtagcttgacatagtggaaatagaagctgataaggagccaggagacccaagttcctgtcctggatttgcacaaataaactgtaatagcctttaggcaaattattaaacatctcagttttctattatataaaatgagagggctgtgtttgtgaatggatctttcaacatgcttaaggttataccaaacagatcactgaaaatgaaatatgttatctacagtcattagggaataaagtattcttgctagtgcaatatacttatttggagaggattacaacataaacaagaaccaacgagaatacatcagtgccagaatgatacagacataagcagacacctgaggctctctgatacccgcaggtcattgctatgtcctaggaaaacatagccatgctagttataagagttttctgatgatgagtctttataaacagaggatttactgggaactagagatggaatttttaaatgatttccatgttatggatgacctgtacttgggcttatgatagctctgccacatcttgagaaataatttattgactaaactcgagttggcaaatgtaaaaactcatttgggttagctagcttgtttacttgttcttggcattctttcttcttcttatttcagttgtaggcatgaagccacattttgggctgatcatctttataataggcttatggttttataacatcagattttgaatgatagcattttctgctctctgtgtttcctatcacctgtagaattaagataggtcaaatatggaacagatggattgaatgattccctagaattattcactgacattataagggtgcctcctgtggcacaaatagaaatatttctgagagttgtaaaaattaaatttttaaaaatcgaatccaatttttctattgacctgcgttagaatttctgagacattctatcttcatttctgattgattttcaattagcaaaggttcctgccattttaactttaaatttcttagttcccctttttcctccaagtggttaatgatctgtgaacaaatattggagcaaatcagagatgcttcagtgtacagtcaccctatagatatttctggtgtgcaagggagtgagctacctgggagatgaggaaccttggttctagtgttttctctgccaccacagaggtatgcatctttgaataaggtctttttgcctgtttcaggcaccattctctcatttgtaaattatgagctccattgatcctatctggcttcaatattctaccgacaattgagtgggaaaaggaaactttctctgaatcataatctctcaacttttcttttcataaattttcttaaagtggattatacctatctgtaagtggataacagcctccatttattatccttatttttatttggctttttttttgacttgcaaattcctttttggatggattagattgaaaatctttgggaggctcaatcagcccagacagatttattcattctttattctggatgaagaagaggaaatagtttaagatagatctgacatggaacattaatttgattgaagcctttctgtgtgaggagtaattgtagcatcttcattgtcataatggagagattagcatggattagattagcttgtgtacaaaggttgtacaaattgattgctgtgatttgtaggctgggctgatctttatagtcactggcatgacttcttaagcattatagtcatgatttctttcatgtggtttacatgtggcaacaagaaaagcacatttccctcgttaccaaaaccttgtgtctcccaatgggaacttgacatagactcaaaaacataagacgtgtacatataatattaaggagatggcactggtcatctggcctgctgtctgggatgacagcacacattggccaaagacagaagagttcccaaaacagatgttcagagaagatggctagaatactgttgaaatgtggtctagaataattatgaacataagcctaaaaaggtagccaagatatggctctgaattatagccagtcatgggattattatttaactccagtttagtatgtttcctgccaagtatgtgccagaccctctgaaacagaatctggtttttgccagcagtgcttagcaactctatattttaagtctaaattccaaaaaaaaaaggaagagtaaagaatactaaactgctttctgatgggagtaagttgtatttcaagtggcctcagaaatctttttctctagaggagactttctgtggctaagaggaagagagtgggcacttctcccctccactgaacccacctggacttggtctctctcccaaggctttcactgcaattgaaaggctttttcactgccctaggtctctctcctaaggctttcactgcaattggtacatgtgttcagtgactattagaacttaaatgatcactctcatcccacctcactgatctcattttccaaatttctccctcttgctctcccattctagggaatctggccttcttcttggtcttcagatgcactgaacatcttcctgcttgaggatgtttgctgccttaccttactctgctggaaagcaattccttccaatggtgcaggtctcacttccttacttccttcagattttcgctcagataccatgttattcatgaggcttccctggccaccccatttaaaagcagcaccccaccagcattgcctatcacccccaccctgctctgtattacctgataacactaatgaccgtctggcagattatatctttatttgcatatttattatctgtattctgtctttagaatgaagacagaggctttattccagtgactgaaacaatgcctgacatgtaatggaactcaataaataattgttgaaataatgaatgaataaatgattagcctttaatttgtattcattcgtacacattacattggggttttctagaagacagtatgaaaatttcacttaatttgtgactcaagtacagaaagaacgatagagatcagaggttcttaaacaactatccatgaacccaacgctgtgctttacaaaatttaacgtgcatgtgaatcgacagaggatctcgttaaaatgtgaactgtgatttagtagtctaaattggggtctcgggttctgtgtgtccgacaggctcacatacgatgcggatgttgctggttctaagattgcactttgaggagaaagactctaaagtacctgtggaagggattcaaggggttcacaaagccagggttatgaatgtccagtatcattgttatagcaaagaactgaagtgctagtttctagaaatttctggtttatgcaataccaatgaacagatcatttattggacattcattgcagagctttcaactgttaactatgcatggttgttctgtatgcagacataaatataggtataggagaatttctttttctgaggaaataatagaaaatattcatcagtttgtcaaaaggatcagtccaaacaatggtgacagccattgttaatggatgatggcattaaacaaaagaaactttaggtatcaaaccaaaacacatcataaccacatcgtaaaagtagtgacaaaaccaacacatatgtttgcaaataccttgggaagattgtgttttatagcaatagtttttttgctaaacaaacaactaacttttaaagttaacatttgctggagatgatattttcccagggaagtatttaaatgcttggaacacacctatccaaagacaaatatttgttttcccccagccactggaaagagaccccaactggaaacattgtctagaaatgaatatttggaaactctgaggccctctataaatgccattgcagtagctcactgtccttctaagctgaggccaaaatgccctcaaaggggccttggtgtagaaaagctgttttcaggcaaaaaaaaaaaaaaacaaaaaacacaacagcccatcaagagctgcatagcttttcagtcaggaaacttacccccaggtggatgtttctcagccaaggagtgtgggcaatttagtttcaaaagtaatttggaacaactgagatgttttatattaaatggtcctactaaatagacatctagcacagggcttagccaaattctagaaggcctcgcatggtatggtatcacgatcctcataattgctaaaaatattactcataatcataatggctaacaattattgagtctaaatatatgctaggcaaggtgctactaaccttccatacattttcttatacaatatttataaaactaattcggatggtactataagtttttttgttttgcagaaaaggaaactaatgcatggatatgtgatttatattgctcaaggtgacaaaattgttgagttgtagaattgggactcaaattcagatatgctgattccggggctcatcctgctaatgactgtgctgtactcataatcataacaaattgatttttggtgaccttgaaaccctgcttaggaaactaaattttaagattttggttgaatttaccctcagggtggagaaaacacaggttttcataaacttactgtcatcaaattaactatcctatattatttttcagaataaacactcactacttgttaaggaaatcatggtgaaacttattcatatgagctaagagcttctgcattcccatttcatggaaacgtggattttccacgtgtggctctgtagcatggcaaaatagcttggtgtgcaaaaataccctagggtaaagataaatgtaattgtttttgaaatcaaccacttgtccctaatgctcaatctgtgcttctgagaatttgccgagtttcaatgctttaatgtgtgtattgaacagggctttctgttgcaaatagcagaatttgcacacgctagttgaatcagaaaacaataacgtaacaacagatactaataaacacgtagaatctcggagagtgccaaagagcagggttctggggctacacagccacaccttaggacttctctctaatcatatgacttctcagcacctgtgatgccaggacttggcctcccaaagctgaggaaccaaatgcctcaccaactgctcctgccagaaaactggttctccctggtttggtgcccatactctttgaattttctggctttaaaaattggactcatggtgtgagaaaattccaaaatgtaggaagatcttcaaagatgttgagcagtcaccacgaggaagcttccaatgttgtgtatttcagatcagtgttgtggagtatctttccctttatcacacttttccttcatttttactccctttgattgctaaatctttacagagagcagggactctgttcattcagtccccagaatggcaatgtgttaagtccacaagaaggcttttcgtggacttttggagtctgatcataaaggagaaatatgtcttaaaaaggcagtggaggtgatgtggtgaattttgtgcttagcatttttaacttgagaaaaatgataagacaggccagtcaacacacaatgggcaaatggagataggtgactgtaattcagaagtgcacacaggactccaggtttgagtatgggagttgtccttcaaggattggcagttgaagcattcaccagagcatggatgtgttttctgagcaagagctgtcaataattaggatagaaaactgaacgtggaaccctgaagacctctcaccctgtgccaaagtccaggtgcagaaaagaaaggtgagcttgtgataaagagcaggcagagttcagaagacagccatattattttggtgtcataggggttaaaggaggcaattcatgagaattgattgcttttttctcactctttattgagatatagcttctcaaatgtaaagcatgatttgaaagagatcagtaacaacagttatgcattacatttgaggtgtgttttgtacttttcaaatttgttttcaaatccccatcacttcatttaacttcattcagacacttaaattgaaaattactttctatgtgtggttaaaaaaatcttgcattatttttgtttttttctttaatctaacttaaacatggaagaaaattcagttgtgtgtagttaatcacaggtttgaagaaattaccttaattctattttgagaaagaaagagtatcatgtggtatacagagtgaaggcttggatacctccgttgcacaagtttcctgcttagctgggacctggtcaggccacttcacctcccatttaaaacatcctttagaactaggtatggagctaatgttttagatatgaaaaataattattcacagcgtgttactataaaacatatgttcatagattcttacatttgtatacaaaacaagaaatcacaaagctttattcatgcagaaaaaattaatttgaaaaagcccactgtatgccaagaaatattcttgatgcttggaggtttggggttgaggtagcaatggggagataaaatgaatatggcttgcttcttgctttctgcaaagaattgagtttcgattctgacttaagagacataaacaaggaaaagtacattctccatgctgcatatgtgtggcttaggccctggcttgatgaagggagatttggtattttgttaatgtaggaaaaactaaaccaaagtgtcttttctattctctcatttaacagtagtcaacacagaagacttctgtgacctctagtcaccaagaagtgtgtggggatttctcactaccaacaaataaaccatcagttctgcagctgacactagctgggtgtcctctaattcaatgctactctgacactgtctacctggagatacagtcagatccctcagcttgagagctcagtccctaagactgtttcctcccctcactgcagatgccagtcacaagctccagtttgttgcgtctgtgcttccagccagctggctataaattggggttccctcaacttcccccttgggtttgattaagttggtagagtgattcacataactcaggaaaacacttacttacatttaccatttaccagtttattatacagaatattgtaaagaatacagatgaagaaatgtgtaaggtaaggcatgggtggtgggggacagagcttctatgcccttcctgggtgggccgtcctccaggaaactctgtatattctgttacccagaagctctctgaacccaatccttttgggtttttacagaggcttcattatataggtgtgattgattaaaccatcggaccctggtaatcaacttaactttcagcctctctccatccccagaggttgtggggtgaggttgaaagttccaaacctctaatcatgatttggtctatccagtgaccagcccccatcctgaagctacccaagactggcagccagcagtcaactcattggcatacaaaatacatagtttggaggctccactgattttcagtgtggtaccccaggaaagtggatgaagaccaaacatgtatttcatgaagccttctatttcagtagtaagaaaaatactaaattataatacgaatttttttataccagcaaagcagttgcatttgcatctttaaaatgcaagtgcaacttctttttagagatctattgcattttaaagatgcatttcatcacttattacagccaaatgacttgcccaggcattagattttctgttgcagtgatagcagggatttaaataatgattatcttctctttgacctggtgaatttcttattaccctgcatatagacatggttggattgtactgactttgcaaataccacacaactgaagttggatttctgttgtccttcaatcaaccatctacctaagcctcaaaccgttttgttttgcttaaaaacagaatgagtttggcaaacctagaaaagtacacaaaggatcatccatggatataggatggaagatgtatgaatatggaccaacaacagtgtttattttaataattctaatattgttataagttgtcataagcttattttcgtaattagagaatagtcttcaatttacactgaatgcatgtttggcaaatatactaatgttatatatgtacttctcttgttcagggcagtcacttgttttaagtaacatgtttatctttattaaaatatgaatttcatgcggttttacagcaaggttattggttaaatcaatattctcaattaatgaaactagtgacatcatcatcaagagcaatagctagcatttgttgaatcctgactatgtgtcaggcattattttaatcacttcatatattttaactcatttaatcttcacaatggctctactatatagaaacatgtattaacccaattttgccagagggttgagacacagagattttagggaacttaggcaaagttacatagctagaaattacagtcagtgattgcaaagcttgtgctcttaacttctattttatcttgtatctgtaaagatatttactaaccaagttaagtgtccttagagcatatttttatagtataaaaattgggaaaaaattaagataaagaaaaaaacccataatcctactgctgaatgagagctctgttaacattttgaggtacacatatttaggctttttccctcctttacatacattcacataatttgtattataaatgctcttttaaattaattttattcaattaatatattttaaaactttccccatggtattatttcattattattttaaatggctacattaagatatggatatttaggcttgaaataagtttaaacaaacctattgtcttcttaaatctccagtcatatttccatgaaggatggcagctcttagaagtcatggaagcaaagaacagtacccctcaggaccattgtaagaaaatgtcttctttgagagttcttaagactattagcacatctgaggacattttcctaaggattcatcttggtgtaaggacacactggggatattttaatttgtagtgatttgttgttgttgagcaataaacagtatatacctcttgaatttgctaaggaatgtgtgagcatacagtgctggtaacactacattagttaactctctttacctttcaaaactgatttaatgaaggtattttaatgccgtttcatagataagaaaatgaagtgcaaagtagttaacttgactaacaacaagtaagtgaaggagacataatttaagctttagcacagacaatctgtctcttatagtgaggcagtataacaataaatatgtggaggagatttctaaaatttccagtgtatgttaagaaaacaatgtattttatgatgttttagagaactgcccattataaccaactgataatgaaattcttcatctttccatgctatcatatttttcccttgtcagcacactgacctaggaatcaagaaattttggttctaatactcgcatttccacctttctgggtctcaagtttttatctttaacataaaaggttagaaaacttgaaaatcttaaagtctcttcttggttcagagagattagctttatggagttgtagagcctgtgtagaagctttataaagtggtttagagtcaattgacctcattggagaaaaaaagtagtcagtaagttcttcacctctgcaaagtgcagactgaatgtggagaacagaattgttgttttcttagctgtggctgtagcaggctgttactgattaccctcataagatgttttgaatttgtcttggaggaggtggctttcagcctgactttcaggctggctttgggtcatcctgagtaagaacaagactggtagtatatgctgccaaatgtaaaattatataactgcccaggagagctgtcacacgtggaggatactagaggctgccatgacaatattagccaaaaaatgataaaccacaacgtgatagaaggaagaatcctcactttatagttgagccccgagtaagtgaggaaagttgtgcaagtttgtaacttcagtgtgatggttgaggatggaattaaagtctcctgactgcttatgaaacctcccacctatatgtttttacgcaaaatgtcatggcccttacatccttttgtttccattgctatgatggttctggattgtaatcctataagaatatgatcacttaatgaatttatgttcattatatttcatatgcagcctgaaatgcctctggtttctttattagcaaatcaacagaaaacacttgataaccagattcaagattagacagcaaagatctacagaaacagattaatatcattttatggcatactatgatctttttttagggaattaactaattactgctcaaggaagcatatccaataatatgcgggtaaaaggatataagcaaaaaggtagcagtaaatagctgtgttttggattccacaaggcttgtgttaggtgaggtcttattcagcatagttatgatgtggtaaagagagtacattgcccactaatacacatttcaggcattataaattgggaaacttgcaaatgcaaataagaaaggatgggtaaaatcaatatgcttagtgaagaagggatcttaagaaatttttttagaaaggatatgggaccctaaaactattgaagtaacaagaaattaggacaagaaactaatatgggaccctaaaactattgaagtaacaagaaattaggacaagaaactaacagtgatagaggaagggtactggcttgttagatttgggctcaccgtttggcaatccatctctaaaccctatcacaacttatttataataataatcttggtgctgatcatcataatctgggtatgcagatttacctacataattttaggcaaattggttaacccctctggacatttaattcctcatctgtgaaggagttacacaagaatacatttattggtttaaataactactgttcaatagagaatttttaaattagcatctgtagctctgttaggagggaaaaatgatgatgttttatgatttcaacacatgacttcatttctttgagctatgtgacagtcatgctttcctccattattcatcaatactccccactgcttaaagttgcaaatatctagggctgggctacacaaagggaactgagagatagcccacccttccgtgcaaattttattgataagagtgatgtggtccagagacatgagacaccttgtccaggggtggttaatggtggagcctgaaggatgagcaggtcatgattctcagcacagaactctttttctcttgtagaaaagatagcaaataggctggatgaggtggctcacacctgtaatcccagcactttgggaggctgaggtgggcggatcacttgaggtcaggagttgagaccagcctggccaacatggtgaaaccctgtccctactataatagaaaaattagccaggcatggtggcatgtgcctgtagtcccagctaccgggaaggctgaggcgcaagaatccattgagcctgggaggtggaggttgcagtgagctgagatcacatcactgcactccagctgggtgggagagtgaaactgtgccaaaaaaaaaaaaaaagaaagaaaaaaagaagagatagtgagatagtaaataggttttcctcctcatgccaactcagatcagttgatagtacctgccagttgagaaaatttgtaaggacgtagtacctaggtactacataaaacactattgctattaataaataattatcactatcagtaattattcattagtactgtctgctatattaacaccatagggaaatagaaaatgtttgccacctcctatcaagaatattctttaaacatattccttcaagataaacgttcaatatttattctgcctttcttgtatctctgtcactcacaatattacctaatgctatctaatgtattctgttcttagagaagtaaaatgtctcagtagaccaaacttagatttgatcattacgaaagatgtcattctcagtggctggatcttcatgaggttttcttgagctgtttttcatttcacctgctgctggatgttttaggctgctgtattcacatctggtggcctgtctcactaggatctcatggctgcccgggcagtgtcacagctctgagttcaggttggctctagtcttgcccttcgctacagaatcgtggaatacagtgggagatgaagaaggcagcactcttgccctttgtgtttctagtaacttaaattcaactcctggcagcctacttcacattctgatttgggcttctgatgttgagtgctgagggaagctttctcccactgcttacatgttctagctccttggttggctccaaggagttgtgatggaatttcttggcatacttcaagccagcagcagccaggttggccttttccctccacatcttatagctttgtaggattttgggagaaaactgacctggaactagttacatgacctttttcatttatttgggtcttagtgctcatccttgtcacctcttattatttagaatgaaaagcacattactctttaaggaactagagtataaattcagaaacctagaacacatatattaatacacagaactttttctcttttcctagctgttcaaatgtaatacagttttatgttcaaactaaatgaatgcctatttattcctggaagtaaattttgttattttctagtccaggctctttgttttacacatgacaaaatagaagcccagtacacaggagggttgaatgacttgtttaatggcacatggccaaagaaacagaacagaaaaaaagaaatcagaatttgtcagttttctgtctagtgcattccaaatcacatgacacaaccattattggttttagaattggaaaagtttggtttattttttaactgactactcagattttaaaaaaattgtttcattaatagattagtaaaaatttaatactgctgttcattgtagggcttagtaagccattactatgatagatctttatttttgttttctttaagtctgtactggacattgaagtctctctatggtctctggacttacgtcttggccttacagactgtcctgtttcacctttgcctcagtctttgcagtaatctccctcactgagaagtctggaacatgccacatgttcacagtgaggctgttaaaacttccagccccatccaaaacctagacttggaaaccattgtcgcattgctttctgagtccacagatagcaaatgtgacaagtcaaaaatgatgcctaatgttgagcaaggagtctttaaaaagccctactcatgtttctaattctcacacccatgtaattcacaggcatctgtccacaggtagtttgagaacctaactatattaaatttcaatattcagcaaatagctcataaccaatcatatctgaattagaaaagcatgtgtaaagaacaatagcaccaactagcactcatagcagattattccagctatgttataataaggcccttggcaataactcaaggtctgttttttcaaaatgtaaggattaggtgttcttgaggcaggaaagaaaaacaagactattctttgcagatggagaaaaaaatgaagtagattcactagcagagtcactttcatggaaatttggagctctgctgcacagttttagtgtttaaacaggattggaagtcctttgggatgacattttcaatgctgaaagagaaacacctgatagaattgagtctcaatgaaacagaaaacctgctgaattgaaaaggggcttcactcagtgactaattttctaaagtgagtaccccaaactgttaataactattttaaagcagttggatgactacattcaagataaaaaattatatgggaataaaaattgtcaatatatctgattttggtaaaactaagcacacaatttaaatttatcttggaaaaccttagtagttattggaattacttgagaatctattgcaagcaatctaaatgaattcttccaaaacatgtcactggagcaggtactcaagaagtaatctgaagtaaacaaacaaaaacaaagctatatttatccttcctcttttctgtgtaatataatccatgggaagacaagaagaaatttattttctacttgtgagatttggggatgatgatgctttttctatccttatcaccatttgtcaagatacaactttcattactttccagtaccacctttgaacagcatcttcttttttagtatattctcccttcctccttccatctctccattctttcttccctcctcttttcttcccatatttccttccttccttctttctttcattttctctctctttggaatctcttctcttaactttatgttttccccaagtgatcagctgtttttatacttctctgctggttcctcctaacagagtctttgcagattttaaagtaaaaccataaagaagaaaacataaatagaatcttcagtgatttcacagcagaaaggcatggtttgtattactttctctcagaggtatttttaatggggtaaatatttatttccagatgacccaaatctctttgttatgtttgctgacagaaacagcagctcctccttctttctctctacagtaatgagattatggacagggatagaccttcttcatactgctctgacaacagacattttataaaccagggacgggctatttcaattcagtttaattcaaaaaaataattattggatacttaccacatctaggatattgttagctgttataaatgatacaaagataattaaaacattgttcttcctctcaaggaatttgtaatctagtatgagggaaactgtgtaaataaatatccaatcctggatgactgccacaacataaaaacacacaaatgtttaggaactcggtagacaagcaaaggaagtagaatagtaaagatgaatgtctcctatttgtcaatattttacttcacctctgtgttgttttgggatatatcaaataatgtcttttaaatttagagttattgttactttataataattattattattgtcataggtagtgttaggttgtgtcatttatgtaaatacttatggagtagtaacatgatatagtagtctacctcagaaagagatttattgagtctatgatgctgaattatagttttgtaatatgtttctaaattctttatgatggagtcccactctatcacccaggctggagtgcagcagcacaatctcagctccctgcaacctctgcctcctggattcaagcgattctcctccctcagcctctcaagtagctgagattacagtcatgcgacaccacaggcagctaatttttgtatttttagtagaggtggagtttcaccatgttggccaggctggtctcaaattcctgacctcaagtgatacgcctgccttagcctcccaaagtgctgggattacaggtatgagccacggtgcccagcctgtaatatatttcattccaacttttagatagcttctttatcaggtgctgcaataaattgtttgccctagatcgaggtggggagagagccctcttaggatgagctgtcacacagtaaaagataagatttcctggatcagttttctaaagtgacaggcgtgtcccctaatcgagacagacagtgctccattttgacaaataggccagacttctacgtgtgcatatttgttttgtgtgtgtcagagtgagggtgaggttgaggagtcattctgttcttattggaagtgaatcaggcataaaagtgatagagcgcttgaatgagatgattgcagttgaaagacacagcaattaagcagatttcagactttagagagcatgtcttccgggagctatccacggtactgaactgcttctccctatattgtcctgtaaccccgcaaaacaaaccttcaaacattttaaaaccacaagacattttaaaaactggctttggttattccttactagacaaattctctaacctgtgtatttctaatacttgttatttgtttaatcttggctaggtcagcccatttttttttgtttgatattacacattcatccatttatttattcaacaaatatgtaggtacaatcttccgtatgttgggcagcctcctagtggttaaggtgcttaggtttcttattatgtaatgctaattattattacttttgatttttctgggatttactctaaggaagcagatttaatgattaaaataattctacttcgtgtgtgttgtttgaagaacttggtttctggcccaaagatgatgctttgtttacagtacctagaacagccctttggcgtatcgtagacactcaagaaattgtattcacagcataaacatgtttattgttgtggagtgattttctatgaaatgttacaaggaaaatatatattttaaaccaacaagtaatctttgcaaaaaaaattttgaataagaaaaatattgttctaagtaatctagatggagcatacacctagccttaaagagtctagaattgacatgttgggacattctcatatgttaagaccacattacaggttgaccagaaaactaggaagaaatagaccagatacttcctgctcaggcttttatgtgcatatagaagctcagtgatctttttattctgttttactcaggctattctgtattcaggtaggatatctatcacccttactcttctctaaccccatcttaaaaaacaaagcggcggggagtttttcttttgatatcagcaacagataaccaaataagatggcgtataatcttttttttttttttttttttttttttttttttttttgagatggagtctcgctctgtcaccgaggctggagtgtggtggcactatctcagctcactgcaagctccgcctcctgggtccacaccattctcccgccttagcctcccaagtagctgggacgacaggctcccgccaccacaccaggctaattttgtttctgtatttttagtagagatgggggtttcaccgtgttagccaggatggtcttgatctcctgaccctgtgatctgcctgcctcagcctcccaaagtactgggattacaggcgtgagccactgcgcccggccagaaggtggagtgctattcttaactgtccttttgtagttctttgttctaagaatttggaaagacaagttagtcctgacttccatggaaatgttttttttccaaccaacatgggtgtaattctgaaggagaattctttcttaccagtgactcagtccctctgcagggcacagaatcaacagtattcctagtgtttgcaagatcagtgattatatagggtcagtataggcaaactctccatttccaatccgttgttaatgaaatgttatttttggtgaagttctgagatagactgaatctgagcagaataaaaaaaagtggaatcagcctgagttctagcttctacccctatttctgtgatatgcttccttattgacatgtgggctttgaaacttggtaacatccaaattgtattatcactctcttgaaaatgtcattgttccatgaaattgtgagacttaaccatttttattgatatctcagagaaaccaaatcttgagaactaagagcattggaggataagctcctttcctagagatacttactctacttttggtcatggaccaaatttggagttattcctgtggatttttttctcttgttccttaaggcagtgatagatgcttgtttagtcaccataagttgtgagaatatgtggtctcaataaagacccagcaataccttgtttttctactcattatccagccccaaagtttaagatctaaatgtttcctggtgagaatacaaagaaaagtgagctcttatagcctgttgatgggaatgtaaattagtgcagccattatggaaaatagtagagaggcttctcaaaaggctaaaaatagaactaccatatgatccaacaattgcactattgggtatttatccaaaggaaacaaattcaggatattgaagagatgtctcctatttattacagcactattatttatttatttattgcagcactgtatatttatttattgcagcactatttatttattgttaacactatttatggcagcactattcacaatagccaagatatagaatccacctaggtgtgcaagcatgaatgaataaagaaaatgtatgtatacagaatggcttactattcagccaccaaaaggaatgaaattctgtcattcacagcaatatggatgagtctggagggtatcatgttaagtgaaataagtagggcatagaaggataaatactgcatgtccttacttatatgtgagagctaacaaaagttgagctcatagtagtagagagtagaattgtggttattagaggctgtgagggggagggggaagaaaggagagggaacggttggttaaggaaaggagaggagaggttaagaggttggtgcagggttatagctgggcaagaagaatactttctagtgttatgtggcactgtagggttaaatacagctggagatgatttatttatattttcaaagatctgggggagaaggttttcaatattcgcaacacagagaaatgatgaatgtttgaggtgatagatacggtgattaccctgatttgatcattatgcattacatacatgtattgaaatatcactctgtatactataagtatgaataattatcatgtgtcaactaaaaataagagggaaaagtttcaaaacaatatctatttgttgattccatctgtatggcttagtgataatgtaatcttttgctgtcttgcattgttcccatactggatttcatgactaatatctttgcctttgactgatttgaataaaaatatgttaaatgaacagagaatcttgacctcctttcagaggctgaaggattccttaatttctttcctccatttgcttaggaatcagtgccattgactgtttgcttttagttaatacggttttgtttgcttaatacagaatatgtgcaatttaagtgtcatatgtacataataagatgtaatcttttaattatatgatatagcataattatttccattttatatatgacaaagttaatgtttaagaaagttaaataactctaattaggagtcaggattgagaatccagacacagatggctctgacatcagaatcactgctttaaaccactcttcttttctgcttgctttaatattcctttacttcctccataaagtgccacatcagaatatagaacaggttattaatggaagaaatatttcaatattttgagttttttgggtgaatgaaaattatagaattaaaagctgaacatcattttatttggcagtttcatcattatgatttaaaataaatgcagtttttgaagtttcctaatttattctcttgaaatatatttggattgccacatgctgtatattctaacacttggccctggtagggtttatttgtatatgtgtgggtgtactttaaatataaagatctcactgattttaacacacattggaaatatgcataggcaaaccccaaacaactttttattcaatagtgtccatgtatctctaaacttttgatagaaatttgttccaataatggggttactacataagttgaagaaagtcaaactgaagcaaaatttgaaggcttctatattaatgatcagttttaggcgatacttgccaaaatctagttcaggattagaataggctgtgttgacattttaagtgagacatatcagttactctttttcagaaagttaaaataaattctcataatgaaaaaataaatgataattttagattcttttagagaatttactacctttacaaattaggaaaataatattcacagtatccatgattccaaccagttaacatgttggtatatttctttcagttatacacatacacataattaacatataattatatgaatttatatataattttgcattctaactttctatttgacataataacagtcttattttgcacttttatgattttccaatgagatatatctattagccatttctattttttgagttgcctgtttttttgtgtatgcatagatatatgtacgcctgtatatatacacgtatgcatacatatatatgttttttgttttataaaaagagataccatatttctattaataccgtcacagctctgatccttctttctattgtagagcttctatgcatgtattaaaatttaatttagaaccaatcaaggaagaggtcaatctgaataagataatatttgtaaagttcttgcctgtattatgtatagcaactagagctactttatccacagcgatttgaagccatgttgaacctatacaggttaattgatgcaattctcttggaaacatcgtcatctgttggcctataatgttttaaaaaccttggaacagtctcattgttttaagtatatctcctagttttttcctttaatttgtttgatgatatttttattttcttaagatcatcttcagctgaatcctgacaaccctactacatgatcataacaaaaaaagcaatgaggagtctctataccctttattttcataggaaaatattctaatatccacaaatgtgattaaaggatagagcaggtggtggggcgaggtaacatctgatgtgagaacgaagaagcaaacagttgttatttttactctggtcaggtgaaaacaagcagtcattacatgtctaaatcttgggtatctttggaatcattttcagccaccgtagtaagttgtacgtgcttgagtgtttttaaagcatgtcttatagtgaccaaatgtttctaccgcatttatctcagtaaagttgacaggattctattaggacgatcttcacctaatgagataaatattctaattgtaatcatcctcttggaatgcatatctcttctgggaattaaaagtgctttaagtggtgttgctaaacaaacatttctaaagagtaatcataaagttaaatgcctcacaatagcacaataggctttttagttgacctggtttttaatacttttttcattgcaaaatttcttattctggaaagtttggaaaaatgaggaaaaaaatagaaagaaaaatgtcgaatttaaacattttgtcactacctagttaaaatcggggataacattgtgatttagatttctccagtctcctttctttttttttttttttttttttgagatggagtctcgctccatctcccaggctggagtgcagtggtgcgatctcggttcactgcaagctccaccttccaggttcacgccattcacctgcctcagcctcccaagtagctgggactacaggcacctgacaccacgcccgccaatttttttgtattttttttttttagtagagacggggtttcaccgtgttagccaggatggtctcgatctcctgacctcgtgatccacctgcctcggcctcccaaagtgctggggttacaagtgtgagccaccgttcccggcctctccagtgtcctatctcaattcttattcaattgtttgttaactagattggaatcatactgtgcatattgttttataatttgctgttttggctgacatttggaaaaattattttagaaaaaacagccagttttgtagatgaaatggtgttttgtttctattgatttttgatttttaagttgctattacttcatgaagttagcgtctttcttgtgtattggctattctcttttcttttgctataaattgtctgctacatcttttagttcataataattattgagtcattttctgtttaaatataaagtatttttctcatttgtcgctgtaacataatccatttttaagaagcagagcattttcttgacagagttttgaaatattgtgtgactttatggctagaacacagaaacattagttagaatttcagaatcatttgatcagctctggctttgagcctctgattctacttgtagtctccaaaccaatctttggtatccttctgtagagatgtaagttgttatcaccaactcaacatgaaattgtaagaatttataacagtgttttctaaaatgatttctttgatttattcaaagaaatattatctctgataatatatttcagtatttttcatattgctcaatatcagacgaaagttcttataaaagtcctgattgtttcagcagtgatttgcatgccattagcaggtcattcatccccttccactttgaggctcaagttctacactagatttgatttgttggagggagtctacaaactctgctttcactagaaagacatgatctgtgtgctttgctgccatagtgggcctatccacatggctcattctctgtaacactaacttccaggaaagctcttgtatcaaaattcatcaccggtattaaacagtgtcaattatttttatcacctgttgaaagcttaaatgccaacagaaatttgtgcttcacagggcattgggtcctccatttatatttttcaaatgtgtagtatactcttgcttttagtcgtctattacccagtgttcttttcggaaaatatttttaaagttaattatatactcacagataatagtgcaagcaagtttcctccatgttctgctttcctttttctgactttacttcatgctacattccttcacaaatagtaataagaatttatttctactcagaatgaatgttcctcacagtggagagaatttgccactacaaaatgccttctactctgtgtttaaattcctcgtacatacaagcaggttttgggtgttacatttgttcatagaggtatgaaattgagagtcatagattgaaatgttttttatagtagagactcccaaaaaaaggcacagaaaaatggttgatatctagtaggagttatttacatgctgctatttctgatgcttcctatttgtttcttctgaaaaagtcgcccttcctatgtctcaaaacagtacacctgtaaaaccacatcctactgggcataattctacaactgcttctattctcaatgcttgtgttgcatgcttttggaccctaagagaaatcagcaagctataaacccaggaccaagaagagcatatatctcttggaaaaatagcatttgagtgattgaataaaacaggctgttttggggatcattccaaatgcagggaacaatatggatctgtgatacttgagttgttggactttgtagaatatcaaagatgttctgcttttcatattcagatttttaaatagaaggaaataaacaatttttaaaatgtttggaattaaatgggggaggtcatctgtaactgtctttgttgatttttgtgggcatcatagcacagaagagttctcctggcttagcattctggtattgctcacatatcacctatatgctaatttgagagcgttcatgagtgccatgaaggatgagtcagaatgatagacagtatgctgactttttctcctcttattgaatttagtctgatctgctagtgagagaaataaaagggaaataaagcagggagtataatagggaaacctattttctccaaatgttgagatatttaaaaagtctttgttcagtgtacctgcagttataatctttccagagattcatgagatgtcagggctaggcaagactttagaattctatgtagtaaactcttgtttggggctgggaaaatggagggtcacagttagaataattgcctaaagccacaccgacagagagctggtagtggaatccctgttttctattcaccttcctactcagttgcactacaagtttatcctaattcaagtaagcttagacatcaccttgggtaactttctgatttaccaaatccactagtggaccatattgaatttgcttccaacatgaatactcttcatttctctccatccacactgctacccaccaaaatcccatgccttgaatgtaaataatcttagagctgatctgtttgcttctgtaacttcctgctactcattccataagcaacagaagaggcaaaatgaccttttaaaaagtataatttgatcattattctcctttacttaaaatcctagaatgacttccattgcacttaaaattccaaatttctttccatggcctaaagggtctacttgatcagtgtatcgcctttctctagaacttaatctacctctgacccttgtgtgctatgctgcagccactttggcctcctttcttttccccaaaattgaagacacatttccatctcagggcctaagtgtttgcagttagctctgtttggtgttctcttctcctagctgtttacagctttcagccttctgcagagatgttccccagctaccctgccgaatatcgcctttccccacccaatcctttcattaccctattttttcatagcagtaactactaattaattatgtctttatctattgtcttttcccagtctccaactagattgcaaagtccctgagggcagaggtcttgatgtcttttccattaacaatatctcgagtaaccaccagcaatctgcacatagtaataacctgaatattcctttaatgaatgaataaactgaaaaccctaaagttcagtaatactggcctctgtgtagagtttcagaaatatgccaaatatgctttcaagcatcccagcctgtctagtgtatcctttgctctcttggccttctgagatcacttttaattggcatcctctgaagttgttactctcagtcatgctggttgataccccgaatggataggaaatggataggcattttttctgtccatctctaaacatctctgattgggcctaatatacctctcaggcctgctcctctggccaggacccctctttttatgggaagtagggagacccaggaacacagaacctataatatattagaacctgttatatatctctctagaaaaaacagttattttaaggaacgtgattgctggggatggcaagtcagaagcctgtagggggaggcctgcaggctggaaactcaggtagcagttgatgctgctgttttgaagctgacttttttcttctatggaaagcctcagttattgctcttaaggcctgccaagcaatcggatgaggcacacccacattgaagattatctcctttacttgtggtcaactgattatagatgctaaccacatctaaaaaatgccttcatagcaacaccttgattagtgtatgattaaataatgggacatgatagcctagccaagttgatagaaaactacccatcccatcatgcatttgtggtattggagaaaggaaatgcttctccattgttactactgggactgttactgctgagacacaccgaagaggagaatttttagtttttagtttgctttttagcagaattcaaacttaaatataaaattaaccaaattgtcagaaaggactgaaggttatcctttcaattctgagttttttatgtaaaattattttattattagcaacaggttttgaaaacatttatcaattatattcttatatattggtgactttaggtaatgaataaatctggatttatctttctttataataaaaatatggtctgatcaaagtatataaaattgaaataaatattgtcttatttgtgctttaaattaattgtagtataatattaataggatattatataatattcagtcattttagaataggagaaacattttagggtaggataaacaagaccgtatcatgaaattggagattttaattgttttgtaatattaaattttacctctcatgaaaatagagtagataattattatggattatgaaacagcataattagttgtaacagttttaccttgaagaaaatatatcttttttataagcagaaaacttcattttgttttctttaaaatgaagtgaataccggccgggcgcggtggctcacgtctgtaatcccagcactttgggaggccgaggtgggcagatcatgaggtcaggagatggagaccatcctggcttacacggtgaaacgccgtgtctactaaaaatacaaaaagttagccaggtgtggtggcgggtgcctgtagtcccagccactcgggagtctgaggcaggagaatggcatgaaccctggaggcggagcttgcagtgagccgagattgcgccagggcactccagcctgggcaaccgagcgggactccgtctcaaaaaaaaaaaaaaaaaaagatgaagcgaataccatctctactctcaatgtatcgtggacgataataactatgctagtatttctgcatagtattcttaaagaattctgactgaaaatatttaaatgaaatacacataatcactttgccacctaatgcccatcaatcattgccaacattgacttttaataaagacacataaccagagatgatttttaaaaattatggataaattacattagaaaatttagctggagcaaattatatttgattattattaacctgccataatttatattcattaaattgccaaatcttgattataatagtcaaaaagaaaaggtacatgataatgatctagaggtagaacacatgctatcaactggaaaactaattgttcagcatcctaagtgtatttgttgcttaattatatatataatttctacaacaagtggaatgatttacatgaatgtcaaataactggtttataaatgaaacctgatattaagctaaataaaatattggcatatagtgttcacttatgagctaatattcttacctctagcttcatttacaaattaattatgctacaaatatattaatgttccacaactctttcacacttccatcaatatcgagtttattccattacaatgtgaaattaaaaaaaactgtagaataattacttctgcttcagaaaatatagattacctatcttccagtaagatgctgcaatttatttagataactgcatttattgcattgattttgaaaaattgctcaacctaataccctttcttctttgctaattcctggggaaaaggaatccttttcattttgatccaaatgaccattaatcatattataaagtgtaataattaaccctttttttaagtgtcagagacacatgaatagtgattttatttggtttcaataatcaagtaaattaagtgataaaatggaggccataattaagtgatcttgttttctaataagaccaacccattaatgtgcatgtaaagatgcctgtcatcaatttaacagctttctgagtttaatatacattaagagttttatttttggaacaacttagtaatttttagaaacttgagtacaagtgttggcaaaggttctataaaattctgtctacagaatatgtggaacacaaccttgggtcgtatctccaaggaaaactaccatgattaaaaagacaatgctttgtcaaattcacttgttatcacaatctaattgtgttaaatgccggccacattctgagtagacactttaacttggcttcccttgggaaataggaaatgaagggcccgaaagaactagaagctgcctctcaattttctttcaacatggcaaaagcatttgcatttatctgtgcccctctcttggctacactctcagctttgatacactacttgagcatgtggaggtttacctactgaatgtgacccttatatgaataatatgagacttttgtatcaacagtagtgatggtttttgtttttaagtcacattttattgtatgtcttctctacctctcactatatgacaagtttagtgaaggcagggtctgtggctatcttgtttattattgttttatatcctgggggtatcacagtgcttgatcatagaaagggctcactaaatatttatggaaggaaagagaggaaagaagggagagtgaaagaaaaaacattcaatgttctcactcttaaaccaagaaaataattgtttactttatttcattgtagtaagaaaactgaacatgctactaccttcaataaatttttaagtctgcaatacagtattgttgaccataggaacaatattgtatagtggatttctagcatttgtctttcttaactgtaattttgtgcccgttgtttagtaactctaaattttcctcttcactcagaccctggcttccccccattccacaatttgattctgtgaatttgaatattttcatagaaaacattttatgagtagaattatgcagtatttgtttttctgtgactaacttatttcacttagcacaatgacctccaggttcatccatgttgttgtatatttcagaatttccttcttttttaaggctcaagagtattcgcgtgtgtgtgtgtgtgtgtgtgtgtgtgtatcacattttctttattcatctgttgatgaacatttagtttttttcacagtcttggctattgtgaatactgctgcaatggacatggatttttaagcgataaagaataaagctcttttcatcttttaactggaattattttttagaaaatattttgttccaattttatgatttttttgctattctttcatgattaaaagttatgtttcattattatcaggttgtatatttacatatatattttgtctgatgttaataatggcatgtttactttctttgtgtaagctgatgtatggaaaatattttcctagcttttatttcacattatttcatcttttgtttcaatcattcatcttgtatattttggcttccttcttcccttttactcaacttagaattttagagtgagtaacttttaagataaaacgagtttaacagataatttagcccattcacatttgttgtaattcatgatatttgtgtgtgtttgttatctcttcatttttgaattattttgctttttaatacatcttttctccatttcttctgcattaccttccttctttattattaattgaggttttttgtgctgttcttcttccatcttttttaaactaatgaattacaaaatttgcttctttttatgatttgtctcatagttattgttaaagttttgagacctgtgagtaaaaatattttatattaatacctagacttataaatcagtactaatatcttgtcttgaacaggacttcatccctagaatactttttatttctacatcatctgcttttaaataatcagatattaaatccagattgccatcgtttcatttttaaactttgcagcagagatttttttagatgtgaacataaggtgtctattttctttgcttcttgttattttgtgttgtctttctctttcttgggtaattttttgttttgttttgttgaatcagtaagcttttcagaaaatgcctgtaggtgttaaatttctgagcagttatatatctgaaaatatctttgctcttacatttggttaatactttggctagatttagaatttaaaattatgaaatgtttttctacagacttgtgaagacattcaatatttgtttcagcacatggccttagaaatgggatatctataccaatctaattcccatgtttctgtaagtaatatacctgtttttatcttctctgagatattttggaatttgctcattattcttggagttttgaaatgtcatcaaaatatgtctaagtgctggtcttgtttagtaatcttgtatacctcaggggaaatttcagtctaaagatgtatatcttttccttcagttttttttttctctctctctctccatatatatatatacacacacacacatatatatacacgtatatatacgtgtatatatatgtgtgtgtgtgtatatatatatactttttatgtcttattagacaaacgttaggatttctgtttctgttctctgtcttaacttttttatgctctccaggccatcatgtgcttgtcctataatctggaccaaacccaaggtacacatttgtagctcacaaattcttcactagtcaccatctctgacttatcctaaatgaaattttattttatttttaaagtgattatattttaaatgtttctttttataaaatgccaaccagtttttcttaatggctgtaatgtattgaatcccttaagctagttcattattcctatttcaagatttttttctactccttctattaattgtttttttttttttttttttttgagaactagttttgtgttgtttgcattggagtagcatatacaagccattgtttctgacccgagtgctctcttttagaattttttttttttttagggtcagatcccctcatctagtacctctgcctttaaccgcagtctcatgaatccaactgctattcagcaccttcgactcagatgtctgataggcctgtcaatcttgggagacccctagctgaacttccacagaaggatgggtctgctccttccctagtctccccatatcaggagatgatggtacccttcaccctgtagctcatgccaaccttggattcatcctgatacctttcttgtcctacattctacatccaatgtatgaacttgtgctcacttttatgtccaccttcaaacaaataccatatctgactgtctctcaccactccccagctacatccctaatccaagtcaccatcatctttcacttactctattgcagcagcaatagaccaatctgggctctgcttccattcttttcaccctatgtttattatgtattcagcggcctcagagaaatgtaaaacataaatcaagttccatcactccctgcaaacaacaacaataacaccccttataatggctttaagtcctaagcatgaccaatacagccatatgacatcaaggtcctgcttacttctctgactttctgttctataatttctataatgtctatcattgttcactgtgtttcagtcatattggtcttcttgctattttggggagtatgttcccacctcagggcctttgcacagctgtttcctcacctagtagctctttctctagatattacttggcttcctccctccctttaattgtttctcacacaaaatgcacctcctcagaaaaggattgctctcatccagttatcatccactgtccctctttatcccttttccctgccctttttcttaataacatgtaacgctgcctggtgtgaccaagataggtttgtttgtgtttgttgttgttcttcaaaatagaaacatgaccagggtatgggactgatgacttctccaccagcatatcctctgagggtgctgaatcatttctgttacatagtgggtgcagaggaaatatttgttacatgaggctatatatcaaagggcttcatgaaggttttgctttactgtgaatctggagtcagataattcttttctttatttctcctctgttttctttgtagagatcatgaatatcttaagctttatggtgcctctctctctatagtttggctatgagcctccccgaggcagatggttaactttatttagaaagagggtttcaggactttattctagtgataaataccgtggctgctagtcatagaataaacaagggcatgagagaaggcagccaactagaccagctgttcacaccatggtcctttcataattatcctggttactgcctcttggctgtgtgtattgcttgactccaagtgtggggtgtcttttgtagagctttatctggagctgttttagggagaatcaatctcacttctagtagatttctcctgtgtaagtgtgggctttgatttcctctacttctatttctactaagcccattacttatattaatcccatctactttcaaccttcaaggacttttatttttcaaatttctgatctgatagttaaaattttccccgatgtgccatgcacttattctaaaatatgatttttttcctggtgtcaataagatttggcgtacagggaaagacagatatatatgacttaaattttgtcttctttgcctctattgtatgttactgtttttatcttctgtgttgttgttgttgcttaacaaatgtagctacacatttatatcttatcactgttttcttaaaaataatttgttttgttcttctcccttttatatttagaaaatatataaaaaatgtggaccatgcctttgatcagaaattattatgaaaattgttgtttagaatgggtttgagggtggaaaagtttattaagagattgtaatttaacgaaagagaggtatgaatattctgagaattgaggtgtcttatgcattaattggattgctagatggccccactgatttcctgtttttcttgttgtgttaatctatatattgaattaagcacctcaaactatgagttattagatctcatatatctatatccctacagcaatttctctaagctctggtcatttctgctactttgtaatctaaaactgcttcataacttcctagatagaaatagaatatgtgggtgctcagagtatcagatagaccccatatataatagctatgaaatttcaggctctataatggattataggatatttttgaaccttggtaggttgtaggattagttgcttaaatacatagtaccatagattgcaaatgtttaaaaatcttgatgctggaatttattagaaaaacaggaatgaatacagtttgagaggctagaaccgtggatttcaaatgctagcctgtatgagggtcccttggagggcttcttaaaatacaagttgctggttgtcattttcagggtttctgatttacgaagtataggatgggcctgagaatttgcatttccattaaattcccaggtgatgtggctgctgctcctgggacaacatttagagaaccgctagattagacagtctcacaacagggatttctagggacagcttaatggttactttatgatttgaagctggaatacccaattaggggtttttccagtctcatttcatttcatttcatttgcttccttttttctttcttccttcctccttcccttcctcctccccttcctcctccttccttttttatctcctctccttgcccatcccctttcctcccttcccatcccctcccatctcttccccttccctcccctcccctcgctgctcctctcttctcctctttctttctttgccatttcaggtgctttatctcttaagcactgcactgctttgggttatccatttaagcttagaaggagagcaacagaaaaggaattgaaatgtaaagcagatatcaagagagcaaaatttgtcattaaattggaactagcaattaatttgtctatttattcatagtctaagtgtgattatcaaaaatgcttgagaatcaatagaaccacatgggtttttcaagttggataggaccactgaagctacctggtggaaacacatcattgtattgatgagaagactgaagcaagaatatgaaaagcatctgaaccaatgttttcttttccacgttctcatcactctctgctacccacagctgcccgtcatggatatactatatgttgtcagctatattttgattacttctctgtatatttatcatcatagtttactaaaattgttagtattataccttttgcatataagaaaggatgaacatttctagttcttaaaatgtaagaataagtgattacatattaccttgaaacagtatggaacactttttactttaaaatatttttttcaatttttgtgggtacatagtaggtgtatgtatgtatggggtacatgtgatactttggtgcaggcatgcactacataataatcattttccagaaaattgggtatcagttgcctcaagcatttatcctttcaattaatgctcttagtctgttggtattaaaacaatttttattttctgatgagaaagttgctgtcactttgatcattgactttgctacaggaattttcttttcttttcttttcttttctttttttttttttttttgttttttgagacaggtctccctctgtcttccaggctggagagcagtggcacaatcatggcttactgcaatctcaacctcctgggatcaagtgactcccctgcctcaaccccctgaccctcactatctgggactacaggtgcacaccaccacgcctggctaaattttgtattttttgtcaagacaaggtttgtcatgttgtccaggctggtctcgaactcctcggctcaagtgatccacctgccttggcctcccagagtgcggggattataggtgtgagccatcatgcctggccaggaattttcttgaatgcttcaataactttattccatttaactctcacaacaatcccatcaaatcaagtatcatgattatgcctcatcattcatttcacaaattaataagcaaagtcttagggggttatcacttcccaaattattacatgccagtgaaaaaccaaagtttgagcttgcacacaaactttgaaacactattcaaaagcagtgttttcagcacctgatctttattgcctcacagagttttatacagatacaaaattatgaaatgtagctggagccaggaactatgacatggaatatacctggcatacacatggtctttgtcttttcctacatctgtgaacttgttgaagctttagatgtcttcccagctcagtgatcatgaagacgtcctcactgatgagtcatctttacttgtcatctctagctacctggaataaaacacccagtgtagtgtctgggatccagtgggcatcgtgggtcagttagttctccagccccggttccttttctggttgcctgagcttggaaaattcataaaatctctttggacctcagttacgcaactgtgaaattgtgctatagggtgacttgaaaccactttgtagattttttgggagagctaaattaggtaatgcatgtaaaagcatttagtgcaaggtctggcacataggatatatttgctaaatattcgtagaatcagatgaataactctcatgaaatattttgttaaacattgtgattgttcactgggaatattatatggctgtgtgtgccactgtccgtgtttcccctaataattaataaatattaaataatttaaaattaaatattaaataatttaaaattaaatattaaataattaataataaatattaataaatacctttggcaagtatatactatgtcttcaaaatgtttcttttccatttaatgttttcatttatctgcaacatttcttaaggcttatttgcatgtgggtaaaattcaggctacaataatagtcaaggaagtatatttctcttgttctgctcccatacaaatggtgcccccctgcaagcctcttctgaattattcctggacacccaaataaaaatggtaatttttctttccttttctcctggattcttattctaacatctgctaggaggatccacaccctgtcctaggctagtagtgtacagaccatggttttgatgtctgtgcaaaaggtacaggtttgtttgcatctcttcaatttttttcattgtatgaaaatataaataatataaaatgtactatttttaagtatacgattcactggtattaaatgcatctataatgttgtggaactatcaccagaatccattgccatagctcctttaatcttacaaaactgaaaagttgaactctttacccattaagcaataactccccattccccctcacttaagccccgggcaccactattctactgtctgtttttatgattttggctattcaaagtacttcatataagcggtatcatgcagtggtatctcatctttttgagactggcttatttcacttagcataatatcctcaaggttcatccatgttatagcatatttcagggtatttttcctttttaagactgaataatcatccatttatagatataccacattttgcttatccattcatccagccacgggtacttgggttgcttccactttttatctatcatgaataatgctataaacatgaatgtacagatatctctttgagtccctgctttcggttcttatgggtatataccccgaagtagattgctgcatcatataataattctgtgtttaaatttttgaggaatcaccatactgttttccacagcatctgtaccattttgcattcccaccaacaatatacaaatgttccaattcttcgcattctcgccaaaatttgttacatgttgttgcaaaagtaattgtggtttttgccattaaaagtagttacttttgcaccagcctagtatttttttttctgagtttttttttcttttgttagtaatgggtgtgagtggtatctcataatttttatttgtatttctatagttgttattgatgttaagcatcttttcatgtgcttaccagtcatttctgtatctcctttggagaagtatctgtgtattcagcgtttgcttattttcacattgaattatcagtattttttgttgttgaattttaggagttctctatatattctggatattaatttattgtcaggtacagatttggctttgatggcactaaagctacttcttcttaccttcgaagtcacagtacctgtaatgattgcttatgtttagcaaattaacatcattaggctttctctgtcattatataaccccttcatcctaagactcacacatgagcacctcaactgaggctggggatgtgtgtccctgttgttgggggaacacatgtccttagctctgactccctttctccagggtcatttctatcctctcttccgatgacggtctaccccacagatcctaagccacatccaagtcacctgaattccagcatgattcttacttagattcttaagtttaaatgcttgtaattccttcttcctttcctctccttattaagtacctttaaggaagtagaaaactctcaacatttagaaacacttacaagcatatgaatttccatattattaatgcctcgtgaccaagatgtcctgacacatttatatggtcctgtaaaagttttataaataatctggagcatattatttctttatatcctcactttgtgaactagacaaggtagatattaaaattccaagtctcaggaagtttgaatgatttttcttaagcttagtcagctaattaggagcagaatcaggactggaatttagggcttctggctccactttatctctgaggcttgtactattctactgggatatcattagaagaaatgccaaatgaatgccattgcctcttcagccctaaacacaaagcccagttaagtgtttccctgacatttttcctgacatctataaaaattcatattttatttttattcacatgctgattgatttagatgttatgaaaattaaataagttccaaaaggcagaagataggctatacacatatttttaaaaatttgtcattgttcaaacaatattgaatataaaattgaaatgtccctcattataaaaaaaaattctctaagagtgactagttataaggttatatcttttggcatgatgcacctctaagcagtgcttgcataaagtctctaccaaagctgacagagcttccctaaggcctaaagaacttggcaaatgttgttgaacaaaaatgacaacaatgaaactgtgtaggaggattctgcattagtgcacctaagaatgttctcgctaatttgagcacttctcaccatggaataatgcttttgttcctctctgtctttttctgctgtctcacagagactcctaacagggctccctggaccaggcttagacatcaatagggatggactagaggcattccatggaggtgacaattacagaagatcagaagtgcctagctacacactctattttcttctagcatctgaaattattgacttgaacccatttgtggggtcactaagccaccttcatataatatttattacatgtgcaaagtcagaacatatggagagcatttgcatttgaatgggggaaacatgctgttagataaattagaaaatctttatatttgcatttttctttatttaaaaaaatcaatctgtggtatagtagagctaggaatattccctttttggttgacttcttcactctgtgtttaaactttctcagcattgaggcatgtgattaaaaggagctattttcctaatacaaacaaaagcattgaacatcctgtgaaacaaaagttgttcattttaacttgcgttatatggaaatgtgacatgttttagatttgtgtaagctcatgtacttgaaaatcagacttgtctaaaatttcttttgtaagatattagagaacttttgaattatacctcttatttttgaatgtacattcctcagagaatcatctttatgcacaaataatgtttattttatatttttaatctactttagcagacccacctgattcttctacatgtaaggttgaaacagttttgagtgataaagaactgattttatggagcaactaatgattttgctgttgctacttttgtgccagcaaatacgtaatccacaagaatgttataagaaagatatttatcaagcctctaaaaaaaaagaaagtaatcaaaagataaggatgcataaatatcttaagactactcatgacatcaaggaaggtgaatcagtattaataattcactagtttgtgcatacttattgtcaggtgctgggtcaaattaaattggaatgatttgttgacatgaggatttctgggttcatgatggattcacattaaaacaatttttatgttttaagccttctcccatcaaataggttttacggtcttgtgtacacattacatgagggaaatagtactttaacattttacatgctggtgtatagtctatatcagcagtccccaacctttttggcaccaggaaccagtatcatggaaggtaattttgccatggagtggggttggggaaaggagatggtttagggatgaaaccgttccacctcagatatcaggcattacattctcataagaagcatgcaacctagatccctcaaatgtgcagttcacaatagggttcgtgctcctatgagaatctaatgctgccactgatttaacaggctgcggagctcaggaggtaatactcgctcacctgctgctcacctcctgctgtgtggcccggtccctaacaagaccattcaccggtaccagtcagtaagctgggagttggggacccgtgttccacatgttataaaaacttaggctgggcgcggtggctcacgcctgtaatcccagcactttgggaggtcgaggggggcagatcacgaggtcaggatatcgagaccatcctggctaacacggtgaaaccctgtctctactaaaaatacaaaaaaatagccgggcgtggtgggcgcctgtagtcccagctactcgggaggctgaggcgagagaatcacttgaactcgggaggcggaggttgcagtgagccgagatcgcgccactgcactccagcccgggcgacagagtgagacttcttctcaaaaacaaaacaaaacaaaaacttaaagagttatttgagccggacacagttgcatagacctgtagtccccagctacttggtgggctgaggcaggaggattgtttgagtccaggagttcgaggttgcagcgagctatgattgtgctacttacactccagcctgggtgacagagcaagtccctgcctctaaaaataaaataaattcggaaagaattatttggtgattcaagtataaaacaaaatctatcagatatttgtgaaaaacatattgttacattgttacatgttttaagaagggaattaaactcctagactctgtatggtataggagttcaacactataggttggtctatacatctaatgttggatatgtattttgtgccttttatttaaaataacatacattttatggcatttcttgctttgcattaattactggccatacccagaatcctttccttcgaataaaataacctcttttcccaaacttttacatattgttcatattttcaaccccctacacagttgttaggtcttgaatttggaagaattaaagggaataacattaatgacagtgaactatgaattaggaacctcaccctatcaatagccaatttccctccttttcagttttgtgtctcagtaatagtccttaaaacaacaaatgatacattaagtgacctgagccaatttcctcttgacatggaactattcaacaaagcctcacataagctaacatttcctaattagccccttaactgttgacttgagaaagggtttgcaatacaggattcttatatattaataaaaactataggtaaaaaattcaagatgttgttgaatctttacagttcgactcattattcaaattcttcatctttacatcaagtttctcatctttacattcctctaattcaggtcatctccacaatatgtccaataaaccgtatttgcaagatatcgggagaaaagcgagtctgcctctaggaattataactgatacttcctttgtgtgatgaacagtgatttttatgtatttagtcatatgctattagggaatagatatctctagatcagagaacagattgtgtattagtcacagaacatcttagcactagttcctccagccctagttcctgtggagtaacgcgatgagggccagatatctatccccatgggcagcagtgttgcaccgcatgagaggaaccctggaattatgaaacttggagcttacacagggcagctgggcacatctgcccttcctcccctccagagatagaaagacttgtatgtattctggcatgtaagcaaatgactctcggggagagtaaaaagatgcctccaggttttatttcatgagcatatggctccagaggagacgcatctctaaacctctcaggaacagttcattgtcttttacttctgagacatactgtccattcagtcattctttagccaaggttgccagtactctttgctaagaaaccccagatcatgcagaaatgtgaacatgttcacagagaattgtctctcaatcaatagtacctagtacattattatacaaagttctggggatgtttggcagggattgaacccatgaactagaattatgagcattggaacttatctaaaccaattagcaaataaaaaagttacacatttcttgagaaaataattttatagattaataattacatgtaggatatgcatatctcaagtcatctgagggtttaatgttttgtatactttatcttacaaaatagattccaattcatgctgtctggatatacaagcattaaggccttccaaaggcaaaatcaggctaggtgtgaaacatgagtggtatacggaggtatagcaagtagtgtcccttgatacccttggggaattggttccaggatgtcccagagataccaaaatccatggatgctctagtctctgatataaaatggcatagtatttgcatgtaatctagcccactttcctgtatactttatatcatctctatattagatataatgcataatacaatgtaactgctatgtaaatagttgttttatttgcattgtttagggaatatgacaagaaaaaagtttgtacatgttcaatacagatgcaatgttttggaatgttttggggcatatttttgaatccacagatgcaaaacccatacatataaagggctgactgtatttaagttcctcattctggtgtgattaattttatctctttttagtatacttgtggttctcaagtcactaatgttttagttataaggtgaaaggcacactgtgtaattgaatgctaaggccaattctttacctctgatgtctggaataagagccagatttcccatccttttatggaactacaagcgtcatggctattagcaatcccagaatagttctactcccactttggctgagtttaagatctttttctaaagacagtaaaaagagcatcagaaaagcatttgtgaggctgaagtacctcacataccaattttgtgggcacatttttggacccttaagttctttttgacagttttataaactcatgcccagagtagtttcctttatttaatatttgtcttaccctctacttacaggaaatgcaaggctcatcagctttttcagggagtagcatgactcagagtctgatgtacttgaaaaaaacacagcgggaatccaaacacacttatgtcatttttatgtgttagagagaaaccaggaagcatgaattctcacttttcttaacgtctttacagtgtcaaagggatatttgtgaaaagaggttgtgggaatcattgttctgaagtgcatccaagattagaagcctggtttatgtgtgctattttgcctcccagtatgagcagcctttttatatttattccaagtattactgtaaactactttttctttatacatacacaatatatctttgtctgtgatcagagcggagcttcatttccactgaccaatagaagggcatttttatttgatttaagtgaaacttggggcataatgcattctttcaaacctctgattggacatgacaaacaaaaagcttgagctagaccatggtcatctgaactatttccaataacttacctttgtaattggagtattgcctcaaatatttccctgaactctaattaccatggatacgatatcactcaacagaactttttcttaggagcactaagagtgtggaagacagaggataaatgttgtagtttcatttgattatctctatgtggatgctcacatttttttttctataaccaaccagtttcattttgatgagagtgtttggagagatggttatgctgacactagcctaggtaagagagtaagtctccctctcttaaaaaaaagtgacaatgtcacttctgctcacagtctgttgatcaaaatgaggcaaacggccaaacctgatgcctataggttgaggaaattgtgtatttgtgaatagtaatagcacagcagccactaggcctcccagtcgtactggagatttctaaaaggcaaagtgtttttagtttgttttaggtaataggttgatatttagcctattaaaaaggcagaccctggcttgacagacaaaaattaataattaatttgggagccagatacagacttaggttttttgaattcttgtttctatattcttattttggaagtttacagtttggttttatatgcaggggtgttagatgaaggtgtattgttttgcaaatagaaacagtctcaggagacaaataacaatggcatgagaaatttatgaagtttatttttagcagcactttcaggcaaggttttgccatcaatattttcattggtacccaagaagccaacagaggaggccatgttttatgaattgatgtggctacaaatattagctctgacattttttaagtgaaaaatggcagaaaagatacagaagcaaataaatatagagtctctgacagccagcagagatggaaccctttctaacaattatgaccaaaggtatgtgtgtgtgtggtagtttggtttatacttgcttgaatgctgtccttgttcttttttttttttttttttttttttggtagttcttgcaccaagtgactgatggcttcctccaaaacaatgtcagcaggacaaggatgtattggcagggtatcttttgaatcagtaaccccatactgatccttgacctaattaacagtctgctataggcatcttgcagtttactgctactgctatcgcaacatcaagaaaatgttgaaacttaagcacccataagaaacttaagggggtgtcccactcaagtcattataaattcagttttattatgctaaaattgtgtgaactatagttcacacaattcaggctggctggaagcctgaatactacattgttttatattataccacatttattggaagagttggtttgcttttaaaggaatccatcactattagtttcatggcgtatttaacatctggtcaggtcagttcaatacttggaaatgttttgatacttgaagtttccagcagattttaacacatgcctttggatgtaagtaaacacctttgtccacaataaataaaatgtaactgagcaaatgaaactgtcacaatgctttgaaaactgtagcatactgaccaaatctatgccatgattttaccttctactgatggaaagaaaagtaactttgattattgcaatctgggcaattcacttatgttatcttatttaactttcatgaaaatcttcatatagtagctatcattattccatttcaaaatgggaacagaagcttaaaaatggaataatttaaagacatacaacctagaagaggcaaagcttctgaatacaacagctatctaactccaaaggtcttggttcttataagaatccattctgttttatgtctgtgattgtaagcttttagcagtttctcttcttctatttctttttttttatattttttattatactttaagttttagggtacatgtgcacaacgtgcaggtttgttacatatgtatacatgtgccatgttggtgtgctgcacccattaactcgtcatttacattaggtatatctcctaatgctatccttcccccctcccccctccccccaccccacaacaggccctggtgtgtgatgttccccttcctgtgtccaagtgttctcactgttcaattcccacctgtgagtgagaacatgcagtgtttggttttttgtccttgcgatagtttgctgagaatgatggtttccagcttcatccatgtccctacaaaggacatgaactcatcattttttatggctgcataggcctagaaaggtgcagaaactgctttcaattcctgaagggacttgtcaggcaaaataaacatactgaaaatagctttgaccatttctaaatcctttcctggatcagagttggaggttgctcctacattcatacgcattgctgatggattctcatcaatggcccctacttctgggttggctgagatcaataaatcttagcagtttataaatggaagaaatggctttacatatcttgtttcctgaatccctttggatattttaaaagaggtgattaaagtaaatttatgtttctgcagatgcatgtaaagctaattgttttaataacagtataattggcgaaaggaagttatgtgtaataagaaacaaagcgtaccacttccaaaatattcacattagacatttgttaaatttgcagtgagtttcagcatacacacatacacaacacagaccatatgtgaacattaggaagattgatttgtttaaaaaatccacttctacaccacataagtaatatttcttactgagagtcactgaagtgaggaagaaaaataaccacataacgggaaaagaaaaacattaaatttagttatattgtatatgttttgtgtttattagtttttattaattgtaggcatgcaggtaaaaaaatcgcctcatttgaaaattaataacccagggcacaaactattaattaaggcatatagcaaatgccttttaaaagtattttatactggctgggcatggtggctccgcctgtaatcccagcactttagaaggccgaggcaggcaatcatgaggtcaagagatggagaccatcctggctaacatggtgaaaccccttctctactaaaaatacaaaaactagccgggtgtggtggcgggcacctgtagtcccagctactcgggaggctgaggcaggagaatggcatgaacccgggaggcgcagcttgcagtgagcggagatcgcaccactgcactccatcctgggtgacagagggagactccatctcaaaaaaaaaaaaaagtattttatacttaagtttttctagctgctagtttaagagagatgagaatacattcaaagagcagggaaaggagagtgtctgaacagaggaatttctaaaaatgagtacagtattaacacagttatccttacaatagcctgaggtcaggactattgttttctccacattttggatgaagggactgagacacagagaagttaagtaacttgtataagatagagaagagacagacatgaaactgttataaaaaggaaagagacaggaaaagaggagaggagagagaaagaacaaagcttggatggcaagttaacttaggtcatctacctttgaaattcaagtagtctgtaacttttgccattacatttagaggcaccctctgtgacacggtcatagaatactggttcactcttaggcattcaacaaatgcctattgagtgtcagtcatttattcaacaaacatttactgaatgtctaattaagtagcagatatagtgctagttacttgagctacattgcggagacagggcctctttgaagagcttgtgcttcctctccatgaatgctagattcatgctttccacctaaaccctacttttggaaatcaagaaaagttcacctccttcatgagacttcttggattaaccccatagtctattttcacctagaaatagaaccctgtttttgagtcatgcacgttgccagctgggataaaaggctacatttcctagtcttatacctaggtgaacccatgggtctcaggtcaatgggatgtaaataggatttgtatgagaattctgggacatcctccaagagagcagattcagctggcaggaaaggaatttgctttctgatatggtttggctgtgtccccacccaaatctctacttgaactgtagctcccgtaattgcaggagggacctggcaggaggtaattgaatcatgggggtgggtctttcctgtgctgttctcgtgatagtaaataagtctcacaagatctgatggttttgcaaaggggagttcccctacacatgctccctctttcctgtcgccatgtaagacatgcctttgctcctccttcgtcttccgccataattgtgaggcctccccagccatgtggaattgtgagtccattaatactcttttctttataaattaccaagtcttgggtatgtcttaattagcagcatgagaatggactaatacactttactacctatcctcctcctggcctggaataacatcactgggtgggtggagtttcagtcactgtcccaggacaggaggtggcctggagaatggaggccagtgcttaggtgtggagtagaagaatataaggggcttgcatccctgatgacctgaaggtcccatttcagccctcaaatagcctctttctggatttatttcatttgagagagaagcagttacatgaagtttgttactttgtttgagagataaatgcagttatattaggtttgttaattttgttttgtttttgttttagttgtatgatgctaaatccaattctaattgatatacctccttcataagataattttataaacccctggaaggaagattgttcattgggctttggcaggcagtgaccttaaaactaggaaaaactgagctttaagggcccatgaaagtccttggcttgtgggtttgctggctctttgctagaattatattttgtttttttctggttcagggtaccgtaacagaaggtgggaagctatatttttcatgaaactgattgcttttctaattaacaatcttgctaataaagcaccactgtacagcagatatagtgtttttaatgtcatggatattgtacctgaaagtaagtgaagaagtgtcagatagtttctgccaatatttgagcagtcttagttctaactgctacaattatgcaaggtatttgtcttagaagagcaatggccatttgagtaagactttccatatggtgttccacagtcactgggagaaaatgggcctttttttttccttagtgaggtgatcctctccttctttctctacaaagtaatgtggagtttggaatgaattctaatgagtgaataataggaagattttgcatactcatttggacaagataaacacaacagcatggttaaaattcttgagatgaaaggctgagtttctgtagcttgaattttagatgataaatatcaagaatctatttgaaggtcagctatcacaaatataatttttctctggcaacacttgggtagctttccttggcaaattttactcaaaaagaagataaattatttctgcctcaactttttcttttacctctcttcttctttctctttattcgattgtttgcctttgaaagtctggctttcattgcatcattagacagaattgtgtgaccattcccaaagagattgacagtgttcatggcaggctgtataggaatctttctgtgtgcaggctggtctacaatttagcataataaagatctggccttatattcataggatctagccaggaaaattagtcttacctcagggtttaaagaaatgagggtgtgtcccagagggatctgtctgtggccagcaggaaatttaattttaaaaactgaagaatatacaatagttcaggcactgaataatttgagcctgcgaaggtgcttctgccacatatattatcatagtgttagtaaggccaggaaggtctgaagtttgtatgagttcacagatattttgaaagactcatgcaggtatttttgatatgattccattttaaaatcacattgtctgtgatgtgtatttatggcattatctaccacatgtgtttgtcctgtagaatttacattacaaaaccttctctgatcaataattgacgatgagtgactgtagtagtttgggaaataacttgctttttactcttttgtcacctgcttcaatatagttcctgctgtttgatgagaattgactgagctggagcctgcaaaagtaactgtagtcaaattagttacattaaagggtcaaaattatagctgcgtggagctaaggtcatggcagaaccaaagagctctgggcacagatcttcctttcatgctcgactgggtccaataatcccccgaggctcaggtctctgattgcatttccagatggtctcctctggtgtaaacaccacccgcgctctgtccaacagcataagctaccctggcagaaagcaaaacagcaggtcagggagccctgggaattacacagtgggtggcacctgttgccaaattttgacctctctcatcccctacgttatatacccatgatattttcaacttacccctttcctttggtatttgcagggcaaactctctagtttcttagaataaagccagcttcatccactccccttcctaatctccatatattcttcaaactggtgcttagatttcctggctatcttgcagatgaattctaatatctactagtcagtagaatgcatttgtgtacttacacacttattattcaacaaatgcctattgagtgtcagtcatttattcaacaaacatttgctgaatgtctaattaagtagcagatacagtgctagttacttgagctacaatgcggagacagggcctctttgaagagcttgtgtttcctctccatgaatgctagtctcatgctttccacgtaaaccctgcttttgggaatcaagaaaagttcacctccttcatgagacttcttggattaacctctctcagatctgagcaggttgtccttctagaattgtcttaatgcatacatttgcagtcccttgtaaccttgttagactgcttctttcatgtagatgttttaaatttttcatagtgtgttgtgtacttgttcaaacgcaaactccccaagagagattcacttctggcaccttcatttttgcttttcatttcccctaatacattgctggacacttaattggtgttcaataaacatggtgaattcatttaacaaaagttattttgcacctaccatgctcacggctacaaatggacagcattatcacagcaactggacattacatagcatgcggaatggcagatggacagaccatatctataatatacttgggtaaaattttgaatgtttattagaatttcatccactgtctcatgtcttatagctacaagttaatttccaaatttgaatatgtccatacttgtttattaaaaagctggggacgatactctgtgagggtttctaaggagcatttgataaggtgtaaaaccactatagtcttggattcttctcattgctgagcagaatgggatgtgtcctgcagcaggttgagtggctctatgtggttttatgaccatacgtaggaacctgcttcttctcttgaaatggctgttttgttttatggagattggctagactggcaggtgacaaggcaagaggtgggctggccacgagagccagctgagcagtgcgagttggtgtgattcagccatttgtcaccaccatattctgccatagatagatattttctattcgagaaagtggatcaaatttcactgtacaccactttctcactaggctagaaatacatgaatggtggggcatagttcactccaaatctgatccatctaaacttttctttctggtgagttgatctgttttgagattttacactttacataaaaatagtatagcagccactctttgccagtcacaaaccacctttagctgagagtattatcatatcaattgtttcaaggaaatgacaaatgagtagttaccaaaaaaagaatgaatgaatgaataaataaataaacacaagggaatgagttgttactagacagagaagaaaaagattgcttggcatgtcccaatttggttattgaaaatttttatttttgatgcagtgctcttcttttttccttccttccttccttccttccttccttccttccttccttccttccttccttccttccctccttccctccttccctccttccctccttctttccttctgtaacttaacacctatttgattttttgaaaacattttttattagatgcttagatcagctgggacaacttaaattgcaagctaccagaaatatcatattaaactaaccagtgaagatgacagtttggatcatggaggtagggttgatttcagctgaggtttgctttagcagttgcaacactgtgatcaagatctgccttctctccctccatttcaatctagtttcctggccttggctctattctcagcaggtcttgtcttcctgttcctaaattggccatgagcatctcattccttattctaatccaacagggattatacctgttggtatacctactcctcctacttcctcccttagtctgtgggggaaaaaaaaaagaaagaaaagaaaagaacttctgagcttcaatgtgattaggtcatatgcctatcactgaactgatccctgtggatagtgatgggattttgctgataagtctcagtctcagcccctcccccaataccaccatccactttacagctgtggcttcactcaacttcccttgaaacactgtatggagaggaatggatgcctaaatgacaacttgggtgtcattaccaagaaaaagggaactatatgcaagacagtcaaaaactaattaaatgtcctctctaaggtttcatttttaagatagcacagagtttgctgctgctcctcctctttcttcttttttttttttgagacagagtctcactctatcacccaggctggagtgcagtggcatgatcttggcttactgcaacatccgcctcctgagttcaagtgattctcctgcctcaccctcctgagcagctggtattacaggcacacaccaccatgcccggctaattttttttgtttttagtaaagagggggtttcaccatgttggccaggctggtcttcaacttttggcctcaagtgatctgcccccgttggcctcccaaagtgctgggattacaaatatgagccaccgtgcccagcccacattcttcttaaagggtttgagattttttttggaaattacagggcatatagctttgtgctttattcaaaatgtcatagagcttcaaacagttcttcctgagacagatgtaaaacaattttaagatttctgagaagtaatttatatatccttataatagtcataccatgtgaaacctggcctgctaataataagaagaaacatctggaactagtgacagggtcaattttgggtattctctctctatggagaggactagttcttctgagattgatgttggcagtttggaatcttttcccagtgggaaggaagacttagaagaggatagttgatattgcctctcctcccacaagcaagtttcatctttatcacagttccctatggctatgccattttgagatttgtatacaaaccctgtacattagtgagggactcactcagagaccacctagactccaatcagtatccagcctttaggagatggcttgacctgggcagcttccccagtgatggagtttacaaaggatgacaatgaccatattttaaatctgttgttactctcttgcaagactcctctttttctcttgcttgctcttcaccttagcacgtctgtacacacctgcctttggtataacttgaaagacagccctaattgaggcattcatctcatacaatccaagagtcaggaacacagcttttggaaggaatgcattgtggattcttcagatgtgatttaatgaatatccaactgtacttagggactaaaaagagcatttttaaatgagattttgctctgaattggaaagtaagttgaggtgggaaataagccagccattaaatgctctagttttttttttttttttttcttgagatggggtctcagtctcactctgttgcccaggctggagtgcagcagcatgatcatggctcactgcaacctccaactccccatgctcaggtgatcctcccacgtcagcctcccgagtagctggaactacaggcatgtgccactatgcccagtaaatttttcataatttgtagagacagagtttcgccatgttgtccaggctggtctcaaactcctggactcaagcagtctgcccaccaaagcctcccaaagtgctgggattacaggcatgagccatcgtgcccaaccatagattttttttttcataatggcagagaatggctgcaatttagggtctttcttaggttcttcctcatccatttcttgcagaaaatttagtactttgtatttctttcaataatttcaacaattttatcctgacttttcccagagcaaaaattaggatggggatgttagagcttcctttgagcaggctatcatcgcaatgaaatcttgaccttgccccttgtagttgcctattgctttataaaacttgttattgaaattgcaaacagtccaaattatatagtagtttctaatgtactttatcagggtgtcagtttttcttttgcaagtgttttgaggagatcagattgttaatgaacattctttgagaatctgaacctgagaactgtctctttaggatgaagttaccaaggacagatgcaaaatttgcaaagatacggtgttccagcctcctccaacaaaggttaacaaccacccgagaaccccagtgccacttacctaccacctcttacctttggaagcagattgcccagtgacggataagtgtggaaactgttcaaagattgggaaagaaaattgttagaaaaggcacatagagaagagtgggattgggggcaaaaggagaaggaggatagtcttctgtgtttttttgattggttaacttaaaatctcagctatttgtttacacaaaggctatgttgatgtccatattcaacagatacaggtatttggctcagaaaagcacatggttcccagaccatttgccaaatgtcctatccttgttcagctttggttattatgaatatccttctggaagcaactgacacctaacatgtctgaatcctctggacctgtagagttcttaccccggagtgattacaatttctgaaaagaacatccctgcaaaattagctttcaaaatacgtgcagataagcccatagaactgggaattcctccagggaattatatcctaagtagcctactacaatgcttgattccttgggcaccagtggttgctcaataggttttttaataataaaaactagaaggaaagaactattgttagctaaagttaccatgtaataattggcttgggtatgtccctgcttgtttgaattgcttaatgtctgttctttgcacagcagaaactcttgtgccacttcctgattagtcatcttggtcttctgtttcctgagctgtgctccatgatctcgtgtaaatatatacaatttgtgataaaatcatcttgctcattccatagcaggtataagtgggttaattctattgggaaacaagctcaaattttaacagaagtttttctttgcttcaagggaacgagtttcccaacagtgggaattttaagcattttggcaaatcaataggggagatattttcaaaccagcatgattctatttggctcaggtaaaagtaagcccttctggactggcttgcaggtgggttcttgagtcttggcttatttaaaaagctgctgcctgttcttaataaatgccatgatatgaggcaccatgaacaagctggatttaaacctgccctatcaataattttactcataagttcttggcaagtatgtttgttgtctgctgtctgcctgtcaaggttgtcagttagctaagcatcagccaaccacatgatgctgagtccccatgattaatctgacttggtaatactgttcatctatgtaaagaattggaaaaagtagatctcccttcatgcgtgtgcgcgcacgcgcgcacacacacacacacacacacacgcacaccaatttgtttaaaataaaaaaagattagacgaaagcataaaatcagccctctggtctgaagcaattaatctgtagaagatgctacatatgctgggtgtagtggctaatgcctgtaatctcagcagtttgggaagctgaggtggcaggatcacttgagctcaggagttcaagaccagcctgggcatcaacacaagaccttgtctctactaaaataattttctaagaatagctggatatggtggtgtatgcctgcagtccctgctgctctggaggctgaggtgagaggattgcttgagcccaggagactgaagcttcagtaggctatgatcacatcactacactccagtctgtgtaacaaaatgagatcctgtctcaaaaaatttaaaaaataaaatgaaaaagaagatgctacgtacattatacacatataaattagtaaccaaatggtttaacaacctcagtgattgtgttgttctgtagtttgatgacttttatcttgctccttctcattgccattgattgtaccaggttatttcctggagcatgttgtatatcaaggtttatgcaactgtacatttaacctttcagtgcctagctttccccttttcctatagaatcacaagaatttgaaggcaacacaatatgttttctatcttatagtctgaagttaatgcatattaatggcatgctgctattactagttaatactgatgccatgaggattagataatcattgtaaaaaatgtttaatagagcattttttacaatacttagtggatgccagtatactaaatcctttatatatgcttaggtcttttatttcccacaaatctgtgaactaggaattatgaacgcattttacaaaacaggactcgttgcataacttgccaagtcacacagctaatgaacaggagagtcagaacttgaactcagggttgcctgcctctaaagtcctccactaattctcattcattctgtaaaaatagaacatggcctctagaatctcgtcatttagaaaagaacagccttttggagattggttagctggtttgagaacatgtagtttgtttatctgtgtctttgactagtaataacgttcagcctcattaaatctagtaagctaaaaggaagcaggaaatggctgtagtatagacgcttgatatttcagcgatgataatgatggataataatgtgatttcacagcttgggttatcagacccaggtgagtggataagtggattcagattcattaaaatcaccgggcctagtttgtggccttcctttcacaaaccccttaggctgcatattaccctttaatagcatatttttcccattatagttgcccttgctattcatttcaaccacattacaagtataaacatgtacaagggagaggacagatgtccttcccttctgtattaactctcttgttgtatgaaataatgttatgtattaaattattgtctcagtttatagagtctgctagactgtgctgttcagtagaactttttgggatgatggaaatgttcaatgtctgtactgttcactaaggtagcaactagttacctgtgttagttgagcgagcacttgagatatggatgatgaaactaaagaacagatgtttaagtttatttaacccatctaaatttaaatgtaaatacccacatggctggtggctaccttattggacagcagagatttagaatagtaaagctgaatggaccttagagtacatgtaaggcaacacattctttttattttagaggaatgtaggactcagagcatgaaaaggagtaaaaccaagcctaggatcctggtctcttgacttctagttcataatttcttccactaaacttaaaattgttaaaaatgttactttgaactttagtatttgaagattatcgtggtaagactttgcttatatttacaaaagcattgtaacagaaaataaattttgaattacaactgtgactttatcatatttattttacattttatgattgctaaataggtcatatattgacgtctttacatatttgttgggagcaaaagagttgaaagtaaagttttcttcccatctatgttatttagccattgattcccctctccaaagggatcagtaatagtttctttgtgtatctttttaaacattcagatatattaagtatttaaaactgtgtattgttctctcatctttttaaacaactggtaggatatgtacactacacattcatatttttgcattaaacttatatgtggagatcttttgatgtgagtacacaaaaagggtactttaaaacagatacataagcttctattgcacgtaccaactgtagtttaatgcatccctatcgatgaatatttacttcctttccaaagttttctcttaaaagtaatgctgtagagaataactttggacacataactttcatgtgtgcaaatacattataagataattcctagaaatgaatgcactaggtcaaatagtatatacacattttaaattttgataaatattataaattgctctccatagagtcacagcattttatattctcactgacaatctgtaatctctatgccttcatcaacctagtgtgttaccaaactgatcaattcataccattctgacaggtggaataaaatctcagtgtagtttaaatgtacatttttaaaaattgtgaatgagctgggcatcttacatatatgtaagggccatttgtattttatttattgtgaaatatgtttgtatgctttgtccatttccatcagtttttaaaattgacttagaggagcttttatatataagacaaaatatgacatatatggtaaacaaaatgcaaacattttcttcagttgtttgcctttttcactttgtttttcatggtgtttgctatggagaaaatataaatttttacataaacagatatgccaatctttccttttatagcttctggttttttgagtcaaaaattgagagaccttcctcattctgagagtataaaatagtaattatttttaattttaattaatttatttttattgacacctaataattttgcatgtttatggtttaccatgtgatgtcctaatacatgtacatattgtgaaataatcaaatcatggtaattagcatatcaatcaccttaaacatttatcattcctttgttgtgagaacatccaaaattctctcttctggctgcttgttggcagtagtcaccttactgttcaacagagtactagaacttattcctttctatgtaactatatctgctgaccaacctcttcccatctcccactccctcctattctccctagtctctggtaactactgtcctactttcaacttctatgagatcagtttttctagattctacatgagtgagatcatgttgtatttttctttccatgactggtttatttcatttatcataatgtcctctagcctcattcacattgttgcaaatggcaggattttatcctttttgtggctgaatagtattccattgtgtatatgtactgtgttttctttatccattcatcccctgatggacacttaggtggattctgtatttcactattgaaaatactgctgcaataacatgagcatgcagatgtctcttctatatactgatttcctttcctttggatatatacccagtaatgggattgctggttcatatatttttaacattttgaggagcttccatactgttttccacaatggtagtactgatttacattcccacgagcagtgtataggagttccctttcctttacatcctcgccagcataataacgattttaatatatttggaatttattctaaagatgtaaagtatgactcagacatcatttattaagcaatccatctttttcccagttatttgagatcccacctttatcacataaaaattttaatatatctttgagtcaacatctcactttgtagtctcttccatggaatctgcctattcttgcctgtaccacctgttttaattattttagattttatagtgtactttaatatattgaagaactattctctcattgctgcatttcttttttaggctgttcttcaccactgttacttgtttatattttgtatgaaatttagattcagcttgtctatttcaaaaacaatttctgttggtatttttagtaggatcatattaaagttcaagattgatttagagactttcgaaaagcattgaatctttctatctgggaacatgatatgcctttccatttgtttaagcattcttttatgttttctgtcagtgtttaatggttttcctccaataacttttaccatctataatttagcttattcctacattgttcttttttatgtcttcaaaatgggccttttgcatgtatgcatcaaagctattgacttgtattgattaacttgggcctcttctaaattttttcactttagaaaaaaaatattttagcaattggttattttatgttttccaaagacctaaatataaatgtacaggtgatgaactgcactttttcctttgaaatttgtatgcctttactttctttctctgatataattgtattcactatttcctccagaactagttaaactagagtagaaatttttggcatttttttggttcctaatcaaagttggaaaaacagacttttcccttgaaatgtagtgctggcatttaggttgagatagaaatatttcattatatgtttttaatcaagaatggatttgaatttcatcaaatactgtttaaacatctatgataataatttgaggtctccataggtttattaatatcataaatgaactattttagccttataactttaaaagccttattcttttaaagttttattcattctcctcccattcttgttcactattcgttgcccattcttgttctatataaaaaccccagtggtccctgctgtgaattcaatgacatcttatttcttttccttaagtcagagcaaatgtgcacatcagaagagcaaagtgtcaagtaatgatagctggaaattgagccacaaataaacagaaaatattttcttcattgttatttgtgtgtatgcttgtgcttctttttttcaagggagtagaccactgttccacatgttccacagttgttttatggtggaatgctctagttatggaaaaggagaatggagtctagccgtataaagttactaaacctgcttggatatgagtcaagggtatcctttttgtgcccaaactagaaaacctttccccttctcatatttttgagcaaggtgttttatgttgcaaagtagcccactgtctcttttcaactgcataagcccaaataacattttatattccagtcagtcacaaaatgaaaacaggaaacgtctttgaagcaaggcaaaaatgtcagagtgtctaaaacatagaagtacttggtgaaacactttcagcgtcttagctctgcctctggctagtcatttccactcgctgggctcagtcaggtctttcattagtgaaacagaggtggctgagcacttcctgtgaaatcgcagggacaggattgtggccctctggagagggggccaggaggaaaaggaaccagacagctggttttcgggagccaccagatgggagcaaatttccaaggctgctgagaagaatggtctagaataacagaattgttttgtgaaggagccttcctaaaccaaatgttctgagcgtccccgcaagcagagcaaatgagcacatactgtgttcatggggaaaaggacaaatgactgtacaaatggagtaacaaacaatttacgaaaatgtatgtggcctaaatttagtatcaaggtgatgggcaaaatgacttacaccaatttgtgacggtcctgttgcaaattcaatgacaaagccagccagtctacctagtccatagtatccagcagatatatcagtggagatggcccgagtgcaggctgcttaaataagataaatcatctgtgaagaaggaaaaggtcaaatgtgctattctctgtctttttttttttttttttggtctgaattaaatggaaaccattacaatttcttccaagaaaataaaaatcagcacctacaataatgctgtctccttctgaccctgccaagtctgactgcattccacctggaccctgcctttgtctctcatgtttttatccaagaataagtaggctaccttgtagtaaacaggaaatcttactcttacctcgcactagttagttatgcgtggtacttgatccataatcttctgcccccatgtcatagaagataggtttttccaactctcagatggaaaatcactagtgcactacacacacacgcactcatgctcagaaatattttcacagatccatttttctctgtgtgacggaggttacataattatatcagtggatgtcctgcagtccagctggtatatgtagagcaactgcatgtttgtatcactctgttaggtgcagtgtaggacacaaataaagagagagaagggagagaacactgccgagtcattaggggcatgctttcagttcctatacagccaagtttttttttaggcttggcctatgcttttttcttagtttgggtttagtatgtattcattcattcatattgccatgtgtgttcaacaaatattttgggatgcctgctctgtgccagacattgtgctaggttagagggatgcaaagacaaattagaactccttttctcaaggagacttctggttattgtatttgtgataaagttttaaagttactatactttgcctgcctagaatgtagttggatctcaaaagaattactgagggttggaggtttgagtggcagaagagcaatgattgatgaaacagagttttgaaagatgagtggcctatttgtcatggaggtaggaatggggggtgggtgggcttctggagagacacagcagaagtgtagagaagaccatggtacttgtagggaacttctgtggtttagagtgagatggatcttgcaagagctcaggctggagactgagaaaatgctaagtcatggggggtcttacacaacattctagagaatttagactttcccctgtagacactgaggggccgtgaacagcatttgtacctctgcaagatttttctggcagagacatggaaaatggtttagaaggtgaagataaggagctcaattagtgggctatttaaagtgtgcaatccacagataaaaggcaaaaacaaaacctgaatcagaagagtataccagaaaagggtgccagcctattatatatggcaatttatgatttatttaacattgaaggaaaaaacaggccttcaaaaataataaaataagaaggtgctagctatttacccctataacttcaggtacaagaagaatatttttattttactgagctcctcaactgatttaaaaaattaatactcataccagattgtaaataattcaaggaatcatagccccttccttactttttttacatttgtaagatttaaagagtcatacacccagataacatcaggctgcagagttttagagaccaactccttcagtgatttttcaagatgagaatgttctccatgttctcctgcagaagcttctctgggagccccaatatgtacaagagacagaggtagaccactggctgtgccttccctcctcctcctccccattctactcagctctgaattgcagttgcatagtttgcaaacttaatgttgtcaaaccttgttattccataatgggggcatagttgtgcaaactggaagtgattgatttacccagggacagaagacttggttaatagtagaaaaggatccctaggttccctaattgttggacaattgctcttagcagttttggttaacctggtttttatctggcttctcagtagagatgattctttcataagatcacctgcacacaaccagctactcatatatttgcttatatgtgtcatatctgatttatgtacattttctgtagacaagcttgttttaggtcatgtacttattacttactaagtgtttgttttctccatacttggggatctaaattagtaagcaacaaactgacttggtgggttcaactcaataatatccaatgaagccatttcttcccattcctaaatcctaatttagctgtgggaagtttggatcaatggaaattaaactccatatatgccaacactatgggttgataacctcttccaagaatcattgcctgaccatcatgttccttctacctgaccactccttcctgcacttttatcacatattactctaagggatcatgtctaactttttgtcttcctcaattagactatttcttgaggccaggaaatgcatcattttatccatagcatctaactcaatatctaatgtgtaataaactcttaatagaaatttacttaataactagatagatagtttaagatatgcccttgatgtagtcaagaagacaaaatgtatgggtacatttccttcttgtgtctggttcctctttctgcattgtcagggcaagttttaccctctaatttcttgtggaccagcagctgtcttaattgacagtcccaccaaaccctggatttcataggatgtcccagacaatgagaaatggcttgaagatagaaaattgtctgtgtcttaaaataatcttctataaattatgcgtattaacacagatatgtagcaaactataaaggttattttgctctgaagaggaattcagaattagaacttggatgtagcaggacacctctgttctcattgccataaagaaaaaaaaaacaccttttatattgaatttcagtgaaccttgcagccagcatctgtcccattaattttcatatacgagaacaatgtggcatgattactcaccagcaacagaagtagcagttttataaatcttatgttgtagtggctggaagggacagggttgtgctctcattgtttccatattctttgtgaaattcacctttgcagggggtggtttgctctttctcttccagatgtgcacagaaatatgccatgtcactaaacgtcatgtggcttaacatttctccaattttcagctaatctactgagaaagtagtaattttttctgactagtggtggcctacttctcctataaggctgtcttttacaatgagggaagttggcctcactttatttataaaggtgcacctaaggctggtgctttctggttctggggctgcttaatccaccctctgtttcatttgatcctatagagtttgggggagggctgaacaacagtttcattgacgtgattcagattcaatttgctaagaacctgattgtgtttatgacattaataagaaacactttaagccttttaatacgaatccccagtcactctgcttcttccctttctactgatgatactttgtgatctacatagtttaaactttcattacacaaggaaacttctactaccacttgatgtgtgtgtgaataggctatggggaaaaaaaggttcatttttgtttgagttttttacttttcataggtcattgtcaatgtggtaagtatgctctttagtgggatgatccaacactagggcttcatattcaatatcatttacagaaatagtaaatgtcaataacagctaatgttcattgagtgctaatcttccaggtactgttcaaagagttttacctattatcaactcaattctcccaacagccatatgatgttgttactgttattatagataaagccacttaggcacaaagagattaagcaactagttcattgttacagagttggaaatggaaagccaggtcctaacccaaatgctctgttgcgcacttctctgctgtctgcaggtgggatgagaggtgggtgctgagctgcctcctgtggtgctgttttgaaacctgcccatcccaaagctaagggagtatcgctgtgctaaagggttcagtcagcagccttgccagttcggaatcccctagaaccaccctccatgcatgtcatgggcagctctctgagatttctggtgcctcttactggcttgttaagttggcagatttttctccccatttgcttccttcattataaaattcccatttccattttgcctctaggtagaagctcatggaactcaaatgggaaatgatgatggtggattttcctgctgaaaagatgtacctcaaaaggaaaaaatagtgtatttaacatggagaaatgaaatcctccgaagggagcttcatgaactaaattacccagaatggccttactgtctgttgtcagcatttttctgctgcccctttgagcatcagtttactcactcatgtgtgggtcagctctactcatctgtgaaggtagataataaaacctacccccaaaaggttgcagtgaagattaagtgatgtcatatttttaaaaatgcctctgtaggctctggtacattccaatggcttggtgaatttttttttttccttttccttttccaaagggaattaaaaaaaaatgagagtgagttttgaggatcctagagcaagtaatcccagcactttgggaggatcatgaggtcagaagttcaagaccagcctggccaacatggtgaaaccacatctctactaacaatacaaaaattagctggatgtggtggcgggtgcctgtagtcccagctacttgggaggctgaggcaggagaatcattcaaacccgggaggcggaggttgcagtgagctgagatcacgccattgcactccagcctgggcgacagggtgagactccgtctcaaataaataaataaataaataaataaataaataaataaaacagcaaagcttctatgaattctccttttagcccttcatataagtctattcttcaggagccagtttatattttatggttagatacacatattaaattattggtatgtcagatatgattctattagtagtctccagggttcatagcttgttagggaaaatcctcctaaaaagaagttctttttgtctattcttcattaacttatttcacttgtaaagcattaaaatgggtcctctttacatattatgttgttttctaagggacaaatactagtggttattattacagttctttttttcatgtttggtacttcagtggttgattaactgtttcttaatcctgaaatgtggaggaggtttttgcaagtggttgtagcctggttttgaatgaaggtgaaaatgctctttttgttagctctagatcagcagaggtgaataagcatcatgaatttaggagactggcgtttttttttacataaaagttgctttgttgctaattagtagattagaattcctttaattgcattctgaccaaagacttttgggtgttcaggagggcaagttagcatgtgttgcatttgaatttatacatttgagacacattttcttactgaagctgatattcatgaagcagaaaagataaaaacttgtacatacctttttatttcttgattttaatgttgaagttctattctcagaatggattttataggcaacaatatgcacttaaatttatgatctgtttacgagacctcactgtattttgacagaggtcaaaataagggaaatcaatcttggttctcattccaaagagttttttttcctgatatcttaaaaaggctttattacattatgttgatatccatggcagagagttccaaagacatccccatgaaagggctataaatgtgaggtttgaaaccaaggcaagtcaagcagggtaagcaatcttttcacccaaggttttaaaataactgctgataagaccttctcacagattttcattcatttcttcctagttataggcaggaaattctgaaagcaggtgaattctaaaattaccttataacttgatttcagaatatagttacacaaagtgagaataactcgatgaggatgctgtttggatcttgagtactgtaagtcctgtggtttaattgacgagttgatggatttcttttatgcctaaattcaggctgaaaggcctaaaggccacacgaggcagtttatcacgagcgctattctccgtttttatattctggttcattaccagccccttcctcagtacttctatttatataatgttgttctggtcaaggtttatactaaatctcttttaacttcaacatccaacaaatatttttaaggactaatgtgtgcaaaacattatgctaggtgtttcctaaggcttcaaataacttggatgccagttttggactgtaagtgctcacaggataatagaaaaatcttgtttgcaaataactggaacataatgtacaatggaatgtgtcataaggggagtgcacacaatgctgtaggaattccaatgaaattcaccctcatctttcattgtattccctgttatttacctctccttaaaagaaagaactataagaactctacatcttttagtggcgatttcctagatagaaaaataatgaatattaaacatgatgtgttaggattggtgaggctgaagaaattctatgcattttgtcatttagtgaatatgtattgactgcctgcctattcagtgtcaagcactataggtggtaatgtatcaagaggttcatgaactaataataaaggggcacctctgtatttcacaaatatttgctgaatgaatgaactcattatattttattctcctatgtgattcctagataagttctgctacctaaaggaaagcacttatggaatccaaggtttggaaagggcttgaaagatcacattaataggtttcccttttatttgcctttttgaatctcaatatggaataactttgacttatccatactaaattgcatctcattggtgttacacaatctttccagtttttcaagattatttttaacttatgccaacaacatattaaatatcctttccatctatgggacccattccattttctaagtttacctaagactttaaaagacattaagccatcagagccaaaaacagagtttctctacttccatgttgatattctccttaatctacacttccattcattcaataaatatttactttcagggtgttcggatgagctatgggttacatagtgatgaattcagcagacatagcttctgccctcatgaagcttacagcctacaactacagaggatggggctgttgaagcagctaaaaaaccctaccttttctactattgagcaataaaagaaatgtttttcttgaatttctgagatcatttcttgccagtctttgctcatgtcactacctggaataaactcccttttatcatattgggttatcaacatcttatacattcacaaaagaccacataaatgttaccagctgcaaaaatcttattcatgtctgtgaaatccattaacatgtggcaccacttgagttgggctcatcacttgctgatttctgctgtcattatttgtgaatgtctaatttcactgtaagctcatactgtcctttcaaacatgaatgaggcctttaacattgttgtatcaatccataacattgaacataataccctgtttgaggaggcatgactatagaccctttctgtccaataataaagatgttggtaagagtaaataaaaggtctcatttcttgataaactggttagaatcaaggaggtctgagcatgacactagggttcctaaatactttcattctagacacataaaacctctagaagattaaattcagacaattttaaactttagatacacattacaacacaaagaaatgcactattataaattttaatgggggaaggccggtaattcaggaaactgtcagatctgaataatgaaataccagatagttcttatctatttacatactctgtgatttctaacactctgaacaataatatttcagggttctaaatattggttagatttttaaagttttcgaaattatataactagatgactgctctcaaaattaggccggtattttggattacacagagtgcctaaaagtgcatttttcctcctgaaggggaaagccatgtgcctagccaatattttcattccctaaggatccatggaattatgatagcttaccctcatcagtcacccaggctcccattggtgtgaattgggcaatgctgtttacatagcaaatacacttccttttatacaagggtccacaacccctgggccatggaccagtatcagttcacggtctgttaggaactgggtcacgcagcaggaggcgagctgcaggtgagtgagcaaagcttcttctgtacctacagccactctccattacttgcatcaccatctgagccctgcttcctgtcagatcagcagcagcagcaaattctcatagaagcatgaaccctattatgaactgcacatgcaagggatctaggttgcacattccttatgagaatctaattgctgatgatctgtcactgtctcccatcacccccagatgggaccaactagttgcaggaaaacaagctcagggctcccactgattctacattacggtgagttgtacaatcacttcattatatatcacaatgtaataataatataattgaagtgcataatatacataatgcacttaaatcatctccaaaccatcccccactgccaccctggagcatggaaaaattatcttccacgaaacagatccctatgccaaaaagttggggattgcagctttaatagactcagaggcatagtcttagagtgtaacaaatgcacaaaccttttcttttaaaacagactccagagggattgaagagagggaaccagtgataatctatatgcccatttcatggcagacatgctgctgtgtgctttccatgcattatatcattcatccaacaggcatctaaagaatatagagtcaagaacagttaagccattgccacaagatcacctagctagtaaatggctcaaactcagtgactcaaacccaggatttccaaccttaaataaggctctcactcccacaccgcacagctgcatatctgagtgtttatcagtgaattacattgatgtaaattcatttatgaaaatgtcaagatatcgtgagcactagtgcttttaggagagaatatttaactcatttcagacaacatatattaacttcatcaaaagtttgcctgttataaacctgtgactcactcttggtcaccatgatggtgcaacagctgtccactggacaaatactaaataatattttatccttgccccctatttcttatgagaaagccacaatgaacttccttttgtctctcatttcacccttaaagggacaaatagcattgcattatccttgaaagggtcttctgctgacccatctttgacgcttccatcacagggtgacgatgggatgtttgctgtatcacacttccctgtgctttcatgaatgtgttactggtgatgaagaatgccaattctttgtttagtagcagtttgctgggtctccctgaaaataatgtgtcagttaggctacctataaatctgagtcagtaatgtacttctctaaggtatatttatgttttgaatttgtctctgagcaatctgttggggggaaattttgctttaatatgttttataaaaaggtgagaaagtaataaagtgtaatgaagataagataaattttctaataaaataaaatatagaagtgttcaaaatttttgctttccccatatgactttgttttttccccaaatgttaccctcataacaggtgggttctgtctcttgatgggtatcaacacagtgaccacaaccgaggaggatttagcaagggaatcttactacttgtaacaaataagggaaacaccaggagcaattcccaaagcagtatctctccaagctggggggcagtcagattttataagtgtagggtaataaggtgtgatctgattggattctgcaatgaggtgttgtcagaaggcataatctgactggattttgccatgggatgatggcagagctcaatctgtttggatcctggatcctgccattgttgtgtctgcttttaattcagtccctactccttggtcagagcacttaggttccccctgtggttgcactcttggttcttccgcacatggtcaggttatgtgacctgagggtccatggcaactgaaaaacaagaggaactttgttacataaaaaattgaaccagatttgcctggcatggctacacaaatggatgtctctgttcagccttatttatccacagtttttcctcctgctgatccctttttcttgcctgtcctccctgcctgctcacttgctttctggcctctcttgcctctcttcttagccagagctgtatagggatttagttcagtgtttcctccttcattgtcattggacaatattcactcatcagctccaggtcacctccctgtcctcacctgtgaccagtcttccttccaggttcattgccattttcaaagtgagtctgcactctctcaccacccgtttgcttatcacccactctctatgtgattacttgtgatttgacatctgcccatgctactacaatgaaatggctttctcagagactatcatatgtctctattgacaaaaccggattagtgctgcttattttctgcagtatttactgttgttggacaccgcttccttcaactttctcctctcttggttccagggcactatactaactttggtggccatatactcagtgcctccttatacatgagtggaagtaaggggttcagaatgaaatgattcagtcagtctcataaagagataggacatctgtggagattaaagttctcagagttagtagtctcattgctttattccacatgatgttgacaaagaagtagaaagggaaagccaaatccttcaatctatattgctaattaaaaaatgattttcttttcttctttttagtaaatgtttgatggtgtcttgggagtagccttagtagcaaaaggaaatatttatgcatgtctttgggaaaatgtctttccattttctgtggttattgtatctgtaaaaattggacaccatttcttaaaaggattatgtgaaaattttatgatgcctggttggtgaaaggcagagtgtcctgaaatatctaaaatgtagaatcatattctttctattgttttgatataattagaagtgtcgattttaaaattacactgaaaggcattttatttttaacattgttttattaggtgagtgcaaaagtaattgcagtttttgcattgttgaaatttgccatttgatatgggaatacattcttatttttaattaattaatttattattattatactttaagttttagggtacatgtgcacaatgttcaggttagttacatatgtatacatgtgccatgctggtgcgctgcacccactaactcgtcatctagcattaggtatatctcccaatgccatccctcccccctccccccaccccacaacagtccccagagtgtgatgttccccttcctgtgtccatgtgttctcattgttcaattcccacctatgagtgagaatatgcagtgtctggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttacagtcctttgggtatatacccagtaatgggatggctgggtcaaatggtatttctagttctagatccctgaggaatcgccacaccaacttccacaatggttgaactagtttacagtcccaccaacagtgtaaaattgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcacgtcctacgcccacttcttgatggggttgtttgtttttttcttgtaaatttgtttgagttcattgtagattctggatattagccctatgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggttttcatggctttaggtctaacatttaagtctttaatccatcttggattgatttttgtataaggtgtaaggaagggatccagtttcagctttctacatatggctagccagttttcccagcaccatttattaaatagagaatcctttccccattgcttgtttttcctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgtgatgcctccagctttgttcttttggctcaggattgacttggcgatgcgggctcttttttggttccatatgaactttaaagtagtttttttcaattctgtgaagaaagtcattgatagcttgatggggatgtcattgaatctgtacattaccttaggcagtaaggtcattttcacgatattgattcttcctacccatgagcatggaatgttcttccatttgtttgtatcctcttttatttccttgagcagtggtttgtagttctccttgaataggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacgatggggttttctagatatacaatcatgtcatctgcaaacagggacaatttgacttcctcttttcctaattgaataccctttatttccttctcctgcctaattgccctggccagaacttccaacactatgttgaatagtagtggtgagagagggcatccctgtcttgtgccagttttcaaagggaatgcttccagtttttgcccattcagtatgatattggctgtgggtttgtcatagatagctcttattattttgaaatatgtcccatcgatacctaatttgttgagagtttttagcatgaagagttgttgaattttgtcaaaggccttttctgcatctattgagataatcatgtggtatttgtctttggctctgtttttatgctggattacatttattgatttgcgtgtattgaaccagccttgcatcccagggatgaagcccacttgatcatggtggataagctttttgatgtgctgctggatttggtttgccagtattttattgaggatttttgcatcaatgttcatcaaggatattggtctaaaattctctttttttgttgtgtctctgcccggctttggtatcaggatgatgctggcctcataaaatgagttagagaggattccctctttttctattgattggaatagtttcagaaggaatggtaccagttcctccttgtacctctggtagaattcggctgtgaatccatctggtcctggactctttttggttggtaagctattgattactgccacaatttcagatcctgttattggtctactcagagattcaacttcttcctggtttagtcttgggagagtgtatgtgtccagaaatttatccatttcttctagatttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattaattttttgaagggttttttgtgtctctatttccttcagttcttctctgatcttagttatttcttgccttctgctagcttttgaatgtgtttgctcttgcttttctagttcctttaattgtgatgttagggtgttaattttggatctttcctcctttctcttgtgggcatttagtgctataaatttccctctacacactgctttgaatgcatcccagagattctggtatgttgtgtctttgttctcgttggtttcaaagaacatctttatttctgccttcgtttcgttatgtacccagtagtcattcaggagcaggttgttcagtttccatgtagctgagcggttttgagtgagattcttaatcctgagttctagtttgattgcactgtgatctgagagatagtttgttataatttctgttcttttacatttgctgaggagagctttacctccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttaacagtggggtgttaaagtctcccattaacaatgtgtgggagtctaagtctctttgtaggtcactcaggacttgcattatgaatctgggggctcctgtattgggtgcatatatgtttaggatagttagctcttcttgttgaattgatccctttaccattatgtaatggccttctttgtctcttttgatctttgttggtttaaagtctgttttatcagagactaggattgcaacccctgcctttttttgtttcccatttgcttggtagatcttcctccatccttttattttgagcctatgtgtgtctctgcacgtgagatgggtttcctgaatacagcacactgatgggtcttgactttttatccagtttgccagtctgtgtcttttaattggagcatttagtccatttacatttaaagttaatattgttatgtgtgaatttgatcctgtccttatgatgttagctggttattttgctccttagttgatgcagtttcttcctagtatcgatggtctttacattttggcatgattttgcagcggctggtaccggttgttccttttcatgtttagcgcttccttcaggagctcttttagggcaggcctggtggtgacaaaatctctcagcatttgcttgtctgtaaagtgttttatttctccttcacttatgaagcttagtttggctggatatgaaattctgggttgaaaattcttttctttaagaatgttgaatattggcccccactctcttctggcttgtagagtttctgccgagagatctgctgttagtctgatgggcttccctttgagggtaacccgacctttctctctggctgcccttaacattttttccttcatttcaactttggtgaatctgacaattatgtgtcttggagttgctcttctggaggagtatctttgtggcgttctctgtatttcctgaatctgaatgttggcctgccttgctagattggggaagttctcctggataatatcctgcagagtattttccaacttggttccattctccccgtcactttcaggtacaccaatcagacatagatttggtcttttcacatagtcccatatttcttggaggctttgctcatttctttttattcttttttctctaaacttcccttcttgcttcatttcattcatttcatcttccatcgctgataccctttcttccagttgattgcattggctcttgaggcttctgcattcttcacgtagttctcgagccttggtttttagctccatcagctcctttaagcacttctctgtattggttattctagttatacattcttctaaatgtttttcaatgttttcaacttctttgcctttgatttgaatgtcctcccgtagctcggagtaatttgattgtctgaagccttcttctctccgctcgtcaaagtcattctccatccagctttgttccgttgctggtgaggaactgcgttcctttggaggaggagagtcgctctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcacttctgttggagtacccggccgtgtgaggtgtcagtctgcccctgctgggggatgcctcccagttaggctgctcgggggtcaggtgtcagggacccacttgaggaggcagtctgcccattctcagatctccagctgcgtgctgggagaaccactgctctcttcaaagctgtcagacagggacatttaagtctgcagaggtaactgctgtctttttgtttgtctgtgccctgcccccagaggtggagcctacagaggcaggcaggcctccttgagctgtggtgggctccacccagttccagcttcccccctgctttgtttacctaagcaagcctgggcaatggcgggcgcccctcccccagcctgctgccgccttgcagtttgatctcagactgctgtgctagcaatcagcaagactccgtgggtgtaggaccctctgagccaggtgcgggatataatctcctgatgcgctgttttttaagccggttggaaaagcgcagtattcaggtgggagtgacccgattttccaggtgccgtctgtcacccctttctttgactaggaaagggaactccctgaccccttgggcttcccgagtgaggcaatgcctcgccctgctttggctcgcgcagggtatgcgcacccactgacctgcgcccactgtctggcactccctagtgagatgaacccggtacctcagatggaaatgcagaaatcacccgtcttctgcgtcgctcacactgggagctgtagaccagagctgttcctattcggccatcttggcttcaagagcgggaatacattcttacatgtggttatgttatacatcattttaataggtatttctcacttgtttttgctaatgacttactacttgctgtttattttatttttattttagactatgaaagtgatgttagataaaaagcaaattcaagcaatttccttattgtagttcaaaatgggtcataaagcaatggaggcaactcacaacatcaacaacaaatttggcccaggaactaacgaacatacagtgtagtggtgattcaagaagttttgcaaaggagatgagagccttgaagatgaggagtgtagtggctggctcttggaagttgacaacaaccagttgagagcaatcttgaagcttatcctcttaaaactacaagtgaagggccaggcatggtggctcacgcctgtaatcccagcactttgggaggccgaggcgggcagatcatgaggtcaggagatcgagatcatcctggctaacacagtgaaaccctgtctgtactaaaaatataaaaaattagtcgggcatggtggcaggcgcctgtagtcccagctactcgggaggctgaggcaggagaatggcgtgaaactgggaggtggagcttgcaatgagctgagatggcgccactgcactccatcctgggcaacagagtgagactccgtctcaaaaaaaaaaaaacaagtgaagttgccgaagaactcaacgttgaccattctatgatcgttcgacatttgaagaaaattggaaaggtgaaaaagcttgataagtggatgcctcatgagctgagagaaaattaaaaaatcattattttgaagggtggttttctcttattctgtgcagcaacaacaacaaacaatttctcaatcagattgttacttgtgaggaaaagtggattttatatgacaactggtgatgaccagctcagtggttggaccaagaagaagctccaaagaacttcccaaagccaaacttacaccaaaaaaatgttcatggtcactgcttggtggtctgctgctggtctgatccactacagctttctgaatcctggctgaacaattacatctgggaaggatgttcagcaaatcagtgcgatgtagtgaaaactgcaacacctgcagccagcattgttcaacagaaggggctcaattctccaggacaacgcccgactgcatgttgcacaaccaacacttcagaagttgaatgcattgggttacgaagttttgcctcatttgccatattcacctgatctctcgcgaactgactcccacttcctcaagcatcttgataacttactgcagggaaaatgcttccacaaccagcaggatgcaggaaatactttccaggagttcatcaaatcctgaagtatagatttttatgctacagaaataaacaaacttatttctcattggcaaaaaagtgttgattgtaacggttcttattttgattaataaagatgtgtttgaccctagttataaaatgatttaaaattcatgatctaaaaccgcaattacttttgcatcaaccttaatatttgaaaattagtaaaattgcaaaaagaaagcccttattagctgttaataaatataaaatatataaaatgtgtgtgtgttaaactaagtgccttgagtatatgaagctatgaaaatgaagacaacagccttactaacattccatctcattattgttataactcctggttccatcataatcttgtttttccatcccaacagaatctgaggtgcagtcatttttgtgaagctgttattttcatcacaatgtgatctatacctaatgattacattacctgtacatctgaagctcgttcgtaaaccatcgtcccctgagagtatacctaacataggaaatactatatatatttggccgctgaagtgctataatgatgccctaaattacatatccctttctacagacataatttgctttattaaaaataacttctgcataactattgaagaataaaacagccacttatgcacaaggtgagggatatctgcatatctgagctagacaaaaagtatgtttgataatctattgtatgttttgctacaaaagcaaagtggttccttatgattggctgaaactctttgagttcttgttctatctttcagcaaatgaagatgctaattgtctttattctagccttttataacattaccttggctcttcaaagtcaaatggaacctggaaaatcgaacttaattccattttacatttttcccttgaccatttcccatggtggggaggtatgtgtctagatttggaaaataagcctgcttagttttttttcccagctcagtgcttagaaacaaccccctctagcaaaaccatgcctaggaaaacaaagtatccagctaggctttcaaggttacttgggggcaagacatggatagttacgtccttggaggaaaataaatacaaggcagtagatccaaatgtatttgtcatgcaaagaacattagctgagagagagcttccatatataggtttgcaaaactgagagcaaagccaaagccattcctgggttttgctttgtgatatagtctccaaatggatactattatgattaatctattctgagttccttaaatgctattgtaacaatgtcaggggccaagttcaagtctaaagtacgtgtatgatgatcatagctgctataatactcataatgctgaagacatagtaacaacaatttataataggagagcagttttgtgcagcaaaatagttccgtggagcagaattagatcatgaaaatgttgcatggtgggcatttagtcgtgaaagtataaatctgtacctaatgattgatgtgaatcaggtttcaaacctattagatgtgccatttaaccaggcaacatttgcccattatttttttgcatgaaaagtaattaccgtatgtttaatagttactgaattgtgactggcaggtgtgccccaccataataataatgatgacaataataatatcttcaacttcaactcactctccacaagtcagggcaaagagagaataaacaatgattatttggcgtgtttgaataatataaaagccagtctaggtaatttaaggcaaagatcactttcaaaagccagatttatatatttttccctcctccattcaaataattgtctcagagtcccatttcaacttattttaatagttacttcctgcatatctgtgatgggttctcaaaaactttcaaaaccactttcacatattccgttacttagcccttaacaacagtgtcgaatagggtaggagagaaacattgttccctgtttttcatttagaaagccgagattcagagaggttaaatgactgtttctactccacaaaaagaaagaaatcagttgaattttctctgataaacctgccaacgttagtgatacgaaagtgaccacaccgatagagtggtgtcactgtcaatattattctgttggcaaacatattgtatctggaagtcaagggcaagaaaagaaagttagaaattgctgagataagggctgtgctaccgaaaaaacactgaaagggtgccccagctagggtctcaaacctatacctctccccttcagcctggtacttcaatactgagtagattatggtgcccattttgagggaaggctagtgttatctcattcagattaagttttgtgttggtgtgacacagatgggtttatataattaatgtcatgtcctagagggctgtgaacattcctacacttgaggcagtgttcaaaatctattactgtttttttttaattaaaaaagaatttgttttctttttcccctagatggaacttaaactcattgtatatgattgaagaggaacaaggagaaggagaaggagagaaacaacatacaataaagttgtccaccaattgtcccaggaaaatttgtttctcacataggggtcatcacaactgctgcattgcagtcagctggaagtataatcttccatgaatctgaagatgtgatgaaagatagtaggcacaggcaaagcctagctttaagaaaaacataaaatgaggactttgagaccctagggcctctttccttcttcttccccttgataggcaaaggcttttttccaaatcatctttgtaagaagtcccagacccacaatgaactattgaaataccatgatccagtaatgtcatcttcttctgctattaatatggtaatcattttaggtgatagatttcaccttcaacagttcttgaagaacattcagacagttcaccctgaaatgggtgaaaaaaaatcaggtacctcctatttcataaggatgtgagccaggatgaagcagtatgttatcaggcttggcatttcgcaagctgagtagagtccatgtgatcaccaggtataatgttatgctggagttgggtttcatctcttgcttgggtttggaatgtaaacaatcttgaaattgtatttggagagaaggaaaccctgggaaatgtttatttttaaaaaacatggattttttacaaaagcaaatacatgttctaatttacatcagggagcagatacctctttacttttttgagatttttctgagacattaaccttaagttatcacttgtgtgtatcaggagaaaagttgggagagtgggagagatgggtaaggaaacatttttaaatgtacttaaatctcccatgatttatttcaagctgtaaagcatttctaaaactcgagtttgttaattatcccaaggaaaaagaagagaggaaaatagtcaatctgatagactggtgacattccatgtagcctgatactaagttgtgacaaaatatctaacattcggccattgtttttgatatttgtactttttcttgtaaactatttgctctgggacaaaaagtcattggttttgaacttgatttgggcaactaaatgatatacttaaccacctgctttagcccgaccatgactttttaatgacttccattttatttggttttggaaattgatttgccctttaaaaataatatcagcatttaaagtaattttgcttgttttttgtttgtgtagtagctaaatatgctaagagaatgacttcaaatatgcagcctttatgaagatgtgaaaattgctgtgctctagctacaaatggcaattccgataacaagagcttgaatgtggccttgaggcaagggaaaaacagaaaaagtccactgaaagtcaactttgtccccttaatttgcaggcactgtggggagcagggaatactccatgggcacaggcatcctcccgagccatattggttgtagtgttgtctattatatctgcacagttcctcctttgattctttctatgaatcatgtgttagcaacccaagtagctgccattagctccagccatatgggtgaaggtaggggtagaggttgcagagcttaaacataggtatccagaaatcattggctcttcccatttcctgactgattctccaactatcaatctgcttgtaagcacattcacaccactcagtgcccctggtacataaaacaagagcagtgactgaaataagctctcaaactagcaaactgaacaagctatacaagacttcttggatattgaaaatactaaacattctcatagctatagaattaattatttggaagatattggcaagtaccttttcatgtctacagtgtccatctattaaatgggaactactactctgaaagtagcagtaagttttattaggggaagggggagaatcatcacaatcatctaaaactgttttgtttaatgttacctgccaagatatgtgtctaagaggctgctgtggctcccaccagccctgacctctgcacatcactgaacctgtatcctactgttaatgatacatatgtcatatttacaaatgcctcatgtgtctcagggtggtaaaaatgtttctattcaagaatggcaactaaaaacacccataggtccatcatattggattaaccacttatatccagctacctgaaactactggcactactcagaaaataaattttcttttaccatcttgcccacttaccgttctcagaaagtcctgcctttcctttcccttctttatccaattaacccaacttttagctcttacatcaaatcttctggaaagccttctagacatttctctcccttcctctctgccattatttctttttcaggataggttagatattatactgggcgctctcatagcttcatgggcatacccatgtcaaagtagccagcaatcgctattctaagaaacttgtctgaatttgtaattggattgtaaatatcttgagtgcaagatcttcaacttgtatagttgtatttccaattttcaacatatgttgagtgaatgtattctaaatataatattaagcatggcctatacctggtaatataaacatggaaatagaatgattatttaatttgtcatgtctgtgaaggacccttgatggtatctagtcttaaccctcaacttacagttgaggaagctgaggaccatagtgtattcattcattttttgtttattaattcatgaattcattcatgcaacacattgcattgagcatccatgtgtgcttggcactgagctagccactgaccaggtaatgctaagtagagcagaacaaaagacatggtccttccctcatagagcttacctcttagtgcagtagagacacagtaatccaatcatcacacaagacatttatactcaccaactgtgctaactggggactatggcagccaactgatgtgaagatttggcttaatggcaggagtcaggaagcctttcctccaaggtgtggtgtttgaactgaaatctgaagaaccagcagaagagcacaaggagggaaaggagtttgccaggcccaggccagtgggtttgaagccttgaggcaggggggaatgaggtgcattcaagaaactgaaaggcggaaagtgcaggagcagaagaatgagggactcaagaagaaagaggcagtacaaaataagaatgaaagatggtcaggggccagttctgtaggacctgtagccatttaaaaatgtttagttattaacttagaacagtgagagcactgaaatgtgtgagggtcagaagaactgggaggtggcctgataacacatgcattttgaagaatctctgctgcagtgtagagagcagattggtggacaattgatggactgagcagataggtgagaggtagccctactgggaagaatatgctgaagtgtgtgcaagagattttggcagcctggagagtagagagcaccactgacctctctgttttttctaactttctcaaaaatgctacgttcacctacatcttatcaaagaaggcctttatttacctatacttctagcatgctttgctttagattttcccatttctcaggtaagggcacagaggctaacgaacgctcctttcctggggccaaagcgttttcagtttgggcatctcagtaacttttggcaccactgctggctttaaggagcctgttatgtagtctatggtggatctgaataccaggcagacagatgacatttttataaatagtgtgaggaaaccccagaagtaatgtgaatggatgagagttcaagaccactgctgacctggaaagccaatgactgaggcaccagaggaagtaggctctcagagggaagacagaacaccccctttccagctcattgagagtgaagcaggtgcttttctgaagcaggtgatattctgaagatccacctcctcagaacaagtgttctgaagtttctctgaaatgcagagaatctaccatatgatatggttttgctgtgttcccacccaagtctcatcttgaattgtacttcccataatctccatgtgtcatgggagagaccttgtaggaggtaatttcatcatggggggcagttacctccatgctgttcttgtgatagtgagtgagttatcatgacatctgatggttttttataacagggttttcctcctttgctcggcacttcttcctgccgccatgtgaagaaagatgtgtttgctcccccttctgccacaattgtaagtttcctgaggcctctctagccctgtggaactgtgagtcaattaaacctctttccattataaattacccagtctcaggtatttcttcatagtagcatgagagcagactaatacaccatctgtaagaaacttggaaaaatgatttgtttagagttccatctgagcagtcatattattagtaagatatatatgtcgggaaaagaaatttacttcttatgactttttacattttgagatcttattgtttgatgctccacgttgagggagccatatttctccacctggtcaccaggctcattaggagggacagatgtggcctcacatttcatgtgcggttcttgtctcagcccttctttttctcaaagattcctgccttttgtctacttttctcaaagtgccatcttccttctctcaggctcttttgggattacccaaccaccattgtaggcaactctagttctataggcaactctagttctataggtaactctagttcagtatcatgactttcatggtttctataaaaattgccatcccacagccttcttcacatctgtgacaggcagttgagaggggactgaggaaaagtattgcccatacatggaatttgtggagactcaatcaatgttacttggattgagtaataaaggaagttatttgtctaagtttgggcagcaagagaatggcagggacagaaccaaaagcagtttttaaacgataatctttttttatttttttactattaaatacagcttgggggcaaagaagagggatacaatttgttgactttcattgctacatttttggacaaggaaagagaaacagagactcaggactgtttagaagtccaaatgctatttatttccccatactacaatggctgttgaaaattctcctataatatgctacaaatacaagtgtattagagagtttattgtgtatatttttgaacatagtgtaatttcttgtatgatgttaatacagttcttgttcttattctctgtaagagcttgtgttgctgttatctctagataggagcaaacttcataaaatgtagaattccctctgcatgcatagggaagtagcttttaaaatattagcctattccattgtttagttataaagtaaaatgattttttaaagtgcaggataagtgaatttttatgtttcatttttagttattgaattgtctaggtaatgcattttaggagggcactgttcctcccagaacttaggaaagcagtcattcaatcactcagtaatttttagggatttttaaaatagatataacaattttaggatgtcaagttttagatgtctagttttaacttgtttggttgagctgacatttaagttcagtcccaatgtgatgtgaatggacctagccttttacctcttctttttttcctcttcattggaaaccagtacagagaacatggtcacttaataagaaagatgtttcctgctttgtttccttttattcaactcagaactgcctgggggaaaagattgcttcctttctgaatgtggtaagccacaaaatggaaaatgtgcacacgagctctttcctattaaccttggggaaaggtgacagaaatgtgtgaacaatgctgttagctgtttaaatgttcttttattattattaatttggtttaagggttttgcctaacaagtaactcccttgatttgtatgtttcagagttgtttaatttttctccaaaataacaatttgtccttttgaaattctttgttagatttatgtcattccagtttcaatcttggtgatgattcttctatctgtcatgagtggtttaatctgcatgtttataattatagcatataaagccacataattcaaggtgggtcttggtatataattcctttgtactttttgggaaaataaggctgtaatggaagtaataaagatacctgagttgggaatgtttaggtatcaccaaatattagctgttcagaaaaatatccatgataaattagaaactgaaatcagcacatttttctggtttcggttcttttggggaaacactgttattttttaattcctggcttaagaattgtatttgattatgcgaagacaaatccaaaattttaaattctaatccaagaccttagataaattagggaattagggaatctgtgtatgtattttataaccatatcaccatatattgacatacctatgtcactgaaggtatattgtaaaagataatttggccaactgtattggaccaactgctcttgaactctctaagtacaattggtttaagatattgcctgaaatgactattttgcttatggtgtcattctttcatggtcaagatgacagttctctaggaatgttatttcatttctagaatgtcagccaaacagctttttatgatcctgagcagttatactctaccatcccaaacacacacacacacacatacatcttacacacacacacacacacacacacacacacacacacacacacacacaaataagccctgagaattttcagagaaattcatggtggaagatctgagattagaacccaggaactcctaagattccttggttttgtatcaaaggtcaataaagagacatgaagtcaatgaagtcaacaactgagggaaacatccctgaggaaatgcataatggaagtgctggtgtaactacctcaaataaatatttctactgaaactgatcagtcatccatttgatcaggtaaggcaggcaagcccacctctgattgcgtagtaattcactgatcattatcctgatttcagtggatctatgccatactcaagacctacatttgtcagtgacctgattgtcttattgccctacacagacatataatcagtccagcctgtgtgaaactccttgtgacccttatcatcatacttaagctgttttggtctttcaaatgtattcgctcttctttaccattttgaagccatcactctttcaccactgccagctagtcttagtaatctttcaccgtgcactgtctgttgcctcactgaatcctcacagtcattctatggcataggtaatatgattgtcattgacattatgttcataagggatccaaggttcagagggattgtattgttcagggttgcacagctaatttctagtaaagccaggaatcaacttgcgtctatatgattccatggtctatgcacttagctgtgatgtatgcgttctatctcaagtgatcacctctaaaatcaggatcagttcacagatatttgtgagtctctcaagagaactagggaaacttctgtaaagttagctaatggctttttaatgttatgtggtaattgtggtgaagcaattgtcaattccagttaaattagcttaaaatgataagagcaaacacatatctttgatgataaggctgggatagaggttaatgtctcatcaattttgggtctctcttagatgtttgaccttatcctaacaacttaagctttaggtaaagtctgcatttggtactctaatctcttcctatcagacacaggtgctcttctctgcccaactgcaattcagtccaagacatgccttctccagttagtctctggagaatgttgttcctacttagactcactgcatagatcttaacttgtactcctgctggtggtgtgcatatatgagctgtcacttgaccatgcagccacacctggagacccatttctaggttcagagtcatctctgatgcagcctgtaatttccccactagcatgccactctgtaggaatgaaccagacattgccacatcattctatgtagcattttcttaaaattagagcttcactataaacaatctttggtcaaggaaaggctttgttatctactccatggtctctttgagaaaaaaggcctggtcccattaagctcttgcctcgtttttgcctttcagggattattcgtgctctgtgttagatgtgaacttttggttaggtacataggaaatatctacctaagacacttgtgatttccaccaagtttgaaacagcaatctaaaagctaactcattcattaaatgatggaattgttaagttggtataaagtgatggtacaaaagcccatcagggcaggtttgaaatctaaatgcctttcagtatgcattgaacatgcgcatccatgagaaaatagtatgataaagaaagcagggtgtgaccttattggattcatatttccttatagaacctccaaattaagacaaatttccagacatttctaaaagcagcaatacaatcaagaaaacaaaacaatgagattcagtatgtagctactgcaaatttgtcagaaaataagtgggaaaataacaagatcctaggaaatctgttgtatggagctgaggaaaaggaatgagtttaggtttttctttaagttattgaagaaggcatgggattatcttctggttgctagtcttcccttagtttcaatgggaaacttatcagacacacttatcttgcagaagcaagataagaggacaaaagaatttggaagatcatggtggaattaaaaaaaaaggaatgtagtcagatggtaaatttagtctaattatatttagagatgggttaacataatcagaaggtaaggaacccaattatgagataggtgtgataacatagatggcttaataaaatacaaaatagaaagatataaatagaatgcttttatataaattctggaggagtttaaaaatgagtgagtgttcaagataacttagaaggaaagatattaatataaacttgaggtatgttggtcttgaagaaaaatgaaaaagctcattttgtgaaatgagtggaagaataccagctctttttcagattttcaccattttattaatattttttgattatagaattttaattatgtaggaaggaatttattaaaaagtaaacacaaaataaaaccaatcatatagttttggccaaattgttgcttttcttttacttcatttcctaaagggcatttctcagagtcacttgaaagtaaaacttgagagggttttatttttttgatttatttatttattttttttagtggctgtttgttgaaaaaccttgttgtaggctgctaggcattcttttactaagaatttcgaatgcacctcatgtgcaaaagactgcttaagtgtgtcactgcagaaactagcaggatttcaaaatcaaactcatcagttttctgtgataggatgatggtttgggagatactcaagaaaggagtacgtgttagtagctgaagatttttctgtcttcttccttgtgttgtcagatccacacttttattttccttttttttttttttgagacggagtctcactctgtcaccaggctccctgcaatttctacctcctgggttcaagtgagtctcctgcctcagcctcccgagtagctgggattacaggtacgtgccaccatgcccagccaatttttgtgtttttagtagagatggggtttcaccctgatggccaggatggtgttgatctcctgacctcgtgatccacccgccttggcctcccaaagtgctgggattacaggtgtgagctactgtgcccgtccttgttttccttttgtcaagaaagccagacattctgtgacacggtaaatgaaaaagggcttggacccaaccccagctctgttgcttgcttgttgcgttgccataagagaccctcaagaagaatctcacaaaatccactgccctcccttagtctcgctttcccactaaatcgctccatgcaaggggagccatttatattgcattaaacttttctcggtgttctctaattccaggggttcttactgcctgagagggtcactccaccatgtgggtaagcggggtgtccagagtctgcccataggccatcagcatcagtttttcaaatcctgggactttcactaaaaaactgtggttcttattttaaaaacaaaacaaaccaaaaaaactgcaaggaagcaaactccacaaaacccatcaaaaccccaaaattttcttaaccttaataacttgttctttttccatgcatatctaattcctccttttaaaaaatacctaaaaaattgaaattggtttaccacatattcctgttggcccacgacacataatgattaatattttttcctttataaaaaattgattgcttttactgtgacaactttgacaaagtctttcaaagagggagagaaatgtgaattcaaaaggataatgtggcttttattttttttactttgatcctgttttgtgaagcattacctaggttagtattgcctcatgttaatcagtgaccataaaggccattaggatgccttgatagatgcccttggtctcccttgactttgattgaagcatcttaaaggcctgtatgcatgtggcacaacatctaacattgtaattgctcactcagtagctctgagcacttactcttcaataaattcttagatgccgtggggatggcgaatgaactttttaattacatgtctgttgttttctatcaccaggaactaaattaatgggaaattagttcacaaggtttattatgcattttccctctttaagaggggactctttctgacagcccttccacttttatccttttaccatttttttttattggcctcagtactgaaattccttctttcttgttccaactacatcagaaacattcaatagacttagcagcctatgaaagtctgacaattacttcctcacggcagccttgtttcaagagtaggtccagaataaataaaagtttttcattttcctggtggcatctgttagttttcaacattgcccagagaaagagttactgtggaatacaaaaaaatgagctatttttttcttccttttggggagaaacagacatatagaaaaccatgagtgcttccttcataaatcatattttatgtgcaaccagtaagagagagagatgatgatggttgtggaaaagtcatagtggataacctcaatttattcagtcttctgagataatgtaagagtaaagcatggaaacaggaatacagagttcatcataattatagatcatccattcaaaacattttgaaaacagtgctatgtaaacttgggatgacaaataatgaagcatagttaacacttctcattggttgtgaattttcaaatacatccaagtatttaatcatggccattcatcattctgtaaatcaaaactaggtctttgaattctctccctttcctattctcagattaaggcatatttggtttcatataaaatcttatgcataattttgaatttcttgggccaatcaaataatggtacataatttaatttaaaaaacttttcagaaggagaaaactcatgtttcacatacttcttattaatcctaaggcctagcaaagggtacatacagctgtagttcacctcaattatacactgtaaatatttagattagagacacgaaataagttttgggagttgcaagaatagaatcagatgtaggaggtattcttgtagaatagagatggagatgggatttaaaattttttatttcactgctagagcaataaaatcagtattaaaaacaaggagaggctgggcacgatggctcatgcctgtaattgtagcactttgggaggctgatgtgggtggatcacgaggtcaggagttcgagaccagcctaaccaacatggtgaaaccccgtctctactaaaaatacaaaaattagccgggcgtggtggcgtgcgcctataatcccagcaacttgtgaggctgaggcaggagaatcgcttgaacctgggaggcggagattgcagtgagctgagatcagaccactgcactccagtctgggtgacacagcgagactccgtctgaaaaacaaaacaaaacaaaacaaaacaaggaggggcatgggcttggattttcataggaagagaggctgagaagaacaagaatgctgacatttgttttgtgaaatgggtctgaatgcctataaaagactagcaggtactcagacatgcctgtcaccacttggcagcaaagcaaggaaataggacagtattacatttgtgaagttgttgatcagaaaactagtgtgcagaggaatttgtgtgttttaaaatattcccaaagtggcagaatattactgacatttgaaacaatagcacagtctacctatgttaaaatggtatttccatttttaaattatattttttcaataaaagtcttgctctcttcttaagttacagatttttactttttcattttgcttgttcctgtgctccttgatccatcaatgaaaatgtgattttctgttggagtcttcgataaatatgtaaggctattttcattgcatcagaaagctgaaagggaccttggctgatcatttgtgtaattgaatcgtgtctgcgtttagggcacaattttcattttatgaaagaaacacaagatttcccatgatgttttgcatgtctacaaattcaggcgaatgagtctttcctcgggctcagtgagatcagtggggtcatgctagtgaattaactggcatgatatttgcttaacaaaagcatgccataaataagagacttaatagtcagttggcaagttgcttcatgctaatgctgtttttaaaatttaaagtaatggatgaaataaagttttatatacatgtctggatttttgaaaaataagaagatttgaggcatagtgtattatagcagaaatgtcttttaatttatttttagttgttttgggtacatggtaggtgtatatagccaaaaaccacaattacttttgcatcaacctaatatttacagggtacatgagatgtgttaatacaggcatgcaatgcattataatcacatcatggagaatgaggtctccatcccttcaaacatttttgctttgtattacaaacaattcaattatacatttttagttttttaaaaatacaattaaattattattgactatagtcacccagttgtgttatcaaatagtaggtcttatttgttctttatagctatttttttgtacccattgatcatccccaccttcccccaccccaaccctcccactatccttcccagcctctggtaactgtccttctatttccatgtcttttaaagtgtctccctcatttctgtgtacatgtgactcactggggaataaacagggaaatcctttgtgatgaatcagatgtcattctgagacacagagcttcttatacttttctttaaaatcatatttgcccttctagatcagtatcaagcaaataacaaccaagaatcaacatgcataaaaatgacaaggttatcccagagttctagttgtcattttcatagttgccagcacccttttccaggaaaacaaagagagtggccatctaagtgatgccgttgaggaagctgcctttcccctaatttctggagagcctagtgtagagggagaactcctgcctctgggaatatagcttttagggcatccctttatccattctccaccattccttcagtgaaggaaattataaaagcaaaactgggacccaaggcatgctttgagtctctttgcctcagcccgggcaactgtattctccgaattgagttcattaatattgtcttcttaggagaaatattatctttctccagactgggcagggagtctggcttgagaggcaacaataaagaaagaatatgtcttcctctataaagaaaggccactttataatgaatttcctttagatcacgaacagcactgtaagacccagactgtcaacttgtgcttttgaggttaggagctgagaaaactcttcttgattaataattgagacctaaacatggcaaaaaacaggtctgcctcagcacggagatcatgcatcgaggtggcgggcgatgccttcagtgggttctcttttcttcctgtctcctctgcgattatgtggcaagtttagagtcaactacaggaggagtttcagacaagaagcacagtttgatagaaactaatttctggattgtgattgtgtgagacctcctgggtgttcctgagactttcggaggatgattcttggccttgctttgtttttgttcttttcttctttaggttttcatctgaaggcaagtaactcatgtccctacaaggaaattcccctgaggaattagagataagcatgcatttctcaataaaacattttcagaaaaaaagttgctgtgtttccgggagaagcagatggctgctattgagagacacctaggtttgtgttctgggaatctgtctcctactcatgatagcagggggcagattcagatctgcaggaggtagaaataggcatcagatcactctgtcctaaaaaacaaacaaacaaacaaacaaacaaacaaacaaacaattggaagaaatgaattgatcacagaagcatctagagctaggaccaattaaaagtcagttagtttatatgacctatttgaagatttctcaacaatcttgacctattgcttaagagcacaacatttgtagtaaaatgagcctaagttaggatatgacttaagatcactgaccagctgtctaagcttgttagggttacccaatattgtgaaacttcagtttccccatttaaaaatatggaggcaataatagcaattacctaactggttattgcaagcattaaaggaggtcatcaatttctgtttgaggttggaaaatccttcaaaagctttctattcatttgagtaacaagcaaaacattctgatttaatatctgtatgtgcttcagtgtctttgattatcacatttagaatattcaatattttacttgtaatagtgaataaaaagtttgctggttgagagagtgaataaatgggtgaatggaagagtaaataatgactcttgtaacactattagttatggagtggatacacactagaccagtggggctgagaaaatttaaaaaatattcaagcagtagaaatttttacttaataaatattgcttgggaggctgaattaatgataaaaataaatgttttgcatttgacattatctacccaataattcacttctctctgcattctctcactctcttaaagaagggtaccacattgatgatgctaaatgattcttgtagaaccagccagaggtggaaaagaaagtagttctgacacttggttaaaaaatatacatatacataaataaagtcaaactccactgccatctctactcaaagtgtgtgcatactttcttaagtacacgctgagatgactcattttacacttctttttttacatatttaccctgttttaatgggttggggaatggcaagagcaaaggaaagaatagctgattaccattcaagacacacatccaaatcacataaagaaatctttagatctgagaataattgtgaaaagaataccaaattccagtgtagctttaaaaagtgcaccgttatctttaattacctgcttgatagaagaatatttattttggaataagaaggaataatttcaaagttgatggccttgttataaatataagcaaattaacttttttagaaagccatttcgaactccgaagacaccagcaacatttttattgattaattctttagtgttataacaagcaagttgtttttatgccgtatttatgagctggtatataatcacacatctcaggggtggagaggaccttaagaatcatccacttcaacagcttatttgaaatgtgtttgtttttatgttctgtatatattctgttcttttggttatctctctctctctgtctctgtgtctctctctccatgtatgtatgtgtgtgtgtgtgtatgaaatagataatatatataaattatcataaaagtatatttacatatatattttaatgcccactctattggacttgtaagaaaatcttacttctataaagtactctagaggcatatacttgtagcttattttgtgacatatgtttggtcatacatctaataacaaatctttgatcaggagcataattccaattagagcagtggttcttgacagcggcagtgttccatcctaggtattttatacatgtatcagaattttattttatcatctcaatgactagtaaaaggcaaggttgctgggtgccctgtgatgcatgtgacaatctttctcaaaaggaatcctcctgcttctcctaaaatatttgaatgacccactggattttgatgtaggttagagactgtttataatcatcggagcctagattttattttacttaaatcgcagagtactgtttttgctattttaatatgctgtaagttttcccagaaaacaacttgtataaattgacaaaacttattttgttcagaatttttccaggagatgctcaatatttcagaaaacgacctatctaaagacaatagtgtttgtggcatttaagatagaaataaagtacaaaccgtcagtctgcatgcaaactgtagttactgtattctcacgattctaattatgggtgcaggcacccaggactttgctatgttttcaaatatagtttttttctattgctatatatggaaattcttataattttattctgaattaataaccttacatcttttttatgatatacttgggacattatattgatttttaaattttgtatacagataggttgtattatctataaatttcaaatcatagatgatgtaacttattatgtctatgataatgaaagaggcattaaattatgtacgagtgcaataaggagttgcgtttgatagggccaaaaagccctgaaataaaaaagcagtatactcaggggaatttgctacatcttctagtacaagtagaattatggggcaatatactatttatcgattgttatatagtaatatcgccacaaactgagtggcacacatttatcatcttagagtttctgtggttcaggagtctgagtatggtttagctgcaacatctgcaaggctacaatcaagatggtggccagagctgcagtctaatttgtaagattggctgggaaaggatctatttcatgagtcatgcagttcatgtaggaatcgaggtccttgaggcctgttggactacagacctcaacttgttgctgtctgctggataaaggcttcgcttacttcctcaccgtgcagctctcttcagtatggccacttacttcattgaagccacaaagggagaaagtctgaaatcaagacagaacatataatcttatgtaatgtcatcatgaaagtggcatcctgttggcggagcttgcagtgagccgagatcgcgctactgcactccagcctgggcgacagagcaagactccatctcaagaaaaaaaaaacaaacaaacaaaaaaaggaagtggcatcccattatctttgctgtattccattggtgacaagtaaggtatagattccacatgtactcaaggggcacgcattacacaagggatgaccactcacctgcaaggataattgaggaacattttcgattctgttcaacacagccaatttcctatagcagtgttaggtggaggggatgagttattgggatcagaaggtagctagtgtgttctgtagtctttattccaatgaaagataactttacccattaatgtgaagtcaattgtactcagagaagagggaaaactagattactagaatgtaatctgtttaagtcttgtaagactacaaagtccttactaatttgatgtgcatttctctgatgagcatttctgtagcactggagtccagtgatgcagggatgggttatccacattttctgccactcaagatctttccatccaggtgatccagctagttctcaggcccatcaaactttgatccagggtcagatctggaagaggtagagagcatttttttaattccttatttaaaaaatgtgatttttgtgggtcatgtgaaggtttgttataaagataaacacgtcatgggggtttgttgtacatattattacatcattgaggtattaagctcagtacctggtagttatcttttctgctccgcttccctcctcctaccctccaccctcaagtagacctgagtgtctgttgtttccttctttgtgttcctaagttcttatcatttacttccctcttataagtaagaacatgcagtatttggttttctgtttctgcattagtttgctaaggatgatggcctccagctccatccatattcccacaaaatatatgattgtgttcttttttatggatgcatactattccatggtgtatatgtaccacatgttctttatccagtctattattgatgggcatttaggttgattccatatctttgctattgtgaacaatgctgcaatgaacattggcatgtatgtgtcttttccggtgaggttgcagagaaaagagaacccttacacactattggtgggagtgtaaattagttcaaccattgtgggaagcagtatggcgattcctcaaagggctaaaagcagaactaccgtttgacccagcaatcccattactgagagcatttaagagtcaaatgtattcatgacataaatgtgtattgaaaatctgatatgttttagtgattgttttatagggagggggcagagactctgcttttatgaagcttacagtgagtgccagccaccattttagcttttgggggccttctctaagaagggtggagtagttaatgtagacaaacatgggttttggcagcatacgaccatgaattaacattatatttccgcttaccagccgtgtgattttagcttacgaaagctactctctggttgtttatttcttcaagtgaagaaatgggtctaatagtacctatcacacaagattttctgtgaagattttgtgagatcctatatattaagcacccagtgcataggtgttctcaatgttaaatcccctctccatgtctgaaccttcaataaaacagactattacaaattacatatgaagactttgatgtttaacgtcatccacacaaagttaggcaaaagtcatatataacaaatatttaagtaatcacctggaacaagatctctttagttattttttaaatatgagatctcacaattattctcagcatttcctgttcattgttttgctatgggtagcatgtcctgattactcagttatacaaaatatttgaatggcttaaaggagtatttgtgtttgacagcataaataatattgtttttgaaaatgtatgaatacagatagaaatcaatggactggagtatatgcatttgtctatcttggattgatctagtgtattgagtcacaaaatttagttgatagaagggatagagtatgagaaacagagtcccacaactttgcatcaacttagaaaattattcttttatttaacattcattcattcattcatttattcaacatttttaagtttccgttccaggatcttgagtacagacatatgtggttttattgcactttgctttatcatgctttgcagatattgtgttttttacaaattgaagatttttgacaatcctatgtcaagcaagtctattggtgccattgttccaacagaatgtgctcactttttgtcacattttggtaattctgaaatatttcaaaagttattattaatctgttatggtgatctgtggtctttgatgttaatattgtaattgtttgggagcacaacaaaccatgcccatgtaggttgcaaacttagttggtaaatgttgtgtgtaatagttgctacaccaaccagctgttccccaatcactctccctctccttaggcctccctattccttgagacaaaataatactgaaattaggcaaattcacaaccctataatggcttctaactgttcaagtgtaaggaagagtcacacatctttcactttaaaccaaaacctagaaaggattgagcttaataaagaaggcatgtcaaaagctgagataggccaatagctaggcctcttgttccagttagccaagttgtgaatgcaaaggaaaagtccttgaagaaaactagaactactttagcgaatacacaaatgataagatagtgtgacattctaattgctgatatggagaaagttttagtagtctggataggagatcagccacaacattctcttaagccaaagctaactctcttcaattctatgaaagcttagaggtgaggaagctgcagaagaaaagttggaacctggcagaggttggttcatgaggtttaaggaaagaagccatcctcatagcataaaagtgcaaggtggtgcagcaaatactgatgtagaagctgcagcaagttatccagaagatctagctaagattattgatgaaggtggctacactaaacaagagattttcagtgttgacaaaagggttttcttttggaagaagatgccatcttggctttgaatagctggagagaataaggaaatgactgacttcaagggacaggctatcttgttaggggctaatgcagcaggtgaccttaagtcgaagcccatgctcatttaccattctgaaaatcttagggcccttaagaattatattaaatctatcctgcctgtgctttataaatagaacaactaagcctggatgccagcacatctgtttatagcatgatttactgaagattttaagtccactgttgagacttactgctcaaaaactaaaaaaaaaaaaaaaaaaaaaaaaaatactcttttaaaaatattactgctcattgacaatacacctggtcactcaagagctctgatggagatgtacaagaaggtgaacgttgttttcatgcctactaacacaacatccattctgtagctcctggaccaaggagcaatttcaacgtctaagtcttgttattgaagaaacacattttttaaggtgatagctgccatagatagtgattcctctggtgtatgtggacaaagttcattgaaaagcttctggagaggattcatcattgtagatgccgttaagaacactcatgattcaagggaggaggtcaaaatattaacatttacaggagttttgaagaagttgattccggtcctcacagatgactttgaggagttcaagacttcagtggagaaagtatttgcaggtgtgatggaaatagcaagaaaattagaattagatgtgatgcctgtggatgtgactggattgttgcaatctcatgctaaaacttgaatgattgaggaattgtttcttacagatgagcaaaataagttttcttgagatggaatctgctcctgatgaagatcctgtgaacattattgaaatgacaacaaaggatttagaacattacataaactgggtagataaagcagcaacagggtttgaaaggattgcctccaatttctcaagaaattttattgtgggtagcatgctatcaaagagcattatatgccacagagaaatattttataaaaggaagagttaaagcagcaaatttcattgttgtctttaaaaaaacaattagcacagccatctcagacttcagcaaccaccatcctgatcagtcagcagccatcaacatcaagggaagaccctccaccagcaaaaagattatgactttctgaagattcagatgatcattagcatttttagcaataatgtatttacaaattaaggtatgtacatttttcagatatgttattgcacacttaatagactacagtatagtacaacttttgtatgcactgggaaaccaaaaaattcaggtgacttgctttattatgatgttcactttattattcagttcactagaactgaacctgtaatatccctaaggtatgcctatgcttgaaaaatgttatcagtaagatgtgtaatgtgtgacaaatccagataatacattacttttggagaagctgagctgtttcaaaagtgttccttttatttgaagaagaagcagagtagcccaatcaagtaattttatttattttgaacttacacaataatttacgcttttgtttttcagcaagtagtaagggaggtgggttaatctgaaatgaaatgttcttagatcctgctgttcagttggttggagggcattaaagatagttattacttaagatctctgttgttttgaaattcccattttcctctgacctaaattctatgatgtaaaagaatcccagccaccacagatagactgtttttccttatttaaatgctttaaaatttagttttgacggaatggtctcttaatagaattcttgtgattctgtaacatcttagcatctttggttggcacttagaatattctcccacaggcatatttcatttgcctgtatgcttgtattcctcattagcttatttcctctggagagtgagactctgtttctgcatgtaacagttgatcagtaaatgttttgattattactatttagatcctgaacatgaacgggctcctattcctttcctattgctgcccccaatgaatttttacattcaaaaagtaatgacgtgttatcttggtttttgtttctgggaaatattaggaatgctttttggcaaatttcaagggaatcctatttggcattagaaattatttattttgaggcctcgtgtaaaataagcttcaggattttgaataactttgggccctggagagagtaatacctaatgaaaactgcaactcaaagaaataatgaaaggcctctttaggaatcaaggtggtagctctagctcttgaagtcttctaatcaaagagtcaacaaccatttttgatctctgatcgccaaagcaggcctcagaggggtcaactggccatgcagcctgatctcagagtaatggctcctcctatttcaagattcaactcaagcatcaattcctgtaagaaaccttgacagaactgccttttctcccacctccaagtcaatgtgaccactccctttttgccttcactttctctcctgacttgcatttgatcagctaaatttatgtaaaaaaatgaagcctacaaccctaagctgatctgaaacacacagcaaatggaggtagccacatatatatttgataatttcccagtttatagcataacagttaaatcattgtaatttcttatggaatgtatggatcaaacattacatttattctgtattgtgtgcatttggagtaatccatttgacatttttttttacattgtgctagaaaagttaatgaggccactgaagagaaccaaaagtaggaattagaactgaagatacagcaagaattgctaaaagaaaggaaatactgtataaaagagaaaaaagacttttatggagtgattttagagtaactatggctttgtaaaaatgcacatcagtttatcagttttataagccaatgcttggtgggtatggagtttttcagtgatccagtttcaagtaaataagcaacgaataagaagaaattgtgtttctttctagaatgtgttgtcaaccactgaatttaatgctaccaatagatgcagactcatgaagtgcagtatgatttcgataaggcctaagcaattatcaaatcagaaatggatctctcatgctataaaattgtacatttaagcaaataattttaagataattggctttcaaactatttttggatgtatcagaagggatggttgtggaaataacagcacagtaaatgaatagttactggaggacaggaaagcagaaaaaaaatctgaagtgtaaggagatacagtcaagctgtttataaaatacatttagatacaaaagaggtcactgtgtggaaaacctttagaatcactgttgaaagaaaaaaaaatgtccacttcccaatttcaagttctattgggattgtttgtattataaagagttgactaataaattcctgccaaggattatttccctatccaaacaaaatgtccacaattctttatgagagaagatgatacccatagcttctgcttcccgcagtggcactctcatcacatatattggtaagtatagaggtgccaaggagaagcaggcaacagttttctccatagcatccatagtcatgctgttcagcagataagcctagtacagttagtatgtcctgattttttgctaaatcctgggaaaaatgaaaagagtcttccttatgcagttgtgttttgctgctgagttgtgtttgcagtgtattagaagaaatacatgtaggaagcctgttttcagtacaccactgtattactccatggtcttgaatttctgaggtcttaaaatagggttattaatattacggagaaagtcacactgctgggtaatctggttgaaatggagacagagcataaaccaatagaggtgtacacatatactaagaattttgactggttaagggaaacaagaaacaaatgtatttgttttcattagtaaatatgattttttctcaggatatgagtaagaattagtgaagagggaacaatattaaattattttccttagtaaggtaggatattaaaaattaatcccttctatttgtcagttttccatgtccagagttaattgaacagttgtgttaacattaatataacattgcttgctggctaccaacaataatagcatggaagaatgttttaaggtatgtcttctggtagaataactatatcctcattattaacagtgtggaaaatgtagaaatgtagaaggaagcaaataatcactcatccagagatgatccatgttaatgttttagtgtatttttttctatatttgtagctttgccaatttcacacagttactttttaatatatacaccggggttaagtctttgtatgattacaaaataaattcttgttcaatttttgagaaaaataaggaaactatgaaaacagtataaagaagagcatgtgtgattcctagaaaacagcaaaaataatttggaactgcttttaatgacaagggtaggcaatcaagtttgctaaaatgaataggataatcagctccagccataaataaattagtatctttttaatgtgtctgttgtgtgtattctgcagctggctcttaagtaatttttaaaggaggcctgatatgtgttcggagggggagcaacatgattagaatatggtagctagcttggaataggcatcatcaatgattcgaatgcatgctctagatcatgcatgctttggaagctacaaagcttctccaaatcttggagaagcaacacagtgagaaacctgtcactaagcttttgaggattcctatctggaagaggactgttaacagtaaactcaggctgcagttgattttctttccatcatcaacatattatctgggtctagtgaattacaaaccctcctcttggcttaacattctctctgatggctttctgcacattggcttcctcttcttgctatcacggtaattactcaggagacataccataggttttcttgggtttagatcagcttaggaaagaaaagaaaacttaatcagtgaacagatttctttggcattttccatgtaatcctgggacccctgcttgttagttttgtcctgtttcctgttacagaaaaggctgaaaatcagcatgcagatgaatgagatagcagatggttttcccgtgatagagaccaacaatttgtgagatagaatagtaacgacaaacatacataagagaaaaggcagaattagagtacagtattttaaaagctttcaggcgctcaataaatgctcactattgttaaagagagagaaaaaaggaagtcctgtataatacatcaataagattttaattttcagttattattatttgagctttatttcccagctctctgacacagatttaggggtggtgtggatattcttagagtggaaattattgaactcttagattaaaggtactcgagttcctagcttgccctgtaactacacatatagagaagatcactctcgtaggtgctagtaagtaggagataaaagttttagggggaaacacagagggatactcagaactgggagcagtcctaaggtggaccttcaaaatgattcatgtcttagaaaatatgatttaagagaagttaggtctatagggtcattttatctgaggaaagatggctgtaaggatctttaatgataggagtcaaatatatgagagattgttgcaaggagaatgttaaccagctattctacaactcgactggggatagaaatagctttaaattacaatatacagaatttagattagataaaggaagtatgctctgaaagtaagagttgttaaaagttagaatatgttttccaagtaggttacaaaattgttttaataaaattatttgtgtttattcaaaaataatgaaaacatatatattacatatataaatattgatatattacatatcaatatataaacctaggatataaacccaatatgtaattgatatgttacatatcaatatatattatacatgtattgatgtcttacatatcaatattatacatgtgttgatatattacatatcaatatattatacatgtgtttattatatgtgtgtgtgtctatgtacaaaaagatagctttttgacctcaacagcattataacttgataattgtcttattttggaactcacgctgaagtagctttcagatactgttctagaaggcttaaattaagtatgttgacaataccccaaactactggatgatatttgtaatgaatttcaccctatatcagtacagaagggtgtcacagttcagcaaaacaaaagagaatacgctttgttaaacctctactttctgaattttaggacagtgaggaaatttaacattttcaatttttttttcttttcttgactgaaaagaaagtcaagccagcaatatgtttctgagagagcagtgatgcatttcacaacactgttaactgtctgcttggctttttgaggcttccagagttcagaattgtcttctcttgaataggtcagtgcatttttttccttcagtttttctccttaagcagcaaaacagaccatttaacttccaaatatttacagcttgcaaacagataaacttcccaaatctgtttttttttatgaaaaggaaaacgatcagccacaataatctataatacgatatatttgaatcaaagttattagatgccctagggtcttttcatggcagattttatatatcaccaccattaataaatctgttatcagaattatgtctttctctctgttgatagttatttttagactaacatattcatacctccttctgatgaaaaacattaaaatttgaataaggcatattagaaaaccctaaagctctgtatttacacaaaggagactcataaatattggtttttcagggtgaagcattgtgtgttattccattttgtaccacagggaaagcctagtcacacatggggcctcattaaaagaggatctaaagaaatatttaatggttgaaatataaggtcttattctgaatatctaccttcactttataataatagaaactgaactgaaaagattcagtaagtgatttagaacatccactcattttaaaagtaatgtctaggcctaggaaagtgacatcatgttccaaatgttacaaatccagcgtttttccttgatgtctttataaatacattgtttacagtttttattctcctccatatatgatgccccttttctaagattatttcgtaggtatatcctttaatgagagaacctcataaataaacttcctgaatttgaaaacgagtgagaggagacttcaagtttgtggactgagctaaacatgtgtctactctcccttcaaacatcccatggaaatggcagtaaagacagaacaaagagaatacatttctgaatatactgaggaacatatactccagagagcagaaacaggaagaggggcctctgctaaagctgaaggagtcttcaggagggaacccagctgggctctgtgttctggttggcagatacagagagtagccaaggtcaaaagcagacaaacagaaagtgaggtgattggccacaggtttggaaatggctcaggtttgctctttccaaccccttgcatgtcactgcacatttacctccagaagtaaagcaggagaactctgcaaagggaaccaacaatctgcatgggagggcattgcctccaagtgtgtgggctggcgaccaagtgcagccctctgccctagttatgggagttggagagggacttactggtttgcatgttccatgcaagagctaaagcaaagcacatctcggagaagtgagccaggaaagtggatcaatccatgccaacaacctatattaattaacctgataattaatatgtatataaagtgaaaaaaaagaaagaaaaaagggaaacagccatgagacaggatttcacaacctctgcactatcaacattttgggcaagatactcttttgttctggagaagtgttctgtacattgcaggatgttaagtagcatgcctggtctctatccaattgatgtcagaagcaagcaacatccatccctggccactgtgaacaaaaatgtctcaatatctagacaaagatattgcagcatactctggaggacaaaaccagcactagctaagaaccattatcctagagaaaatagaaatggtttagagaagagatcttttcaagatatctaccttggtatcctcagacatactgaagaattacagtctctaaaataattttctgatacggaaaatgaagaaatcaaaggacagaaataacccacggaattttaaagtttaattaacaaaattgttgaaaaattcaaggaaaccttccaaaaggaaaagaaagaagaagttataatatgtgaaaaaggggaagagacaaagagaatccgtttaggaagctaagtgtctgtctaataggaattctaaaaccagagggaaaaagcacaataaatgagacaaaataatcatgacatttcctagagttaaagaaaggcacgtcctcagaatgaaaggcccaaataatgttgagaacaatgaattttaaaatacctacatcagacacatgctaatgaaactttagaataccaagacttaagatcctaaagattttgaaaaagaaaaacataaacaaacattctatcataggaatgacaatcacagtcaagttttcaatctgcatcttgaaaatgccagatgataacaggacagtgacctaatgttcggacagaaaacaaacctaataccaaatggaatcaaacaggaaactcagaaatagacacgttaatatgctcaagtgatttttgacagaggtacaaaagtcattcaattgccttttccacaaatggtgctggatgcccaatggcagaaaaaagtaagtcttcacctaagtcttacaccttacacaaaagtcaactgaaaatggatcacagacttaaatataaaatatgtacctataaaaccttttagaaaaaaacaggagagtgtctttcagatctaaggtgagccaaataatgggtcgacttgatactgagatcacaacttataaatggaaatgttgataatttggactttgtaaaattaaaaacctttgccctgcaaaagaccctttaaaaggatggaaagacaagctacagattgggagaaaatgtttacaaaccaaatacttgatctaggactagtaactcaaaagtcaacagtaaaaaattttagtaacaatctattttagaaaatgaacaaaagacacaaagagatatttcaccaaagaggatatacatttggtgaaaaagcacatgaaaagatgttcaaggtcattaaccattaagaaaatgcaaattaaaactacaatgaggtatcactatccaactatcaaaatggctaaaataaaaagattagtgacgagaccaatcgctggcaaagatgcggagaaactggattactcattcattgctgctgggaatgtaaaatagtacagcccatactaggaaagagttcaatttcataaattaaacatacaactaccatatgacccagcaattgcattcctaggcttttctcatagagaagtgaaaacttgtgttcacatagaaacctgtacgctaatgttgaatgttcacagcaactttatttgtaatagctgcaaactggaaacatctccagtgtccactaatgggtgcatggttaaacacattgtgatacatccataccatggaatagtattcagcaataaaatagaacaggcatgcaatggaaagttacatgcaacagcctggatgaatttccagagaaatatgctgagtgagaaaggccaatctcaaaaaattacataatgtatgatctaatttttataccactttgaaaccataaaattaaatgaagaacagattagtggttgccaggggttaagtaaagtgggaggaaagtggttgtggctataaaagtgccacatgaggaatgcttgtaatgatggaattgtctgtttcttgactatgagtgtcaatatcctgaatgtgatattgtgagatgttaccatgggggcaactgggtaaagggcaaatggaatttgtcttatttcttacaactgcctatgaatttacactgatctctaatgaaaagtctcatttaaaaatttgatagtgcttgattttatcagttgatcaagctgctcttagttgaaataacaatttcagaaggatcagcataatgaatctaccagtcactgaaaactctcaattatctgtcttgtcttccctttcagtttttgtttcatttctgttttagtaacctcttagaaaaaggtagtattaaaggagacctaggtctcttttaccaatttaggataacttcacaatctccgcagataaattggtatctgtgtacacacacaaaaataggaaattcttgtgagtagtttacaggggaagtgcttaatatataaacaaggcagtgctctggtaaaattacttattgcattgagattaagaacataataaaattattaaaatagcctaccactttcattacagacttaaaatgttcttccttttatctctgggggtttgataatccctgtttattgttcttttattttgctgtatatcacgttggccatttaatcattggctctttagcagggtgggtgtagagagcattaaaaaataataaatgatgcagtttatcatcacctccctgtaaaacacaaggcacgtgaaggatatgagtttcctttaagctaacgtatttacttaatgtgatttcaaacaaactcctacaaaagtttttggttatggcatccattttggaatttgaaaaatatatataattcatctgaaataaatgtataaaacagctaattttctggtaagatataatatgtgggattatcactactacttttcaaaatgtagtctaaagaatattacttaaatgagctttatgctgagtaaagaatatgggggaaaaaaccctaagagtataaaagcccagaaagagcctcttctacgtatgagagtgtatgtatgatatactatattaatatatgtattgtttaatataacctattttgataaataatagtataatagactatattatatactattatataatatagggaggaaagtaccattaaataaaagatactggagcaactggataactatttgaaaaacaataaacttagaccatttgttgcactatacaccaaaataaatttcatatagattttaaggttaagtgggaacaaaaagatatcacacacaaaaaactgtatctgaaagtaaatatgttctccttatagtagagtgaaggaaatcagttaaagcattcaaataaagagaaaaatgtaaagagaaacattagtatatttgctatataaatggtaaacgttttatatgtcaaaaatcatttgtatattaaatatttatattaatctgtcatatgtggtagatgattaatatacctagcatataacatgctcatataaataataaaaaaatcataagagaaaacaagacaaaagccatatatgtagataattcatcaaatggaaaattataaataagcaaattttgaaggaaaataaaataatatgttctatgattaaagtggtcaatgtctttaaaggctaatattaatagctgacttgtggtctgtaaagaatagtttatttaacatgtgacttataaaaatatataacacttttggacagcatttttagagataaatattccacactttttgtagcattgattaactttattcacatcttaaatacttataaaaatctgaatactactttatttcaatgttatttaaattggtgtcaagttctggctaatctacctaccgaatagtaagaatattgttatgcagatcattgttattctataaaatgcagtaccattcagtcattcaaaaatacatttccaaaaaatgtttagagaaaatgctaaaattatgctaagtgaaaattcagacaatatttaaaattttaatagtctgacagattctgatatagataaacagaaagaaagaaaggtaatgtaattttcatgtaattgtacccatgtatatggggaaaaaaggcttgaaggcagtatacaacaaaatgttaaggacttgttatttgcatctactatttcaagaattccttctgaatataaccaacagtttatgcacaaagaatttaattgcaatattcttaataacggtgaaagtcaaatattcatcaataggtaagtgtttaaattacattatcaaatactcagatgatataattctatgcaggcattataattatgtctttgaagtgtttctgttttaataatatgtaaaagtgcttatgatataatgctaagtaattaaaccatatgaatgtatgttaaaaggctgcatgaaaatatggtaaattgtttgcataggttatcattgagtagtgaaatcataattgctatttctttcttttttctttttttttttttttgagatggagtctcgctctgtcgcccaggctggagtgcagtggtgcgatcttggctcactgcgagctccgcctcccgggttcacgccattctcctgcctcagcctcctgagtagctgggactacaggtgcccaccaccacgcccggctaattttttgtatttttagtagagacggagtttcactgtgttagccgggatggtctcgatctcctgacctcgtgatccgcctgcctaagcctgccaaagtgctgggattacaggcgtgagccaccgcacccggcccataattactatttctttcattatgttctggacactccaaattttcaactacagggtccagcctttgcaatcaggaaaaaaaaagtgtttaaaaacatctctgaggacttacatataacaccagaaggatttatacatttatttagttaatgtggttaataaaaccaaaatattctttaaaccatgtcttagcttcattcttgtctgcaatactttggcactgcctggatttggcatcatgaactgctgcaactaaaataacagtaaggtgcatttatacaaaggaagaaatgagagattaaggtcccctgttaatactaaggagcctgatagattttgatatgttttgtgcactggtatctgtattttcattttattgatttttttctaaggaccttacagctaaagccaggtccccaaagaagtcaggggtttttgtgttacccacaacttggcagaatgtctgcaattactccttctgcttttaactgactttgaatcctctccttttggcttgagtacctggctttcagccaggagaagggaaaatactctatctgttggttttcaaatgtcatttcccctttggctttgttgatggtaaaattctgcctttgcatctgaaattggaaactcttctaatcctggagtctgagtgtaattaatcggaaggctttctcttatctgtgtctaggatcagcctttagtctgatcttcatttttatccaggtgcaaaactcaaatacttttacctttagtgcagtggcccaaattttgtccctagttctgcctgtgctatcattaactgtcattttttaattatatctacacacgaatgtgggccagaggcagcaagatctggattttctcttcctctctgagtccctgacccttggattgttcttccttcttttcaattttggtgggttctgggtttagatttgtagcctaacctagtcaacaacttctttggcatagaaaagaattatttctgatgtgtatattttcccagaagttagaatacccctttgatatatttatttgtgtttaatccacagaaagaatgaagaattaagttatattaacaagagtatcttgcagtatatatatgctttaaagttcacagtgactttgacatgcctctttcatttagttttcacaactcttggaacgtgtttttgcccattttctgcataagaaaactgaatttcagtaaaattaaattgtttttcccaggcaacccagccaggaatcactagtccccctctctcaaaatccagcatttgctcactagaccagagctgctttaaatgacaatagtgtatggaattcattatagtagaatccattctaaacacattgttaatggtttgatcaaacatctttagtagcaccttttcattcatgttttattatgtatgtgtgctacccactttctgtgcagaaatttcaaggaaaaggaaattaggctttctgtaatactcctaatccctgtccttaataagtccaaactctttaacatgatacataagactttcactatccggggaccccagggtactgcaccattctcatccatgtttctcacctctaagcttgtgatactcctgtcatgcagcattttcctttgttgtccaaacgtgtcctgctttaaatgttaccattctcaattctcatctgcctggtgaccttgtgtttcagtggttgtctggagcgttagtgttcattagaataacctggagggtttgttaagacatagcttcttggacgcccacttccaggtttctgattcagttgatctgggccctgaagttgcctttctaacaagtttccatgtggtcctcttgctgctggtctggcatcacactttaagaagtattattctacttatccttcaagacctcaacctaattgatctacagatccttttccaactataggaatatttaattgcttgttactctatgctttcaagctcttgtttgtgtaacatctcacattttttggtgactatttatgagtgtcttctttgcttaactgtcttccttttacaagggaaaagacttgtttgacttgtgtttagatcctcatgggctaacatgatgggaactcatgaagaatttgtatgaataaataatgaacctggaaacctttgttcatttaaagttgcttgtacaggatgaatgttttgcttcattggtttccattattattgtcttcgttcccattcaaattctgtttctaggcaaactggaagaggaaaactatgtaaactgaaaatacaattctaagcctcccaaccatctgagtggaccccttctctcaaccaagggcattccaaagttaacctgaaaaactagttcaggccatgataggatgggggagtaggacatgcctcaatattccctcctcccttctggaactcaggcacagctgaccagtattaacattaaaatagattttaagactgacaaggcagactgtttatagcaataagataccacattccagcctgaatctagtatagtatcacctgacagatagcagaccctgaaagaaatcaaagtattttatctcaaattatggttttttgccatatcttggaatagtcctgcaaatctgtctctcatgaggaaaatccacattctgaagagaatccctttccttttccaggcctctttcctgatccagaagaaaatcaactctgataagaaacatttacaatctattctctctgaagcctgctacctggaggcttcttctgcataatgggaaccctggtttccacaaccccttatcttgacccagacattcccttctattcattctaggtctttagactataacttgactctttcatccaattagaaaatctttgaagctgtccgggcatagtggctcatgcctgtaatcccagcactttgggaggctgaggcgggcagatcacccgaggtcaggagttcgagacaagcctggccaacatgttgaaaccctatttctactaaaaatacaaaaaaaaaatgagctaggcgtggtggtgggtgcctgtaatctcagctactttgaaggctaaggcagaatcacttgaaccccggagacagaggttgcaatgagccgagatcgcaccattgcactccagcctgggtgacaagagtgaaattctatctcaaaaaaaaaaaaaaaaaagagagagaaggaaagaaaatcttagaagcccctcacaccttgccacttcaaattgtccccccttttcaaatcaaaccaatatacatcttacatatattgattgatgtcttatatctccctaaaatgtgtaaaaccaagttgtaacccaaccatgtaaggcacatgttcttaagatctcttgagggatgtgtctcaggctactggtcattcacatttggctcagtctaaatctcttcaaatattaagagtttgactctttgacaactaatacatatatattttaataaccactatgtgccaggaactgtgcttcatatatattattgtgtaattctcagagtaattcccatgacataactatagtacatctgttttaaagatagagaaactgaggctcaaaaagactaagtattttgtaaatattctaagactggaaataatatttgatttcaagattttcttattccaaaatgtgttctgatctgctgctctaccccatctctactaaaaatacaaaaattagctgggtgcagtggtgcacacctgtaatcccagctacttgggatactgaggtaggagaatcacttgaattcaggaggcagaggttgcagtgagctgagattgcaccactgccctccagcctgggtgacagagcaaaaatctgtctcaaaaataaataaatacgtaaatataaaattaaattaactcttgcttgtctcatgacaggtaaagatgatgggacagtggctgcctatcttcagataaaataaaggtaatctccacattaacattactagcagtggttcctgctctcttctttcttttttttctttgcatccagattcaattcctaaattactcccagtatgacagtgatttctactgtgtttctccttcactctctgcagatcattgaagaggtagctgcaaatgcctttcacttgcatggcttttccaaaatgtattcagattggctgaatttctgaatcaaatacaatttattttctctcttatcctagcagaagatttaagcaaagagatatgtaaaatatattaaaaaatttttaagtttccttttttttttttgaggcagggtcttgctctgtctcccaggctggactgcagtgatgtgaacatagctcactgcagcctcaacctcctgggctcaagtgatcctcctgccttggcctcccaaagtgctgggactacaggtgtgaatcactgtgcccagcttatttattctttctttttttttgtacccattaactatcctacctctctttgtcccaactgcccttttcagcctcttgtaaccatccttctattccctattctcatgagttcaatcattttgatgtttagatcaatatgggacttatatttttaagcattttgatttaattttcatccgttggccaagcttggtgttctgcatttgcaaattttgttagggtacagggtagtcatggctgcaatctggagaaaataatattcaagatagtgttccaggacttattattatcatttcttactggtccattggctgagttggaataccagctaatttattagatataccctatgcttccattgtgcaaacctcagcctatacttggctacattctcttgtaaacattttcaagctttttaaaaaaattccaaggttaaatttgagttgtagaaaagaaatatgaataatggccatcataattattccattataaaaacacatacacacactcaataaaatgtgttgttttaaaattattaccctaaggcaagtggtgaatagatccaataaaaataaaagaaatagaatgaataagaagataataagacgaatggaagactacattctttctactgactggtcatcggtttttctaaatcttggtcctttatctccaatgggtctttgaggacaagcacatcttatgtactttgtaaatatttgctgtttatgcacattttgagtatcattgtttagctttgcttttcagatgcatgaaacaagtaaatttgaggcagcaaatgagtaatttgtaaatctagacacaatgagaaggcaattaagaatgctgcttgatgaaaaagaataagagaataatgttgtaggtaagggacaaactaatttcactaatagtggctttatatacagtccagtatgtgaaaatacttaagtaattaacattaacattcacactgtcatcctaggtagtgataagatactggcgaccacacacaaaaatggaatagatatctgtgtctgtaaaactaaaaactcttcaagggagaaaaagctctagtgaaaaatggaattcaccaggaagtcactcaagagaatgcaagtattaaaagcactttattataagataaggatgtcccattcttaaaataatctcctagggaaggcttcaaggatagcattatactaagtagagaagttgtctgacaaataggtaagtataaaaatcagagaacctacagaaaacaaatcattctttgagttgcatgaactttaggaaagagtctttatcagccatgatcaaataaattggacaggtcatataacaagttagaagttgccaaaatttttttatagaagaaacagatgtcatcttcttttgtaaactacatcctgaacatatcccatcctgactgcttcgtggcgtatataaactcccactccacccccttttccccgtctcaagcaagctgacctaccaagctgtgtatttttaatcactttctatagcaatcaagaatttgccatcagagaaactgcttcactgcgtcttatctttccatgcctgttcttgctaaacagatttaagataagagcaactggcagtaagtgcccttcctgaaaacagaggtcacagatgtttctactgaagcccagtaaatggttttgggagacatttgaaatcttagtcatattcaaatcccaaatacaatttctcttttttttcccagaaatttcaaaggttttagaaatattttctactggaaaggtatctctcattcttactcaaaatttagacactaatgagtagatggcaagtcttgtttataagcattaatcatgaagatgaacatttataactgaaaaaagatgttcgaattttggggtttgtaaaagaactaggaatggagaacatttagagttcactatgtggtgatattcacaaaagcaaatgatgatataactatgtcacttggaaggagcttcaggcaggttctttctcttctacatgtaacatgtaagcctgttttggggtcattgctgaggaaaactacttcttaagacaattttacgactgcattgtttcaatagtacaccaaactatgttggaaagttatgacctagaatctgaaaaagaaaaaagtgatgaaggaataatgaaaggctgcatgacagaagtatttagtcttcattcctgtgtttgaagcagaaaaaaaggtattgagggctaaccagactctgccttttgctaaattgaagagtatcacatcaaaggccaaagatccattttaacaggtgccttaaaaagttgtactaaatgatctctgtgcccctttggatcatgaattgtctacataactgcacaacgaatgaacgtaagaaaaatgaattggctggtgaagcctgtctggtaaacaatccatgatcctgagggaattgtagttttgcaaaatattcagcaactactttagtttaaatattttatatgactcattgaagctccaggaagatactactttcttctcaatatcagttcctggttattgtcatcattcctttatcagagtttgtttccttgtcaaatgaactcttaatacatgtatctatcactgacaattttgtagaaaggtcattatctgttctgtttcccactccatgaaacggaacttattccattcaacttcgtgtaaagtcttttcaaatgacacaactgtaattaggaaagatgtcaataactatttacagatatttatgttgtattcagaactgtactagttagagtgtgtggtttaaaaatttaaaaaaaaagtgggtgagatggtgagacttaactaccctattacaccactactaggatggtaagaatttagtaagtaaaccagaaagttattagaaaaacaagtaggagcaaaataagctctgtggcattgaactaagaataaaatgtgaagagaaggggtgagctctattatctacttagggatgccttcagtagaaaatgggacttaaaaatgggcaaaacttaggagggtctttccaggaatgagaatgaacagatcctgggataagttaataaggttggatttattaatcacctgagattctcttttttgattattgggtcatcttgtacacatcaactctgattacaaagtaattagtaatcaataattatttctgcatgtgccactggataaccattcaatacgtaaaaatatttaggtgaaaactttgcttgccaaagtttcaaaagttaaatacttaccaggctattatcactatagaaaacaaaggatgagacgttactatgaaaaggatgggtacaaaagtcatttgaagaagaaacgtactaataaaaatatatttcttaagtactttagtctgcaagtggcataattatttgtgtgcaatatccagaaatacatgcttcttggtgggttttaacagacatatttttacaattaaaaagtatatgcctaatttatgttgtggcagattacatttttcaaagacagttacactgataaatcccaacccacatggccatgttataggtgatgttgacactcctccattgggaggtatggaccagttttagtgactcactttcgtccaatagaacgtaacaggaataatgctacagtccaggtcataaaagggagtagaacttctaccttgttctccctctcatgatgttagaccttggaacacagccacatattgtgagaaagcccaaactaccccatgtagagaaatcacatggaaaggcccacagagagaggaactggggatccagctgatatttagcatcaattgcaaaatgtgagtgaaggaggcttcagatgattctggcctagagccttcaacttttttttttttttttttgagatggaatctcactctgttgcccaggctgaagtgcagtggcgcaatctcggctcactgcaagctctgcctcccgggttcacgccattctcctgcctcagcctcccgagtagctgggactacaggcgtccactaccatgcctggctattttttttgtatttttagtagagacgggatttcattgtgttagccaggttggtcttgatctcctgacctcgtgatcctcctgcctcggcctcccaaagtgttgggattacagacgtgagccaccgcgcccggccgagccttcaacttgattcttccatgagaggccctaaacatcatggcaaagagtctaaccatctccattgtgctctgtctcagttcctgacccacagaatctactagcatagcacctctaagttattgagtaatttttagatagacaataacaagataatatgtcaatctggttttcatatctaaatttatactggctccagatattcacttaagattttatcttggccaggcatggtggatcacgcgtgtaatcccagcccttcgggaggccgaggtgggcagatcacttgaggtcaggagttcaagaccagcctgaccaacatagggaaaccccgtttctactaaaaatacaaaaattagccaggcgtggtgatgtgcgcctgtaatcccagctacttgggaggctgagggaggaggatcatttgaaccctgcagaggatgtggtgagttgagatcacaccactgcactccagcctgggtgacaagaatgaaactctgtctcaaaacaaaaaaaaatttctctctaatatacaaataatatcactttcaaaaatgtatctgctcttctaaaaactcagtttccaaatagtgggctagtcattttgccaaattttagaaaacagttttaaaaaatcacacgtagctccaaatgtggtgcactttccttggttttgttcagtgctcaatacattgatgttgctaaaggccatatcagtgccctccgaccatggaagtttggccataactagttcaagccctgaagaactgaccctgggagtcaatccatatgctgctttgtcccaccaagaagaatctctcttctaagattttgaactaagagattgagagttagagagtagctatcgctgaagctgtcaagatcatctagacttgtaccatctcatgccagtcagatgactgttattaaaaagtcaaaaaataacagatgctggtgaggctacagataaaagagcatacaaattcactgctgcttggaatgtaaattacctcagctactgtggaaagcagttagtcagtttctcaaagaacatttgacctggcaatcctattattaggtatatacccaaaggagtataaatcattctaccataaagacacacgcatgcatatgttcatcgcagcagtgttcacaatagcaaagacatggaatcaacctaaatgctcaccaacagtagactggataaaggaaatgcggtacatatacatcatcaaatactatgcagtcattaaaaagaacaagatcatgcccagtgcaggaacatgtaaggaactggaggccattattctaagcaaactaacactgaaacagaaaaccaaatgctgaatgttcccacttataagttggaggtaaacactgagtacacctggatacaagggaacagtagacactgaggcctactggagggtgggaggaaggtgaggatcaaaaaactacctatcaaatactatgcttatcaactgggtgatgaaataatctgtacaccaaacccccataacatggaatttacctatataacaaacctgcacatgtatccctgaacccaaaataaagtttttttaaaaaaaaataagatcatctagacttgggtaggtggccattgtggacatcatacaagcagaagaagctgatctatggagaagacccataggacagtagtattgagaaagcatagagtcccagagagagacaatccagtttccacagccttgactaatattattgctttataattctgtaaaatttcctctgaagccttccagtaagctccttttccacaaacaagcctgtttgactagcttcttaatattaaaaccaaataatttctcaggtggcaataagggggaagtggagtgcattggtcacacaaaagacaacaacatgaaaatcttaattgttttcagtgtcaaacacttgagtttctggagacaaaactccctcttctaagaaaatcaaactattatacatgataattgtcactttgttagttaagacacatttatacaacattttaagatttggagggtagatactttattaataggtggtatggttctgttcttaagttatgtttctgatttttagatagatcattccctgtttctgtttgtgggaaaaatggctgtctcagtaggctgcattataaactcagttggaaaaaactggtttatttgttgaatgagaacttcatttattttgtgtaaatgagcaccactttttattattcacaggttattgacaagcataatattaagttaagatgcttgacattaaaggattaacatgtacaaatttgaaaaacaacagccgcctagtagacactcagaatttctgttcattgatcaactaagcataatatctctgctctttagcaagtggtttaaaaaattgatggttattagtagtataaatcttggaaaatttgcagagaaaatataatttgtctattctaagtatgttaaatggtttaaatgatatgttaaatagtttaaatgatgaatagcgtgaacaatattagctatactgtattagccattagccttgtaacaaattactcccaaacttaccagcttaaaataacaagcatttattaactcagtttctatgggtcaggaatccaacaacagcttcatggaatgaccccaactcaaggtctcccatgtgactgtcatctagctgttggccaaagctgccattttaaagacatgaatgaaacaggattatccacttccaagctcactgtgtggctgttgtcaggaagctttagctccttaccacgtgggattctccatgtggctatttacgacatggcttccctcagagcatgtgacacaaatgatcagagaaagatctaggtgcatggcctcatctcagaaatgaaaatccttcagttttattgtatcaacacaggtacgatgtaggagggacaatacagtgtgtggaagctggagatggagatccttgggagctgagttggaggctgctaccatagctatatctcttgctagagttcccgattttgcagcctgccatcacctcacctaagactgaacagaatcactgcctagatttacaatatcccagtatattctttttcatgtgcactctcactttacatctcaattttcattccgagcagtacttttaagaaagaattatcttcccctttaatgtgaggaaaaactcccctgtgtataaaaacaaaataatcattcaccatctctttctagtgtgtgacatgcagtgagatttaacttcattgctttgttagaatattctgttctctgtggagggccgtgtttttaaaaaatcactcttcagtttctgctgcaaaaataaaataaaattctctgtgaagtttgtcaagtgaaatggacacaaacatggctcaaagtctagaggaaataaaatgaagccacaatctcagtctatgaaaaagagataagttaggataaaactacagcaaaaaatgtacaggaaaagaatgctgctctttaggagagaaatcagaaaagtcagaagataaaatacagagcaaaaagtttactgatcccaacagagaaacaagaaacctcagagcacttatatgcaaagtatttgcggtgttttggggcccactgactgtaagggaaaccaggtatacacagctttagggcacaatggagagaaagctcttgatatactctcctgagtctcataaacagcaacatcctccaacgtaaatgacagtgaaagaatatgatgaactcctgatgggttgatgccacaggaggatccagccttatttttcctcagctctttcctcaaggaaaagactgggaattgataatactaaattgacaagtccaaataagccttcaggcaaagcagatgatccttttttttttttttttttaagtatccaaaccagtctcagatttcttcagccagaaagcatgtttttgcaggctttttacaaatcctaagcaaagttatgtagttctcgagagttatagaaaaccaggtttgcatcttggctctgatacccctccctgtgatactttagaaggcttacctggcctctaaaaacctccatcttctcatatgtaaaacacaaaaaaccctgacacatagtatgtgctttgtaaactgtagctcttgttaatagtgaataggttttgtttgtttgtttttcccaaaagaatttgatgcttgtgttttgaggagttaaaattctcaatgtaatagaagactctataataaacttacgtcttcttagggtgatacgaaaattattaaactcaatccccctttagttgcaaacaatcaatactcaataatttttttgaattgatgaacctctgattgtgtgcaactatcttaattatgtctatattcttggtcttgtgatgaaaagtatccagaaaatgtctactattcatcactgtatgccttcttctttttagcacagagctttgtacatacgaagttctcaactaatgtctgttaatttaaattgaagaagctttagggagttactacaatttaggtctggaactcacatcccattttccttcttttgtcccacccctacccatttcagccatgcatatgtgtatttggagccctggatcttcaaaaaggcagcaaggagctaattaagccattaatgaattaactttattttttgaagtttataacttatttagacttagtgatctttctttgctcattaacacctctccctgtaggcagagagaaaaaagattaaaatgtgactctgtgaattcttaggcccatataaattcctaagtacaggggaaaagcatcgatttgtaagtcaacatgacattagtcagaagtgttggtttttctttatctgcaggatctgtttccaaacatatttgatacccaggacttgaaactacatcaattatttgaggaatcttgttagggctccatttgtatggagaggtaacactcactggtggcagtggtttgtgggtagaaggggccttcgggtatgtgcggcaaccttgtcaccagaagctgacaccaacaatacacactcacatttaaaaaatgccaaaattgtatccatcacctccaaaattttccttatgtgaaaggttttggcaaatccttgccagattttaaatgattcattctacatttgtatttcacagttataaagcagaactttgcacaacaagttaacttgccaaaatattatgtaaatattgccaaaatattatatcatcaaaatattgtataatatctgtgtattactttttgtattatatatttgtattacataatttgtgtatttatttgctgcttatttaatttataaacataacagaaatataagggaaaaaaagccagataaattttccagaatagatgagaaatggagaaatctgagtccttccttcaagttcattgattatgagttgagtaaccatgatatgctagtatcttttcaaatatataattttttgattatataaagataaggttgatcttcatctcagacaattttccagcctagtagaaacaataaacacagttggattgtaacccaaacttcaactgtaggtcatctcacctaagttagtggatatttggtataatgtttagtaaaaagctacactttgtggcccttcatcatagcaaatattggctttattggcctttaatatcccaaataagaattatcaagaaaataggctccattttcattattaagtatttcagagaaataaaacaataatactgccttaccattgtaggtcattttatagtttccaagggttttcaactatatctttttttaaaaatttgaactttataacatccctttacagagaagacattttacagaggaagacactgagcatcagggacattcagtgactgctggctggtaggcagcagaggtcttgaccagacccctggcttaatcttcagagttcttccatgctgatgcatggaagacttgcccaaggaagttgtctccatatgaaacagccttgaaaataagatgactttcagtctagtttgatcaacatttatgtaaacatgtaattaaaaattgtttgcttcaactcaacagtatgtctctgaatgggaactggttctttctcaggaatattcttggctgaatgtgtctgtgctgtgtcatatgcctcctctttacatatgactgtgggagggtgtggctgtttctataaacactgaaaacagacctgtggctaacaaaggattgtgggtggcagttgcttttagaaaccttggtgaaacttttcaaaagaatgtttcctatcaagcggtgcgttgtacatgtgggagaatccctgacagcacgttgctcttcctggagctccgtgagcatttattcccagtaatgtcctttggtgcttctttccttcatcccttaacgaacctaatccactctagccactcttcgtgatgtgaggtcaagagggtgaacatggcagatgtggcatttatgcgattacattctggtggaagaaaatgggccattaaaatgcaaaccaaaaatcaatgatctgattaattgcagattgtgataactgtaagaaagaaacagagtgccctgataaaaattaagtacgctgacttatttccatagggtttctgagaagatcttcactctggggaaacaatatttaagctgcgagctaaaggatgacgatgacacataggaaagaatgttccaggctacaagaccaatcagaacagaagccatgaggcgggaagaagctacatgtctctaacttctagtcagtatgaccagagtgtagattgagacagacatgcagcatagaatggaatgagatgaaaatggagacagaggcgggatctagaatatgctatatcttgagtcttctaaaatgtgtccagcgtctgttctcagtgcaacaataaactatcaaagagttttaagcagggctatgagtttatctgacatctgttttaagaggtcattctattttatatgagtggaagagacatgaaaaagaccagttagaaggctaccagaacagtccagcagagagatgatgttgggagcaaataaagaattccactgtggaaatgtcacatttgagatgcccaagagacatctcagtagaagatttcaagcatccattgtatataaaaggctagagctcaaaggagaagtctgggtcagagatagatatttcagagttttgaacatatatgtgatacgtaaacaggaatacagattaagaataggggataggatcaaaccttgagaaattcgaatttttaagataagatatggaataaaaagataaaactgtgaaggaaagtcagcaatgtgaagggaagagcaagagtgtggagttgtcaaagagaagaggatctcttgagaagaaaggagtgtttgatttgaatgctgctgagaagtcaatacaaagaaggcaggttttacaacaggaccagcctcataattagtgcatctttcaaggagtgtgaagtactttcttcactgatttctgacattccgatttgtcttactttacttcattgcaccaggaggaatttgaagatccatccaagttgtcagccatgaaaacaaaagtgcagcacgtgagccccagctgtgctcctacctccttggtttggtttccatgagtagttaagcttagaaaaattgtgaagaaacttgttgtgtgggagcgatttttcaaagacctacaaacagaagtaccacttgacccagcaatcctaaacttgtatatatacccaaaagaatatgaatcattctatcataaagacaaatgcatgtgtatgtttattgcagcactattcagaacagcaaagatgtggaatcaatctaaatgctcaccaaccgtagactggataaagaaaatgtggtacatatacactactgaatactgtgcagctgtaaaaaagaacaggatcatctccttggcaggaacatggatggagctggaggccattgaccttaccaaactattgcaggaacagaaaactaaatacctcatgttctcacttataagtgggagcgaaatgatgagaccacatgggcacatagaggggagcaacagactctgggtcttaccagatggaggagggagagaatcaagcaaaataactaatgggtactaggcttaatacattgggtgacaaaataatctgtacaatgaaaccccatgacatgagtttacctaaacaacaaacctgcacatgtacctctgaacttaaaaaagaaactttttctgtatcttaggatcatgagaaagaatcacgttcaaagagtaacaaaattgatattatatttagacagggaatgggattgcaagtgaagaatctgtggaatctcttgatttgtgaagatttcttttagagttcagtaatggatctgtgacatccaatttttctagttaaagagaaagagcattgaactaagaatcagagacttggtttgcagtcccggattcattggttattggttgcttaaacttgggcatgtcacttaaccattctgacccctaatttccttatctgaaaatggtaaaaatcatacctacctgatagacttgttgtgagtgttaaaatgatgtggcttaaaacctagaggaggcattcaattaatgataccttatttttattaatattagcatattgggagtaagcacagggccaaatgcaatcatgtatagaaaagcattccgctaactataaaacattgaataaaatgcgctgatgtgtttatgattgataactgttttttgtcagctttttaattttagctgcaccatcttactttttggtacagatctatttactatctaggagttgtgggggacttggtgggtagccagaaaagatgacagctagcagagcttaggcacaggagcagatgtaagtgcaggtggctggcagtgtggggaccctggaagcagctgctctcagggtaaaatccacgggaggactaggcagggtgagagagcatccccaggcaaagtagagtgacctgcctctgagagtttgggtgtagaatgcagcaggatgactcagaaaagtctgcagagctttagaaatgcttttttttttttttttttttttgatgtggtgtaaggttagaagactagaatgacgtttgtctattattcaggagatgttctttgtaggagaaagaaagggaaaaagaaaaagattccaaatattttagtgggcattatgtagttccgtctcttgctccttcccttaattccccctccagaggggaaacagatatctgtgaaactgaaaagcttgcatctttgtgagatctgctggagggaagctaccgtttaaacccagtctccattattttaaatggttttaagcctcacatgtagtgctatttatttttccttctaaaaaatatttctgggttatgcctccatatacaaaactcacctttgtgccattgtgctgttttgatgataggtaatttagctagatttagctaccatctattgagcacttaaaattaatctctgtaataaactctattcaggcatttcatcatttaatttaatacaaaccctgtagaaagtggatatcactcctcttttgctaattgggcactgaggtttaaagaggttaagttaatttctcagtttgctatagctagaatggaataggtccattatttcaatataggtttgccagactccaaagcatgtactggaactactgtggtataaaacaatatccactccttagaaagatcagcatattcatcttctatgtcctatttataagtgaaccggtgtgctcttccctctttattgagatttttttcaaagtaggaaaaagggaaggaaaaagcatttattgaccacatgccatatgccatatttctttacaaatattttcccatcattcttagaaataaaccccaaatgaatatttttgtccatgtctttcaaatgaggagattgcttagagaagttgaggagttcgtcaaaatccaccatgcttatttattttcttttcatcttacatttttacatatctagtgattgtcagatactgagttatccagggttaaacagaagttacagtctgtgttaccaagggcctcgtagattactggagaagacaaagatgcaaataggcaattataataaaaaatgctacacagacagacaggaatatattcaagtcactcttaggcgcttctcctcccaaaacttaatcccccacttccattacgccatggtgccttccagaattagcgcagtttgcatactgaaggaaactgaggggtggtcagaaacccagtttgtgcaggaaaaaaaattgtggagatcaaaattagcttcagtttttaatatcagccattaattctgaggaacaacttcatccacttaacttgattttccatcttccttgagtcccaaggcaaaactgaaatggaaaagaatctacaggatgctttcatttagcaaagaggcaaacaaacccaaatcgagcagtacatcatagcaacccactaattggaagtctgggtaaaacatctctcatcccatttctaagaacttagctatttatccaaagcaagacctcttgccccctggagctctattccccaaagagaagacttctttaaagagatcgtccttcttagaaaaggagatttttctttcccattcagatatttctagattggttcacgtggatagagaattctatgccttttttagccactgtgactcagatataattcattttgccttaaaacgcaaagcatcagtaaacattgttagcattgttatgtcacccttttttttttttggttgttcacaaattttctttgttaaaatcctgtgcagctttttgaattcacactaaagaactttaaatttccaaatgaagaaatttcctggccagtttttggttttttttttttgaagatgactgctgcctgagtgtcaacatttgagaaaatatagaatttaatttttggaagtcactagatatagcaacctgcctggtgccagagaagagctgtctatgctgtactgcaatttgacttttaatccatcgtagatctgctaatggtatggcacatgtgaagtggtaaattcttgagtgtttgagacaaacattttaaggtacccatacataatgttaagttcacgtttaggaaagtagtaccagttaataagattacttatttgaaaataagaccagtttatttcaatctggatattcgaattatcaaataatctttttttttcaggattttcttggtgtatgttacctttttagtgaaggaccagtgtctcagagctttattttttatggtagtttaattatttaactgaaacctggaagaattaatagggtcagaattttagatcatgaaacatattttattgctcagtggatgatattcttcttggtattatttgctcttccccagagtcaccatatggtataaattattttaaattcccacaattatcagttatgtatatactaataatatcaaaatcatttgtttgggacattttttgtaatttattgaattttcaaagtcaattttgttcagaccattttttttttacaaagtagcttaaaggcacttagaaactgacagtattggatatttcatacgattttttagaattgcagtatctgccatttatctgaggactggtgattcaaaaactctgtttttggttaattttaattaaaaacatgtccactcaaaatactgctcaatacccaaatcattgcctaccttgtatatagttatttttcctaagggcaaaatagctaagaccataaattacgatggcaggcacatggtttgctgacagaactatataaaatactgttttcatcctcatgtcagctctggtacatgcctctttactttaattccttggggaatctgttgtaagttatagttttaaaaaacatccctaccccactagctctgtcagcttacctttttctgactgaccattttatttctctgaaagaacagatagaaactgagttatgtcttagctgaacttgtagtgccctaaatattaatagctgtgaaccagtttagtttaatttggatatttcccaatcttacacctgcgatattgcaaggtagttataaaaagtacacagaattcatctctataaatatatgctcattttatatcctttacaatctgtttcctagattcctaatccaaagaggccattagtaccaatgacatgatggatagagtaggttataatgtttagcagctcattggagatgacatagtttgccaagttaatttacacattttcatactacatatattatgtacaatattttttgtatggtgggttttcatcgagtacccttctctcttgtaagaaattattttttaagaaacatgttaaagagtaaagatgttttaaataagcatttctcaaatggttggtccttactaccaagcatattctggaactgacactttagttttacttacttccagcacatttcatgggaaatggagatgtccaaggaaacaggaagacgttaattgatgatacattttcttctaatattttgatatcccccaaagaaaaaaatagtccaggagatagattatactagaacagtttggctacattatctaaaagtatgttcccatggaaaattatataataggcttagtacattttagaccatttttttcattttctttttttttattattatactttaagttttagggtatatgtgcacaatgtgcaggttagttacgtatgtatacatgtgacatgctggtgcgctgcacccactaactcgtcatctagcattaggtatatctcccaatgctatccctccccctaccccacaacagtccccagagtgtgatgttccccttcctgtgtccctgtgttctcattgttcaattcccacctatgagtgagaatatgcggtgtttggttttttgttcttgcaatagtttactgagaatgatgatttccaatttcatccacgtccctataaaggacatgaactcatccttttttatggctgcatagtaatccatggtgtataggtgccacattttcttaatccagtctatcattgttggacatttgggttggttccaagtctttgctattgtgaatagtgctgcaataaacacatgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacaatgtaaaagtgttcctatttcttcacatcctctccagcacctgttctttcctgactttttaatgattgccattgtaactggtgtgagatggtatctcattgtggttttgatttgcatttctctgatggccagtgatggcaagcattttttcatgtgttttttggctgcataaatgtcttcttttgagaagtgtctgttcatgtccttcgcccactttttgatgtggttgtttgtttttttcttgtaaatttatttgagttcattgtagattctggatattagccctttgtcagatgaataggttgcgaaaattttctcccattttgtaggttgcctgttcactctgacggtagtttcttttgctgtgcagaagctctttagtttaattagatcccatttgtcaattttggcttttgttgacattgcttttggtgttttagacatgaagttcttgcccatgcctatgtcctgaatggtaatgcctaggttttcttctacggtttttatggctttaggtctaacgtttaggtctttaatccatcttgaattgatttttgtataaggtgtaaggaagggatccagtttcagctttctccatatggctagccagttttcccagcaccatttattaaatagggaatcctttccccattgcttgtttttctcaggtttgtcaaagatcagatagttgtagatatgcggcgttatttctgagggctctgttctgttccattggtctatatctctgttttggtaccagtaccatgctgttttggttactgtagccttgtagtatagttggaagtcaggtaacgtgatgcctccagctttgttcttttggcttaggatggacttggcgatgcagactcttttttggttccatatgaactttaaagtagttttttccaattctgtgaagaaagtcattggtatcttgatggggatggcattgaatctataaattaccttgggcagtatggccattttcatgatattgactcttcctacccatgagcatggaatgttcttccatttgtttgtaacctctttaatttcattgagcagtggtttgtagttctccttgaagaggtccttcacatcccttgtaagttggattcctaggtattttattttctctgaagcagttgtgaatgggagttcactcatgatttggctctctgtctgttattggtgtataagaatgcttgtgatttttgtacattgattttgtatcctgagactttgctgaagttgcttatcagcttaaggagattttgggctgagacagtggggttttctagatatacaatcatgtcatctgcaaacagggacaatttgacttcctcttttcctaattgaataccctttatttcctctcctgcctaattgccctagccagaacttccaacagtatgttgaatagtagtggtgagagagggcatccctgtcttgtgcaagttttcaaagggaatgcttccagtttttgcccattcagtatgatattggctgtgggtttgtcatagatagctcttattattttgaaatatgtcccatcgatacctaatttgttgagagtttttagcatgaagagttgttgaattttgtcaaaggccttttctgcatctattgagataatcatgtggtatttgtctttggctctgtttatatgctggattacatttattgatttgcgtgtattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttgtttgtgtctctgtccggctttggtatcaggatgatgttggcctcataaaatgagttagggaggattccctctttttctattaattggaatagtttcagaaggaatggtaccagttcctccttgtacctctggtagaattcggctgtgaatccatctggtcctggactctttttggttggtaagctattgattattgccacaatttcagcttctgttattggtgtattcagagattcaacttcctcctggtttagtcttgggagagtgtatgtgtcgaggaatttatccatttcttctagattttctagtttatttgcatagaggtgtttgtagtattatctgatggtagtttgtatttctgtgggatcagtggtgatatcccctttatcattttttattgcgtctatttgattcttctctctttttttctttattagtcttgctagcagtctatcaattttgttgatcctttcaaaaaaccaggtcctggattcattgatttttttgaagggttttttgtgtctctatttccttccgttctgctctgatcttagttatttcttgccttctgctagcttttgaatgtgttttcatctaaatatttgttatattttttgatgaagggcaaaacattttggttacagtttctttgaatatttcattccacttacgcttttcaaccaaatacaataaaaaaagcaagaaggggttgtcattcttttttttttttcatttgttcttcaatttagcattgaaatattaaatccaaaagacaactacctttagtatgagattgtatattttgaaaatgtgcagaggtttaggtattttataatagtgacaatttacatatttataggaaatatagtttcaaatagattttaaggaggcagctgttaaaatttgacatattactgaaacttaattagtaatatcgaaatatttcagataacacagggatgactgagctaacctgattcaacacatcagttcacaatgttgtgaagaacacattgaacattttcatggaacaatgcattctgctgcttacttcaagaattaggaaggtgaataagatgattcttactctcaaagagcttataatttagtagaagaaagacaataagtctgtgtgcccatacatttattaatacaaggtgggtccgggtcatatcttataatttgtactaagtgtcatggggtagaagagaaaaaaacatttaatgtgatttgaaattgagaatgtttgtgtggatatgtattttatataagatacttataaaaaactaaatgcatcaacccacagattttttgtcttatggcctctgttagaatggtagaatgggaagaactatttgggttgttatatacacaggcctagttattattcccttgagtaaaatagggctttgttacagctaacctaataagaatatttcagtaatcaaatatttaaggaacattgttgaggtggcatggaaagtcaacacaaaaaaggaattccacttgagctgtaattttgttttatttgcttagcgtagattagaattgtgatacttgtactgttagttgcactgtacataaatattttgaattactgtcgctgattggaactaccttcgtgctttaaattaaaaaaaaaagatgtatctgtacattctaaatagtaaaaactctttttggctcaaatcttttaattctgaaggaatatactggcagatacttagtagacataaataatcattaatgcatgtatggtgtatttcattcagtagtaccaaaatctaaaacacattgagttgtctggcatggtttcattgccaaaagttgtgatgtgactctgatgtaacctggtttgttctgaacaactccaaatggttcttcagacttgcccaggatccatctggctcctgggaagccttatgttatcatggctataatcccagactctggtgacagtctgcctgggttcaaatccaggctctggtactcactatctgtatgaccttgaggatgttggtttgtctgtttcccttgcaaaataatgaacattatattccctatctcaaagggttgttgtgaggatactctaagataatgcaggtaaaagtgggatgttaacagcatttggtaagttgtaaggactcaggtgctggctatgtaaaaataaacttttttaagatggatagatacatagatagatagatagataggtagatagatagatagatagatagatagatagatagatagatataaaaacctatacctgaaaacattattttcataatatttcaaaagcttctattgtactatctatgcttttatacatagtaaaagcagatgacatgctggtcctactaaatttacaggttaatttttagatagttactaagaaatcaaactgtgtggaattttctggtacaaaattacaatatgcaataccttcctactgaggtacccattactgaatatttcttttctatcatatgtgaaatgcatcaattttaaatatttggagacatacctaatttaagtgaaaatctcggtatttcctgaaagtcgccacactataacagataaccaatcaaatttgtctagcttataatgtctgtcagcctgggtgatgtggatgggccactgtgttctcaactgcactgtctcagtgattggagccagttcatgaagcgctacagcctgtaggatgccaaggaggttctttttcgtaatcacacacaagcaatgtggtaaaaccctcaagggatagcagttgctttcacaatctatttacacacatacacacacatacacacacacacacacacacacagagttctttgttattttacatctggcaacaggaagagcatgctggacagacctctggcatcataaaccatccttccctctgacctctgtgtgaatcagcagactatgatctctgcagaatttaggattaattgcagcaaagaaaaagaacctctctgaaatctaaaatgtagacttggtcattagttcattttgcatgctgtggaaactatatttggcatcattaacagctgcttccatgagatgttgagcactaaaatatgattggtgaacactcaggattttattttgtggtattggttgcaattatggagatgttgatagatcaatttccacatcatctaaacccttaactaagaaataaagtggtacataatatgcatgtcccctctatatgagactttgttaattttcttaatttaaaaaatttttttaattctatgaaggaaaagaaatttctctttcagctgatgtttccctgaacacacattgtgatcatttactatttcctaagtgattcaagcagcaatcttgttttagaatatttcaactgaaatgccagccctggaatttcagtgctgattttaggaattattctaatgacttcttgacaagctttacctacatcaggagcaagtgaacttggcagagttgggataggagacttgcctccaaaatgttaacttatatataaccaccttgttatcgcattagttgttttcatggtggctgtggtggtcaatagcagaggcaatggaatgagctgtaataagagtcagcaaatctgagtggacttggcttctcccgtttgccatggtgtaaatatccccaccatgattgttttcaggctaccaacatgatgtcactaaatgtggaattgagaagggatgtccaaaatatacatcaataaatcagccctcatttgattttcttctcagtgaactatgtggttaaatgacttttatctacctttatctcgccattagcaggagacattatggaaaaatataatgccataaagtcacctctatgtcattgtccttgttagaataaaaattaagacctctaggtttacttttatgggttgagcctttgacctatctgtggaagtggtaagctggaacaacaaagaggaaaatgagagtctgtgcttttaggcaggtagttaatgaaggaccaggtaggaatgaagaagccaagttctagtccaaattgccattgattatctagaagattttggacaattcacttcatgcagtagctcaacatccatcaaagagtttttgaaagtctattatgtgccaggtgttggaagatgtgaaggtgaacaagcagatgatttcaccttaaaagagcttgtagcttagtgggaaggaggaaaaaaaaggaagtaataataacaaagtaagaaaagagctagcatagagctggggaagcaaaacacacagaatgaaagtggaacctgatcttgcagagtcctggaagggttctgggaagagatgactgtgtgctgagcaaggaagaatgaatagaaagtaggcaagaaggaagggtgagatgagaggcttcttgatttgattccagatctcaggttttatttcaccgttaagtatgatgttttagtctctcttttcttttttagaaaccttcactatgttaaaaaacagtttttttctattttttaattggcaaatagttttttttaaatcacaagtaagtattgtgtaattgtgtcagatttttttctgcacctattaaaataattgtataggttttcctttattctttaatgaggtgatatcatatcaaatattagaccaatattatgtatctgaaaaaatatgcacacacacatataaatgagtgtatttgtgtgtatatgacttttgagaatacattaatgagagagattgtactgtaagttttttctaataatacccttgtgatagcaaggttataatggccacataaaatgcattactaattgctttttatttctctttcttggaagagattgtgtatgattgctgtaatttcttccttacgtatttgggagaattcaccagtgaggccatcttggcctgaatttctattctggaaacgtttaaaattactggttttatttatttaaaagatttagggttcttcagattttacattcttctcatgttaactgtaagttacagtttttctttttttttaatgtgttgttattattttttgtatatgtccatagggtacaagtgcagttttgctacactgatgtattttgcattatggtgaaggcagggccttcagtgcctccatcactggaggaaggcacattgtacccaccaagcaaccttccatcatccactatctcccacccctcacccctctaagtctccattgtccacacattcatgatggacagtgtgcactctgcttccatgtgcacacattatttagctcccatttataagtgagaacatgcagtatgtgtctttccatgtctgaattattacacttaagataatggcctccagctccatctttgttgcaagttggtgtttttcaaaaaatttccttatttgggttgggcacagtggctcacgcctgtagtcccaacactttggtaggccaaggtgggcagatcacaagatcaggagttcgagaccagcctgaccaatatggtgaaaccctgtctctactgaaaaaaaaaaaaatctaaccgggcgtagtggtgcacgcctgtagtcccagttactcaggaggctgaggcaggtcgcttgaacccaggaggcagaggttgcagtgagctgagattgctccactgaactccagcctgggcaatacagggagactccatctcaaaaaaaaaaaaaattgcttatccattttattcaaattgtcaacttcattgacataaagttactgttcttatctttttgacatctgtaggatctctatcaatatcccttttgtttttatacctgatattggtcattcgtgctgtagtttttttcctcaataaggcttgttaagagagttttaattgtattagattttcccaagggcaaattgctggccttgttgatgttctctattgtacacttttttctgttttataaatttgtgccttttttttttcactttttctcatttctatttcctttgggtttgatttttcttttttgactttttgaattagagtatagattattgatattcaactttcttcctttctaatatatgcatgttaggccgtaagtttctctttaatgagtttcagctactttccctaggttttgacatggtattttctatattatttaattcaaaatatattctagcattcattgtaatttttctttaatccaggggttatttaaaaaatatgttgcttaaatttaaatgatttgaagattatgtagttatttttctgtatttgagttctagcttaattctaccgtggtcagagcatatggattgtatgattttggtgctttaaaatgaacttgttttattgcttatcatatggtccaattttgttaaacattcaatttgccctgggaagtaacatgcattttgcttattttaaaagcagtgcattataaatgcaaattaaggcatttatatataatgacatatatatgtgtgtgtgtgtgtatacatatatatgtatacatatatttgcttttgacttgtttcctcagctactgggagaggtatgtcaaaatctcaaactttggttgtgaatgtactattctttataaaatttaaaactgtgttattaggtctataaacattaagaatgtttgtatatttttggtgtaatgacccttttatcagtatttttttcatatttatctctagaaatgctttgaagcctaatttgttattaatatatcaataattgtatttcaaactagattattcaattcatgtaaacccgatgtagttaatactttatgacaaatttatcgtgcttgagtttggtcaggattctcaattctatatttgatgtcttttatcaagttttgtaaatacttggcctggatatactcaaatatttcttttatctcaatctttatctctccatagcttttgggattctaattacttgtgtcttattcctttatgtcatgtctttatgttcttttctaccatttttatttttttctcaatgttttcatccagaaatttttctgacctattttcttattaattaatcttcttcttctgtgtcaattctgctatgaagcccgtccactaggttttaaattcaattatagaactttctgttcaaaaatttccactttattctttatcattgattttatttcactggtaaaattatctgtctggtcatctttttaaaaagtaatatgaataacagttatttattctaaaatccttatgtaactgtaatatttaaaccatccaccaggtccatttgtgctgagttttctcctggttttcagtcatttgattttgtatgtatgtatgcttggtaattttggattgggtgtcagaaattgtgtatgaataaaatgtaaaggttctggatgatgatctgttatctcagagaggaatgtattttcttcaggaaggaatttaagtacagatagaccagcttgatgcagttagaaagtgagacgattcaaggttttattcctgtcattctgacagcttgttattttcagtttctcctttgtcctaggatacagcccttcagaggtctcaaatgaaagacggggccttttttctttataggtcccaaactccagtttttgtctttcagttccattaaactatggaaagctctgagctactgttttctgttcagcctgtctgccccatcctgcttgtgaataagcagttgcctcaagtgaaataattttcctgctttctggatcttggtctgtcaagttctaactgtcttaatcattcctcagtatcttcaaacatttcccctgcatttatagttgttataagtactagtatgatctaagctattctgttatagctggaagcagaaatgctgccatcgaaagagattaggcattggaataatgtgatctgatttgcattttaaaaagatttttctgaacaacaatatcctcatatgtgcaatgaaacattttgataaaaattgttctctcaggcccttttcagctccaatattctgcaagtcttgagagtactaatagtgtgtcataccatgatttcaagctgtcaaaaccccagggcttttagttttagtaggctaaagttagaaaagcttagactctggggaaaatggccaagaagaagactctcatctttggtgtctttctatgtggcttcatcactgtacttcttgttagctttcagcaacatcctctcttttctgggtcttggtatctgggcacctagactatttttccagtaacctgaccactctctcctcatgtggtggtgccccattccacactctcttctaaaatgtttcatacttgagatttaaaattcactgtccatcctgcatttttctgattttttttagtaataaattaacatttattgggtagttatgtgccagacactgtgctaaacacttagatggaatattttattccatattagctctatgaggtagggacaattattatccccatttacagatgacaaaattgaaagttaggggagtcatgtagcttacctaatgttacagaggtaaagtggctgagatgaattctgatccctggaatgggcatcatttagaggggtggttcccaaaagccagtccacagactgtcttgttctctaatatataaaaaataattcagcaacatctaggagcataaatccagagattctgaatcagtagttcttggatggggcccagaaatctgaatttttttttccttttcaatgattacattttagtttactgtacaatgaaacagagaaaactactttttttttttttttttttttttttttgagacggagtctcgctctgtcgcccaggctggagtgcagtggcgggatctcggctcactgcaagctccgcctccggggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctacttttttttttaaagatctgagagtgtgaatcttccacctccttttcaaccaaagttgaggaatttgtcctgctataatctcaacccttgagtatttctttttttaaaaaattttattattattattattataatactttaagttttagggtacctgtgcacaacgtgcaggtttgttacatttgtatacatgtgccatgttggtgtgtgcacccattaactcgtcattcagcattaggtatatttaaaaaaaaaaaaaaaaccttgttatctcagtatgtttttattatgcaaatttcctctaaataatgaaagctcctttttaatgttatattatgatagcaaaaggtgtgctctttgtagagttagcaggatatggttgtgtgacaaaaagccaaatagtattttaggctccaatgaagaggaatatctgtgaagggggtctttcttggtatttttgaagttccacttgaaagtgctgttggccatcactaatcatgagggaaatgcaaattaaaatcacaatgacataccaccttaccccccagccagaatggcgattagtgaaaagtcaaaaaacatagattttggcatggatgtggtaaaaaaaaaaaaaaaaaaaaaaaaagatgtttatacactgctggtgggaatgtaaattagtacaatctctatggaaaacaatatggggatttctcaaagaactaaagacagatcaaccattctatccgacaatcccactacttggtatctacccaaagggaaggaagttgctttatcaaaaagacacctgaatgtgtatagaatcatcctaagtgcccatctactgatgagtggataaagaaaatgtggtgcgtgcatgtgtgtgtgtgtataccatgaaatactatatatatatatacacacacacacacacacacaccatgaaatactattcagccatttaaaaagaatgaaataatatcttttgcagcaatttggatagaactagaggccattattctaaataaagtatttcaggaatcaaaaatcagataacacatgttcttacttatgaatgagagctataggtatttaaaggcatccagggtggtataacggacattggagactaagaagcggggaggctgggagtgagggtgagagagaaataactatgcattgggtacaatgtacactacttgggtaataggtacactaaaatcctaagcttcaccaccatacaattcatctctgtaaccagaagccacttgtatccctaaagctattgaaataaaaaaaatcacaaagtgctgttgcctactccacagccatgcaagtttgattctggatctgagacaagctatgatcacattgttgtagagaactgaggtccttggaaaataaaacacaggttcccaaccagaagttaattttattctgctgttaaaatggaactatgacttttcttatttataagaactgtccttcctttttaaggttaaaacatgttattttattataatgcaaataatattcattatttaaaaatagaaaaataagaggcagatgtagttctagctcttaataaacctggctaaacttttacaaatttcatctgatcatttatatacttttctacatgattggacttatttataatttggatttttgaatagtgctttaacattttttacttaaattgtatacattttatagattatctcttgataagcattattttaatgatatatatgtataaataatatatattcttacataatacacacacatgtctatgtaatgacatatatataatattttgcaatggtgcatatgtgcttgttcccttaagatggatatttatttgactgttttcttattgttggattattttgtttcataaataacattctatgctgaaaatatttttaattgctataaattgcccaactaagacatataacttcctgttatcctttcactacctttgataacacactaaatttttctttactatatttcattcccttcttaatctcatttctaaaaactgtatttctgtcttacaatatatatatcattccttcagtactcctacctgttgatcttctcattgttatttactggcttgtcaggtcttggaagataggcttctcatacaacccaagcctgtcttttgacctgactataaatattttattgtttacatcttcccctgcaaagaattcctctaggatctgcccctttcttgttctccaggcagtatgccttggacattctgtagctggctgggactgattccttgccaggtcagtaggacagatgtgtagactaagaaattaactagtgagttcaagtggaggttcctggcctgttggtgcctgtgaacaggattcttttgagtatgattagtgacatgaaggtcctgaataatatcgtaggcagaagaagtgccattactactcacagtgtaagaagtagcttgagttaactggtgaaagagctaaaagtcaatgaaaagtattgaacttttaaaatgtattatctattgaaaagtttaaaagatcatttattgattaaggaaattcctttgactttaatagctgtgagctctaatgggggctagaaactccagcaagtggtacagtttctagaacctagcagataatttttcattgactagaattccatgtgtgatacaatgatttggcaaagtaaatcacaataattattatgttcattgttttctcctttgtttaccttgattaaccatctttggtgattgtttcataattgttgctttctaaacaactttattgaagagctacaaatggctagctcttctcaaccctttaattagtgtctgggatcggtggatgttagttgaggggaaaaggttattttaataatttaagacaaaacaatttagaaattgtatttttttgaagacaacttgctatgtaaccttttataattccctgaatttttctgaaattgatgttttctttagtgtatagcagtgatagcatgaaaccaccactgacttttttagggcaacttgctggctaattttataaaatttgaactgcactatatgaatgaagaatcatctgtagcaattgctcttttccaaatgttcttttgcttcaaatgccgtatctgaatattagattgtttctccagatgttacaggctcatgtttccttctgctgaattcaattgttggttcctgcttatgtttctcaggatttgtatcatttctctgtcttaagtaaggtttttataaatgctcatcaatgttgtagagtttggattcaattcagatagaggctatttccaccggacttttgctcatctacttcctccctggagaatggtgaaaaacagtcctcttttccctcctctgatagggtgatgggctactattgctttctctctcctaatatattgagtacaccgacctctcaccgaaaccttaggtcaaagtgagaagaggtgattgtttttaattggatgattgctaccatatacttctcttttggtgggatcccaaaataaataaataaataaatgacactccccccaaaaaagaggaactaaaaaaaggctgagaaagcatgccatgaaggtccaggcttggacaacaagcataccatgatgtgaattttagccccatcacctactaactgtgtgaccttgggcaagcttttgaactcaccagggcctcaatttcctaacctataaaatttttgtgatcattattataattacaactaagaataagtaccttatcgttttgctgcaatacacgcgtgataattgtcctaaagtgcttagcatggtgtctagaacgtattatgtacttaataattattgtctgaaaaaataaacacatgaagaaaataccttattgtcaaagaatataatactgtgccccaacttgtgaaagattaaacctcttgtgtctccaggatttctaatagcttatcccagaaaggcagtgcagaggacatgtgggctctcttcctactgcagactcgggctgttctgatggtggggtccaagggcagccttgcttctgccatttgctcagttgatcttgtgaacagctgcggttcttgctgtaactacttgctcgctctcagtgactctgtactgtaaatgtttcatgtgaaggagcactgctctaaaacaaagctggaagacagggaggcaattgccagagctgtcattgtgctgagtcagggaaggcttcagcaatcatccaaagagatgtggcatttacacctgcagctggatgggttatgaacccaaataggtccttaaaaaggaaggctcatctcctttccccccaacagccccccacccactcaatttttgcctactttaagggaaggtttttggtaactaatttttcatctgctcattagagcttaccaattacagcatgtgttacaaattataggttccaggactttgggtgaaatatgcttcgtaaataatggcatattttgctgtgagcagtccttgattttggactcttgcattacctttcatctcgcaaattttccgtataggaatacttggatgtacaaatttcaggcaagtatccgatgtatcttatagaatcagctacccgacaatattgtcaaaaagagaagcaacgctttcagatgatgtaagcatagaatcaagcaaggagttggttgaatccttcttgtgcttttcctttgagatcaccttatttcagaatcctaggaggattgaaacattcctactttgatattttcctctggagatcacttgttaaaagtcgtcaggagtgacatttactagtcttgtattttctctggtcttaacttgaaaagttctgctcatcaaaaatgagtatgttgagatgatattttctatagaaattttgtattttacccccttaaaatcctcacttttcacatgaaagtgtatgctcagataaaacaagactcatggagagcacatgggtgagatcatgctaggctctcattgctaggctgagatttgcatttttctgaaaatcagagtgctgaattttcttagctttgaagtagctaatgggacagtgtgtgtatatgtgtgtgtgcccacttgcatataattccgaatcacttgtttatgtgtagtatatgattctatgacaaagagctccctttaatgcaaatgtaaggcattcatgagcatctcatgtataagctcatattttgaactttgtttttcttttactcaaagaatttacaaaatcattttgtggtttgaaaagtaattcagatttcctataaaatgttatataaaattttaaatttagattttagctagcaagtattggcttaactgtagaaagaacttcattttctaggaccattcaatagtctagcttctgctttatgacaatctactcgtgttttttaaaggataataatattaaaacatttttataaatctcacaataatgctttatgtatattaactcatttggtccccacaataaccctgatggatgtcattattattatcctcgttttttttttttgagacagagtttcactcttcttgcctaagttggagtgcagtggcaccatctcggctcactgcaatctctgcctcctgggttcaagtgactctcctgcctcagcctcccgagtagctgggattacaggcgtgtgccaccacacctgtctaattttttgtatgtttagtagaaatggggtttcatcatgttatccaggctggtctcgaacccctgacctcaggtgatccactcgcctcagccttccaaagtgctgggattacaggcgtgagccactgcacccagcctattatcttcattttaaatatgaggaaactgagacacagagagagaatatacattaagatcagaaagctagaaagtctaggaactaagattcagaacaaaatcatctgattccactctctgtgctcttaaatacttcactagaataagtcttattttttataattgatacaactggtctaaatattaatgaagttttaagattcaatttacatatagcttctgtctctgtaagttaccagttattactacctaaaatacacttgtagtcaatagtaacattgaatattcctagattttattttataataccaaccagaataggaggcctcaaaacacctgtgatggaaaaaatgcagtgcctgagtgcatgcagctaagcctgatcactagaatacatttcatttatattttataagataccaaagacttcagaactacaaagagaactatagttgctgcaaccagaaacctattcacatatacgtacttttataaatcatgtgcatatgtgtgtgggtaccttcatgtgtgtgcatatataaatacatctaaaagctgagaaccaccttagtctggggcattaaaattttagtaaacttttttgatgtatatgttgaataagttgcaaagttgaagtctgttccctgcctccatgtggcttacgtacacttgctaatgagaaaggagcttattacaaatattcatagatgtgatatatatgtgtacatgtgtgtatatatatgtgtgtgtatatatacatatatatgtgtgtgtatatatacatatatatatctttctccccctacacacacatacacacacccctttattcgctctctttttttttttttttttttttttagttggagtctcactcttgttacccaggctagagtgcaatggtgcaatcttggctcactgcaacctctacctcccgggttcaagcgattcccctgcctcagcctcccaagtagctgggattactttctactatacaaattttactgtcatagacattggcttttgtacctccaaaatgtttgttattatccacggaaagggtacccacattttacttctatggataaattacacatatattgactgatagctactatttaatgaaactttttttgtgtttcagggtctcaactctatctttctatctatctacttatctacctacctatctatttttttctcaattaattccagaatgttaaatttcatgatggcaaaagtcattattaattttgttcactgacatactaagcacttaaaatgctgcctggcacatgtagagactcagaatatgctttcagaattgaatgaaaatatcttgacaaggtagcacagtttttgcttttgtttttgttttaatagagtcagggtattgctctgtcaccccacccaggctggagtgcagtggtatgatacagctgactgcagcctcgaactcctgggctcaagcaatcctcctgcctcggcctcctgagtagccagtaccacaggtgtgtgccaccacgcccagctaagtttttattttttgtattttttttgtttttttgagatagggtcttcctcagtcttcaggtacaatctcagctcactgcaacctcaacctcctgggctcaagtaatcctcctgcctcagcctcccaagtagctaggaccacagacacacaccaccacacccagctaatttttaaaaaattatttttagtagaaatgaggtctcactattttgcccaggctggtctcaaactcctgtgttcaagtggtcctcccgcctcagcctcccaaagtactaggattacaggtgtgagctaccacacccagcctaatattttattttttgtagacacagggtccccttatgttgcccaggctggtctcaaactcctgtgttcaagtggtcctcccgcctcagcctcccaaaaggttgggattacaggtgtgacccactgtgtcagcctctcattgttttccatctgacaggtgagaaactgaacctcagagagcatggattactgacccagtatcacagctagtgcagtgcagaagcaggagtggaacctccatttggctccactggccagactccctatctgtgactctgtctccaagaagctcttcgaggccagacagcagcatcttctggggtcttttaggtcacaagtatccctggtcttttcatgactacacatttctggctgactttagagctctagatgtttttctcctatgttgatctaccccgtaaggctccatgagaggcttggactattgtttcacagtaggcttcctaagacattttgcttagctccttgaaggcttccacctgctcttgagcttaggaggagaatatggcctagtcaaagagagaagagcataatagcagataggagtaagtgagcaggaaacacagagaaatggtgaagaggaggaaagaatggccaatagaagatggaaaggcagcagtcacggtcacaaaaaaagggtccagaaacaatacaggagatgcacaagagatttcattgcttttaagaagtgttatgctaaaatatcttcctctatagggaaaagacaatggcaaagaacttttaaaatttttatttggctacttctatttaagtattaagtatatcgcggtgtacaataaatgtttacttaacaaaatacataaaactctttcctgggctaaaccttgaaagacagtcatacatatttcataagttttttgttgtaaaatatttgatgatttcgcagttagggggtttcttagaaagtgctatacataatcagatataacctttccattttatatttccttgtgtaagcaccatgacttctagtaatcttgagtgtctccccttttcaattcacttaggaattttgcatttaaactattgcccttgtttagggagaacaaaacaacacatccaaaaaaatgaccaaatgtgtacaacctggtattacatttctgatttacataatttccacctcagaaaagttttcttaaatacaaaactcactcactttattttaatgcccgaaagaatagcccagataaatggactccaaatttgaggcctgagtaataatgcattttaggattagactagtcatccttgctattttcgtggtgttcatcacgtacagagtacaacaagatactctattatcccttcaggctgttggataaatacaaataagcacatacaaccaaaacaaatcattgtatctgtgaattgaaatgcatgtcataagaactttaatctggtgcaattgctcttatagccaagtaaatatagtcagcaaagcttaccttttatgttaagcattttacagattacatatgtaagataaatttaagatttgtgtttaaatgacttttaaaagtaaaaaaagcattgggaagacttcttactcagaggttgtggtcagtcattttcaaataatttttcattgccaacatctcatacataaacttatataagcttctacaacccctcccagagtcagccttctctcttctttcagtaacatcctgtgttgccatctgactgaactgcaccatttgtcaccagttccaacacatcttgtcaacataccttttctattggaagaaaaaaagaaaatgggcttgaataaaaacatgtaaataaatgatgagcactttgctcttttggttgaattaaacagtgttgaaaggtgttagctagagaagacttaatagaaagtataacattttaaataatgtttaaggggaaaaagaaaaagatattttaggtttcagaataaataaaagataaaaataaataataaaagattttaagtattagggatgacttgcaaaatctcagaggtaaaggtaagaaacactagacagaaaataattttatttgaatttaaaaaatgggagagaatccacagaccctttgagggaactggatcatctttgcagactccctgagatgtcgaaaaactgtgagtctgcttgctttctcaatggggatgctcatggtatggggcaatttctcagccctgatcatctgctgcctggaaatagactcagtgctgttggtaggggatggtgggagtgagaccggcctttaggactgcaggctgcatgggagtggggtgaggcctgtgattgctggctttcccccacttctctggtatcctgtatgactcaacagtggcagccataatccccctgggaatacaacttcattagactgggaaccacatccccatcccccacagcagccacagcaagccctgccaaaagagaggctgaactcagacacacctatccctgcctccacctggtggtctttctctatcagccctggtagctgaagacaaagttcataatctcttgggaggtctatggccctgtccactgcctaagaaaccttaatactcaaccagatgtccctagggcaagtttgcaacctgtctataggaccacagctgatgcactcttgaaaatgacacctcctggctggaggctaaaccaaaaccagtgcattaaacaaaaacacaaccaaggacctcacagagtccacttcactcccctgctacctccaccagagtaggtactagtatgcacagctgcaagacctgaagagggatcgcatcataggactctgcagatattccccagtacaagcccagagcccagtagctccactgggtggctagacccagaagagcaaaaacaatccctacaattcatctctcagaaagccccattcctaggagaagggggagaacaccacatcaagggggcacctcatgggacaaaagaatctgaacagcagttcttgaatcccagatcttccctctgacatagtctacctgaatgagatgggaccagaaaaacaattctggtagtatgacaaaataaggttatttaacaccccccaaaaatcataccagctcaccagcaatggatccaaaccaagatgaaatctgaattgccagaaaaaagaaaaattggaaggttggttattaagctcatcaaggaggcaccagaaaaaggtgaagtccaacttaaagaagttgaaaacgtgatacaggatatgaaaggaaaaatcttcagtgaaataaagagcataaataaaaaacaattgcaacttctggaaatcaaggacacacttagagaaatgcaaaatgcactggaaagtctcagccatagaatcaaacaggcagaagaaagaacttctgagctcgaagacaaggcatttgaattaactcagtccatcaaagacaaagagaaaagaattttaaaaaaatgaacaaaggctccaagaagtttgggactatgttaaatgtcccaacctaagaataactagtgttcccgaggaagaagagaaatctaaaagtttggaaagcatatttgagggaataattgaggaagatatccccggccttgctaaagatctagacattcaaatacaagaagctcaaagaacacctgggaaactcatcgcaaaaagatcattggcttggcacacagtcatcaggttatctaaagtcaagatgaaggaaagaatcttaagagctctgaggcaaaagcgtcaggtaacctatgaagaaatatctatcaggttaacagatttctaagcagaaaccctacaagttagaagagattggggtcctattcttagcctctttaaacaaaacaattattagccaagaattttgtattcagcaaaactaagcttcgtaaatgaaggaaagatacagtgtctaccaggcacacaaatgatgagagaattcaccattaccaagccagcactacaagaactgctgaaaggagctctaaatcctgaaaccaatactcaaaatacaccaaaatagaacctccttaaagcataaatctcacagtacctatataataataacacaatgaaaaaaaaaaacccaacttattcaggcaacaaatagcatgatgaatagagtagtatctcacatctcaatactaacattgaatgtaaatagcctaaatgcacctcttaaaagatacagaatggcagaatgaataagcattcaccaaccaagttttcttctgtttttcaggagactcatctaacacataaggactcacatcaacttaagataaaggggtaaaaaagatattttatgcaaatgggcatcaaaagcaggaatagctattcttatatcagaataaacaaaatttacagcaacagcagtttaaaaagacaaatatgttcattatataatgttaaagggattagtctggcaggaaaataccgcaattctaaatatataagcacctaacactggagcacccaaatttataaaataatcactactagacctaagaaatgagatagacagcaacacaatagtagtgggggacttcagtactcccctgacagcactaaactggtcatcaagacagaaagtcaacaaactctagcctgcaacaaatgaacttaacagatatttatagaacattctacccaacaactgcagagtatacattctactcatcagcacatggaacattgtccaagatagaccatatgataggccacaaaacaagtctgagcaaatttaagaacattgaaattacatcaagtactctctcagactacagtggaataaaattgcaaatcaactcctaaaggcatccccaaaccatacaaatacatgcaaattaaataacttgctcctgaatgatcattgagtcaacaaggaaatcaagatggaaattaaaaaattatttaaactgagtgataatagtgacacagcctatcaaaaccactgagatacagcaaaaaatggtgctaaggggaaagttcatagcattaaatgcttacatcaaaaagtctgaaagagcacaaatagacaatctaaggtcacacttcatggaactagagaaaaaagaacaaaccaaactgaaacccggcagaagaaaagaaataacgaggatcagagcagaactaaatgaaattgaaacaaacaaaaacaatacagaaaataaataaaaagctgtttctttgaaaatgtgaatgaaattgatataccattagtgagattaaccaagaaaagaagagagaacatccaaataatcgtaattagaaatgaaatgggagatactacagccaataccataaaaatacaaaagattattcaaggctactatgaacacctttacacacataaactagaaaacctaggggagatggataaattcctggaaatatacaaccctcctaggttaaaccaggaagatatagaacctctcaacagaccaataacaacctgcaagattgaaatggtaataaaaaaattgccaacaacaaaaaaagtccaggaccagatggattcacagctgaattctatcagacattcaaagaagaattggtaccaatcctactgaaaatcttccaaatgatagagaaagaaggaatactctctaaatcaatctacaaagccagtatcaccctaatgccaaagccagaggacataacaaaaaacgaaaactacagtcagtatccctgatgaacatagatgcaaaaatcctcaataaaatcctagtgaattgaatccaacagtatatcaaaaagataatccaccatgatcaagtaggtttcacactagggatgcagggatggtttaacataggcaagtcaataaatgtgatacaccacttaaacagaattacaaccagaaatcacatgattgtctcaatagacacagaaaaaccatttgacaaaatccaatctccctttgtgactaaaaacctcagcaaaatctgcatagaagggtcataccttaaggtaataaaaaccatctatggcaagcccacagccaactttatactgaagagggaaaagtggaaagcattcccactaagaactggaacaaggatgcccactttcaccacttctattcaacatcgtaccaggaatcttagccagagcaatcagacaagacaaagaaattaagagcatccaaaatggtaaagaagacatcaaattgttgctgtttgcagatgatatgatggtatacctagaaaccctaaagtttccaccaaaaagctcctagaactggtaaatgaattcagcaaagtttcaggatacaaaattaatgtaaaaaattagtagctctgctatacactaacagcaaccaagctgagaatcaaatcaagaactcaacccctttcacaatatcagcaaaaaaataaaatacataggaatatacctaaacaaggatgtgaaagacctctacaaggaaaactacaaaacactgctgaaagaaatcatagacaacacaaacaaatggaaacacatcccatgctcatggatgggtgaattaatattgtgaaaatgaccatactgccaaaagcaatctacatattcaatgcaattcccttcaaaataccatcatcactcttcacataactagacaaaacaatcctaaaattcatatggaacaaaaaaagagcctgcatagacaaagcaagactaagccaaagaacaaatctgaaggcatcacattatctaacatgaaactatattataaggcaatagtcaccaaaacagcatggtactggtataaaaataggtgcatagaccaatggaacagaatagagaacccagaaataaacccaaatacttacagcccactgatattcaccaaagcaaacaaaaacaaagtggggaaaggacaccctattcaacaaatggtgctgagatcattggcaagccacatgtagaggaatgaaactggatcttcatctcttatcctatgcaaaaatcaactcaagatggatcatatacttaaatctaagatgtgaaaccataaagattttagaagataacatcagaaaaacccttctagacattgacttaggcaaagacttaaatgaccaagaacccaaaagtaaatgcaacaaaaacaaagagaaatagatgggaactaatgaaactaaaaagtttctgcacagcaaaaaaaataatcagcagagttaacagacaatccacagagtaggagaaaatcttcacaatctatacatctgacaaaggactaatatccagaatctacaaagaattgaagcaaattagcaagataaagacaaacaatctcatcaaaaagtgggctaaagacatgaatagacaattctcaaaagaagacatacaaatggccaacaagcatatggaaaaatgctcaacatcactaattatcagggaaatacaaatcaaaaccactatgtgataccaccttacttcctcaagaatgaccataataaaaagaaaaaaaaaaaccaacaaaaaatagttgttggcgtggatgcaatgaaaagggaacacttttacactgttggtgggaatggactagtacaaccattatggaaactaaaagtagatctaccatttgatccagcaatcccactactaggtatctacccagaggaagtcattatacaaaaaagatacttgcacatatacctgtatagcagcacaattcactgttgcaaaaatatggaaccagcccaaatgcccatcaatcaaccagtggataaagaagatatgacaaaaatatttatatgtacacacacgccatggaatactacttagccataaaagcaacaaaataatgacatttgtagcaacctggatggaattggagattattattctaattgaagtaactcaggaatggaaaaccaaacgttgtatgttctcactcatatgtgggagctaagctatgaagatccaaaggcataagaatgatacattggacttcggggacttgcagggaaagtttggggactggcgaaggataagagaatattcactgggtacagtgtacactgctctggtgatggctgcaccaaaatttcagaaatcactactaaaaaacttactcatgtaaccaatcaccccctgttccccaaaaacctattgaaataaataaataaataaataaataaattgaatgaatgaaccaaaggtattgcacgaggaagcaacataaataaacttagtgagtgaaacagtgaagaaaggggcaatgtgatggtggtgataggtatacaggttaccttgttcacccttttaatactgtggataaacagaatcaagtaatttgttcagctaactagattccatgaaaatatgtagccatttttctggctaaatgtaagaagagggaatgaacaattgggttagaaccttcataaaaagacatccacagggaagctacaaagatttcttatggtccccaacaacaagttcgcatactgtgcctaccttgtttttctcacagtttgatttcaatcctctcacattttgtgaggtggctgtttataccaatctgtggcctaagatattcttatgactattacttgtttatcaaaatggtacacattcttcagttgcagctccacaggctttctggaactactgtaattaacattgatttctttatctctttccttatttgtcatgtatgattagcactacatagaatgacatttactttttctcctttttcttttatatgtgctaattctgtctctttagcctagtcagaagctctgagttcgcagaataaccatgaacacagaattaaaggtctagatagatcttgtctaaccctttcattttcaaagaaggaaagtttgtaaaatggaaactacagtgatattgagtgtatactatgtgtcagacagctttaacatttttgtatgaatcactcgtgttgtcatctcaaaggtcatatggaatacatactattattgtcatcattttacaaatgaaaagaacgatatgcagagaagtggcttgctgagggcacacagctagtaagagacagtgctgggattcaactctagaccttctggctctagctcttaactttccaagttagtgctgcaggtagaacaaaaactctgtctcataacttctttctccatttcagggctcttgcttgttctaactaatttgtaccaccataattcttatactagagcataataaaacaaaagagatgcaagtgtttattaacttcagccttgtatttcacagatcctaaacatgtaaacatacacctgatacactctcatcctttccgaagagagcaagtaataatgttatactgagtgattaatgaactgatgtaaggactcagtaatccgcatgcaattagtggatcaacaaagcaatttacgcagtaggtatgtattttgaatagtattctttctgtagggaaccagctgtatgtagtgtttaattgaatgcttttgcatcacagagtgatttggagtcaaatcatcaaccgcatttcccaatgtgtcaagtagacagttaacttatcaaaacttccgtagtactcagttctcttccaatgtgctccttatcttgaattcttttgaaatagtgtgccttataattttccaggaatgatttacatgtattcctgttcagagacagagggatggattacataacattccctgaggccctttttgccttcgagtaaatgctctttatcattctaagcttcttactctgagtaatatttgaacatgaccctgtggattccccataacaatttctgatactgtttccctagttgatatgtttggatattttccatactatgcaggctgaattctctttttaacttagtatgttctttttcactctgatgctttgacttttgccatcatagttttctttattttcagagtttatcgactgtcactaggctttcttctgagtcctttcgccaagtcatccatactttgctcttctaatcttctgttataacaggcttcctgttacttatatttttgctgttatactctgaatttgttccagattttctggtagagatttccctacaccaaaaacagtattccaggtgcagccacttgagaattgagtagagataaatatgtgcgcccctttttactgtgatgtcttgccatctgcagttcggagcctgtaaaagttagatttgggattgaaaataagacttccactaggactgccatttgcagcacaaactcacctggatggtaactgctgtctagccgcagctccctttcgacaggtccttctcagaagacttcttttccaggcttttttcttcctgtgcatatctgtgttttcattcattttcccctggtgaataagctggccctttcccaacctgactctcatcttgttatttgatcccaagatctgtaactcctctcagaccatctgcattatttctctgtccttgctgatgttttgcaacattctccagctgactatcatctgcagatttcattagcacaccatttactatgttctgaagatcattaataaagatgaataaacagaagagaagaccttctgcagacatctgtggaatttctctgggctgcccccacaactcgatcgccattgttttattttacctttttggttttttgcctagtgtttcattcacttccctccataagcaccctgttgtcatatctgagtaactgcactcataatgtgtgattttcttgcacagctttataattgcctaaacaattcatcatttgtctgacagcatttttcctttattaaatcccagttttattgacagttttcattatcttctagattgcagaagctatatgtaacaatgtgtgtgcccattctgatttctcctcaatttattactgttttaaaacctgtactatagatgataggaagagagtacgatgagaagagatagactcagaatctctatggctcttcttggaaaaacaccataatgtgtatggaagatcatgcatggggattttcctgcaaggcgctaacagtgaactttctatccaaaaagatagaaagaagttgtctctggttttgaacaatgaagatttatatctaacttatattgaaaaatcaaaggattagattttttaaactgaataagaaccatagctgtacttagagaatatctgtgatgcacttggcactgtgataagatgtgatgtatatcactctttatgattacaccaaccctgaatggcacttattttcaggtgtgacactagcctatggcggctgtcatgaggattagaaaatggtgtcccctccaggaggatactgcctgtgcctgagaatagagcacaggctgcatctaaggacccactgaccttctaggccagatatctttgtgtgtggcagagcctgcctaaatgtacatggaagccacgatttctttgtcatttaaatgaagaggataagatacctataaaagatagatttgagattgatactaatgtggttcctccatgccatattgtttctctgcacatagaacaaatatggatctaactcatacttctgtgattgcctactaaattcaaacagtactttgtgtttttacttagaaaagaatggatatggccgggcgcggtggctcacgcctgtaatcccagccctttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagctgagattgcgccactgcagtccgcagtccggcctgggcgacagagtgagactccgtctcaaaaaaaaaaaaaaaaaaaaaaaaaagaatggatataatttaatatgtaaccttctcttccaatctttagctatgctgttgattttcttcccagtcttcagctatgttgtttttgttattgtcattattattattattatttattactgaatctagaaagaatcatggagaagaagcagtattactctgggccaggtattctttgtaatatctttaaaatacatttgaactctgttcacatatccctttgtttgcctattagatccggtcaacattatgcaaacacacaccttcatgatattgaatattgatcaatttagtcacatgccatgcaaacgtagaaataccacttaatggctgggcatggtggctcatgcctgtaatcccagcattttaggaggccaaggcaggtggatcgtctgagctcaagagttcaagaccacccagggcaacatggtgaaaccccgtctctagtaaaaatacaaaaaaattaactgggtgtggtggtgcattcctgtagtcccagctacttgggatgctgaggcaggagaatcacttgagcccaagaggcaaagttgcagtgagccaagatcatgccactgcgctccagcttgggctacagagtgagactccatctcaaaaaaaaaaaaaaaaaaaaaaaaaaaactactacttatcaaggaatgttttgaatgctttaattctttgacttaaattactatatatatttataaaggtgtagaagatttaacaactggaatgtgtgtgtgcgcatgcacatatacacacatatgcacatatgtatatatgtgtatgtataacatatatatctataaataaaagttatttaccaaagcatcatatattttcattttcttttctttccttttgttagcattttcatttttcttgagtactgtttttattgaaatgcaccttgcactttagctatagagcttttccttgttgaacaatgtagttttcttgctcaacaactctgacatccaggtaaatggaaggaaaatggataggggagttgtgtgttcataatgccactttgccaccctgaaatctatgcagataatctacttggaaggctttgagccccagtggaatacagaaccatgtaagtatcctgcattgatttacagcacctgctacagctgcttggatcttggcaggcattttctctcctgccaaatgctgttgaaattgctgggctggtttagatggaggttatatttactggacatgtttataatcttcagagtgatctaagccatagagagctaatttcccaaagatcaatgactaagggaggatttcagaggttatcctctttatccgatttcctgtgtcctaatgagatggctgaaacctgtttggaatctttctgattaggaactcttgtgagagtcaataaagaatatgacattcataaatctaaataagaggcgacttggcagcctgtaggtgattcatgccacgagaagcctttcccctgcccccaacaggatgtgccatgggtggccaacctgagacaaggtcagacttgaaccaagagtcttgagaggacttggcctctcctggttaattcagaggactcttctggctattagaatgcgctgtgtatattttttacctgtcttgatttaattcaattcaattgccattcaattcaaacgaaatgtatttgttaaatgattattatgttttccaattaagaaggatgacacaaaaaaactatattggtatatggtaaggatcattatatagatctaaaaaagttttatcaaagatgatgataatcataatagctaatgtattttgagtagttactgtgtcaggcagtgtgctaagcacttcacacatgttatttaatcctaacaaattcatgaattaggtcttattatacctattttgcagatgaagaaactgtgacttagatgcattaattaactttccatgttaacaaaatccttcccaaatcccatattcccctctcgctgtcttttgccccctctcagctaatcttctaggaaaaacttgtctgcctttatcatctctacttctttacctcccatttgtttctcaacccattcagttaggcttctgccactgccatcaaaatgaaaattaaacagggtcatcaattcctccacatgtccaatacagtatttttgtttcactggattgctcaccaccttttcccacaattaaccacttccttctggaaacagtatcttctcttggtttcttgtaccacatattcctgtgtttcctctggaatcatgagctgcttatctccatttgatagcacctcttcctctgcctaatttctcattactggagcattttagtttcggttctgggtcatcttctcttgcccctggattctgccctgtgtaggggattttaaacattgttggtaccacgtacattattggcagtctcatgaagcctatagactcgaagtgcataaaataccctggatatctctcagtatcccaaacgtagttcttacaaatgggaactcttgttttccatctgcaaatttgtttttcctccagtcttgtccatcatcaatccagttgctcaagaaaactagaagtcatctatgattcctcatttatcctaaaacacaaagcttataccatccattagcatgtcttggctattttatcttcccaccgttccagattttcccactttttccttctatccactgccaccctgctgtcaccccttaggtggtgcttaatacatgtttagtgtatgaagaaaggtttggaatggggaaaataaagagacacactgaatcactaggggacatgtaatactctaggcaagacccaagatagaacagggacagtctgaactgaagacaagaaggatgaatttaaaagataagtgtgtccagtggaaaatacagacaaagaattaagagttacaaatgcctgttagtgtaatcgggttgtttgaagctatcttttaaaaatttccatttctttttaagtagccttttacctcatgttctgtgaagtcttttggagacagtaaatcatattgtttgggaaatttaagggtggagatgggaataaaactgaaaagaggaatctttcctagattaagttgacaaagaaacagctttcttcagccatttctctccagacactagtcaaacaaacaggtgagcaccagatagtttgagcagcagctggaacagttcaataagagtctccctctagcctctccttacttctgaataagccaagttaagctacagtcaactagtcggcttctctaatattctgtattgttctgaggtttaaggctttgtttttttcttggctgtctaggctctctgattaactgagattaatctctatcatcctgtgtaagctaaaccctaaattacataatatgttttctatctgtatgccatatgccttccatgtcagggatgactccagagacaacaaaagcaagctgtgtttttactgattttgcaaacttgcattcatcagccttgggcattttggcctccccagtgtcagtatggtgttttaatagctgagaaaaacaacagaaatataaagagaggacactgtgaaaatcactttccaaactgacttgtattgaaactgcctcacatctaagtaatggaaaataacagtgattaggataatgcggtgcattacattcggtgacagttaatcctcttattaacttcatggtcatatttcgctcatttgttaggttggaaggactgtgtgagaatattgtagttcctgtttttctgttcattgggaaagttgggaaaatagttctaaaaataaaagagttccaggttgaaaagcctttgaggttgactgttctctctggagatgcatgtttaccttgtgccctttatccatgctttgagtttgggtacccactctttgaggcctcattctcttccctttagaggattttctttccacctgagcaatcaccagtgagggaaaagtcagtggggtggttcagctgcatgatatgttgcattgacaaatggaggcagagccctgctccagccccgtgagttggaacaacctacaaagcatttctggcagtgagccaaagaggtgatccctcctctagggaaaaaaaaagtcaatggctgagattgcagttctccatccccttgctgggctgattcatacagcagcattgacactgaggtctcagaagaactgttctcttcccagtccatctaaaaatatctaaattcagatttataatgtcaggagctgataaatttgctgaggaaatgcaagcagtgtcactgccatgctaggaaatctattctgatgaattgatgagggaaagaaattccaaacatagcagagtctcagagtgccacttcccctgggatggtgagcaaaatgagcatgttttccttgccatcgaagttcccttcttcaaacatagtagaaagtagaatatactagattgaaaaggaatatggaaaatacctttttgatcaaaagcatgacatgacataaaactaaatcttatggcctgtaaaatattcttggtttacgtcaagcaaggggttcccttttaaaatgctctttcactaagacaaaaattccactcacatagccctggtgacttttgattgaatcaggatcttttaaatttggaactcagcaagaaaccgactgtcttactttcctacagcttttgtttgaactttcagaatctaagttgatattgcggtctgctgctaaccagctctttcctctctttagttggtcagtggattctcaggagtattataggatgtttcctccataccacctggcttgaaatgatttggcataggcttcaactctaatttattcagcatccctttagcgcctactagaaaccaagtatcatgactggaacttttctgaaatgatgaaggtgccatggggacagatgggcgtgtaaagaacttattacaaatcaaatcataacataataattgatactgaacaattgctatgagaattgaacagaggaaatgcttctgctgggaaaagaccaagaaggcttcagagaagaagcaaaatttgtggttggggtgatacaatgaatgagtactagcaatttctcaggggagcagagtatgtctaacaggcagaacagcatggcactaagttaggaaaagtaccacctgccttagggacttcaacaagatatttgaagtgtttaaataatttttttttctcacttggattttggcttttgccaaacaactaacaaacaactgttacatttgatctaattattttagatcattaactttgaaaattgctgtttgtgtgatttcctacattggccttgggcctattatgagctgacatctaatgaacaggtggctggtacattcctggagttttgcccttgtcaaacacttgacccagaccgcaaaatgtcatggtagctttccctgctgaaaccttgtggacttacagctcagtaacgatgttctaatgatctaacatgctatgccatcatttgttgattcataaagtcatgagataaacactaacattattatcactgtctctttgaatgaaaattaaaggctagacttttaattttatgcagtattttcctgactcaattatttgcattaaaaaatgtttaggcatttcattctcatggacctacctcttaatatgctttcttcttaatcaggcaataatttgtaggtttgggcctcaatttcaatagcaagtgagccccaaactcagtaaaaagcaaaaagggttttttttttctgagattcaataggaaacacagcatacaaatatttcatgtaattttaaaaggtaatttagcatagatatgcatactgaagtatttaggggaagtagaaagatgtctgcaatttattttgaaatgcgtcaacaaatatgacggatggatagagggatagataaatgggtggatatgtttgaaagcaaatataataaaaatgttaccatctgagtataaaatacagctattgattataaaattattttaactttgtggaatgtttgaaatttttacaatatgtttggggagaatgataaggtagcaaagaattaaactggtagaggtgcttggataagaatgataagatacttaaagtgaagagaaatttctctgacttatcaaaatgtagacacgaatgtagttgtgtctgtgagtcaaagtacacaatctctcttctccattagcttatgaatctgtcagatgagaaaaaagatcatcctaggagaaagagtagttcactgtaaaggccagaactttagtctacttggcaatatataaatagacttttggggtttatttttaatataaaacactgatatttttcgcaaataaggccatttctgccttctcagtcatttcaacatatattgagcacttcctatattcctggcatggtgctaagcacgggggctttaacttcaaaaagttgaacatcaagaatggagaaagagaacaagaaggtgatgtcgcacacggaaagaaggacttaaaatgtgctgtgagagctctgaagagggagaagtccctggcttgttagctctgatttggggcaggctactaaacctttttgtgccttagtattttcctctataaaatctggccaataataaatgttaaactactgtctgttaaatagctggaccttcataaatggtcactaatatctttaacccagagaggaagatcaaattaggaaaaaaaaataacacagccataaaatttgtttgacagacatccttctttttcccatccctcctctataccccatcttttgttgccctagtagaatgataaaatcacagccctggagctggaacagacctagccctagattttggacagatattccattccaacccccatttagaggtgaagacactgaaataacttgagaaaagtgacttgtctcaggtcccatagctagtcaatggcaaagtgggtgaacatgtaggataataaagcttttactggagagagaggttgaagaaaagttctttggaaatatagtttatgatttcttaggatgtaagagagaaaatgctcagaaactttttttattgttagaagagaatgtgttttagtgtacctaaacacattgcattagtaggttctcaagaggcatttgttgacttgtattgcattaaacctctcctgctaattgtctgtatagcatggttaacccttgttatgtgggtaactgttcctttaattaaattagtttttaagtcttttaattatattttggtgcctgtaattgacagaatctatatctcttaaccccacatagatttatgcagttaggggtagtgaagattgcttctctctttgtgaaaatggaatgagtactcttgtaacatctctatatttgtatcttatttgatctgtgggacatagaacattttcttgacaagatagcgatttcccctagagatctgtcaattcacaactttgaattaaggtctctaggcgttctaattatcagagccaatgacccccgctggctttgacctccaatactttagctggacagttcactcagagcaaagatagaggttctttatactaaaggagaatatttcttatcacagaggagggaaagaaggagaataagagaaatagagggagtggaggggatgagagaagggaaagagaaagagagtaagtgagatgtcactgcaaaatgtttttaaattatttagttgatactattaggttggtgtaaaaatagttgtgcttttttccattaaatagtaatggcattattaaaattggcattattaaaagtaatggcaaaacggcaattacttttgcaccaacctaatattaaatttttaaaaaataaaagtcatataagagactaagcaaatccacaataaaataaataagttgaaaattagtgaatgaaataggatctccacaaacaatgctgcagaatagtttagaaacactgaaagatatttctaacatgcaatacagatcctttcatgcttcatttgagaagctggtataaatagaaaagtgaatgtacagtttcagaatctcagaccagaaaacattctagagcacaagttctaagacaaaagaaagagaggactcacactctacttgggaatgggctgatttttgctccattgagcagattgcactgttgatcaacaaggtagatctggtaagaagttgagacagagacaccacatgctgaagaatctaggctgtcggtgctttttggaatctcagaaagaggtcagggagcccttgtgactccaggaggtaaatgactttcccattgtttgctgttccttcccagcctcaaaaagtagggatgcagacagctgcttctgagggtgattttttttaaatttaaaagttccacctgggcatgatgcagttgctcatggctgtaatcccagcactttgggaggctgaagcacatggatccttgagcccaggagttcgagaccatcctgggcaacatagtgagaccctgtccctacttcaaaaaaaagaaaaaatcagcctggcatggtagtgtctgcctgtagtcccagctaccagggaggctgaggtgtaaggaccactttaatctgggagatcaaggctgcagtgagccatgatcatagcactccactccatcccaggttacagagtgagaacctgtctcaaaaaaaaaaaaacaaaaaaacaaaaaaacaaaaaacaaaccttggaaaagtctatagcttcatcttatgcattattcccccatatactgataaaattcaagtcccttcatagaacccaaacagctgataatgtggcccataattgtgaattccccaagcccagcatttgaaaagacaatttaaaaaatgagagagaaagagagtcagtgctgataagtatgaggtaatgtgaatgtgtaggcacagggtgactttgtaagtgggaagaaaaggagggagaagctaactttcattaagagtcttctaggttgggtgcggtaaatcacagcactttgggaggctgaggtgggcagatcacaaggtcaggagatcgagaccatcccggctaacatggtgaaaccccatctctactaaaaaaatacaaaaaaattagccaggcattgtggcgggtgcccccctgtagtcccagctactcgagaagctgaggcacgggaatggtgtgaacccaggaggcggagcttgcagtgagccgagatcgtgccactgcactccagtctgggcgataaagcgagactccgtctcaaaaaaaaaaagtattctgtgagccaagcgctctacttgattacttgatttaatcctcgcaaatatttttcatataacatgatgagaagatgggggttcttgtaagcagcagaactgggatttgaacccaaatctctatgacataggtccccatacattttctatgacattggttgtgtgccatctggctcatgactttccagcaatttcatggataaaagatgtataataatctgacattcaaaacccatatacttttgcctgtgttagctgctctgggtaaaactattggataaatgaggtttggagaatagatgtgaattttcattattcattcccttctgagaattgtccaaataatattatttctaccagggtgaaatagagggggaaaaaaaacccctaggtttctggaaatattgactatgggatataaggcaaatttagatgttaaaagtgatagttgccaaatttgtcaaatgccgtaatgttctcatgtacaaaaaaagttggggaatttttgtcagaaaattatgagttttgcactggccaattcaaatcaaagagtttttttttttttcttgtctttggcaggttttacaagggggtgtccctgaggggaggtgaaatgagacctagaagcaatttttactgtaacacacacatacccatgcactaacttgctttcatatagttacctgtacatgccacatttcatgattaaaatgcagtccagaaaaatatggtgcactgggctatgtatgagtcccattctctttctttctatttttaagtggattttatgttgcctatttagtctgtaatgaccataagccactccagccaacttgttttaaagctcagagagaagtaggtcactaaacaatagaataataatgtggccacatatttaactttctagtacccacatttccaaaaagtaatttcatccaaaactatcatttcaacatgtcattaatgtaaaacactgttaatgagatattttgaattttttagtggtaggtcttcaaaatctggtgtaaatttgcactgacagcccatcacaattcagtcaagcccacatttcaagtgctcagtaaacacatttgtctagtggctcctgtattggatgacacaggtgtagactaggaaagcattcactcatggtgtttattcaatattttctctatcttctatcatttcttatattaagttgtagagagagagcgcactatttctaccccatcagagaacatgaagggatgcagagaagaatatgttgagttgactacctacctcacagaggacctctgcatgacatttagttgaagggaactgccttctctttttccaggaagattaaatctgtatcctctctgccattcagtttaatacctatgtgcaaggcatcagtagagaccagatagatagatagatagatagatagatagatagatagacagacagatagataggcagagatgtttgtgtgtgtgtttgtgtgtgtgttgtgtgtttgtatctctaagtacatgaagaattggcatacatcccagaacacaacagactgaaactcctgattaaagataacaggtaaatggaatgaacatccaataaaaacctgtttgtgtttttaaacaaaattaaaagactaaaataagaatagaatataggaataggaagaaagccttacatgacaataatcaatttgggtaccattttgttacctcctggccttctgcaacttaaagggaaaaaaaaattaccaccatcaggcaaatgccttatcatgataggacaaaattcttcccattgtgtggctctgttggcatttttaaatgtgtcatatgtggctgggttgtggggtacaagatgtagacttgcttaggagacaaagaccagcataaacttttgaggatccatcctacatggagaatgtagtgaatatgctattgctctaagtggagacagagtcttgcatggcaggaagcttcctaaggtgaccacttgagtcatgaggcttagaagtctttgcagaagagggaaatgagccttcacattaggaaaatatgctttactattacataagttctgggatcaactgatacaaaagttgggagaaatcaaaattttaagtttttcctatgtgtgtacctatgatacaatcaagtttttattcaatttataactcctgaattcattcatcaggagtcctttaggaagctaaacagaactggcaggtctgtcatttggatttgtcatgattgtgagtatttcgttccctgcaattaaaaacgtctgtgggacaacaggatttcaagtcaggagattgttgggtccttgcttctgctacttagctaatctgtgactttggaaatcactctctgaatgtcattttgtttacatctattaaatgtaagctctctctgatagcattatgatgaggaaaaaatgaaagcatgtgtctgaagtatctggtacagaggccagcacatactggttgctcaataaataccagtttctttcccttttactactctaacaatttctcgtttgtattttctgctcctgagctctgtgtcttgaaaagttctgttggcatacacattggacttgattgcttacattaaaattatctattcttgtctctattttgtattaatgaatacaattaatctgattacaagtataaaactatcagtcaggtttctaaaaagttattaaaacatatatgtattacctgcttcccacattccagtgccaggctctgtagaaacaataatgaataatacagctattgccctaaagaggcttcaccaatcctgtctgtggttcagcatcaccaggcaataccaatttgtcatcatcatgctgaatggggagaggtttagaataatcacaggagaacgtaagaccagctcctggccccgtcttgatgggtcatgaaagaacaccgggtactatcctgagttgaaataattctagctcatagttaatctataaagccttatccagagaaattggagattatctttaagcattttgaaatattaagcatagcctgctggccccaaatgacattttttttaatatttacaaattattaataaaactaaaaatttccatcccttccctggaaccccaagcaaccaccgattatttatttatttattatttatttatttatttatttatttatttatttatttatttattatagagatggagtctcactatgctgcccaggccggtcttgaagtcctggccccaagtgatccctccgcctcagcctcccaaaatgctgaggccacaggcacggatgcagagtttgcagatgggcagctaccattttcgagtatgcagtaactgagttttgtgagaagagcaaagtggaaagggagaatgacttaattaggtctgtcctttagaaacaggtctgcaaaggcagtgttgcaaactaatccaagtgaaaaatcatgggagacttaaatgaaagcattcctgggaatgaagaaggcagatttagtaggattactaatgacaggttggatggaagatacaaaagagaagaaatctatattgctgtgatccattaagtctcattgtctacttttaacacttaatggggtggcagtgttgttattctaggctatcctttatgaggttggggttcttccctgacagttgctgaggctgtgggaacaaacgagttcatatagggagtgagtgaggagggagacttcagacgctcagggattctacaccatggaggaggctatgaaggagatccattttcttctaaatcattctgataggcttctggatggctttcggtctctggccaggtgctgatggaaagctctcctctctgatgaagattaatcatcaaacccaggagataattttattctgctcttctgagtcatgttagattccagaacaattaactttattttccccaaatcttgtatctcttgggaatcttccagtaactttggtttccagtctacggagctacttttggcagcttgttgtcaaagaagtgataattcttaaagcttagagtgctaaactgcaactcagttgagaattgaaacctttccagtaaggggctcagccccagacacctgggactcctctttctcctttcaccctcaggtacaggagtgttacataaaatggcactaatccacttttacagtttttgtgttattaagcaatacattaagatttaataaccataacaaaagggttgttttctcaccaagcagttattatttgttgtacttctatttctactcatttaccttaggtttgctttagcgatttcaatttagtaggtgtctaatgatatgcctgtcaatgaaactttagagatgactttcagtccttggaatttttttttcatagtttcaagaagcaagacttgcgaagatgatttgcgttaagaggtttgtgtgagttgagtgtggacttaaattaaaagtaacttaatttactcagagtagtagaatctagtgcatttaaattggttgagaggtgcagacttcgctttggaagtcactgtaaatcgatgccgatagagtaaaaagcattctctgttctcttgctgttcctttttgaagggttcagaaggttggaagagcatccaaatcagtataatcagacctattagatcctagcaaagaattttaaatacatacatctttttgcatattgattctggcaatttaaccctcagcttaaaagcagaaagttggttcaagtgaatacaacatctcactctgcacaatattaagaaatagatctactgaaactaataaaagaattccattgttgtctcctccatttaaaaaaattctacctgaaatacttgttagaatttttataaaagtagtatctcatttatgtacaaaatagtttgtgtaaactataagtagacaaagatgtagggttgtatcacttctttgataagatactgatcttgtatttttaaccaatgctaggcttaataaaagggtcctgtaaaatttactatgaaatctgtatgcctccctccaacttcttttccaactgagattggagtatggcaaaggaaatgaagcatgaagggaaaactaggagctatgataatctaagattcataaacaattataacattatttgctcacttttgattgtgcaaatgactaaatcttttaatgaagcataatgacccatctgacacatatataacaacacataataaaagataaaattaaatttgtcaaagcaatatagaccacccactactagtagattatgtttgggtttggattttcatatattttatccatatctgtttccttctattgggactttatggaggcattactcatgaactttggcagatcttttttggtgtgtctgaaagaaaatcccaaagctggttactaagatgtttgaaagtcatattcttcttcaaaccgtgtagaaataactatcaggaaataagtggttataattttaaaatggcatgtttagggaagagaatatataagtttgaaaaaccgcagtctcctccaatacatttctacctattactaacagggtcaaaattgtctacagaaaacaacctgatctcaatttcctcagacaattcagctagtaaaatggtgtgactgacctagagttacggagataactcctactgctgagctctctcaacaagtgacaccctggttgacaaacaatcacacattatttattaaacttctatttaataacaggagttatggagttagcaatgttaagtgaagagtccttgttttcaaactttgcaaattacagttagtaactaataaactaattaatgtcctttatgaagagatgctcagtgatggcctgaaaaatccctaaaggagatagggagagaattgaagtatggaataaaatgacctatatgggaccttcaaacttggagttttctatattttcaaaaattacttttgctgtcatttaatgtccaaatccaatcccttgtctagggaaccagttcggattaaacaaaatttcaaaaatacacaagcaatcaatatctaattcatttaagtcctgtttcttcccaggactgctgggtataagcctagagttgcctgccatttctcttatattcaaacactttgggaaaggagccatttttttagatctattttctccctgaagcttgggagctatatctatataaaatgagatgacatactagggctagcgtactaaaaccttttctaagagaatcaatatagctttgagaagcctcatttatatttaaaggagaaaagagacataagtagaagtggacataacgtatcatgtagacattgaaaaataccagaaatgatttaaaagtgactgcgtgttctcatattcccagtgccttgtaatttgacttggagggatgttctagatctccattgaatgtgctcactgagatttgtctttgtcgtattgattacaatcatctgtcaatgccctcaatattttctgtactgaccaacagcgacacagatcataggctgtaactagtacaggctgtgccaatgaaacaatagggctaattagcagacatgaaaatgaatcactgatttaattttcctcctggtctaatcaacacaatgtgtcagctaaatattttgatccattatttcaagtgaatagaatgtgcttttatattatcatttcaatttcattaccttgaatattggaatttttgatttttggatacatcagtgtccagtcagtatccagtgatttttagatacattttggatacatcagccttagcatacatcagtgcctacgggtataaggcactgatatgttaataaacatattaacagtttgtaagccaatgaaacctataattattgcataatttaaattaacttgtgtacaaaatgccataatatttccacatacgtggtggctttcaaaatcaaaataaggtgagcctatttcaatttatgacagacaattgtatatctcctctcttttctttgccaaagaagccctttatttcatcctcacaggtgttatacttgtctcctttctgcttggtgaaacaatcacggtttgtaatttcactttctgaccatcaaatacgataaaatgaaacagtttgtgcttttcttgtactttccgctctcaggggttactggttgagagagctcagcagtaggagttatctccgtaactctaggtcagtcatgccattttaataggtgaattgtctgaggaaattgagatcaggctgttttctgtaggcaagtttgatcctgttggtaacaggtagaaaatgtattggaggagactgaggtttttcaaacctacatattctcttccctaaacatgccactggctggctgggatgctaccttataaatgtgaggtagatgacaccagtctgtaactctagacttctgtcatggatagcaggataacttagactgagagctgtctgtcttcccagcccacatggccacaggatcagagcaggtcatggtgaagcagaggagaaacagctgcaaagcagagaagaaagtccaatagggtaggatgtgatgaataatgttgtgaaacagacagctagtgccagtaaggctcctatatcatagaagtctaggaagatacaagcaagtgctgtcatagacagataaatgaagtggacattgttttgagacaaaagcaagctggcaatatcagagaagcttactataaagagcaaaatgctgggtgcactggctcatgcctgtaattccagcagtttgggaggccaaggcaggaagattacttgagctcaggagttctagaccagcctggtgagacctttatctctacaaaaataaaattaaaaactacctgggcatgatggtgcaggcctgtagtcccagctacttgggaggctgaggcaggaggatcgattgagcctgggaggtctaggctgcagtgagccatgacagcaccactgagccttggtgacagagcaagaccctgtatcaaaaacaataacaaaacacagcaaggaccctattactctcaatgggaaaaatcgcagttgcttttgggccagcctaataataacttgacagagagaattttattccctgcaagctacgagttcgttttctttaacagatgaggtaactgagccacataaaaattaagttacttgtctagagacacccagctgataagtaagagagcagacatttctactcaagcaatctgactccaaagctcatggtgatgaagcaggtcatgaaagctctctttatgacacatttgaataaagcagcatgacagtgggacaaaaagtacacaagacaaaagctccatcgttagggccaaagcataggaacaaactcaggccagtgatggagcaacttcagctgagattttagccaagagcttgttaacatctttccagttcccagatagaattagtcctaaggaattacgaacattgtattccatggcatatatatatatactacattttctttatcctctaatcaactggtgatggacactgaggttggtttcatatacaagagcagatgtcttttatttttttttttttgagacagagtctcactctgtcacccaggctgaagtgcagtggtgtgatctcagctcacggcaatgtctgcctcctaggttcaagcgattctcctgcctcagcttcctgaatagctgggattacaggtgcacaccaccatacccaggtaatttttgtattttcagtagagatggagtttcaccatgttggccaggctggtcttgaattcccaacctcatgtgatccacccgccttggcctctcaaagtgctgggattacaggtgtgagccactgcacccagccagatgtcttttttaatatgatgatttattttcttttggataaatacccagtagtggtattgctaggtcaatggtagctctatttttagttccttgagatatcttcatactgttttctatacgggttgaaccaatccatattcccaacagtgtataaatgttctcttttctccacatcaacatctgttgttttttgactttttaataatagctattctgactggtataagaggtatctcatgtggctttaaattgcatttccatgaaaaagaatgaaatcacgtcctttgcagcaacatggatggagctgggaaccattatcctatgtgaaataattaagaagcagaaaatcaaatatctcatgtattcatttataagtgggagctaaacaatgagcacatatgcacataaagatggaaataatagatactggagacaacaaaaatggggagagagagaaagctgaggattgaaagatgatctattggataaaatcttaattatttgagtgtatacggagagcccaatcttcaccattacacaatacacccatgtaacaaacatgcacatgtactccctgaaactaaaaaaaaaagaaacaagcattgtgaactgctggatccccaagaaaggcagatgaccataactaggaagaaaaggagaaaaaatgtgcaatgtcaagaaacatttttgtaacttatggtcaatcttgtgtttctgcaacacctatatcttaccatgtagaaatttagggatacaaaccacaaagattctgagggcctaatcatctctcctagacttgcttttgcattctggagtaataatctggaaaagcaataagagtagggacatatttatgattattcttaaaactgtgtgtagaaaaatacaagaatatctactccaaaaacctgcatgaagacatttgatagttagccaaaattcaagagactcctaatctttgaaagctacacattaggctggtgtatatgtcccattatttgaaattgcacctttaaatatttgagacatttatcctattatccctgattacaatttccccactacaattcactgcacagtgcttccttagggagctgcttaatacatttcaatcttagaaggtcaagattccctcagccaattccaaactgcattgtcccattgaatagatgtggcacattctggatctagtgagaataacctatgtatattactttgaagtaatacaggtaggccattatagcagaaagaagttgagtaaatgttgatatttaagaaggttgataaaatatttgaacacaactgcaatccatacccaattctcagtggttttttttatagaccatgaaatcatagctaaagtcaacttcggttctgccctaacggagagccacaaataaccctaaaccatagataactcaaatgcatttttacttggcttttgactgctttttatgataattttcacagcacattgctcttctaattatgttttgtttgggatcatattaaaattaacttgtatttagtgattatgtgctacctgatgagttaaagaggagccctgggagtgtattgaaaaaccaggctgtggatggccttcagtactttacacaaagaaaagccaaatagttaaaaaggcattaaaaatggaaaggatgtaactagtgggcaaatagctccaggacctcagttgcatgaacttagtatatctctttcctcctccttctcccctccctcctccacgccctctttctcctagtctctatttccccttttccttatcctcttcctccatcttttttattctttcttggaggcatggaaagcaactcaaaagaaaaggagacctctatagtacatccgcactcagccttggatagtgagaagtactcaggtctgagtagcctcagacagtggagtcagaagcaagatgaactgtcagggattataataggaatggtcagggctgaaagcaaggcaataggtcaaaacctggcaacaaggaaagagccctggataagtagtttccataaatccaagcaagacaatttgttaaggcttagcatgcaatcaggcatccaaaattccatgaaaaccagaaggcagggtgaggaaggaacaggaaccaggcagcagttctgtgcagtggcaccaagtgacagcaagaaggcagcagtactaccaaggcaagattacacccagccaaaaaaccaccagtctgcagggcagccaattgatactccaggcagagccattcagagctgaagagaaagcactaaaaaaaagtgcagccacttctgtgattaaagacaatgcccatggtactaaagtaccgtcttggagacactggtcatagttgttaaagcttccagccctcccagagaacatctctatgaaaaaaatactggtacagcagccccaggcccaccttctggaggttcagcttttaattttagttgtttcaagtgctgtggaaaagactagacctgatccctcagttcttcatattgccttatgaacactggccagaagggaagcacatccctcccttttgttaatttcctccaatattgctaagacaaggaatttcaaaatgttcaacaaatattaagaaacaaaaaagaaatgaataaagaaaataagatgggcaaaaataagtatgcatgcaaaaataagtatgcatgaaacataagttttcaaatatcatacactgacattgattaatcatcactagctgtcaggagagagtgctgtattgagaaggatttagcaacccagaatgtcctaactggcttggctcatgtctgctgtgggtaaaggaaaagcagggagtgctgacaagtctgctttgtatttgccaccctttgcaaataggtactcaccctattcccaaagagctaatataaattacatatcactttatttgtgtttgatttattacataattattattagaataattcacataattataaccagaagccccaaaagagcagagaccctgactgatttgttccatggatacctccagcatctagaacaggacatgacatatagtaccccttcaaccagtagttgcctgacttttctgccctcatttaatggatcctgtctctgaacctgcaggcatcatcatatactatcgtaagtgatttccttagcttcctaaacccagaaagaatccacattctatttctcatggtttttttctatctgtatagcagcatcaaagtgggccctggtttttagtttgagggatatgccacttctgcaaccagctggcataaatgtggcaattgacacgataagagaagctgttctcccagccagggaagaggcattaccaattacaggcctatactataactgtgcctttaacatcacttgcatgtaagaatgcaggtctctatgttagaagagtgatatctgctcacagcatctcatctcctcctcagctctcccagcatttgagcgctctctccgcttcgttttcaaccatggtagtctaatcactggcaaaccaccagtgagttgattgcagccctttataattcctgtgtagtgagatgccataatgacttttccaggagtttccacatcatctgtttactccatgtgacattccttccatctgtctactttcagtttattttactttattttttagtaacttcatatcgcagatgaaagtactgtgaagtttcttctcaaaaccataatatttttgttacgttgcatgataacctcaggaaacatgaaattctaagaatttaatactaatatcattttgggatcattttttaaagcagtaaaagactttatgttcatgttgtctcacttttcagaggaattcatagctttttattgatgtaagccatttcataaccctgtcaaggtgctttgaggaagaagttaactgattgaacatcaacaaatcctggaatgtttgatactaatgatctcagaaggggccctgcctgatctacattccacctgagcactccttaccaaatattgctcttgccttcctctgcagtgattggttctgatcactgtagagaaagcatggaagctcattttacaaggctgcatgtgtgtctggctgctacctagatgcatgtccttcttgcacaggtcaatccattctctggtttttctctcctttgctctactcccttacacagaaacctaatttacctgtttctttcttaagctcttcatttcagaaaaactcaataaggaaaattaaaaaacccctcctttaggatgtctctcttatttctgccagctttttgaagtatgtgtgctctgggcaggggtggggacaggaagtgtatgtgacaaagatcagtcagacaaaacactcctggcatgatttccattttagagttgtgaaactgaagaatgggcaggtaaactgatattttctataagttgtgagaccatgattcactgatttgtttaccttaatgaagcatacgtaaaataattgataaattattttatcaataatttggtaatttcctcttggggctaattgaatatagtgagtataattgagtatacggtgggtggctttcaagcgtatctttccaactttcactattttagtaccctggctagaaaatgataatctgatagtgaaaatattaattcatcctctacaaggttctgaagatactaacttctcagtaaattcagatatagattacaaccattttcaggatataataaagaaggactaaaggtatctctttggtatgtggttctttacggccacataaatggcttccaagtcttcatttccttaagttcatttcctgctaccctatggacattgctaccctctccttctctgggttacaaataaatggttgatggcattttaataacaaagattaaccaggttgccatgttaaggatagatgggagaagcagtttgggaaggtagcctagacaaggtgatggtcttttcaggaagttctcaggtgtctacaataggtagcagaattgggcctgagcaaaagtcacatgagcttacagcaccctgtgcagtcaaactctcaacttcacttaagctttttctttgctttgcttctgcccactcacctggcctgttaccacccactgttttaagcagctcttcagctgcacatctactgtcctgctctgccctgaaataggatgataggtaggactgctgtacccacagtttacatgtccttaccctccatgtaaactgtgggtacagcatttgctacctaccgtgcttctcaaataccggaagcatggtttggacagctgaaggcttagcaatcattccaagctgcagcatctccttgggcctcaggctaacacccatatcaaaacaacttgcgcggtggcgggcgcctgtagtcccagctactcgggaggctgaggcaggagaatggcgtgaacccgggaggcggagcttgcagtgagccgagatggcaccaatgcactccagcctgggcaacagagtgagactccgtcccaaaagaaaaaaaaaaaattatgatatttaaagagcatatttaaccattaaaatagtaaatatgttgctttttttttttcttaattgaactgtagtgtccttattgttttaagacttcatcgtatattctggatacaattcctttatcatatatgtgatctgtatgcattttttccaagtctggcttttcattgtctcaactgtgtctttcaaagagcaaaaattcttaattttgatgaagtctgacttatcagttttctttttagtcaattttgcttttgctgtagtagctaggaaatctttgcctaacacagtcataaatattttcattttttacattttgtgtttaggtctcccgtgcattttaagttaatatttttacatggtgcaaggtgtatggattaaggtttgagaacagacagacaggaatgtctttcagatttataaaacgtaaatgctatatagttaagcatttaataatcttttctgaaaaggaaaaaaaaatgcctacatttgaaaccattctggaaaatgtaagataatgtggttttcctaaccaacagtagtcagcttttaaatgcagtactttgactttattatcttatcattgagattcaccatgtttttatgtaccactaagaaagaaaaagaaaaaaactgattaaattgtttaaaaaaaaacaaaaaccttgaagacaattttagttacctccaggctaatcatttcctttttcttttctttcatcgcccctgaaactcccccaagcattatccaaggtgtgggctctttttggttagtaaacttcacttgtcatctcctttgagtgtgcttccccactctcgtcatcttctgctggcttaactcgaagcccaaatttcttacttgtagatggttaacaaatattccacattctctgcattttcttcctgcatttggaacctgggtttcctttaaggacaccaactccttgaagtcacactccccctttctcgcacgcatacacacatgctcagacaatgagggtggctatctggcagcttccacctttcccactagagttttcaaatatttgccacactatgccagtgccaaaatttatataataatctatccttcagaggcttctccccttgagctgctcacaatttacccctccttctaactcacaaggagttacaaggccctggaaatgtgcctccctcgacagccacaagtgaaatagtcaccaggttcatggtcttactcgaatccctgtcatgcagggatttcttcatttgcttggaatgactcatcaaacagcctagctttacagttccttgacctcggctcttcccaggacttttatctccatatgtcgacaggaatctactttcttggcacttgttactaactggaactgtatctattatcctttctcaacaagaacctctcatatctcagcatccttctaaggctcgcttactatttcacctcttctgtacttctaactttgagccttttattcccttcctatttgcaagcttcctaggcttcatttttaggaccccaatgttgatcacttgaatttccctttcaccagctcactgactctcttggcctttcaactcatcctttttacaaacccctggagcaggtctctcatcgcccttcaccactcctgcagccagtcagaacagctggtcaaatgaatacaggaatggactcactcattcataccaacggtgttcacttgacctgccataacagtgtgattctacaggccctgcaagttcatgctgactgtatatctcactcttctgcctcagagctagagaaaacaacactgaaaatgaccaaacctcctaatcaggaactggtaaattaaactgtttaaaaaagttctctttatatgtgtacatacataatatataacttcacagaagtgagcaaaagtgattacactgtatgtataaatttatggggagaaatgtagcatctgaattcttttcctttttggtttagtttccagttcccctcttcccattctccacaccaacatcatccctcacctcataaacctacacctagaaaaactatgtcaataatctagaatgtatctgggattttttcccaagttcatatgcttaaaaatatatacacactcatacatataccatcatatacttataaacacacaagcatactgtggatatacaggcttttgggctttgttttaaaagatgagatcataatatacacatcttctgtttcttgcttttgtcattagatatcttgtagatatcactctagatgaaaaggttctaactatttttagatctaattattaacttgttcctttgtataaactcgtaaatatttattgagcacctaccatatgccacactgaagcctgggatttattcaaatttcagaattgagaagggagtagagagattcatagtccagctctcttacagaatagatggaaaatcaaggctccgtaaatattcgtgatttattcaaagtcatgcagccagttgatgccatgtctcaaatcaaaatctagctcttgctagcccccaagtccagtcctcttttaatcatactattcagagtcccataaattagcatacaattacttacaatttaatgtgaaaacatactacaacataagataaatcttcaggcctggagtagggagaggatagggaggggcaaggattcaggaaatttcctgataatggtttgttgtctgtgtggatagaccaaattgtctttaatgaaccaaatttatcaaccagtgaagactcattaagatgcccagcatttaaagggagatcaataaaagagagaacttagtattgaaaagctatgaaagagctttgaatgaaattcactctccgtcttagcagagcgcttttcaagagtgagaatcatgggtgggctgtgagggaagatattccctggccatctaagcacatctggaaaggtccagatttcaaactgtcgctcttttgtcagtgctgaaaaacttaaccttgagcgctaggaagatgttctccaagatgctgaaacttgtcacgttatatgagtcttcatgttcataggcaaaacaaaacaaaacaacaggcatatacatgacattaccttcttttttgtttgagacagggactcgctgtgtcacccaggctggtgtgccatgatcctatcatggttcatttctgcctccaactcctgggctcaagtggtcctcccacctcagcctcccaagtagctggaactacaggtgcactaccctgcctggctaatttttttctttaaattttctgtagagatagtatttacctatgttgcccaagctgatctcagactcctggcctcaagtgatcctcctcccacctggtatgaagcactgtgcctggccttgaatttcttaatgatgtttttgtgaatctatttgtcaagagtacaactgccagatttttgtgcatttgtgcccctctgctccgaagtaccctgactgtcagtctattcattcagtcatcaaataactttggggcatctattctatgccaggcactactatggtaggccttcaataaagggaggctatgtttacatgggccttccacttcacaggcaagaaccgcactactgaatctcccgtgtctttgtccctccagataatttagtgtgcaccttatgaccttcactgacaaaatagcgaagaatgaacaaatgttccttaaagccagctaattctttggttattttaaagctgattggatcttttgtacacattctaaagactctaaagagagtccttgaaggcataatttcactgaaagacatgcaccacaaaccccctgagacatccaactgcagggaacacctcagctcagtcagtatgtgatgagctttcatgtcgcagggcacctgacagttggatgaaaaattgctttcagtctatgctgggttttctgtggcagttcagaagcaggactaggttctgggtctttactgtgtatgtcatcttttctttcagggttctgtgtttccatgcaaataattataatagtgtagaattatttgatacctactaagtgtcagatttcctgccatgtacttcacagacttttattctgtacaacaacattatgagtcatgtaatatcatccccacttcagaaagaaggttcggagaggtggggtaagttacacaatgacagaactacaagaggcagagcaggggtgaagctcagatccccgtgtctccaaacccaaggctgagaccgctggctgcactaccccacacagttctgaggcagaagagaatcaggaggtgaggatgggaactggggaaggggttatgttctgatgagttagtttttaaaggagagccagattttctgaagcagaattttaaacatgaataggacatgttaacttgatgttagtgaaatatttcctagagttggggtttattgttgaatactaaactcatgggagtactgcataccactgtggaaaggtgaacagaatgactttagggaatgtgacagtttacaaagaaaaaagtaaagaaaggaaggaaaactagaattctcagtcctgaccaaaactatctctaggataattatggtttatctaaaacttgtttctctgggtaatcagataaccctgctctctgtgagtgtagacttctccacatgctgtatgaggatacctctgtgtccctgtagttaacaattttaattataggtgaagtattcaggttaagtggcctaaattgacactttacatggagaaaaaagtctctcatgagactatatgctataaatacataattattcatatttaaactcaacattctattgcttttatatttgttttatattcatttttcacaaagtttcctttgcaattgattcctgggtgatggtattaacatgtcagtattatttattcaagacaagtggaaaatctcaagaaaaggctaaaagacccttgggagcttacctagtgactacaacagaactaggaattaaatggctgtaaagtgacatgttgtatacaacacaacataatttattatgtgttgcattaatataggcgttttgaggatatcaacattagctgaggaatcctgatgtctgccaattaccattgtttggtaaaagattgggagttctggatttaactgcttggtaatgaaatcaacggtttgcttcaagttaatgttatacagtagatgcctagctgatttcttgtttcccctactatctaccttaaacgcattctgggtctcccttcatctttgtaggtttctgagctatttttgtactgtctacatatcttgattagctaatctgtatattaaccatatgttctgacaagagttcagtgacatggaccctcagcccatgacgctcactaccactgacatgttgcatgtgagtggtggggggagatgaaattagtttattataatatgacttttgagaagatatagcaaaataatcctctaatccattctacagaaaaccttttgtttttccaactttattacctttcattattccatctcagctgttttcactttgtgagattgctagggtcaatgggtgaggatctgccatgggtgtgtgtgtgtgtgtgtgtgtgtgtgtgtgtgtgtatgtgtgtgtgtacttttcactgtcaattattctaagaaaagcaaatgctaaagtgaagtgaaacagacaatggttcacagtaaatatcaagctgtgtttgtattgctgccatctctttgggagaatttcttatctgttcctacagaaaaattactggaaatatatatcaatgaaaacgtataaatgaaatcctgaaactatataagattcatatctcttgattatccaaaatagagacatattattacttatgaagatgaaatgtttgtggtttgatgctaaaacatttagtactaataattattccatatagagtgtttgcattaatctcgactacactaattcagagcatgagctctttgcctttgtgcatgaagacagtttcttgggcaaattaccaatgtaatttcctcgttgtcattccgcaaaccatctatgttcaaatattttaaaagcagctgtacagaaccaaataatttatattttaattctatataaatcaacatatacttctttacttggacattaccattttaacttcaaattcaacatgtctattttgaaacccttgatttccaggataaatcagtctcttgctgacttcccttctcttttgtttgtggtagaatgattcccctaatgttggagccttaaagtctaacttagtgactcctctcatgttttccatatctagtctggggcaacatccagaaattcttcctgttctgtttttcaactatctttttagttttatttctagtgccgccatctcagacctctactaattcattggaattatttttcatctctctgtctaccatttttttcttcttccaattcatcctatgcatcaatgtcactctattttttcatatctgcaaaccactcagtggacatccaatatacaagcaaaccaattataggtgaaatttaaaaatatttattgtaatttataaaagaatagtaaactaaaaatgaatggtaataacagcaattataataatggaaaacaactatgatgctaattaggaggaggaagaatgttttcaaagtctttcaccaggtatcgatattcatctcaaagagtttgaacaacagattcaattctgtgtagggaccatttcttcatttattctttattcctactaaatcagaaataccaaattcataagtcatttggaagggtaacaaatgtttgatggtttgtcaactagtcttgacaaacggattctacaatgtacagaaattatggagacagttttcactgatagatgttcagtgcctcaaaggaaactcattaagatgagggaatgccctctcaaatgtaacaggattgttgaatatatcaacacaaaagatcactagcaaatggattcctaatgaattcctggttgaatttgcctctgataattatgtattcatattcagtttgagcattcagatgtgttaaatatggccaataatagcactgatttatttcctcctttaatttagaatatctttaagtagttagaaggaaacccttgttaactaatccattgacatcaaaatttaactttttaaggaacttttgctgtctctcactaaatattagaaatgatgatatgttgttcatgaagtcataaagtcaggcttctccactctctgtttgatttttatgtgtatgtgctgctcataaaaatcatcacactggtagagattcttgttctcacaatgcagattcacagtgtattttctccctgaaaacttgttattttctttggaacctttatgccaaatgatatataatttgcagtactattttcatgtctttctacttttacatctccgatggattaatgttgcagcattaattcattttgtgtgagttggtactctaaaatacaataaggcagacagctttaaacccatgtgatgtttaatatcctacaaagaccaaagagtcatagtggatatttccctcaatctaaaaataagggaaaatactaataagcaaattatataaaaatgaatctgcttaaatagacagcaccctgtttgccagatgttacctgagacaaccaatccatatatcccatgtatgtgagatgtttaaaaatgtaagaattactaaggacatgataaatttttatgagaatcataattaatcatatagttcaaatttcatggtgcctgtctattgccaacccctagtttttcacaggtttcacattggaaagcaatgggttgtcctttggcttattttattttagtaattaactgtcctttaaaaacaataaaactttcagccttcagtgactttgataacctatgtgataaagtcagaactcattagcctgatattcaaggtcttcccagagaggctccatcttacctgctctgacttctgtcttatacctgctgatccacctggggtgtctgctgaaagcaggtcagcacaatgactcagattcttccctttctttccctctcccatgccccaggatttgtttgtacaactggcccaggaatcctgacttcatttattctctatgggttaacccaggttcttgcttgtgaatggaaacaggataatggagctaaacctaaatggcattttctaaccatgtcttcattattcattctctgaaccatcctctctaatcagtttttactgatttcttccccaaatatgcatttgctttctcatttcaacttatatttacactgttctattcatcagaaatgtccctgtcttgtctgcctcgtcaaattcttcaactcccaactcctgtcttacttcctatataaaatcttattaggttaccttagctgaactatcttcttctttctggaattcctattgcaattacttttgttgtaattatttaggcagtggtttctttgatatcatttactgtgttttctggcaattgcactgaaattgtatactgctcttcaattaatgattatctatttccccaaactagattttaagcaccttgaggacaaatattgcctcatatgcctgtatttctgttccaggtctttggcatactgttaataatgaacaaatattatattacagtaaaactgtatcccaagattttctcagactcatctaaaatataggcaagaacttaataacactaatatgcctgttcaatgaagcattctattcaaaatgttttattaattctttacagcttcctcagcatctgattggaatcagtggcattttaatttatatgtctatttaacaaatactaatatagtgtgcactgtgtgttactcattttctatgcactttacaaataataattttatttaactttcaagacaaccatctgaaataggtgctattattatccctgttttatgtatgaggaaatggatttactgagaagtaactcagccaaggtgatggaattagttactaataggttcaggatttgaacctacatttttaaccactgtgctctaggaacttagttaacagctttaatgaatgaaatggttctgctaattgatgtaagaaactacttacatgttttgttggctaggtcacctgtcactctcagttcagaatctttcaggaaatgtcctttagtctctggtgggaggtgtactgcaactaaccgtcctttgaatttatgttgccatgtacagtccctgtaattttatttcctctttctatctttacttttgggatctaagcttccttgaatgtttagcctttttgtctttttagaaaatattgttccctttatgaatatgtctcttaattgctagagtttcctaatagccaaatgaaaattacattttggcttagaaaatgctttcatctgtatccactggctatatatctgcaaccaaagtaaagtgtggaattgggtatttgttgtttgcagcatttgagcagtgtacacatcaaatgtggttaattctattaccagtaatatttctagtttcttctaaaattaccataaaggtttaggtctagattagataattatttccaatcaatctcctttcaagttggaaatgaatgaagtcccatgttttctgtgtgctatttcatatattttggcatgataattattaatagcaatgtattactattgctcttttgcttacttaaaagtatattttgcagtggtttattttattctaggtgggagaataacacgttgatatcttcttgaaataaaaattatatgtcaatgaatgtgacaatgttctatgtaagtagcaatcgaggaatgactgaaaagggattattaaatatttcaatgcatgggaaaatatttcttctacctatttactgcctaaagtaaatgctaacccagaagatatttatgtcttggtttagaaatctgtagagtgacagagcaatctgagctctgtaatgtatgcaaaatttatcaggctcagagagacatgagtatgggactttggccacataccatacctgtgcccagggacaactgttaggaaacattttgttccagactagttgtgtcacctattatcttcatgttcctggaatttgtgatacaaagaacaatgtatagccaatcgatagcttatgtatttgaaagtatattcttggtaaacaacttaggaactgcctcttgtttttttcctaaaaaaacccacttgtaatggctggtagttggagtgtataatcagagcaacttgaatctacgctcctgagtggccatcttcaacaatcaccctggaataaactctttttaaactagaaaacaaaaacaaaggaaacaacaaaaaagaagaaatctatagagtgaactatatttttccaccttgcaaatagaaggggcaaaaatcaaccttgcctatctgatgatttagtgtcatagggattccaaaatgttatttgtaacgtgtaccttgatatgctaatggtgaaatctcctgtttcttgatttggtcttctcatcttacatttcttacctcaaatccattctgcgacttcaccagcagattaatattctttcctggtctcttggaattttaataaaaacagcatggtcatggggtttcatgaagcttgcagccctctgggggatgcagataataatcaatcaatctcataattaaatgtaattttaaataagagcttacaaaaaaaaaggaatatggtgataatagagcctagacaaagggatattacccagttagtagatgtgtatatgctgggcaaagggattgatatttaaataatgtacaggagtcatctaatcaaaatggtagaggtggtgggtgaggaaggatcttttgtgaaaatggaacaacatgtataaatatataccatgatgggcaggagcacagagattttgagaaaataaagctgtggtcgcagtcacagctcaaggagacagtgggagaagggaattcggtgaactggtaaaggtggcaggatcatttggtacctcataggctctgattaagattcttcctatatctttagagctgttgaaactcactggagtcttcaacaactgagtgacaggattagatttgaaaagatcattcttgctatggtgtagagaatagtcattcttagatcattcttgctaagtcttccatgagaaagtgagtaacatagatttgaaaagatcattcttgctataatgtatgaaacagttgggaagaaggtaagttatgggaagaccatttgaaggctatcacaaagagaaattctgatcatttagattaggtgatggagagaaaggatgaggaacccagaagatagtgggaattaccaaggcagagatgtggataatacagtccatgactatagaacaggaagtgctgaaagagcatgtttctgcacatttagaattaagagggatttggagcatctggagcagaatttgtttgttgggaatgatgactcgggagaggcaggtaggggccaaattatgaaggtccatttttgtgatgtgatggcaaaaggaacaactgaataaattgagcagggaatcacagtcagatgtggagtccagagaagtctctgatggtgtggaggatgctccacatctctcatgaaattaattgagaaactgctatttttttcatctaagagttttaattatctttcatttagttcccagaggctattgggcataggcacctagtaagtaactgttaataacaacatgcttattttgggcatggcaatgtggaaatttattcctgccgagtaatcagtgccagttttatgctggcagggttttaaaagaatggagaagggattcttttgcctccattaggagaaagctgtgccttctcttcatcatatagtgactcattcaaggttggcacaaagtaactttaatcaattaatgtgaataatatcatacctttttaagcctaaaatggatattagaggctatcagccccctggaaaaaagtctgcagaatatttttctttcaatgataatgtcatatatatcatagcccttgaatctttccaaaacatttagtcaatactgaaaacatccctagagagacactcatccaatttctcacatgtgaatcttttatctatctttggaaaattttaagaagtgcttaatttcagactgcttttataaaggacataactagtagcatggtaaaagtgcagtccatgaaattaaattcctgatctgaacctcaggtcaattaacttctaaaaatactctttttgagacaggatctcactctgttgcccagactagagtgcagtggtgtgtgattatggctcactgcagcctcaacctcccaggttcaagtgatcctcctacctcagcctccagagtaactgagactacaggagtatgccaccaaacctgtctatttttttaaatttttttgcagaaatgggatcttgctatgtttcccaggctagtctcaaactccagggttcatgtgatgtgctctgctgggtgctatactgggctgacaaaggtgaataacacctaattcttctccaaagagagcgctcttcaactgatgagggaaataaacaggagagcaggcagtgaatgatagagcagtatcagaggtgctaggttgaggatcttcacaagcttctaagtcaggacatcctaattcaaaccaggaaggatcaaagaagacagtaaagataatgaccacaagttgagtcttgctataagctgaatctggaagatagaagtgaaattgtccatgaaaaaggaagaaagaagaatgtcgaagaccaaaggggaaagagagtaagacaaggtaaatcaccttttgatatcgttgctgagttgtgtgaaaggctgtcaaagtgggcagaagtcatgttcagaagagttttacattcaaattaaggagtctctgttagacagctttaaatccatgtgtctaatatcttacaaagaccaaagactcatagtggatatttccctctatctaaaaataataaacttttctttccaaagggaaaaatttttacttatgaaaaatgtggtaaaatatagaataggaaattctgaaagatacaagttcttcttgaacaatgagcaatgtaaaaatgataaaattattgcatgatacaatcttttttaaaaaagagaaaacactgagcatcttttccttaagccccctttcataaaatctcatattttgcccacttctccatcttaatgattgtggatttctttctcaagacctacttaatacatctcagttggaatttcgaaatgctggcaagtctttaaaaatagacagatgatgaccctaagacatttggaacttatcctaaaggctgaggcacagtagagaaaatatattgaataatatacaattttggtcaggaaatgaggaactgctaggttagaggccccattttctgtgtctggacactggagagaatgcttgtgtttggtcctccaattaagagctgcatgatgcctgtgccctgcaatgccaacacttattgggaacccataacctttgcttctccaacttctccagccaagattatgatgaaaaaagaggcaaaccacaattgccaagtctgttctcagcaattcgttcactggtctttcatcattaggcacattgcccctgtgtacctttggtcccaacgcataaagggatcttgcattgtaagcacatcatatgtttatttaaagaattttgaatctttgcagctcttattgactgttcagcagtgaaattagctgttgaaaagcatttgcactgggggtcgtttctggaaagaaaagaagtatttcttaccttcttctctaagactgcacattccttgggggtttacccatttgagactgcaagaagatgaaataactcacttttctctattaaaaggtgatctcaattgctatagagagaagaaataaacaattattaatattcctgtgtcagagagtgtttataaaagcaaactgtgaggttcgtaatctgtttttagacaagaaaaagatttaaagaatgacttaaagtgatgattataagaaaataaggagaaaaaggagagagaggagaggttaataggtaggggaaattgattctagaccaagcacttaagaattctagttctatgtttgatttcctttttatacatcttgcactttgctctaaagcaaaggagttacaaaatttttaggcaaaattttctacccatgattagcgagcatttatagaaagaagcaataagttctttcagttgaatacacccagtacctctaaaaattaatgtaaagagcacatttcatggtcactaaaagaagggtgcaatttaatgtatgatgttaccatttattactaagaggacctgatacacaaaaatataaattactttttccatatcttctttcagcttcaaatgattttgattttttttttactttagatactcagagtagaatttataaagacatttggggagtatttctacctcaaaggaaaacaaaaatataatgacatttaaccatttcagatatttcatgatatgtagttagttttgtgtatgtttctactacattaaaatatccaatttattggttgtcttgaaaggcttttgttttctgcagagattggatttccaaatatattaaaataattgcagtatttatattgtccgttcttaggggctgtacttatattgcatttctttgcagagttattgatgatgtatccttgttctgcagtatggcacttggcaaaacattgcttcctagtttgaactctccaatgtaaccttcagggggaaatggttctagaataccattgcatcaactcttttagcaaattgcattattagacatccatttataacttatcctctaagtgatctcagtcgaatcatttgctgtcttggtttcacttctatgaaatattctagagcaaatgctgcccttgcttgtgtcataggactgcagtgttggatgccttctgtgaagttcatttagcccctcataatatgcattccatgtaactaggagggaattttctttgggtagatttctcagataagttgtaaggggtggtgtgactggctaaagtgcatcagtaagagatcattggcttgtgaggagtgcaaaaggcaggcagacaaggggaagaggaagtggaagaagccctacacatattgagcaccagtccacaccacactccccatgaagcacttttcatacattgcctcatgtagactttgagatgactctgaaatctgggtgttattagaggccagagatctcaaaaaacttgctctagacacttcatacaaccggtaaagggtagaattggcatttgacacaaatttgactgcctcctaaacttaatacattttctgcaaagttattggagacaatggagcatgaaatatttcttagtttcaggggttgaagtatcatctgcacttagttttcttctcaaataagataaactctaaacaacaataagaaaagtagatttgtgagttttgtacgaattggccagctattaatatcatttggcattctaaaggaagaacggctgaagtaaaccacaggtgcagatcaaatcttgatgtctgtttcactgcaggagacaaatagaatctctctttcttgtatgcttctgttatgttgagtctaaatctgaggtaatcatgatcatttcaacctgaggtatggtttactaaattaggagaaacatacaaaagtttgttgacttttaagctaaagaaggcaaaagccataagtgaaacaattcaagtagagtgctataatgtgactgtttctaatgacaacttgaattgattgtaaaataagtctggcagttaaaatgtattagtgttggctgagcatggtggctcacgcctataatcctagcaccttgggaggctgaggcgggcagatcatgaggtcaagagattgagaccatcctggccagcatggtgaaaccccgcctttactacagatacaaaaattagctgggcatggtggaggctgtgcttgtagtcccagctacttgggaggctgaggcagaagaattgcttgaatccaggaggcagaggttgtagtgaggtgagatcacgccactgcactccagtctggtgacagagtgagactgtctcaaaaaaaaaaaaaaaacatatatatgtgtgtgtgtgtgtgtgtgtgtgtgtgtatgtgtgtgaaattatgacagaatttacctgtaaggtgttagtcatggaatactatgcagccataaaaaagaatgaaatcatgtcctttgtagcaacatggacgcagctggaggccattaccctcagtaaattgaggcagaaaaagaaaaccagataccacatgttctcacttacaagtgagagctgaactgagtatgcatgtacacaaagaagagagcaatagacactgaggcctacctgaggatggaggttgggaggaggatgagaatcaaaaaagctacctatccggtactatgctctctacctgcctgatgaaataatttgtataaccaaaccccagcaacatgcaatttacccatgtaacaaacctgcacatgtgcccctgaacctaaaagttggaaggaaaaaaaagggatagatgttagattattccaacctcagcattttaaataacctctatgactttcttagataagtaatagtaataccaaaataattagagagtggtagagttccatcaccaggtctttaccttcattttaggaataggttaaggcatcaagagataaagtaattaataaaggattatgctgtgatctgaaacacaagtacagtatttgtatttctgagctaagactaaagtccagatttctttcatttcggtgcttgttcgtttataccacactgccccaaaggacactaactgtaatagtactttgtcctgacatttaggacgcactcacacccttttgtccagatgtttctgtcttagatttccttactaaacactaggattgtgaaacctttcctttcctttctagggacaaaatggtattcactggcatatctagtttaatgctttgcgtacagggtgtgccacagacaattgggttaatggttgtaactggttaattgattgacacttaattttcagagttcgaccataactaaagagagatgagctccttgaggagcttcccactcccctagtcctcttctgctgaaaactactgggtcctcaatttttcctgaatacaccgctcatgtggccacccctaactgacccagttgaccatggatccaatttcagccactttgtggattggccaaaactctaaaaggaagcttaccatcaaaatttctgtccaaaaaggaatgatgaacaattatctaggccaactgaattcttctttactctggtactgaaaacatataaaagaaaggaggaaatctgagaccacaaggtgggaagggttataagaatttacagaagtcacaatgatgagaaagcagaagatatgaggtggagaaggtaatacatacatagcaaagaagttgatatcgactagatatggcagctgcagtgaggccagagatccactgaattgctgcatatcacaaaagtggagaaataataaacacatgattctgagggaataagttagcctgtatacttgaggtgccttagatcctatgcttttccagttctgcttcccaagttcatgtaccattccagcaaattccggaattcttttcatactattcattctacaataacttgacccctctttttgttgacgatgactttctgttgcttacaataaaaagaccccagtagctgggcacagtggctcatgcctgtaatcccagcactttaggaggctgaggtgggcaggtcgcctgatgtcgggagtttcagaccagcctatccaacatggtaaaaccctgtctctactaaaaatacaaaaattagctggacatggtggtgtgcgcctgtagtcccagactcaggaggctgaggcaggagaatcagttgaacccaggaggcagaggttgcagtgaagccgagattactgttgattactgttacactccaacctgggtgagagagagactctgtctcaaaaaaaaaaaaaaaaaaaagaacaaaacaaaaaaaagcctaaattatacaacaggatccatgggagaacatcttgatagctttttagcaggaacatcacattccaaatgcttgctagctattttctgagtatcagttatatttaccatgatcctgaggagcagaccctttattgtgtcccagttcagtttgcatcgtcttcatacagcataaggcaacagtgatagaaataatctctagagtaatctccaagtacctttccaaagctgctatgcctcaagtacttcctttaacctttaagcgtctgccttgcatacagtcctcttgggccactcttggcaaaatatttggaaggagatctggaacctgattatttctcaatgaaaaaataatttgcttttgcactgggaagcgacagtaatccaatataagcatgccattgaaaaccttcatgccctactatttcttttaggacttttgtgaaccctttctctttgatacattacctttggcaatcatggtattccaggacgtgccaatgaagttggctgaatctgaatggtcttggaagagtggtttgtggttggaatttctcttgcttgttgatatatgtactttccatgttggactttgtgcttatgtgaattctccacgtctcaaaggcattatgtctagcaagcaatttctcataaattcttatccatacagttattctatgagagcattgcaaatatagtcagattaggctttgatttgtttttcattctaatgctatctaacaaggggatgttctgatttgtgtagccctgtgcctccaagaagttaacggtaccagatacacagctcatttattttcattgtgcccatgtggttttctgaagtcacactttgtgttgttttacatatgggaaaatggaaacctggctaacttgtctttagtaagtgattggtggagaaattagtagaaactacatctccaaattcctgatctaggtaatgctgtttcaacaagctaagttgcatttgaattttgaaatacccactctagattgcaattaccaaatagttgttatgtacccaatcacaggatatgcttttgaaatttttttcattagtacatggaagagagagttttatattgtggtaggtagaaatgcccagacaagacaggactgagataaattaatggccagtccatttattttgataaacacaaataggactaatgcaccttgagctttaggaactagcagggcatttctagttgcagcatagtcacactaaggtgcaaagagtcaatggacaagcaaaaatgtgtaagaagaaaataagattctttgtttgttttctttatttgacatatttaaaagaaggcaaaagtgtatcttccaaaaagtacattttgtggtagacacttttcctctgctaaaccatatgacatcaagtggcatcccttttcttcctttgtggtcattctaaccctgatcccagattggacaaggttgaaatatcagcatgaagtgaagttggttctggttaaacttttccaggattgtcccatcttccagtccttgtaaatgagtgtcatgctttgttgccaagtcaatgaggagacaatgttcacatggagacccttgggcacagatgaaactggaattccttctcacccatttcatacagatagtatgaaactcatttcaactgagaagtgaaaattctggttaaggaagaattggtacttgaaagttgttactttaaaaaattatcttgattcatggttttacaagtcagttataaatgttaatagcctccatcactgtcatgttagctgttgtttcagaaaagaaatacatattgtagtagttttaatagaaggagtaggacagtaaatgtaaatgtctgtcctaatggattgttttatacattagagaacaattttttaagtgatcgagtaaacaaagtccccctcctacctccacggtgattgtttctcatagatgaaaacagttttctcatcctgacgacgacaacaacttcttcttcttcttcttcctcctcttcttcttcttctctttttctctttctttcctctttatttttcttctttctttcctcctcctcctcctcttcttctgctgcttcttcttcttctccttcttcatcatcattatctcatcatcattatcatttcagtgaccagttagtgagcaccttcatgtccaagcactgtctggggtcttcacagatgttatcctaatcttcacaccagtttaatacaagtgtgttaatatatttgatatgagtgctaggatatagtatttggagatgagggaagctaagctcaaggtcacattctgctggaactggatttgacaccagagctgtctgattccaacacccacactcttccctctgccatatcctgtgggtgtgtatcaagttttctcccttgcctgtggataggttgcctattttttaaattaagctcactctttatttctttccttctccctcctccttccccaatttcccttttctccttctctttctttcatttttttcccaagatgatatttacctgcaatacactattgaaaatttctctatgcttctgccctgatctaatacaatttttatcaagggaaaaataacatttactaactaatacctttccctgtagaacctgatagaaaataaagcataaaatttaaagtttatgacacactgcaattcatccaagggcgtctaaatgttcaaagaggcacaagagagagataatttgcttttaaaagaaaatgaggccaggctcagtggctcatacctgtaatccaagcactttgagaggctgaggtgagaggattgcttgaggccaggagttcaagaccagcctgagcaacatagtgagatcccatctcttaaaaaaaaataaaaaattagccagctgtctatttaaaacaagaaagaaagaaacagaaaatgggaggaattcaacttttgattagattgtattggatttctgaaaggaaaagggggtaccaaaaaacagagaatttgttgattaagtagtgtttaagagcagaaatgtctgatgttcagtttaaagatgcctgcactgctgtgatgtaacctctgcttgcctgatactgaactctaaccatgtgtatcacatcctagacaggggagggaatggaggataattgacaagaacagcttttgatgttaaaactaggagccaaatgcaggcagggaatactgtgggaagagagcaactagagttgaaaggatggaattttccataagcaatacaaagatttttgatacctgactcctacttaaaattaattcgactagaaagactcatctttttctgaaaaactttctaatcatatatcacttattttagttccacatttgaaagcactgttgccacaaaatcacctattcttttactgattttattaattaataaaagacattgtgtaggacagtatatttgtcataattatgggcagatataagcattagctccattgcaaaataggattaaaactgaatgtacagtgttgtcaagtatgaaatatttttcccagaataaatgagtagagaagcatttaaagtctccaaaaactccaaggggcctaagtgggctctcttccaaaaaaataataataacaagttatgatcatattaccctgaaatagattcaattacccaaacaattagtcagctaacaaatatttatcaaggctcactcttctaactgatctgggatacagaaggattgtaagaattagtatcctccctaatggagttttcattctagtatgagagacaaaagtaacacttaaaagctaaaattgaatgagttagttacaaagtctgtggggttgactcgagtagagggtggttgatcagtgtaggtttaatgaaattaaaatgagtaagattctataaatgcaagactggccagagaaagtggggagctctggggccagaacagcagaggaccaaaggcatcctacacagccaattaaggaattttcctactgaagcatggggtccagggagcttcatttgtaatcccttgttctgctttgtttcattcttggactctaatatggtttgactgtgtcctcacttgaatctcaccttgagttataacaatccccacgtgtcaaggttggtgccaggtggagatgattgaatcatgggggcagtttcccccatactgttctcctggtaagtaaataagtctcattagatttgatggttttataaaaggcagttcccctgcacaagctctcttccccaccactgtgtaagacatcccttttctcttccttcatcttccattttgaatgtgaggcctccccagccaatgtggaactgtgagtccattaagtctctttcctttataaattgcccagtctcaggtgtgtctttatcagcagcatgagaatggactaatacagactccatcacagacctttgggctaaggactttacctctaggcacctgccctattacttctattaaatggtgtaaacacagtttgctcacccatgcaattgccttactgtgattcatcttgaagtctagcctgatgacagggatactatgcaccccacaaccaaccctactgagtaattggctccattaaaacaagagagaattgtgagataatctggatagagttagagttcacaccaaacatagagtttccaatttaatggattagtttcatttttgcaacattcagtactgataggatgggtcaattttggcagggtctagttgccatcttaaagcgaggtacagggtgctatttagagcactttgcagcaacaaagaggacaaggtttgaggataattctaatagctcttatacaaagatattgaaccaagtaaatttataatatgtgggtctgcaaagtattcatgtttcttgagaggagtgcttcagattgagagacgggagcaatctgtaaagaaggaacccaatggatggacactggggaatgaatatcaaggacacagttaggtatgaatttaagctagatgttcacttaggtaactgtagcctggagtggaatgacaggttagaagaagtctcctaggctgggtgcagtggttcatacctgcaattccagcactttgggaagccgaggtgggaggatcacttcaggacaggagttcaagaccagcctgggtaacataataagatcctgtctctacataaaatttaaaaagttagttgggcatggtggcatgtgcctatagtaccagctactcaggaggctgaggcaggaggatctcttgagccaaagaggtcaaggctgtagtgaactatgattgtgccattgtactccagcctgggtgacagagcaatactctgtctcaaaaaaaaaaaaaaaaaaaaaaaaagacttcaaatagcttacctatgaagaagctgcttggtaataccttaaatttcccttctatgcttttacacagaaccctaaccttgcagttgaggacttgagtcatctcacaattcttttgggtaaaaaaaatgtaaactactgtgacccaactttctttacagctgggaaggcctctatttgattgaaaatataaattaagatactaggttttaagttaaaatattaaattacctctagcttttaaaaatcataaagatctttctttaactaacagtagagggatctagtgtttcaagtattgaattggtttaactgagcaatttctgaatgtcaaagcaacagattctctaataacatcttttgtttttctaaagtttattcccatattatgttatattatcagagagccatgtaaggggactatcttactttatatccccatagaatttccttcccagagttacaatttaacattttgtcctcagcttttttatagaggtcaatataagaaatagcacaggaagaatctcttctcccctctgccctttactctgggcagaattaatcctttacttgtctatgtatatactgtgatttatatatactgctatggtagcacttaggtaataatattattgtaaggaattttgctgtctgagataaatcttccctatattctcccctttgttttactccaaaggactataatcctgcagagtttttcactaatgaatttaggcattatttttctctaaaagaaagatcacactgaaaattatataaaataggctgttttcctgggatacccttgtggcttgttagaacacccggagtcagctggactggactgccactcttcttcacttactttataggcagatgctattccttttagagactgtctctgaaagtgaggaccctgggttatgtctgatcgttgggcggggagggggctttaaggttctaatttttgtatgtgtcctatttccatgtcttgtttcccagataaactatttccttctatgtctctgctttcctgaagacaaaggtacctttttctcagcagtggagttggagaggaaacagattcaggaagagtccaatattactaccattattgcaattgcgtagtagtacatgccaaattcaccctgtcttttcattttacttacctttctcttgtcccacatgcttttattcttggcatgcttacctacaaaattatcctttttttctatttccgtattccctatgccctgtagtcttctttcaaagcccctttgaaatgctatcatgaaagacggatttcttttctcagtgctgtgagcacctccatctcctcttctcttctttcacggtgcccatttcttcttcatctcatcaagtatgcagtcctttcttcgtctgcactgttatgtacctccttccacctttgtttcttccaaacttgtatttcttttgtctttccatttaacaggcctcatttcttttatcttaggaatctattcataaaatttatacagtctttaaggtgcaaacaccttgaaggtagagaccatattatttctatgttctttatattggcactccaattaaacaaaagtctatgtccagttgaagtctggaagcctgataagcacactgaagtaaaagtcgcaatacacatgaatgactgaaagtaggttttgttaccagtggaaaagacatttgtgagaacaaaatgacacataaagaggaagcaagtgattactgacttactggaaatcccaggccgggcacggaggttcattcctgtaatcccaacactttgggaggctgagatgaggggcttacctgagctcaggagtctaagaccagcctgagtaacaagtgagaccctcttctctaccaaaaaataatttaaaaaaaattagccaggtatggtagcccatgcccatgcctgtggcctcagctactcaggaggctgaagcaagaaaattgcttgagctggagaggtcttccagcacctgaaagacagagaaagaccctgtcttcaaagaaaagaaaagaaaagaaaacccatacatttagctcaattgactaaaagcctaaatgaaaaatatatatctttcagcttaaagggttggttggattgatttgttgagtaaggtattactatttggacaattgtaaaaaggacctgtgaaagccatattttggcttggacaagctcacccaccccatgccccatctctactaagggggggtgggattcactgtcaaaagagttcttctctttaaattctatacaataggtacagtaattatatctaattgcatttgaaacacaatagttattaaggcaaacgtttctagactagtttcattattaaataaaaattgaaactgagagtttttcccatattggtaaatattgatttaattttttaattgaatgggaataatatgggcatttttttatcatttgcccaaaatattttaagaaaatactatatagtgtaaccttttttttttttttttttactatgaaggcattaattttgttttatttttagtacttgcttccagttcacttttcaaagtgtcctttaggcttgttagtttcaaaggaaataatatatttccttttgacttaaaatgcctatgctatcattagatattaatagtagaagtaacagcaggattgcctggcacaaatttgtcctgtccttcttctggctaggcaatagggtgcaaatgttccttgctgtgcttttgatggtgaaatagaaataacgcttcacattttataacacattatatttcataaagctctttcacattcatcacttcatttaatcatcaaaaacaattctgcaaactgatattatttttcacatttaagtgtgagaatattgatgctcaaggaagcaatgatttggctgaggacccaaagtgagtgtcagtgccaagacttaaatctatttcttctcactcactccagagtccttcccacatcatcacactgtctccttctactgtgctttgctctaacctgctgaactaactagcaagtgtctttagcatactacattagatagctaagacttactgaatgcctactgtatgccaaatcctgtcttaagaacttacatgtgttacctaattcaatccttgcaacccatgtatgataggtaatattattatctccatctcgcaaataaggaaacatagaatttaaataacttgctcaggaaggcatagccaataaatggaataagtaagtctcaaatctggacagtctatcttgagaaatgcatgcttaatcaccatcctctattgcctcttaaataatcaaagcccgtaaagattttataaatgacttttctcatgaataatagggcctggggtgagtttctcaatatcacttatggcaataagaatttcagcaatcataatcttggtgcattttccaaaaaggatggctccccattgggtaacacaaggtgaaatgtgtattctgttagaaatttttgattccagcctagggaggtatcaagaataatgctgttgccataaagatataagtcttgagacaaacactggagaggttcagtcattcaatcaactatacatatattactgaacattttttatgttcaaatgctgtgctaagtatctgaataatattcacatgaagctgaaaatctatcaaaaatacatttgaatacagatacttggtaaaatctctaaaatgcacaaagcttcatggacacatgaaatttctttactatggagaaatcaaggaaggtttaataaaagtagtaacattagagctaatctttgggtaaagaagaggaaaagacaaattgtagtgcatgctgtaactgtatataggttctttggagatagctcattgaatgcaaactttcagaactcacttcatgagtcaataggaactttacacaatggtgagaataaagtgcatcctttcaaagcacactgtccatggcgtgagagtaaccaccacactgacatttgttgaagaaaggttctcctgggttctccccactctaccctccttggatgccaattaggcaccttaggaaggacaagtgtcttccctgtcccaaagaattgatttttatagatatttatatctacttttgtgaacatgcaatgttcattttgattattattaaatcaatgtaaattctgaatgaatttctctgacttttactttgcttattaagttgaagactcaagggcaatgcagatgagaatttcagattcttcctttgagaggatttttggtcagtggctctttaagaagacccaaagcaggttgggtatacttcgtaaaatcagatacttggtatatagttcttttttttttcttttctttttttggtaacatcaccacgaggatttctttgctgaaatgcactgaccttctgtaaaaattaacactggaagtattttccaatggaaattgactaataaagaaatcaataatgaaggaatatttttagactggcaagaatcatgatgacactgttaagaagaaaacattgtacatatttaatatgtttaaattccagatcctcaatattatgattaagaatttaatgatttttgtttataattccttctcattgtgtgcccacatcatacttagcttaaattatgtatctaaatatgtcttctctataaagtttcttgtggtcagaatcaagtggtccactagtttcatttagcagtagatgtatatattttgacacataccaaagaagtgcagctcagtacccaaaagatgtactaactgaaaactttagttcatgtaatatgcccggcattcaccctcgcggaatttagacaggagggattgtggcctgtatgtttgacttctggaacttaccttagtaaaattcaaaaaacaggttcattagtaatttcttcaaagaaatctgcttcaatttattcagatgttttgtagtctctactttgtattaaatataaagcactgagttaaagaggtaaaaatatcaaaatgaacaggatagtctctctcctctgggatcttataatcatgtaaagaaacagatatgtaaaaactgtaaaaaagatatgtacaatataattataatataggaaaattaaaggccatacattttgtaaataaacagctatgggaacaaaaaaatgtgcatttttttttctaattggcaaagtctaaatgggattgtggaggagcagtttgtatttaagcctgcaattgaactacatgtattatttttaaaactggagatttgaagggaacactggtggcaaatagaattgtatgaacaaaggaacagagatttggaaaggcagatggatgtcagcatggctagaggacaggtacacagctgatggggcagaaggtagctatgaaaggtttgcagaagtcagattgtcagtttcttttaaagcctgctaaatgtgtacactttattgtgtaaacagtggcaaacagtaaaggttttgaactgtaatgatgtagtggtctgggctaaactattcagagcaagcattttaggttacagtaactgaactgtgggtttttgtttacatgtatccagagttgttccctacctttgcaaggtcagtgtctcagtgatgtgccttaaataccttgtccttgaaatagaacctcaacatcttcaccttgttctttttttttaaaagaccgtgtcttactctatctacaggcatgcaccaccatgcctggctaatattttatatatttttaaagatgggacctcactctcttgcccaggctgatcccaaactcctggcctcaagcaatcctcccacctcagccccccaaagtactgggattacaggcctgagccaccatgcacagacttatccctctcttaaaaaaatttgttttcaacaaattcatatgagtaagattaagaagaaatggtacaaccagacataagctgaaaagcaaaagtctcctttcctactttgtttattttgcttcccctttcagaggaaactacatttgatcattaaaccaatacatcatttatattcattttttcaaaatatattaggttggtgcaacagtgattgaagttttgtcattgaaagtaatggcaaaaaccacacttttgcacctacctaatataaaacttcatttttgttttgtctttcatattgatgaaccatcatttgtttatttttttggatattggattgccttcattgttttcactattataaatacccctattacacatacaaaatcaaaataccatttttgccttggctttttaagaaaataaacgttgattttaaaaacaatttcagatatacagaaaaattgtgaagatactacagtgaattctcatttccctctaccatgttccccctattatgaacatcttatattagtgtggtagatttgttacaataagtgagtaaatatgaatactaattattttttattgatatctgatattatttggctctgtgtccccactaacatctcaccttgaattgtaataatccccacatatcatgggagggacccagtgggagataatttaaccatgggggtgggtttttcccctgctattctagtgatagtgaataagtctcatgagatctgatggttttataaaggggagttcccctgcacatgctctcttgcctgccaccgtgtaagacatgactttgttccccctttgccttctgccatgattgtgaggcctccagagccatgtggaactgtgagtctattagacctctttcctttataaattacccagtcttaggtaagtctttaatggcagcatgagaaaggactaatacaatatcaatagatattgatatcaattatttttatcataatttattcagattttcttagttttcacctttgtcttccaggagcccatcctggataccacactacatttattcattatggctccttaggttccacttagctgcaatgttttctcagacttcctttgttttggacagccttgtcaactttgagtaatactagcagggatactgatgttttcctaagtaccagactggcgttctaggtttagtaaggaagttcacagaggtaaagtgctatgcatgatatcaagtatacatattatcaacatgactttataccattgatgttgaccttgatcactgggctgaggtagtgttgtcagattactccgcctgaacatcattgacttttcccctttccattctgtactgtttgggaggagctcattatacacagttcacacttaaggagtcaggaattactgtccacccactggagggtgaaatatctacataaattaattgaatttttttttcttgagatgaagtcttactctgtgggccatgctggagtgcagtagcacgatctcagctcactacaacctctgcctcccaggttcaagtgattctcctgcctcagtctcttgagtagctgggattacaagcacatgccaccacgcccagcaaatttttgtatttttagtagagacagggtgtcaccatattggcaaggctggtctctaactcctgacctcaagtgatcctcccacctcagcctcccaaagtgctgggattacaggcgtgagccaccatgcctggatggaattcttttgtatggcagatctatttcttctatcccatttatttatttattaattcatttatttacatcaatataggcttatggatattcattttatactttgggttaccatccaatatgacttcactttgttgcttaaattgttccagctttggccactgacttctgtgcccctctgacgtttcccatcagtgtgggatttttttttttaagcacttccttactttctggaacgacatgattctccaggcttatcttgcatattttctgcttcaacattaggcaaccagttcttcaaggagctatgactcttttaattggggaacagaacaaaagccaagacctgagtgctaagtgtgattgttactattggggtgcccttgcttctagagcttctcagctgataaagtaaagaaatttatgtgtgtatactaacttgtgcctgcgcacctatctataaatatttctatatgtaaacttctgtgtctacattaagctaaacatgagtacattttggtgtttccaagtctaatatattaccacctggttagtctagcctattccccttgtttttttctgtaaaatcctacaccaaagtgagaaacatggcttctaccttcctctatccattcacataattattaaattctattgtatgcttgtagctgaacaaaatttttaacccatattgctgtaggaaagacactttatcaactagagagtttgagtttatgtgcagttcctcttccttttagacttacagactccactcatttccaaaattactgttaaccacttttaccttcagtgaggttgtagtgtacatttgtgatatagttatattcttttggaacagcctgcattccatcctgtgataaatatgtattgcaaactctaaagaaacctttttaaaatgactaaaaagaagattaaagatgcagtgatgcgggaaatcagtaaggatataaaatcagtaatttgacctgaacagcactatcaatcaatttgttctaattgacatgtatagactattccatccaacaacagcagtatacacattctgctcaacctcacctggaacattcatcaagtagaccatattctgggccataacatttatcttaacaaattcaaaagcgtggcaatcactttgaggaacttgtccagagggtataaggaaaggacaaacaaatgaaatatagaaatgatagaaaaagtgaaataaagagaagacattgtaatgttaatgtccataaaatagaaatacaagaagcattaaaaaataaataaatcaaggatagaaaatatttgaagaatattgtattcaaatatatcttataatttttgaaattataaaagcattaagaacccaaatttgagggtttcataaatggttaacaaaataaagaaaataatcctttacctagctacattattgcaaattttaggacataaaaggcaaagagaacaaaacaaaacattcaaggagggaaaaagaaacaagtattcaattgttatatttctcaccagttatggtggatacatgaagataatacgttactaaagaaaaagtgctttaaacctgggaatttatattttattaaaatataaaatattatttaaatgtgaaaatgaaacaaatttatttttagtttgaccacttaagatgtgctttgaaaataccattgaagatgggatatccataaaatggaatattattcagcaataaaaactcatgagttatcaagccacaagaaacatggaagaaccttaaatatacattcctaagtggcagaagccagtctgaaaaggctgtatgattgcagccccacgaccttctgggaaagggaagaccatggagacaataaaaaagatcagtggttgtcaaggattcagggactggttgaggatggagagggcagtggatggggagggaaatgggtagaacacagggcatattgagggcagtgaaactattttgtatgagactgttatggtggatacattgcatcatgcatttgtgaaaactcataaaagtgcacaacaccgagagtgaaatctaatgtaaactatgacctttaattagtaataatgtatcagtgttggttcagcacttgtcacaagtgcaccacactaatgcaagatgtgaataatagggaaaaactcgggagggtgggggctgggggaaggtgtagaaggaatacatgagaactctgtgcttttggttcaacttttctataaatctaatactgtttaaaaaattaaagtctgttgattaaaaaaaattacaccccagaaagaaaatatatccaggagaacccaggaaaatatgggaagtatggatgagaaaactatcaaagctatcagtaaggtatattacttataaataaacaagaaacaaaagagaaaaagcatacacaaaacaatccagactaacaattctcaaagacagaaatgtggtgtggtgggaaaaatgggatggagagtgtgaacaaagtcatgatgagacctcacagaggcaaaaatgtactaggatacttgtcttgggggcaatataaaatcatgtatataatttaagggtaattaatacaagtgttcatttaatacagtgggaataactaaggaaaaataggatttgagaatataattctcaaaccagaagaagaaaatttggtatgaccaatgaaaggaagaaaagaaaagaaggaaaaaaagaaaggaagaaaacatatagagaaggaatagaaagggaaagaggaagaaataaaggaaaaagggaagggaggaagaaagaagggagggaggatggaagagaggaaggaaggagggagggagagagggaaagccaaaacaggcgaggaatgatgagaaggatgggtagctgttctgtggattgtgtgagttaaggggaaggaagtggtgggacttaacatcagctccatatgctacagagtcaagtatcctcacatattcttacattttccctgaagttatatattgagagccagtggaagacatcgtagaaattccctggtctattttgtgaatgtgtcttgtagtacatagataattacatgtgagccattcctataaaaaggtttagattggtcaaggatgaaagaaaaagagacttgcaggtggaaaacaaaaagggcaataaattaaatctttcaaaataataattgctgaaaaatagtcatcttaagaacctcatataactactagtttaaaatattgccatccagttattgaaaaaagcaatttttcacatcaagaatttttatttatcttaaaatatttcagaggcaattggtgttatgctttagacacttgactgacagtaaaagtttactataataattcaaatgcctcttcaaagtggatgaacagaaacaaaacgttcagcgaggtgagtgttaaattattattatttagtgggaaaatgacctgaactattttctttggttgctgttacataatccataatctgatatcagttccattttgttgtttgtatttgtgcttgaactttcaatacaatagaggtcactaatggaagcctaaaaaagaatttttatttgacttttggttcattagaagtttctttgttctagttattttccttagcagagtgaatttctctcactttctcactatttgtccaatttactacctaagcctggatgtttgtcttttcatactctggaaacatggacaaagacaaaacatagggagtttcgaggcattattcaataactacctagagaataatggctctattttatatgatctaacttggtcacttgaatgggtcatatttctccaatattcacagaaccacctaagttgtttttggttgtgtggacatagatcagattgcctttgaatcatgatttgtagatgtaaacactatttattagttgtaaaaactttatattatctttaacagcctggccaaaaggtcattattgtttaggccttctgccttccagaaagagtatgactaaaacagatgtattgggcagaatttccagaaataccccaccacccccaatttcacagggctaatatccagaatctgtgaatgtgatgtcttttcattcccatgattgtcttatgtgatatgacgtagttgaccctgaaagggtagggtattcctggcagacctaatctaatcacagaagctgttcaaagcagagaaatttctcgtgctagtgacagaagacgaaagcatcagggaaagtcagaggaattcaaagtgtataaaggacttgagctgttgctggtttgaatacagaggagccacatgagaaggaaggtggttagccatgggttgctgagagagagattcacagctgagcatcagcaaaggaacctggagctcagacctagagccacaaagaactggattctgccaacaacctgaatgatcttgaaagtggtttcttcccccacattctccagattagagcccagtaagccatcaccttgactttgaccttgtgataacttgaccaaacctagctaagctggccaggacttctgacccacagaactgtgaaataatacatgggtgttgttttaagccattgagctctggtaatcagtaatatagaggcagacaataaatatagcatctaaaaccagtagctgtttattttgagatgtcaaagaggatcccattctggtgtttgatatttcagagtgccaggccatttttcctcacatcccactgacattcctcttgttttgatttaaatgaatagtctcccttagatgtcccagacaggattataagtctctttccttaaaagtttcagttgttaagatatgtagcataaaattgtatactataatggatcttgtaaatctaaccatttgctaaggtaacacaggttgtaggaagcaaatctggtactagaagccaagatgaaggattttcaacctagtgacctttctactcaaaagccatactggctctgaccttcatattttaattgatcaggcaaataatctcaaatcctccaactttgtttgattatttggctaattctgctcagaatcctctctaaatatctactggaggcagggacattaactgaatttgaaaagcaatattatggtaagactctctctaataataccataaaataccatagcaaggttgtttttaacagataattaaatgaagtccaaaggaaataactagcttgcccaaggttactctttgcaattgagaaaactgaggcttgaataggtgtaattattcattcaaatgtcctcggccagttcatggcagagatagaaagtcgatccacatctcttgatttccaattctttttttacactgagctatgtcaatatgtcaattctatagggtttgccctcagattagtttgagaaataaagtatattcacagcctctgtgttttcagtgtactaccagctgggatatctatgacttagttccaagctgtgatattctctgggactacaaatttttaagagccattttaaaattggctagaaggcaaatctagggtgcccataatgactgtacccagccctgctatgagtgactgcactgtgatttattccctactcagtgcccatcccccactccaaagccctacaggatttaggaaaaactgctggaagaaatgctacatcatgaaagcttaaaaaggctcagggaacaccacacttgaatcagtataggtgggactggtatatttcttttgctatttcattatccattttgcagttcttataaaaaatgagtctgttgatgtagtcttctgaagcattaagatatatgctatttctgcagtgaacaggctgcttagtgaagaagagtgtcggctcacttttgttctttcatatatttattagagtacgctttcccagagtgtcgattgcatgactttattgaagctagtttgaactcagactttcccccactgaatctgagatccactgaggcccagacaccaaggagctgttacacatgtataactattccattcacacctcttcaggagtttcaaacaagtttaattataagagaaacaaaagaaagcacttcttctttgccactgctaggaaaaaaaattgctttgcttggaaatcaattcattgtaagctttaatctgcctagttcggtttctcagaatgaatatttcaaatattaaatattttcttgagtagaatgtatagtacatattttatactaatatctatgtgtgtgttagacaattaagaagactggagtgttttccaaaaacttgaaaagttttcggtgactcgtaatacagaagtgacatttttatttgagaacaatttaccagattatgtcaagttcattattggtatgatactaattatccttaggataaattggaaaggggaaccctctgctagttttctgaagagctgcgtaagcctgatgaaatgtcttttctctttctgtgactcaaagctccagaaaaatctgcaaagttgaatatcacttgtgcctgctaatcttgtgtcatagttattttctatcactgtcataatgtcagagaagcactgggaaaatctgcacatcactcatctctccttcttcacccttatccaggtatatccacatatatccaaacatccagaaggtcacaggtgggatatttttgaagatgtactcacttcagcacaggtgaacctgttgatgacttccaggtctaaatatggtgaccttagtcacactggttatttttagggagcttcctctgactctcttataaactcaagatgataaatgcaatctacctgtaagattcttgagaaatttgtgttgtataatatgaccgtatatgatcccagtagttgtgtggaacttgataggaaccacagtaagtatcacctctccttgcttccatcattcccctactccaacagtttcatcttcctcttctgtttctagtgaataaaacatagtctgctgattttaaggtatattccattcccagttgtatacacaatggttaactttacattcgtgcaatcagtcagtcaacatttgagtgtgtactctatgtcagatgctgttttaggtgctaggggcccagcagtgaacaaaacaggccattgctgtgctggaagtaaaattctagttgggggagacataaaataaggaaataaataagtatataatataaggtaatatatacaaatgaaaaaaataaagcaggaaagagggtagggttttggggggaagaggatgttaaaaagttctaatggtctaggtatggctcattgacatagtgacctttgagcaaaatcgtgaaggtgaaggagctttactctttgaatcaggatgtcaggtcttagtttagactcttcagactagatcttagccattgtttatagatttgcttaaatgtctaattctttttcagctgattatgttggagtttattgttcctaatgaccaatatgctctaccaatgtcagaggcctgattgacttttgagggacaatgactgctccagtttatgcactttctctccccccagccctcccatccctcccatcctcctctgcctaccctccccaccccactcactttttggggttcctttgtcagctgtgtattatggcaaggatcgacattttcttgacattcattgtagagaaggtgatgtaatctctccttggagggtggtcacctgctgcttgcaggctgagctaaaagcagattctctcaatgacaggtatgactgcatttcctgggcaccttcagcaaacaaggctcttgcaacaatagcttgcgtcttattcttaattacttcataccccaaattaggtgggctaaatatctttttgttgtcacagaatggaaagcacatcataattagtgtaaaacaaatatcctcatagggtccaacatgcagtatcctaaaagaaaacgaagtaaacaatttatgtattttgtaatatacatggaatatgccattaggttgttttgcaaacccatgtaggtgatcctggtagattagatttacaatatatctttcctttcacttcattctctccatcctctatccattaatttttcttatatctagaaatagggcactaaagaaaactacagtatacagttcctgctttctctgaaatcaactattaacttcaggcaagtggaacacatacttggtacattacttttttttaaatccctgtattgcataatagaagagaatggtaatttttatcatgccattaatgtgattcctttctttattgcttaaagtgtcaatcagtcaaattgaaatgggttattactctgttatcttcttcattttaattatttggctctcccagcattacccttcattacctgttctccagaggatttgttttatctgaaaataatttactgcttaacatcgatgcatttttctgatatcgttaggtgggcctggtgttacatttagagagttaccgtcatcagagtaagaggaaatatatacagtgttttatcttgcagaacttaatgtaccaaatctgatgtcctataatgtttcagagggatgatacaaatcatttgcaactagaagctgaatattcagccttgtcacaagaattctcccttattcaattagattttttaggtgtttgctttaaaaagtaatatcagattagtaatggggaagcaatctttgaaatcattggtgggccaaaccatgataataagatacaaaagagaaatgaatggtgggaaatggcagacacattacacataaacattgttttgttatggcaaatctctacggcttctcaccacgatgtcagtacggaagtttgaaagaaaaatgtatgcgtctcccgtagagcccatgaacttgttttcttttgcatattatagaatctgcaggtatttttcaaatgaggaccacaaacattcaagtattaggttttcttacaatgacagccaatttagcaagcccaaggttttagagcatccttcaagaggctggttccatttgcacgttcatgttcaattcgcaaagcaacagcagcagcctttacgtatcccacgattaacacttcaacctccagcccattttgtaaggttaggcattcatcaaaatgtcagaatgattacagtacagatctaaaatcccttttgtcagacactggactttaatccgctcttttctgtagtcacgtcctgtcacttttgcagctgacaattattgtttttggtcaaaaaattgtaccttgcaatcaaaatggcttgttatccaaattgatctctgatgctacaaaatgttgtttgtggacaattctcctgagcaccactctccctctcctccagagtttacagttgaaatggaagcaatagaaagtcaggagaacagggtggggctgaggcatgcctggtcttttcactgctaggcttggatgcctaggaaatttacctggaggcttctgagtaactgaacctctaaaagatattaaacgagactttttcactattttattcatagtttgtgcttacttttaagtgagcttttgttttggaattaaaccctgacagtcagtggcagctagaatcgccacctgtcaaaagtaaggtttccagtaaacaaaatatttacatatatcaagtgtgagagagactggggaaaaatttaatgggcaaacagaaattcatagaaggctacaaagtctttcttgaccagtctcacttgtaggtcttaagcctaagatgccatattacaggtggatcagcttcgggaggaaagcaagagctttctattggaagcaagcaaacccctctttgtgagtttctttgcatttgaggttctataaattttggagctaaaacagttagtcccttatttttgtttcactgaagctgctgaatgctaataggttattgatgatggttttatttgccagccatgaaaaatgcttggacaacaggacatgcatgacagttaatctttgtagagagaagatgagcatcagtggctgaattaggtgcggagggttgcagatgatatttaggaacacagtgacatcaagggagagggtagcccatggaactgctggccataaatagttttaggcatactaaaaatatcaggagaggataggagagactatgtggaattgctttacaagaatggcagcttcttaagaattataatgagatcagaaggtacaatgcttttcagtacttagaggtttttttctagatggaaataagcaaaagtagagaattaccagggtttacattttgtctccatcatttatagctaattgaacatgggagaaaacgtagcttccttctaaggctcagcttcctcaactggaaaattggactaaaaaagaaccatacttcagagttgttaacaggattaaatgagataatatatgtcaagtgcctagctcaatgtttggcacctcagcacatgctccagaagtggtatcaattattattacataacagagataatatttggtgggctatgtgtatttgtgagtgagagggagaaagataactgttttttttacgcatttttgtgaatgtataactttctcccaactcagctgaagcatccaccatggagagaagtgcttcaggactgttaccagagaaattgaatgagaaagagatgaaaccattttttaacatccctaatgggaattttcagtgaatggctagacagtaggcataaaagccaaactgtcatcagggaagagtctttatacaatcaattatcaagatgcctgatggataaactagaccacaagtcctgcaggaggacttgctgggatggataaagtaaggaggcagtaggtcatcccttctgttctgaggaatgtgagaggaggacaggaaggtaggaagggcaggagagtcttcctttgcagactgtatccaagactggaaagaaattttaaattagtaaaatgagataccagcagcaggaagaggaaccactttgctgaccaaccctatacccactgggtaaagggagacagagcatcaaagtgatcccagtgatgtcatgtagataggcacagagaaaatgttggtgcttagctttcttgagcatgcctgctaataactggcatggatgggactgaaaagttcctgggttgcctaaataaaatacaaaggtgataactgctaagctgtgccagtatgaaatgaaggcaggccaaggcctccacagagaaccaccagccctgattaaactataagagactggccaccagattccagcatcagatcccaggtagggcgccatacaggagagaacctacaccagggactggcatgatctcagactcccatagatttggaaaccctgtctgtccactaccctatcatctcaaaactcactacattctgtacactcagtgcaatctttgaggggaacagagaaaagagagaaaatgggaaatgatgggattaagctaaactgacatgatagactaatcctaatcctattccctccctattcacctctgtcatcaccagtgccacacagaaggtgggagtcatgagaaagacacaatgcattgtacataaaaggaaaaaagctgtgtcttcaccaactcaaaataggaaaaattgtgaccctgtgatgacaactattacagctgtcataataaaatcaagatgatggctgtatttctcaggcctcacatcaccttttcttttacaaattatttgaaatttaaagtagttttttctaattctgtgaagaaagtcaatggtagcttgatggggatagcattgaatctataaattactttgggcagtatggccattttcatgatattgactcttcctatctatgagcatgggatgtttttccatttgtttgtgtcctcttttatttccttgagcagtggtttgtagttctccttgaagaggttcttcacgtcccttgtaagttgtattcctaggtattttattctctttgaagcaattatgaatgggagctcactcatgatttggctctgtttgtctcttattggtatataggaatgcttgtgatttttgcacattgattttgtatcctgagactttgctgaagctgcttatcagcttaaggagattttggtctgagatgaaaaattcatcctgctaaaaatgcttgatctggtaagccaagtgctagagagactagaggagccaaggaacacgtaggtagggtgagataacagaagaatacccaagctgaattgaaaggaggaggtgcaaagaagcttgtgcattggattaggaaaaaatatagactttgaactcacaaggacttgatttttttccaatttgtcgtctcactctctgcataacctctattatgagttgaattttgagccccccaacccccccccaaaaaagatgttgaagtcttaaatcccaacacctgtgaatgtgaccttaattggaaataaggtctttgcagatgatcatcttaagatgaggtgattaggatatatcctaataccacatgaatgtatctgtgtataaaggggaaatctgaacacagagacagacaagtccaaagaggatgaaggcagtgatcaaggtgatccagctacaagccaaggaacaccaaagattgccagcaaatcaacagaagccaggagagaggcctgaacagattctccctcacagcatgcaaaaggaacgaaccctgccaacaccttgatttcagacttctgacctctagagctgcaggatgataaatttctgttgtttaggccacccagtctgtagtgcttgtaatgtcagccccagcaaacaaatacagcctctcaactatgtctcatcggtaaattaattatttctccccaactcataccataaaatattttagacagcttgcacaagcccccaaacaaaaaaactgtgatgaaatggctaaatagtgtagtagccatggtgtatacgaatataaacagaaacatcgtaacaggaaaaaataagaaagtccattagatgcagttgagcttccagcttgtctcttagtttcctggaaaccaaagtgaaaggaggtacctgtttggtcagaaaagttttagtattacaaaggaaatagcattgtatttctttaggggaagcaaaaactttttcttagccctaaattctacaggcagtgctgaattgctcagtaaacaatgcacttaatgatatttccttggcaaatttggtgaattatccatacactggtgtgtatgtataacatggtagtgcaacccccaacctgaaggtgacacttgtgcgcacgtaaatctctatttcttagagatgtcaaatcaaatcttataaacataagaaagctacataagcatcacaaaaaattacaaacagctatgcctcattttcataagtgatgtcctgactctatctgatctagttttcatgtaagtcctttgccactttacatctatcctcaaaagcctaacggaatctggctggataccccaggtgcttcctcaacgtagaagttttctcttgtttgtttttttttttattctgagttattttgaatatatcagtcaattttaatctaaacttgcattatgttttcaaatacaatataagaatttaattaaaaacaatgcttcactgacagcagctctacaattctgtatttgacattgtagtacaacatgcaaaggcatgtattgaggtcagtctgaaatgaaacacttagcctctatattttttggaaaaacaaatccaaaatatgaaacattcagataggtaggcataacattcagatgtccagtgatggaggtcttgctttgaggggcaggctgtttcaggtataaataaatctctcaaagtctatttaggaaaaagatatatatatattcctgcaacttcttttgtttatttttattttttgtagagatggggtcttgctatgttgcccaggctgttctcgaattcctcacctcaagcaaccctcctgcctcagtctgccaaagtgctgggattacaggtctgtgccactgtgactggcctctgtaacttcttaattctgtctgcaggagccacatggaataatttatttagtgctttaaatatatatatatgtcactaagccattttaaggaagataatcagaaaataattatcaagctgttttgaccaatataattcagattctacttcaaaaaattacaagagattgcctgaattattttttatattaaaaacatagcaggcatatgttacacaatgagttttgttctgtctttcatttgttaatactttcttaggatgataatagaaaaaaaatttgagaatttatctttctctgtaccatcaaatctacagttttccgttgtttattctcagtcatttccattcccaatttaaatgttggatataataaccagccatattaaaggcccgattctatgaatagaaaacatgaaaaaaaatttaagcgaggatttgggagatggtggtaggtaactgaacttggtaataacaataaaatgatcccaatcagaggctgttgtgtgagcacagcctgtacaattaatagtgacacttcagcagcaaagccactccaagaatcataccatcgtttgccattttatatttctctccaagattttccagagaaatgccatcaaaagcacaaatactatttctaggattccaaactctaagaaacatattaattcagaagatgttaaagcatcaaaacagagaggaaaatgttggaatggttactatttatgactagcttctgctctctgcactgaagagcgtagctatttccttcattttacagttgacattcagaaaaagtacattaaaagtacccagaaaagccttatctctgcatatttttgcaatttggaaggacaaatagaaacaacattagaacttgatacatttagtcgtactctgtattgtagacttggagtggaaaaactgtattgtagactcggagtggaaaaaacacaaactgttttccctccgctctcacaccacaacaatcaacacagatgacttctgtgaccaaatgtgtagcagcttctccacaccaacaagcaataggcaatcaatcagttctgcagcagacaccagctgggtgtcatccagtttaattccaacacagcctggatggagatatcatcagatcccacagcttaaaggctcagtcccacaagaccaccgttcgcttcacatggcagtcacaggccctgggttgttttacatgcgcttctgaccaattgtctataaatcagggttcccatgaccccttccttgtgttcaatgaatttgctagagtagctaagagaactcagaaaaagacgtgactcagtttgttgtaaaggatattacagagtacagatgaaaagatacgtaaggaaagacatggggcaaaggatgtggagcttccctcctgggcacaccaccctccaggaacctccacacatttggctctccagcagttgtctgaacctagtcttttttgtgtttacagaggcttcattacgaaagcatgactgacaaaaccattggctattggtgagcaacttaactttcagcctgtctcccatccctggaggttgggggtgggactgaaaatcccaaccttctaattctgccttggtcatcttttggtgaccagtctccatcctaaagctacctaggggttgccagtcctcagtcaaatcattagaatatgaaaatatatcattttggaaaccctaagaattttaggattgtgtgccaggaaatgatgtcaaagaccagatacatgttttataatatcacagacacatgcataggttgtccaattttttctaagtgaagttaaaaagtatttcaaccccaattgtcctattcttcccttacatcattccttcctatacttctgtctaatgtaattaagaagaacatcgaggggaaacaacttttacttgatcagagaattaactgaactattcacttcccaagtgttcaactgaaaggtagattattttatctcatcattttaggattccttttcttaactgatttgttgtttatattgagtaaagtacaccaatattaagtagtacatcttgaaaatgttttacatatttaaaggtaatagctattgtattttctattaccctatattaattttgtctgtttatgagccaaaaatagattgttgcagaaaatatgtactctttgtatcttatttctttctctgagtaaaatgctttttattttcatctattttctttcacacagcagtactttatcttcttttatattccactaaatgtatgaaatgtatgttgttttttcactgtcatgttgatggagatatgggatgattccagccaagggctgttacaaataaagttgatataagcattcttgtatatgtcttttggtgggcatgcatactgatagaagtggaattgctataggtagatgtatatttagctttaattgatactgccagactcttgcaaaatagttgaactggtttatattctcactgacaatgtatgagagttccaggtgctccacatttaatattgtcagtatttttaattttagccattctagtggatgtaagttggtatcatattgtggtttttaatttgcatattcttgatgactaatgatgtttgggacattttcataggcctcaactgtttgaatatctttttagtgaagatgttctttcgattttttgccctttgaaaaattggtttgttcatctttcttattgatttggaggagttctgtttttttttgagacggagtctcactctataacccaggctggagtgcagtggtgcaatcttggctcactgcaagctccgtctcccaggttcacaccattctcctgcctcagcctcccgagtagctgggactacaggtgcctgccaccaggcccggctaattttttgtatttttagtacagacgggttttcaccatgttagccaggatggtctcaatctcctgacatcatgatctgctcgccttggcctcccaaacagcagggattacaggcatgagccagcgtgcctggcatggaggaattctttttatattctgcttacaggtactttgtaatgtatgtgtacaggtactgtgtaatatgtttttccactctatggcttgcctattcactttattaataatgtcttttgatgtacaaaatttctttatttggatagagcccaatttataatttccttttttgtgtttagttctttgtgtttgtttgttgaaactttgcttacctgccaaatcacaaagatatttttctactcttctagatggttggtgttttagttctgtgtttagatctgtatccacctggtatttacttttaattatgatatgcaacagggaccaaggtttttatttccacacagttgctatagtaccagataaccagtgctatagtaccatttattgaaaagactatccttttctcccattgatttgcagtggtgactatatcataaaccatatacctgtgggtctccaggtctatttctgtagtttattatgctcgtttggtctattctgttatctttactcattatcaaactcctccagcttcttgtacatgtttaagattgtctttgttattgtacattatttccatttttaaataaatttggaatcagattgacaacctcctccccatgcctaccccccaaaataaatcttctggggttttgaatgctattgcattaaaaccgtggatgagtttaagtttgttggaaattgacatcttaacaatatatcaagttctgcagcctattaacatggaataacatctgcatttagttagttcatttctttcactaatgtgttctattttggaatagatgtattatgcatgtttcattagatttattcctaagtatttgtttttgatgctatgctaaatggtatttttatctcactataattgttattattatatgaaattcatggatatgaaatacaattaatttttgtatgttggcctagccagcaaccttactaatttcccttattagtcattgtttctttagtattgtttatgaccatgttatgtgtaaataatgatagttttattttttcttgccaatttttgtacattttatttcctttccttgctttattgcaatgcttcattccagtataatgtggaatgggtgataatagacatccttgtcttgtccccaccatcagaaatgcactcagtctatggtatcatgttattaattctctagtgaaaccatagtttgtatttagtaaaacaacaatgtacatttggctatttcaagcttaattgaatttctttggcctctacatgattcttccttgctgaaaaggataatttataacaaatatttcattacttataaagcaaacacttgcatttcagaatacctttgtatttcactttcaactctagaaaatatttgttaggaaagtataatttatgaactgttataatgctttagtttctattcatttatttgggatttaccatgtattgctttaaattttaagcaatttttatatgaattgcttctactctacactatgaacacaaattcaaagatagcctgtatttgtattaaatttctttgaatctcttaaggcaactagcataatgccttgtctcaataaatatatgtttattgctttagagaaaacaagtccattactattttcaaagttgaaattgcgttatatgtttaagctgccatttaaacagcactacattttgccataattttgctatagttaacattccaagtatattcaaagttgatttttatttttttcagaaaaaatgccttagtctgtttggtattgctacaaaagaacacctgagactgagtaatttgtaagaaaagaagtttgtttagctcacagttctgcaggctgagaagttcaacggcatgaccctggcttctggcaggggcttttattctgcatcataacatgacagagaaggtcaaagaggatgcagacatgtgtgaagaggggaaagtttgctaggcatcttagccctgtaacaacccactctggtggaaactacccatttcctcaagaactaatttagtttagtcttgcgagagtgagaacttactaccagaagaacaacaccaagccattcatgaaggatctgccctcataacccaaacacctcccaataggccctacctccacactggggatcaaatttcaatatgagttttgatgagaacaaaccaaccatattcaaagcattgcaaaaagttgaaaaagctctactaatgtgtaaccagacatgtgaacatatataactttgagacatagcacaacacttaaaagccttcagaatcataaaaaatgtatctatcaatcttaatattttattaactcaaattatttttacctggctgcatggacatacaacatttaccctaaatttaaaatagaatgcaaattaatattcattggtattattttcattaattgcacaacatagtgaaaataatgttaacatttttttcctttccttcttccttcttctcttttgctttttttcttacctgtaaattaactgagttgccagatatccatagttatcaatggcaatttggaggctctcagaggcagaagtggttggtgtttttctatttattgttctagatttgggtctgagcacttttataagtgaaactttccaggtattttgttgttgttgttgttgttatatcaggtcttaaactatacctttataaattcttagtcatatatactaaagggcatttaatctcacgactgttatttatgggctttaagtcctctatgcaaagggtaaaattgtccctgtgaatttcagaggtagacattaggtaaagagagagttttttgcttgacttattgcttaagtcagagcgttctctgaatcttctaactcttcatttaattcacttgaaagtatttattaatcaatgtgcctaatacatagatgggactgcttccagtgagtctgtcagtcatgttaccagagcctttatttcttcctctatgccaagcttaaaaaatcagatgatttattttacatgagccacacatgcaaatagacctgtaatgctgaaattttgatacttaaaggtaaatctagtatcagagagctctattaagtggtctagagtatattcaaattacaagacatgcaacttattctaaaatctaatgcaatctactaacagcaagggagagggaactattcagagtaaataggacattgtttatctgaaattttattgacacattaattgacaactccattttatatgacgtatacaatcaactggacctgtttaatgttagtccttagataaaaaataattgtagctcaagacctcataattgtatatatttttttcactgtacctggtacaatcatttcatgtatgaaatgaatgagtccacaatacctcaatatttgaacattttgttttaattcacttaatcattgaaccacagagtctgtgctaaatgctattatctctataactcaacaataaggagatttaacagactcaccatttaatgtgcacgggagcacagatttcaaaatttgtttcagcacaaccttttggattatcatatatttgtaccataaaataaatcatctgattttttactctactgagacggatgcatatgcaacatatttatgtgcatatattcagtgttggaaattaattcataatcatgtatatcaagtgatttggatatttacctgcaccccatctcagggaatcattagagcttgcatttggaacatttaactgattttagttatgtaatgtaattttacacacattaccttacatttcccttcaaattccttctgaatcacactgttctgatttcctggaaacgcagttcaagaaatggccaagagtagaaggatgttataagacattgagtttcgaagttttcctttaaaatacaaaaagtgaaaattccacaaaagtggaatgaaacttgatttatagtgccgcaaagaaaaatcctggaatgtgcaggaaaggaagtgaatgaacttgggaacagctgcaagtaagtatgatgaacgactctgcattgggctagcagttcatctgttccacttgcagctgcaggccaaagcgtcaccaggttttctgcagaaactcaacttggcattttaatggctgaggtgaacccactggtggccagctgctgggactgaaaatcagaagcagctccagtccttccagattgtgaggggaaaggttaaggagagggaagtggtgccttgtcccagacagacgcccattggtcctgagatttcaaaaacaccaggagagagaatgcctggcagtggagaaaccaacactcagccttctctggaagaaagaaaaggcttgaggcaggattctcaagcttcatttaattacgatcaaatagggactggcagaagagcgtagctgcagatttgcagtaactctccctaaaagaacatgagctgtgagagagtgaccttgcagccagcactgatttgacattcacctgtttccctgcttgcattggaataccgctgggttagtttggatcccaaacatagaaaagtaactcctagcaggaggcagaagagagcacttaacattatgcggccaagaggttacactggctgctgcctcttatcaatgggtctttcaggtcctttttgggagcaatcctgggcttcattgccctgcctaaactgtagtttccaagcagtttctcaggcagttcctgttacattctgtgatcctgcctaatacagtaatttgattccagttgaaaacttccattacatacatgtcttgaatcgggagagttagagccttatactttgttcctctgcaaaactgtaagagcatcactgctgtattaaagggaagtgagtggaaagttgcaaagtgagcctttgagttcaagaaaacagatgaaaatgagcccaagccttggaactacagttctaagttttgagtggtggacagagtgggaaaccacgtagcatgcaaaggggagcggaagggcagaggaaggaagcaaggctacagtgtttggctgtgttctaatgtgctctggcatggagttatcgtgagtggaactaatattacataacactatgtatattttggaagatggctgggaaatagcctttggagccaatggagatttattaaataaaaattacctcaagcttgatttttcatctttaccaagcaccatagtaaattggcatctctgagactcctgcgggagccagaaagctggaatcaaaaattcagaaacatgaaatcaagaaagaactgaaaatctgaatggaaagccagtcacaaaagaataagaagtaaaatattctttaattatgtattatctcctacagatcaaaaggaactttccaccatttcattgaacctgtgagtgaaaatgatcccaaaagtatagagaaaataaagaacagtaagcaaattaattcagtttatatactgtcttttaacctgtttagaaagaatttgagaattgtttgatcctgattatataaaaaagatatatctgtatctatgtctacgtatatattaatacatacaaataaaatttctagaaggaagagtacacaattaacagtggttacttctgaagaatgggaatgggatgttggaggagacagatctgtcacttttcattttatatttctctggtgagatcaagggagcatcttactttgtaaatattaaaaatgctgaaatatgtaggttaaaatgtaattaatctacattcctatttttcagaattaatctgacttaccatctggtcatttttgcttgcttacattttttcttttgcaaaactcattatgttgttttgctaaaaacaattaaaacaatgcatcaaactagtaagaaaaaaaaagtctcaaaccacagagaaagactcacaattaccattagatacataaaattctatgatatatttctttgtacatttctggatcaaataatggcaagatggatgaactgatggatagatggatatatagacatgcatcgatgtaggcagacagtaagatcatagtataattgatattttaatttaacagaaggttaaaactgaaattttgcttttagaggaactattgacctcaaataaatgttttattttcaccttaagacgtatctttttctaaaagatccaaagttaacttgaaaaacatggaagtcgatttttttttttttttttattttaacctatcaagctcaattgactccctctcataaaagtggaggcacagtggctcacgcctgtaatccccgcactctgggaggccgaggcgggcggatcacgaggtcaggagatcgagaccatcctggctaacaaggtgaaatcccgtctctagtaaaaaatacaaaaaattagccgggcctggtggcgggcgcctgtagtcccagctactcggggctgaggcaggagaatggcgtgaacccgggaggcggagcttgcagtgagccgagatcccgccgctgcattacggcctggccgagagagcgagactccgtctaaaaaaaaaaaaaaaaaaagtgaagatattgccacaggtctcaggtcctctttccctgcttcactttctattagttttatcagttaggtttacatttactaagtttagagcatatacaatctttttttctttttttttttttgagacggagtctcgctctgtcgcccaggctggagtgcagcggcaggatctcgactcactgcaagctccgcctaccagattcacgccattctcctgcctcagaccccggagtagccgggactacaggcgcctgtgcaatctctatggtaaccacatttcccagttgactactaccggtaataaaatcaaatggattcagtgctcacaactcttcagtctttgggctactttccattcttgaatttttagctgaattcatctctttggctggattttgtggtaaagtagttttttgcttattttttcccccaagaagggcttacatgggtctttttctatgaattattttcctacttgacaatatttacttgttacttttttactttcatcatgccttgggcgcatataatactctcccttcacattttctttccttgaatttgtggagaattttccattttattcttgcagtcaactttactgaaaacaaatctgaaataaaattaatgttattctaccgtataggcgattggctttttagtcccaagatgcctaaaaataagttacccttaacacataatagcttaacttagttaggtctagaaattgagggtttgttttgtaccacattttctagaaagagtgctccttcaacctaaagatttacttagctttttttcaggaaatttcttggattagatcttagaataaatatttattttcatttgttaaattctctacttcaggaatatctgttaacattgtgttggatttttttgtttaaagtattcacttttctctaattgcttttatctccttatctgttcatcttccttcactataattatcttaatccccatttctctgtatcagtaacttaattttcaattgcatccattgtttttctaatttatgtattagtttcataaggctattgttttgagttctttcccccttatatcggtactctcctttatcatctaattctgttattctattattttgtctttgaattttgttttagtgaacttacattcctctattatattacattatattagaattagtagttttgagtaggttggttcatgagtttgtgagtagggtagtttcaagtagggttgagtagtatttttatgtttcttgtgataattttgccaaacaatgaatatttctttttagtataaagatgtctcatggaatatttaggacatgtatatgctaaaatttatttgttgcttatatgaatttcaaattgagctgggtgtctctatttttatattttaatttgctaaatctgtatgttttttataaatttccttccttccctccttccttccttccttccttccttccttccttccttccttccttccttccttccctccctccctccctccctaatctaggaggattttatagttgccatagcgttttcttttctttttgctcatgcttgtgtgtccctaagatgccaagttaggtgggatatattgtaggtggcctcttgactctcttctcaccatactgtttgttttctttacttaatatacagtctgagaactgaatttactttcatggattatctgtttgtctgtaatctatgggaatactgggtgatgaaggcagggatctagtcttagatactctgcagccttttctctgtctcctaagatattttttctgtgcaatgggagaggggtttttgtccaatcccctgggaaatactataaatgaataatttctcaaatttgctgtgtattcttgaatcttcactctcttcaaagagacttaagccactatttcattccgggtaggagcagctaaactaaactaacagaaaagctacaaattacagtggcttaaaaaacaaaggacatttttcttgcttgggtaaagtttcatttatttttccctctatttcattgccatgacttttagggagcagtgacttctaaattgtggttcttaatcaactagagtttatagtttgtctaacattttaaaaatataatcagtttctttactactatttttatattactaattcattaattttcacccaaatctttaagaacatggctctcatggttagggaaagaaaattgcgcaaaggacttgtgtccataccgtttttttggcctcactattcctgaatgtggtttctttcttctaatgaccaaactttaggggactaggactgtgcatctcagaattaaactggtatttctgatatgtatggtttatggttcaatggaaaaatataagaatttttcaaataattttctgattgtaaggatgaatgtgacctaatgttaaaatggcaggacagaaatattaaagaactgaatgatggcatcagctcagccatttagtatttgattttggacttagtttcctcatctgtataataagagctttgcctatgtatttttccaagaccatttcagggttttgcattattttatttcatttggaattaacattcaggtcatcttatagtagtgtactgaataactgaatgttaaatgtcttgctaaaataaatattgggttggtgaagttgaagttttggaataatagctaaaattaataactatagattttaattaatgatttcattcactaactttcaaaagttagacattcaaaaactgcaagaagaatattttttcaagattataaattgctagattcttcctgcagtggaaaggggaacatgagatatttgcagtattaaatagatactcactttcaattgatacatttaataacatcactaaccttcctattcatagtgaaatgagtgatgaaaaagttttttagtaaatattttttactggaacagaaataattttgtagcaggattcataatttgtgtatactgatttaagaatatcattacttcctgaaagtggcattcatctctatgggtagtcattttaacaaggtttttgttaaaaccttccccttcattaacacactttaggaaagtgtcttctaagtcattctatcaaagtctgttgctttcaaatttgattaaagaaaacaaagtattatttgcgtacctcatttttctctaacacatttttctttgcatttctcatattctggattatgtggggatcaaatatgatttaaatgttatgcacaattttgtggtttttcctactaatgaaattttgagttgcaaagttaacattctgccattgttaatatattcttattataaaaagacaaaatttcaacacatttcatttaaagatctcaattggcttttacttgcaattccagaatcgggcagccattagaaccaaaacagttctgaggagctcccaggctgcaatgtggtgcgaaatgttttatggacagaaaatggaaatgaggtgcagaaattggaggtgagattcagagatagctgattggttacagctcagcctttgccttgtttgaacatggtttgaacagttgattgactgaagctaggctgctgtgattggctgatactttactatttgttacaaaggcaaattcctaatttaagctttcaaattgtttaagtactaagttaggttttactttgttacttaggactcatatcgaggtttctaaagcccacatctgatacgatttaacattacctatgtgaagaattactaagcagaaacattttgaaagcctcatgacctgaatcgtattaaatacttaacaattgaatttgtctcaataataattatgtttaaaattatgaatgctggtttgtaaaaaaaaaagccacaaattttaaaattctgatataatctaatatctggtattcagctttgtattatcattttaaaatttaatgaacatctctggactctaaatatttttctttttaaagttatataaaacattctctttatattcattataactattaaactatttgcctacttatttatattgaaagtccttaatatttttacaataatttaataggtttcacaatcatcattacttattatagtttatactgtttgaataataaatatatgtctatactatgactcattgatacatttcaaaatacagtgcacataagaagatcttcattctctagatctgtcatactacatatgtgaaagttaacatttgtagtggcagtgaatcctaggggcagccttgcatgttaatgttatgtggttgatttgagaggatggggatctgtgtaatcatatgatgacaatttgggtttgggaatctcagaaatgccatcagtataggaatatggctattctgctcttcctaggctaagaataaacttgaagacaaagagtagattttggccagacactgatgctaaagtcaccccgatgctgtctttgcttctaaggtataaattaccttattttaagcaactttttcaccttttcaactctatccctttcctcagcctctttcatatgtgaaataaaatattcacttactactgaggatgattttttttaaacctattaaagaatactccatagctacagaggggaccatatcctttagagactccgttggggatgatcatatgcagaattattcttgtccctttgcctctgcttaatccccttcacaaagtctgtggctcaaacaaatgagagttggcagtactaaaggaataagttcccagcatacgtctgccatgctttagcatcatttcagattagaagcatggagcaaaggcagggagacgggtcaaacaaaatgctgagagcttccctccttttaaaaaacaaaattctagtcagggaattatttttaaataaaatgcaagcccccaagacataaataaacagccagcatataatactaacaactcaatgaaagatacttccccaggtcaactcatctggtaggatcagttattttgtgttactgcattgcccctctagcgggatcatagaagaccctaaaggctacaagaagaactgctttctggctctcaagtcatttcagtggttccctgatggcagctgtctctttggggaggtggtgccgtggtctgtttggggttaggccatcagcacaggccccttgtgctagcatcacattgtcataagctttctgctaccatggctaccatccatcaccaggctctgtctccatgggcagcagcctctgtgcccaggccaccccaggacctcaggcccatctctctttccaaaggtaggtaggtggccttttcccattctttagtttttgactttgtataactgaagcttctcctgggatgatgcaggcagctgctgcacagtcactccagacttactcttcactttgttgttaggcccctgcagctcgctgcacgtgactggtgccatctgccctccccgcacgggcagctgcccctcccacactgcctatttccccctttctgctttttgtagccacatgtctaaagatggcaggccagtctctgtggtctattttatgggactttcatttataactaggcagcaacccacattagttatttatcctgatgatctccctcctcttgccccccatgacaggccccagtgtgtgttgttcccctccctgtgtccatgtgttcttattgttcagctcctacttataagtgagaacgtgtggtatttggttttctgttcctgcattagtttgctgaggataatggcttccagctccatccatgtccctgcaaaggacatgatctcattccttttaatggctgcatagtattccatggtgtatatgtagcacattttctttatccagcctatcattgatgggcatttgggtggattccatgtctttgctatcgtgactagtgctgcagtgaacatacacgtgcatgtatctttgtaataaaatgatttatatcttggggggtagatacccagtaatgggattgctgggtcaaatgatatttctggttttagatatcacaacaccatcttccacaatgattgaactggtttacattcccaccaacattgtaaaagcattcctatttctccccaacttgccagcacctgtcatttcttgactttttaataatctccattctaattggcatgagatagtatctcattgtggttttgatttgcatttctctagtgatcagtgaggttgaacttttttcatatgtttgttagctgcatgaatgtcttcttttttttttcttttattttcttttttttgagacaaagtctcacagtgtcgttcaggctggagtggtgcagtggcaccatcttagctcaccgcaatctccaccttccagcttcaagcaattctcctgcctcagcctccgaagtagctgggattataggcacctgccactatgcccagatacttttttcgtatttttagtagagatggggtttcaccatattagctaggctgatctcaagctcctgacctcaggtgatccacctgcctcagcctcccaaagtgctggggttacaggcatgagctgcctcactcagccatgaatatcttcttttgagaagtgtctgttcatgtcctttgcccacaattgtattgttagtttttttcttgtgaatgtgtttaagttccttgtagattctgggtgttagacctttgtcagatggatagattgaaaaaattttctcccactgtgtaggttacctgttcactctaatgaaaatttcttttgctgtgcagaagctctttagtttaattagatctcatttttaaatttctgcttttgttgcaactgctgttggcaattttgtcatgaaatctttgtgcccatgtcctaaatggtattgcctagattttctagggtttttatagttttggggtttacatgtaagtctttattccatcttgagttaatttttgtgtaaggtgtaaggaaggggtacagtttcaattttctgcatatggctagccagttcttccagcaccatttattaagtagggtatcctttccccattgcttgtttttgtcaggtttgtcaaagatcagatggttgtggatgtgcagtctattttttttttttttttttttggagacagagtctcgctcttctgcccaggctggagtgcagtggcaggatcttggctcactgcaagctccacctcccgggtttacaccattctcctgcctcagcctcccgagtagatgggactacaggcacccaccaccatgcctggagatgtgcagtcttatttctgagttctctattctgttccattggtctatgtgtctgtttttgtactagtaccatgctgttttggttacagtagctttgtaatatagtttgaagttgtatagcatgatgcctccaggtttgctctttttgcttaggatagtcttggctgtatgagctcttttgtagttttatataaattttaaagtagtttcttctaattctatgaagaatgtcaattgtattttaatggaaatagtattgaatctataaattactttgggtgttatggctattttcacagtattgattcttcctatccatgattatggaatgtttttccatttgtttgtgtcctctcttttttccttgaacattggtttgtagttgtccttgaagaggtccttcacttcccttgttagctgtattcctagatattttattatctttatagcaattgtgaataggagttcatattcattatttggctctctgcttgttattgttggtgtatagaatgcttgtgacttttgcacattgattttgtgtcctgagactttgctgaagttgcctatcagcttaagaagcttttgagctgagacaatggagttttccagatatagggtcatgtcatctacagacaaagacaatttgacttcctttcttcctatttgaatatcacttatttctttctctttgcctgattgctctggccataactttgaatactatgttgaataggagtgttgagagatggcttccttgtcttgtgttggttttcaaggggaatgattccagcttttgcctattcagtatgatattggctgtaggtttgttataaatggctcttattattttgaggtatgttccttcaaaacctagtttattgagagtttttaacatgaagggatgttgaattttattgaaggccttttctgcttctattgaaataatcatgtggtttttgtcattggttctgtttatgtgatgaattatgtttattgatttgcatatgttgaacaagccttgcataccaacaattaagccaactttatcatggtggataagctttttgatgtactgctggattcagtttgccagtattttattgaaaatttttgcatcaatgttcatcagggttattggcctgaagttttctttttttgctgttatctcttccgggtttggtatcaggatgatgctgccctcatgaaatgagttagggaggagtccctctttcaattgtttggaatagtttcagaagaaagtgtatcagtttctctttgtacctctgatagaattcagctgtagaccagtctattcctgggcattatttggttggtaggctatttattactgcctcaatttcagagcttgttattggtctactcaagaattcaacttcttactggttcagtcttgggagggtgtatgtatccaggaatttatgcatttcttctagattttctagtttatttgcatagaggtgttaatagtatcctctgatggttgtttgtatttctgtggggtcagtggtgatatccctttatcatttttcattgtgtctatttgattttctctcttttcttctttattagtctagctagtggtctatttttaattttttttttcaaaaaaacagctcctggattcattgactatttttaaaggttttttgtgtctttattgccttcagttctgctctgagcttggttatttcttgtcttctgctagctttgtggtttgtttactcttggttctctagatcctttagttgtggtgttaggatgtcaatttgagatttttctagcttttcaatgtgggcatttagtggtatacatttccctcttaacactgctttagctgtgtcccagatattctgatatgttgtctgtttgttctcactcatttcaaagaacttcttgatttctgccttaatttcattatctacccaggtgtcattcaggagcaggttgttcaatttcgatgtagttgtgtggttttgagtgagtttcttgagttctgatttgattgtgctgtggtctaagagactgtttgttgttatttcagttcttttgcatttgctgaggagtgatttactttcaattatttgatcatttttagagtaagtgacatgtggcaccgagaagaatgtatattctgttgttttggggtggagagttctatcgatatctatcaagtccacttgatccagagctgagttcaagttctgattatctttgttaattttctgtcttgatgatctgcctaatattgacagtggggtgttaaagtatccccacaattattgtgtgggagtctaagtctctttgtatgtctcaacttgctatatgaatcagggtgctcctgtattgggtgcataaatatttaggatagttaacttttcttgttgtccccttcaccattatgtaatgcctgcccttatttgtcttttttgatctttgttggtttaaagtctgttttgtcagaaactaggatttcaacccctgcttttttctgttttccacttgcttggtaaattttcctccatccctttattttgggtctctgtgcagctttacatgtgagatgggtctctttaatacagcacactgatgaatcttgactctttatccagctttccattcttttagttggggcatttagcccatttacatttaagggtaatattgttatgtgtgaatttgatcctgtcattatgatgctagctggttatttgcagacttttttgatgaagttgcttcatagtgtcattagtctgtgtactccactgtgtttttatagtggctggtaacaggttttcacttccatatttagtgcttccttcaggaactcttgcaaggcaggcctggtggtgacaaactccctcagcatttgcttatctgaaaaggattttatttctcctttacttatgaagcttagtttgaccagatatgacattgtaggttggaaattcttttcttcaagaatgttgactattgccccaatctcttctggctttttgggtttctgctgagaggtctgctgttagtctgatgggcttttcttcataagtgacctggcctttttctctggctacctttgacgtatttttcttcattttgacattgaagaatctaatgactatgtgtcttggggttgttcttctcatggagtatcttactggggttctctggatttcctgagtttaaatgttgccctttcttgctaggttggggaagttctcctgggtgataccctaaagtatattttccaacttgattctgttcttcctgtttctttcaggtaccccagtcagcggtaggttcagtcttttaacataatcccatagttcacagaggttttgttcattccttttcattcttttttctctaatcttggctgcctgctttatttcggcaagatagtcttcaagctctgatatcctttttttccacttggtctattcagttattgatactcgtggttgcattgtgaagttctcatgttatgttttttcagctccatcaggtcatttctgtcctctctgagctggtgattttggttaacagctcctgtaatattttatcatggttcttagcttctttgcaatggattaggacatacttctttagctcagtgaagtttgttattacccatcttctgaagcctacttctgtcaattcatccatctcagcctcagctcagttcagggcccttactggagatatgttatgatcatttgaaggagaagaggcactctggctttttgagttttcaatgtttttgcattgattctttctcatctgcatgggtttatttacctttgatctttgaggctgctgacctttggatgaggtttttatgggttctttttaattgatattgttgtcctggctttctgtttgtttttcttttagcagtcaggaccttcttacatagggctgcagccatttgctgggggtccacttcagaccctattcacctggggtcctcccacacctggaggaatcaccagtggaggctgcacaacagcaaagatggcagagtgctccttttccccaagaggagcaccaacctgatgctggccagagtgctcctgtatgaggtgtatggagacccctgttgggaagtctcaccgactcaggaggaacaggatcagggacccgcttaaataaacagcctggcttcctcttggcggagagggtgtcctgcactcaggagaatccgcctcatcagggctgccctgactctccagagctggcaggcagaaaagagtaagattgttgattcacgataccgcagccgcccctcctcctatgggctcctttcagggagatcagagttctgttcataaacccctggctagggatgctgaaaatcccacagggaggccccacgcaggtaggaggaatgggtcaaggttctgcttaaagaagcagtctggccaggaactgtccacagctgctgtgctgcgctgtggggaattgctcccgttccaaactgcccagtctcgctggcacctgcagcagggaaaaacggctgactggagcagcagtggtggtagccaccccttcccccaccgaactcggtcttcttaggctgtctccaacctgctacactggctgacagggattccaaagtgggtttcagtttgtagggttccaagggagcagggccgctgagcaaggccgcttggctccctagcttcagcccccttcccacaggagtggacggatctcctgcctccttagttttcccagagctagagtatgcaaaaactcttatgtctcagtgtctgcccaagtggtcgcccacctgagcagccgctgtgagcctgcacagctctgtgttttggacccaaggcccttggtggtgtgggctcacaagggcgtgggttgcagagatccatgggaaaagcgtgcttttcagagctgggtagcacaatacctcaccagcttcctcggctcagagagggagcaccttttgccgcacgcaggctccgggtgggccctcgctccaccctgcttttcctcactgtctgtgggttgcgccaaccatctagtcagtcccaattagagaacctgggtacctcaattgaagatgcagaatttacttgctctttttgttcttggtggaagctgcagactggagctgtttctatttggccatcttggctcaaggttcagtttgagtttctgttgcagacactgcaagaaacagaaccgaatgaacaagagatatgaaagtatgtatcatggcaataactgtttctgtttatttcttattttgttttattttgctttctaatagaattggaggaaataggaagtatttaaaaagtgtttaaatttaccatcaattattcctgtatagttctctatttttaaaaatatgcccccaagttttgaaattctgattcaatacggactttgaaaggatgtgaaatttgggagcacgtattgctgttactaagactgggggctgtgagagggcttggtgttcccccaagcagtcaggcttgcagagagaatttgtgtcctgctacggtcttttgtaaaggaagctagccccacctgttgttcaaattcattttgcttgcgtgaaagaggaatgctgtccctggaaacctctgtccaagtgcctgttttttctgttgtgggcagcattgcaaaagtgatctgtatcctctcagaaaaaggaaaaaaaaatcacatctaaaaatgttcaatgtcattacattgaacactgaccggacaagtaagctggaactgtatggttatattcacaaattctgggatgtttgttttggctttgtgttataattgcagctacgaaactaaaagtgaacaaattgctttctcatttaatttctttttatcatgtctaagtctcagtatttttatttgtagaattgtgttaataataatccacaggcttactatgaggaataaatcagatactgtacataaaacaaataggatatttgttgacatatagtattcattcaccagatgcttaatctttccttcctcttgtctatgttagcctgcgattgttattctagtgttggtctcaaataacttaaactgtcattagaattttgctttaattcatagggccaatagaggaggaggcaatggaaaaatcactaggtatgtttgcttagtctctcagatgctatagcacacaactctcagagacttggaaaaatggaaacacagagatgttgttttgtgttttgtttttgagcacagttcttatagtaaatgtgaatgtttactattatttctagggtttatgataaaagatggaaaagagaggctatactgatgaacgttgtcaacatgggggcttgtcagaaattaaacaaacttttaagaaagtaattgaatttaacaaacattattgagtaccttatctggcccaggcatggatcttaacctcaactcctcatcaagggtagaaagtagactcagtcaatgctaggcatggtggttcatgcctgttattccagtgcttttggaagccaaggcaggacgatcgcttgagaccaggagttcgagaccagcctgggccataaaccaagaccttatcgctacaaaatagaaaaaaaaaaaattagccggaaatggtggtgtgtgaatgtagtccaagctacttggggctgaggtgggaggattgcttgaaccgaagagtttgagcctgcagtgagccattatcacaccactgcactccagcctaggtgacagagccagatcctgtctcaaaaccagaaaacaacaaaacaaacagacaaaaaacagactctttctagtcatgactttattccagtgcttaccacctggtccttgccctcagagttcacaataaagggattctggtctgggaagaaagcaactttaaagaatttctatcatcattctcataataccaataaactccaaaaaagagcctaaagattttcaaatgaccttccttagaagttctagatcctagttgattacctgagcaaccatttgcctatgtgtatttcaatttaaattgtcataaacagctactcaaggaattgattaatctgaattcaaaaataacttttatttagtgaaagtcaaagcacattattgtgttttaaaaagtcaaatgttgccaactcatgacttagttaagcctggaatatgaatgtgcaattgaagcagacattggctgtatgcacaatgcctgctgtttttcttgctgttagtcattatatgttatgtcctttgtcaggttggaaacaaaagattaatttcatttggtaggcttttaaaaatgtgtttgtctggttgtgtgtgtgtgtgtatatgtatatatgcatatatacacatatatacacgtatgtatgtatatatatgtatgtatatatgtatatatgtatatacacacacacatatataaatttagttctgaaatttaggcatatatatatatatatatatatatatgaaatttaggcgcatatatatatatatatatgcgcctaaatttcagcactaaatattaaagtttaggcttaaagtaccaagatatttttttcagagatggattattttagcactaaaattcttctgagccttcagtattgctgagctttatttaggaaatactcagtgatagaagatgaatgcaaaaaaaattgattaaaaaccggagccttaaaaattgaattcccttcttactgttgatgttcttatattattttggtatctacataaatgattatttgaaaaaatttctgacatctgatgatgtgtaacatgccaaattaatttccgaatgttaaaaatcattttacttatggataacttcattatgtagaagctgactatctaatttgtaattatttttatagaaaaatggcaagtagaagcttatcatgggtgaagttaacaacaaaaggctaaaatttatttgtctctcttcagtctttttctcttcagtcaaagacaacttacacacaacaagatttctccttcttaattactacatttattatggtatttaccctgttcaaaaagccttagtgaggttccagctttgaataagatagagtaaacatactgtgccctgtctgtcctactgaatacaactatcaaacctggacaaaacacatgaattatattttcaaggactctgaaaagtgaattgtagcagacggactgagaaagaccagacctgaaaataaaacaaaaccaggcgtgagtttaccatgtttatcctctggaggaacccagctttgacttgggaagctcagaagtagacatcaacacaggcaggaagagcttcacctggcagtgacggtgacagcagctgagggtccccaggtttctaaagctctcaggacgagaaagtaggtcccaagataaggagcctaaagggcttttttctttctgtgtattccttcttggcctccaacatgggtacagtcacaagagcatgtaacagagaagaaggaatagacctaccattttctagataaagaattggaaagaggatccacaggtaaccaaaaagtaccagggaaatggcagagaaggaaaacctcaggagaccaacctcataagtggtatttattagtgcctgggctcaaatccaaattgtacatgaatatgtctggtcctagatagggtaccgaagactttgaaagtgaattttggtatatcattgcccagattccagactggctattgtgtgacacaacatacaggatatatctgaatagtgctcagaagagtttgaaaatgcaaatgatattaaaataaagatgaaaaagagaaagctggtcagaacttgtggacataacccttctggatctgttgcctgattaaaaaatagttgatattctcgaatgaattaaaacaagatttagagactgagcatggtagctcattcttgtaatccaagcactttgggagggcaaggcaagagaattgcttgcggccaggagtttgagaccagcttggccaacagtgagaccaggttgctaggaaaaagaaaaaataaaaaaataaaaagctgggcatagtggcatgtgcctgtagtcacagctacttgggaggcttaggcaggaggattacttgagctgaggatgtcgaggctgcagtgagcacatcactgcactccagcttgggtgatagagcaagacctaaaaattaaaaaaaacaaaaaacaagacttagagtctcataatattcagtaagtctagcatataatgaaaaattgctcagcatatgaagaactaggaaaatttcaacttgcatgggaaatccaacctacattaacactgagatgacagatcttggaattacctgactgactctaaagcagctgttattaaaatgttccaatgagtaagggcaaatctctttatatgaattgaaaggaagaaggtctcaacaaagaaataaaagaaatacagacattttatggtaactttagaactaaaaaacacaataactcaattaaaaaaaaactcattggaaggctccatgaaagtgacagaggaagaattggtgaatttgaagatagattgatagaaattatttcatatgaacaacacagagaaacatgatttcaaaaaaaatgaacatagcttcaggaagctgaaggacaacataaaaaggtctgatatgtatggctttgaaaatccagaaaggtagaaagagtgcagtgtgtgtgtgtgtgtgtgtgtgtgtgtatgaacatgtacacaaacgtatataaacacccttatgtttgaagaaataatggctgaaacatcccaaattagccaaatcacataaacctacagattcaaggacctcagaaaactcaaaataaacacaaataaatccatgcccaaagacatcataatgaaactgctgaaaactaaagacaaagagaaaccttgaaaaaagcctgaaaaaaaatgatatgttccttgtggagaaaaatctatttaaataacttcaaatttcttgtcaaatttcacagaagctaaaaagaaatcaaccaacattttttaaatgctggaggaaaagaactgtcaagtaaaaatattatatccaacaaaaacctcctcaggaattaaggcaaaataaagacattctcagattaaaaacaaaataagacaaaacaaaacaaaacaaaaacccaaagataccctctaaaaagtttgctgaagaaattcttcacacacaagaaaataaactgaagagcaagtttcatgaaagaacagcagaaatggtaactatataaataaatatagtacatatcatccttttcttgagttatttaaaacacttgagagtcaaaagcaaaaatatgacattggctgatacagtttttatccagtatgcatatttaatttaaatatctactataatataaaaggacctatatgatggtagtaggattcctgcattctacttgaaaaagtaaagtattgattctaaatataacatgaaaattaagcatgtatatagcaatccctggagcaaccaccaaaatttttttttgtatacacaaagagatacagtaaaaaacctgatatacttcggtggaatgctaaaaataatccaataacacaaaataagacagaaaagctaaaacagaggaataaaaatcagaaacaaccagcagaaaacaaataatgaaatggtagacttaaatccaagcatatctatacttgcattaaatgtaaatggtctaaagggccaatttaaaggctaatgattaccagaataaataaagaaaaatgtatgatgcagcaatatgctatgtacaaaaaatcactttaaaataatgacaaaggtatgcccaaagtaaaaaggtgggaactataaaccatgcaaacattaaataaaacaatactcaggttgctatatcaatattagacaaaatagacttcaaagcaaggaaaatgactgggaataaagatgacattaaataataataaaaagaacaatttactaagaagacataacaaccttaactatgtctgtagcaaacagcatagcatcaaaatacgtgaagtagaaactaacaaaaatgaaaggacaaacagaaatattcacaattatactttgaagattcaacagtactttctagaaaattgacagaactagtaaacagaaaatatgccttgatatagaaaagctgaaggaaaaaaccaactgactgaatatagttgatgtttttctcactctactccaaaacaatagaataggcattcttttcaagtgcacgtggaataatattacatttatgaagatagacctcattctaaataataaaacaaatttatggcaagttcatggaattgaagtcacacaaaatatgttttttgtccatagtgtaattaaattagaaataaatgacagatgccaggggaaaaaaattccgaacagtttgaaattcaacaatacacttctaaatactctacagtcaaagaagaagtgtcaaaaaaaaataaattatttcaaactgcatagaaatgaaagtacagcatatcaaatttgtggaatgtctgcaaagcaatgtttggaataaaatttattatgtaaaatgctcatgttatgagaaaataagttctcaaatcaataatataagcagccaccttaagaacttacataaagaaaagcaaaaaaaaaaaaaaaaaacacacacacacaaagcaatcagaagtaaaaataataaagagcatacatcaataaaactgaaatcagaaaaacagtagaacaaattaatgaaaccaacaggtggttcttgaaagagattaatcaaattgatgaacctcttgcaagactgacaggaacaaagataaaacacacaatatcagaaatggaagaatcaccactactgacaccatagcattaaaagcataagaaggttatgtgtttatttatgtataatagcaataaataattagcaagcacaacttaattagtaatttcacttaaaatagctttcagaatgtgaagcacttagacataaacctaacaaaacatgtacaagatatgtatgctaaaaactacaaaccctcatgaaaaaatcatagatgacctaaatgaatggagacatgtaccttgttcatggattaaaacactaaacttgttaagcatgttaattctactgagttgatctatagatttaatgcaactccagtcaaaatcacagtagaatattttgtagatatagacaagctagtgctaaaattcatatgaaaaggcaaaggaactagaacagccaaagcacttcttgaaagaaatggagaaattatgtgctcaattttaagaattattaaaaagcttcagtaatcaagagtctggtatcagagacgagatcagtgggtcccatagatcaatgggacataaatagacctgcataaatatgccaactcatctttaataaagatgcaaaagcaacttactgcagaaagggtaatgttctaacaaatagtaatggaacaataggaaacaattggtatacagaagaaaatgcaacctaatcctcacatattatgcaaaaagaagctcaaaatggatcgtagatttaaatgtaaaacacaaaattataaaatgtttagaagaaaatcttcatgacctagagttagggagtgagtttgggcatatctaagaagaaaatatatgtatatatttgataatttaaattggactttatacaaatttaaaacttttgctctgtaaaagacactataagagagtgaaaagataagctatagacagaaataaaatcttttcaaatttcatattcttcaaggggtttgcattcaagatatatttgaaaactcttaaaaatcaatggcaaaaatacaaagaacacgatttaaaagtgggcaaaagtcttgaacagattgtcgaccaaagtagatatggggaaggtaatcaaacagaactatgtgcaacatcattagcttaacttagggaaatgcaactaaaatgataatgccatagcactagaatgataattataaaaagaaaacaaaacgaaagaccctttcactaccaactgctggtaaggatgtggagcaactagacttcttatacgttgattatagggatacaaaatggcaaagctgcttgaaaaatgggttggcaatttctcagaaaggtgaacaaatgcttatcatatgacccatacatgccattccttagtatttatgctagcaaactttaaatttatgttcacaaaaaaccatatgtgaatatttatagtagctttgttcatatttgtcaaaaattgacaatcatcaaaatgccattcaacaggtgaatagaaaaacaaactgtggtatctgactacttcttgtcaattaaaaggaatgaattattgatttgtgcaacaacttggatgaatttcaaaggcattatacagaatgaaagaagtcaacctcaaaaagtttacctaccatatcatatagaatttcaacaaggcagagttatggtggaacgaaatcagtgagtgccaggggttggggtgggggaaaagtgtgactacaaggagatagcatgggaggttttgggggaactgatggagctgttccacatcttgattctcatggtgattatataaatctatgcatgtgatataattcataaaactatgatttatatgactataaattaattttaaaaataaaactagaagaaaaaagtcttcccaatgcttgactattgcttttagattatcctctaaactccatagcaggcaatgaatggcttccattctctggctacactcattttcccaacgtatttttttgcccagcattgttgtgaatctgttctcagtgtctcactcactttagtttttctctattccctaaagatccgagttataatatacaacctcaccaatgctgattatttgagaccagcagcatatctggagctggttaactgacagatgtgattggttggaactttacctaattcacccaaggcacatttggttttcaaagacttgaaaagggatcaatgttctcatctgtgaggttttaagacttttgtaggcgaggatgaatttcattctactgacaacctgaacgttttttcatgatttcaatacccctataaaaagataaaggcagctgggaatacttactctagaagaaatatggttgaaaggagaatataaaccattcacataaatggtaaataagtatttgtcatcttaactaaggatacaaaaaaaaggaagtgtgcatcaattataccatgatggattaattgtgctgtatggaaaaatttcctattaaggaaatttgtttaccttcctgaaaagtgtggctgaggttggtcacagagttgttctctagatctctttaaggatagattcctttttattttttaattgacaaaataaattttatttacttactgtgtacaacattgatgttttcaaatatatatacattatgaaatgactaaattttatcaaattaacatatgtattacattagatagttaccatttttgtggtgagaacactttacatttactcttttttttttaagaatacaatgtatcattaatgatagtcaccatggtacaataaatatctgtaatttattcctcctatctaactgaaattatgtatcctttaaccgacatcttcctaacacctccaatcagttcaatccaccattctgttctctcctatgagatcagcttttttagattctgagtatgagtgagatcatgcaatatttgtctttctgtgcctggattatttcacttaatacaatgtcctccaggctcatccatcttaattgcaaatgagaggatttccttctttattacagttgaatagtattttattttgtatatgtaacacatttcctttatccattcatccactgatggacactgaggttaatgtcatatcttgactattgtgaatggtgctgcagtaaacacggtaaacacggaagtgtaaaatatctctttgaaatacttatttcatatatatgtatgtatatatatgtatacatacatgtacatatatattcatacatatatgtatgtatatacatatgtacatgtatgtatgtatgaatatacatatatgcatgtatacatatatatgtatgaatatatatacatgtacatgaatatgaatatatgtacatgcatatgtacacatatatacatacatatatatatatatatatatatatatatatatatatatagtggtgggattgctggatcatatggtagttctgtttttaattttctgagaaaccttcacgctgttttccataatggttacactaatttccattcccaccagcaatgcacaagagtcccctttcctccacatcctcactagcacttgttatgttttgtctttttggtaaaagccattctaataggtgtgaggtgatatcgcattgtgacgttaatttgcgtttatccagtgattagtgatgttgagcatttttcatatgcccgatggccacttgtatgtctttttttgagaagtgtctattcagatattttgcccgttttttaatcgggttgttttgttgctgttgagttgtttgagttccttatatattttggatatgaaccccttatcaaatgtatattttacaaatatgttttcccataggatagatttttaaccgtttgggatggtttaagggaggccaaatggaaagcctaaaaaaagagcattctgtggctccatggtggattctggcatacttttttcaggatgctcttttccaggtcaatatttaaagaacttgaagaccgcaaagcttctgctcttgagatgagaaggagcttctcctccactaatgatctgaatttaacactggatcacttaaagccaggttcatttgcaaaatatttgctcagctttgatgctataaaagcctctccaaagctaaggaaaccctgagaaatggattattcatgtgactctgcagagcttggtatcaggcattgcttgtatttaatctttccctaagcattaacattctaagcttatgaaaaatttgtgacgtatgctaaatatattccatccagttatgatcagagtccagtcacctgagtgtaagatttctgccctttcagtgagaattgagagccctggtgaaggcagatagaaaagcccagaaacacttgttgttttatttatttttcattgagcctctggctaatttttgataaggtgtcacagatttaatcagttttagtttaaatagaagattgagaaatactatcttcttttcattaccattagaaagaaaccttaaagcttaattttgactgcatgaaatgatatctaacagcaaatatttgtaattggtgtattccagatacttgtagtgtaggaaatacaatattgttttctttaaaaggaaattgggtgtgtataaaacatcagaggaaacaaatttaaggcaagattctgaatgacagttctgtattctacaaacctttgctaatgaaagggaagatgatgattttcaatgtaggtcatggcctgaagtggagaatttctgaaattgtcattgcagaccctccaatcagcctgatctgtctctgcaacactcctgatgagctctgagccttctcagtgctatgagtatttacatcaggcagaggtgggttgggatccaaagcttacccaccctaatatgagtaagatgattctattacattcatcctagagagaatatccttcatagaaatagaggaagaaaaagcttgcatttggttaggaatatagattatgaagagcctccttatcctgaaagctgagataatatctgtatcatatgtggtaacaaaaaataaggttatttgtataaagaagttagcatataggaaggtatatagtaaagtgcttcataatggcaggaaggaaagaaatattgaaggaaaaatttaaaagacattgcgtcagttggtatctgtttttggcaagtaaacaaacaaaatatattttctcttttctgccagtagataggttaggaagcagctggaaggtaacatcgtgtctgacttctaggatatcacaccttcaatgagttattgttttattgttccttgggagcttccactgaacgtggtgttctgtcacttctgaaactctggggatttcttttcatgatagaaaattgacaactagtatttttttaatcatagaaggtaagaattgtgcttattgaccaaacatgtgatcaaaagtggttagaaagtctttagcaggtgtaccataaatgcctgccaccttcccatttccacacctccacagacagcttcttgtgaataccccctccacacatacccaaccatacatagtgttctctctgctaagaagaaaactgtatacagaccacatgacctcacctcactttcattctcctccgtacccaaagctgagactatggtggccagtcatttgtaagctgtctaggcacctttgacatggcattgtttgaaaagataagaggttatctttggggaatttggtatgaaggaacaaagcaatgagcagtgaagatgaaagtttatgtgacagaggctgagatagccatcatggggaatgatttaagctgaaattgtgggaaagtagaaagtatgactatgaataagtgtaatgtataacataaagacagatgatttataacacagagaaaatattacagatcagaaaatgaaaaagccaaaggggagagataagagagtggaatcgatttctgcgtaggtagagagtttaatataaagtagaatatggaatccttccatgttctccctcataaaattcacagaaacctcacgacttaccaaagatgccaagaggagcaggagatgctcttgtgtttcacccaaatatttgtttctcattttttttaatgaatgtgtgtattttctagaatgaatataaaggaatgcctcattcgtttatgtatttaaaatacgtcttgactaccaataatgtataacaacctctgctagactcaatgctaggtccagtgcatgcacttggaatccagggacccaacttggaagggctcacagtcttatgttaggagacagataaggaagcatatttatggggcacatgtgagattttgttacatgcatagaatgtgtagtgattaagtcagggtatttgagatgtccactactttgactatctgtcatttctatgtgttacatgctgtgatactgataaagacagggtatgtaaatgtgggagctcaaaggagggacatctaactccaacagtttgccagttgtggggaagaaagggtaaggaagtttcctcaaataattacatctgagcagaattatggcatgccagcaacctcagccaggtgaagggcaaagagaaacatttgcatgagagcctccagggaggtagagaatgcagtgttcaggaactacaacaacaacaacaacaacaaatcaagtattcctgggccacaagatgtgagagggggaatgatgggagatttgctggagggcagggggattcaaataaaagaccagcacacatgagctggtttgtgacctactacatagttttgacttgatccttacaacatagtattttaagttaaagagagagaagttcatatttgcagcggggaggtggataagtggttgttgagacattaaaatagtagagtttactggacttggaagacttagcactggacttggtaacttagtaccttgatttctggcatctcagtgagttgaggccacatgacaagtaggaggaagagcagttattatcaagagaatgcaaatgactgaaatgttgagttggggtttctatgggatatactggtagatagcagagtcagtagtaagatacaaataggtctgagacacaggagagaatctcaaaagggatattaagcttccatctctgtaagagccatatggttgggtagttggtttgctttgtgctatacaactatttgaagttctttacattttctttcctcctgttttttttttttttttttttttgaaacaagatcttgctctgttacccaggctggagtccagtggtgtgatcatagctcactgcagcctcaaactcctaggctcaagcgatcctcccacctcagccaactgagtagctgggactacaggcatgtgccaccatgccccattaattttttatttgtattttttttaaagacaggggtctcacggtgctggccagactggtctcaaactcctggcctcaagttatcctcccacctctacgttttcaaatctaaaaaaatagtttaggacgtattcaccttagagatttaagagtttatattttagcaagctgtaaagtccagaaatcaaattgtgagtgggcaaacaaaatcaaagcaagtttcatctcatttagaaatgtggaagaatgagaacccttagtttaccttgcttttgtgcatgcagagtgctagctgtaatgggttagcacaaaaagacaaaatcctaaatcacagtcactttgccataatttttaatagttatgttctctcatagttctatggatgacatgctcattatagacagtctgaaactgaggagaaccagggttcttcctacatgtttatgttgaatgtggagaaggtgaggttactgcttctgctgcccttttcagctcaacatttgatctggccaatgtggttagctatactgtgtctcctaccaccacacatactcagaaaactgtggtagtaaacatagaatgaacttccttaaaagtagaaaaccattcattggctaaggtacataagaataagaatgaatgatgaaaacattggtagaaatgctgatggaagaactgattgatgcagatctattttggagaccccttaactgccaggggacatgaattgcctggctggttgaattgactctagaaatgatgctctgtggccgctaagtctccatatttgaccaaaaggtgtgtgagggctgtgtccatttcatcacttgccatgagtcctcagggctagtcagaataccaggccgatacacgcttcacaagcatgtattgaatgagtgaatgagaaaatgaatacaataatattttcactagtagccatggattgaggataaaattaataagaagagcccccaggaagtccggattgagctttatgctctgggacactcttctgctcagctttgtggaataatttgcagcactagaaatggacttaacaaccaggatgagggggtcatgttttggggatcaaacctcttttcatcatgaaagctactgggtggcctctgacatgatgtgtttagttatcaaacatgtcagctaataccatggagagaacacatgtattaaaagtgacagacataacaagggtcaaagattaaaggtgaattgcaaagggctttttactgcatctctgttgttataacagtttctagagtaggttgaatacatgagcaaaaagaatgatgaggagtcatggtgagcagaagctctcttctcaggcaaagcaggaatttttttccccacattgagctaaatattctttaaatgctataaatgttactacatatctgtgctgtttgtgggacagcacaaacatatttgaaacattcagcagttctttctcattaacttccatttttctaattttcattggttatattttcctgattacagaagtagtattggctcattatcaaaaataaatgaatgaaaaaatatagacagttaaaatgtgatataatgtaatggcctaaatatgacattgttaactgtacattcctgcagttacaattgaagatggcattttatcccttaatcagatacaaagaactgttagaaaacttcctttttgcccaccactgcattgtatactgtggtatatatggaaattcccaatacagacatggaaatgataaataaacacaaggggaactctcacggcataactctgtgtctagcaggctaagataataccatgttgtgcagtggtggtaattagagcacatcacgtgactctgagtttttgagggcagtggtcaatatctttatctttgtatccccaagggtgttggctaaaatgttcagttagcactttgaatgagggaatgcttattgagtaaaaagtcaattacatgtgacaataaatgcagtaagaattagtcaagagaaagacaagtgtggcctgcagtcaccaacagaagctttaagctccaaggatacccaaatgcgtatgttaatcatgtgttattgttaaagcatttagatgatgatgtttggaagttgtgtgcaaaaccaggaaaaatttgaccaagttttggaagttcctttctgtttgatttatctgctgttatggtgttagggctattgctgttttatagatcagttctacactgtagtaattaactgggtaatgaagacaaaaagtatttagaaacactctgacatatcaagaaattagtgtcaccaacccagaggcttctctgtctcttcagcataatcttccatctcaggtatacctaaacttgggtgtttactgcctcaaaagcaagcatttcccttgaaaagcagatttctttctttctttttttttttttttttttttttttttttttttttttttttttgagatgagtctcgctctgtcacccaggctggagtgcagtggcacaatcttggctcactgcaacctctgcctcccgggttcaagcaattctcctgcctcaacctcccgagttgctgggtctacaggcatatgccaccatgcctggctaatttttttgtatttttagtagagacggggtttcagtatattggccaggctggtctcaaactcctgacctcaggtgatccgcctgccttggcctcccaaagtgctgggattacagagagaagctccagcttttgcactagctgaatgttgttatacttcctcaaacatttgaggataaagacataatatgtgatagttttaggtgactttttgtgtgtaacatttgagctctgaggataataatatatctttctatataacacatttcaatatctatttaatgtgccagttgcaagaattttctgattgacattgatcattttcattcagaattaagtcatttccttctgggaattaatataatagatttattatatgcttatgggccttgtctaagctctcttctccacactgtttcttcaaatgtaattccattgaaaatctagctgctgttttagagattacagtaaggcaaagcatttctcagaagacaaatatagaacctaaagttactataatgacatttggcaaattatataatctgagttcattttttttctcttctctccctcctcccttgtcacaaagcctataggaaggtatactacatattttgacacttttttttttttttgctttcaatagctgtgttcttactcaccactttaaaataacgtctttcttatatcttttaactcagaggtatactcagagactggaagacttgaacggggactggctacccagatagagcccccttggtggtgttttccttggtgatatgatactgggccgtattccctcaggattgcagggtgagaactgtgtctttgctagcagactaggtaggagaggatccattcctcagaatcaggttcatgttaacatagttcacatattgtattaaatacaaaccagaatgccaagttttttatttacaatgagcaatatagctgttaaataggctatggcactcaagtcaacaacaattcacagactcctctccccatagagaagcaacatggggatccaaattgtaatcagaatgccaagttatcaatttataatgagaaatgcatctgtctgacgagaatgttgagttggcctgataaattcattgtctccctgtagattagtgacaggggatgccaaattttcggaaagttgcgagagaatatggctttaaaacaatgggaaggagttgatcttaatttctgtcttccaattaagatggttttaacattcccacctctacctggctggccttgccgagaaaacaatactgctttagtcaaacaatactgctttagtcgctgtgaccagtgtgggcaataaaatgtttattttctgcctttcctttttctttgcttttctcaaccaactacctctctccaaaaatgtgtatgacataattgattgggcttttgtctgtcatagtattgattcatcgagcctcaatcatatttcagccttccagccctagaattactcccatattattttttactggtgtctgggctatgttcatatgtgccaatcaaacatgtatagtttactgacctaacctcacatttgtttaatcatatcctttatttttaaattctgtaaatcaactcactgcagtccttggcactgaaaatacctctatttcttcactacatttcctgaagtggcaaaaatgccaagattatatgagacccagggggaaatatagtgttctctgcccctagtgtttaatgcaaattgaaactaaaataaggcttgctttgaaaaagtacaaaaataaattttaaaaaatgctaaaagctggattcttctcttttggagatggcaaagagatagtaaagttgataaagagatgatttgggaaatgcaggtactttttagcattagtgagtagactcatttctaacatctcctggaagtatttgtgaattggctccagaatcttttgctatcacctaccctacaattaactagggatatgcaatcaccaaatacagtttctgggacaccttcaaagatgtcagcttcttcaccataaagatggcaaaaagtagaataattacattctatctttgacctttgatgagaaatgatcagtttctttttctaatccaatatggcaagcacttctaattcgtgtgaatagatctctttatagacatagtgtgtttatatttaaatactaagataatctggaattctgaagctacaactgtataatgacattatacttggtcagctattgcttttcttttcccatttatttattttgcattgagtcctacactggtgaaaggcctggtgcgttgcattgagttctgcatgtttgaacttcacaaaggttcaaaggtgtgcacatggcctggaacgataaacatttgtcctaaagtcattcttcagcttctgacatagcttgtgatttaattgccacctcattaatatgggccactgggtgtgaatttgtcaaaacaagatacatcaggagagctgagtgaaatgtttcatgttcagaggtttttaccactcctgttccccactgcccatgttttgtaaacttttaacttcaagagactggtttaataaacatgccctgtcttctaggtcattgggttaaggatcatttcagtctttttgaacttttcacttttcctgtgtaagtataagctaagtacttattgggttctaaagctaaaagcctatgaagataaagggccttattgaaatagtgaagtgagcaaaatatctttatggttcctgaccttgtcctcctgggctttgtccttcttttaatgaatgacaccttaccctcaggttcccagtatttacacctttgtagtgtttttgcaattcagaaaaatgtatttgatagatgagtagggtgactgtcgtttacaataatctattttctatctcaaaatagctaaaagagaatagtttgaatgtttctagcattaacaaaagacaaacatttaaggtgatacatattccaattataccgacttgatctttacaagttatacaaatgtattaattcaccacgtgtagcccaaaaatatgtacaactattaagtatcaatttaaatttttttaaaaggacacagtgaaggaccatacttaaacttgattatttaattgctcatcatgaaattttatagggaaagaagaagaaaatcttcaataactcaaactcataagtaaagggacatacatggctgtatataaaggctatttataaagccctctatataaaagttatacatagcctataaaataaataaggatctgactttatattggtacctggcacaacacatgcattgcacacaggaaccactccataattacaattaaaattattatacacacaaatacatatttacttcttatcaaggtatcacatgttaatgctcacatgaagcagtatcaaaataccgccaatgagttgtagaagtctcttgctctattttcctcagtggcattctcactccctagtgaagtgtttttaattatttttatttttttatttttttactggctattttagactttctggtagagcactcaataatttctggatctgtcagagttaggcaatccactctgcaattggcaagatggggattttgctcatttatacttgactctccttcttctattaatcttctccttctatttatataactgtaacatagctgcaagctttaagtaaaacacgtaaagtcattttcttgttctgatgacttgcaatattttctctttattccccacgagatgaaatgaggatcttggtcccatacgctttccccaacttcttctcactcatttcaggccctacttctgtcaatcactctttctgtgtttagattgttgatatttgcacgttctgctaaaaatacaatcatctttgcccaaaggttaactttaaaagtagaacaataaacagtattaacattattatggccacataaaaatcatttaatgttaggtaaaaagtatgttaggattacatttttttaagagaccaatgtcatgacctctaactcactgaaaagaaaagattcctagcatttgagttcaaataaatgtttttttccttatatttagtcaattgcttaaaattaagctgcatttcttttatgtattctattttcctgcatcatatcttcatatatatttttttactctctatcatattatctagtctatttggtctgctttcccccactccaaatatatcccccttctagagtcgtctttctccctactccacactggacttacaactcctagacatcgtgctgcatcgctaatgtcctaagtttggtgttattggtgctatcaatcttcttggttagatctgatattttggtagcttcctattttttgaattatcctcttgttttattataatacatcctaaagtaacttcctaagagaaagcacacaggaggtaaatgttctgtttcttgcatactctcatatttgtgtgaccctttggccgacgatagaattctaggttgaaaagagttttcctttcgaaatttgaaagctctgctccattgttgttgatgagaagtcaagtactagttttattcctcctgtttccctttaaaaacttttaggagcatctcattattttaggtatttacatgttttcgatgacatacttgagaatcctttttgcacttattacaatatacactcaaggaaacttcttggtttatagattaatgtcttccattgagctatgggaaactttatttctatcttttctttaatatgttctcgcctccattttctctcttctctttctctgacttttaatatctggatgttagatcttccagacttatcctttctcatgacttctgtctttatactttagtcaaattagtgagagtccctttactgtgtttactccctctacttttctattttgtttattccaacaactgtgtttttagtttctaagtagtctttcttgctctctattttaattgtccttaccttctgtttttattttttggttataatagtttctccaatttgtgtaagtttattagagtatcttttgtctttgttcatttatttcttacactattcctgttttcatcttgcctgtcttagtctttatccataatattgccagatctcctaatatatttattattcttgctggtctatttgtatttaagggaaacaaaaatggcagactgcttttttttttatctaatagaactatttacacttaaaatctttatccttagtgagaactgtgggaatagaggaaacagagggaggggcaggtgatccaatatattaaagaggtgaaatttggcatcaatgagcctccaccataaaagaatgtgaaaattgctattcccagatgccaacatctaactaaagccttgcttttctactgggaattagttcaatttttttagagaagaacaaacaataatttttgttttgctttgttttggtttttggtttggggggttgcatgattattattttcttggatgattattattatttgcttgtaattgttcctgctgtttgtttcccaatatctcaaacggagatatttggctgcacaggagaacaacatatgtagctgtttcatacatggagcttacattgggttttgttttcagtcatatcttttatttctacccttggactccctgaagtttttgttattctttttatttctgccaaatctcccaccaatttcgtagtcaccttatagcatattttagactctggttttctgcctgttacgttttaaaatggagcagtaaacacaattatgaccacataactaagttaaaattgagtcaaaaagtgtgctaagattaggttttagatttttttttactttcagggaccaatgttgtgaacttcccatcacctatcttcatcttcatcccaaaatagcacaccctttcttggttattatgtacttcttttgtgttctgctaaactattatatactatacttatgctttcaaaataattcatttatatataattaagttttgtgtaaatatttaacatataaatatttagtagaatctctgaaaggagtgaaggcaaaaactttcctgacccataataattacatacctagagcatcacaaaatctattatcaatgaatggattctgaattctttgataacatgtctttaatttttaggatttaaagtacctcctttaaagcaccagaccagtagtcaattattatgatactcacctctgatattgtcttatccctgagtgtgtaataaacttctggtccctggaatttctcttccctcataaaactgtttctcaatgtatcattttgtgatgacttttttttctgagcttcctttacctacccaataggtacacattttttcccaagatgctacaacaataccagacaattccagatattcccgccttccacttgtgatctgtaaaatatatatactggttggttatgtgcaatgttttatgccctatgccctttcactggtgatgttttaaagcaagcattgtagatgaccatgaattatagcagacaggttcccagtcctatgctgtttcctaatgtacattttttctcttgtcacaactaggaaagtcacgtttcagtgttttggttttggtgaatgcccacaacaaggctagtgaaggaaggaggcatagtaggaagctgttggccagacgagcttttagaagacccttgctacatagagaggacgtagaaaatgtctttatcattaggtgagaaacatgaactgcattctttgttgcgtcatattaaaatgtaaatcacaagaataaattataaaaataaaacctaaccaaaacacaaacaggaggaggtaacagaggacagaacagagttcctagaaaattatattacaggacagacatacaagtacccaagagaaagcaaaattctaaaagtctcttagccaagtgtagagcacaaaagttctcctcagttcatgcactttcgaggcatgtcagttggaaaaagagcatgctataggagacagttttattgtgttttgtgcagtgaccttttaaaagggaaaggtcctttctgagatattttgagttcactcatgcatctgtcatagaatttgcttggaacgaagtgtgcctgtcaccccaacctttcttcagagcagagcctgcttcctcatgggaagaatgatgttttaagagtgtcattcagatggaacagaaagaggtcttctccaggtttgtcttgctactgaatcaataggatctcctggattttgaaaagtatattaaattttttttcagacgtcagagttggggggaactagttttgtttagctttatacaaatttctagcattacttgtacggatatgctggagattctgctgcctcttgcaatctgacagcctcatggagagttgaataaatggtcattgcctgggtaagtgagggctctttctaaagtgttcaagagtaggtcacatagagaggagtgccttcttcctgcattttttcaagtacctgttttcccctattttattcttttggaagggattgattttatggtagtccctttcttttctcacctcttgacagaatgtttttctaaatgattccttcagattattctttaggtcccattaaaagaaacatgctggttcttcattctcattctgtctttatgcttaatgcagatataattcatatttgttttatcaaagtcatttgataacctcttcaatgacaaatccctgattacagatgtattctcttttggtaacccacaggggttgaaattgctctaatttttggtactgtgtattaggttgagattaaaaaaaactttgaggacaatcttttccttatttaatatctggagaaaaaatactacatgtgagaaaggtggaaaaaggatgttgcactgtatgtaataaaagctatgaattttggcacttttgtaaactgtaaagatgtaaatgttccttaattattttcagtagtcagacttatgtttcttccagttgtatttccaggctgagacaatacaaaagatggacagctctaagttgattatcaagctttaaatatgtttcacttgattaagaacattgaaggtgagaatggaattatgtaggcttcactgagtatccgtaaagttgggaacaatgatatacaacacagaaaagaagctccataagaaaacagctgcaactaacccatctggaaagagacctcaatcaaaatgatacttagcgaaagaaaaatactttcagtgatcaaattatttgtctgaccaatgcttggtggaaagattccacattactagttatttgtaatgggtaattgcacaatatactgtattgttcaatctggtgtgaatgaaagtggggagatcttgacaattgtcttggaacaatagatgtaaaattgagactattctgggaaaaccaggatgtttgggccccctggtaatagtctaatcattatacatctgtgctataagcacacaaataacatctagtaatgaaagaaacattcagctaagaaaacttgcagtcaaaaacttttgataaagctgtgaagacttgttaggtcatgtattaatttaagatctttaagatggagagcatcccatcaatgattaggagaaacacaaacattttatattgtgtttaatacacttttttatgtttaataaaaaacatatcacctaccctacaactcataattaacttatataaagttttttttgtttaataaacatttcatattgtgtttaataaaacgcaaacattttattacttacaggtcctgggtgggggcagtacgtggcatgcctggagatgacacacaaggagatcaggaagtgtgggcagggagaatgtggacctgggtcacttgtatttattggagtccagggtgagaaacctaagtgtcatgggacgaggggagcaattgggcagtttaaaacaagcaggcacaaaatttcaaacaacccaacattaaaaaccctttctggcaaagaaatgttatctagaaatctagctgacccaaaggctgagtgtgtgggtttggggtaagagctatcttgcctcaccagagcaacaaaaaggagaagtcatcggctaagctagatagccaaacaaaatggatgctgaggcaacattaaattataagaattataaggtcaagatgggatggagattctggacctggtacaaggaagtgctgcaatgaatagcagggagttagggcagactacttccagtgtcctgagttttcaggtttcatttggctgtcaaaaccatttgttccctagactgtgatttgactggtgatgctggctggcagtgcccctactgatgacttagcagatgactctgagctgacaatttgccatccttcagctgtcttggtaggagggattcagttaccagcatgcacagcacagagcagaatccaacctcatagattttcaaaaacttatcgctaaagtctattattaacagcttggtaagaaaagtctttttcattgagaaatgtatagattattgtgaaggaaaagtatttgctaagaccagactggccgaagctaatccttttgggaatagccttaccaatttgggggaaatgactcatttacttataagctatacctgtcagcttccctttactacctttgacagctcttaaaccagcagtataagaactgctagtgaaaaaataaacattagtataaaactttatgtacctattacataacagtcatatattaggtgtccattttaagtacagatactgaaatagcaaaataatttattggagaaactcaaaatgctatagaaaaatttgacttggaaagcaccacaaatgtacatgatacaagtaaacttgaagaaaccaattacattgggggatagtcttgttttctgttattctgtggacttgctttattaatatatggaatttagagtttcttatatttaaaaaatatgaaaatgcacataatcattcccaggctgctcctgatcctttagtgatgattcctacagaaaaaaaaaaagtgcttgggatggggaagaactttgtggccatcgattttttctttctttctttattatttttatttttttattatactttaagttttagggtacatgtgcacaacgtgcaggtttgttacatatgtatacatgtgccatgttggtgtgctgcacccattaactcatcatttaacattaggtatatctcctaatgctatcccttccccctcccaccaccccacaacaggccccagtgtgtgatgttccgcttcccgtgtccatgtgttctcattgttcaattcccacctatgagtgagaacatgtggtgtttggttttttgtccttgtgatagtttgctgagaatgatggtttccagcttcatccatatccctacaaaggacatggctgcatagtattccatggtgtatatatgccacattttcttaatccagtctatcattgttggacatttggcttggttccaagtctttgctattgtgaatagtgccactataaacatacctgtgcatgggtctttatagcagcatgatttataatcctttgggtatatacccagtaatgggattgctgggtcaaatggtatttctagttctagatccctgaggaatcgccaccctgacttccacaatggttgaactagtttacagtcccaccaacagtgcaaaagtgttcctatttctccacatcctctctggcacctgttgtttactgactttttaatgatcaccattctaattggtgtgagacggtatctcattgtggttttgatttgcatttctctgatggccagtgatgatgagcattttttcatgtttcttttggccgcataaatgtcttcttttgagaagtgtctgttcctatcctttgcccactttttgatggggttgtttgtttttttcttgtaaatttgtttgagttcattgtagattctggatattatccctttgtcagatgaatagattgcaaaaattttctcccattctgtaggttgcctgttcattctgatggtagtttcttttgctgtgcagaagctctttagtttaattagatcccatttgtcaattttggcctttgttgccattgcttctggtgttttagacatgaagtccttgtccatgcctatgtcctgaatggtattgcctaggttttcttctagggttttaatggttttaggtctaacatttaagtctttaatccatgttgaattaatttttgtataagatgtaaggaagggatccagtttcagctttttacatatggctagccagttttcccagcaccatttattaaatagggaatcctttccccattttcttgtttttctcaggtttgtcaaagatcagatagttgtagatatgcagcattatttctgagggctctgttctgttccattggtctatatctctgttttggtaccagtaccatgctgttttggttactgtagccttgtagtatagtttgaagtcaggtagcatgatgcctccagctttgttcttctggcttagtgttgacttggcaatgaggactcttttttggttccataggaactttaaagtagttttttccaattctatgaagaaaggcattggtagcttgatggggatggcattgaatctgtaaattaccttgggcagtatggccattttcatgatattgattcttcctatccatgagcatggaatgttcttccatttgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttgtctgttatgggtggataagaatgcttgtgatttttgctcatcgattttgtatcctgagactttgctgaagttgcctattagcttaaggagagtttgggctgagacgatggggttttctaaatatacaatcatatcatctccaaacagggacaatttgacttcctcttttcctaattgaataccctttatttccttctcctgtctgattgccctggccagaacttccaacactatgttgaataggagtggtgagagagggcatccctgtcttgtgccagttttcaaagggaatgcttccagtttttgcccattcagtatgatattggccgtggatttgtcatagacagcgcttattattttgaggtacgtcccatcaatacctaatttattgagagtttttagcatgaagcgttgttgaagtttgtcaaaggccttttctgcatctactgagataatcatgtggtttttgtctttggttctgtttatatgctggattacatttattgatttttgtatgttgaaccagccttgcatcccagggatgaagcccacttgatcacggtggataagctttttgatgtgctactggatttggtttgccagtattttatggccgtcaatttttgaccctgagagtgaacctcacctttggaagttactaccaagcatttgacttttggaagactctttacacagcaagagatctcctccacctttgaggtgaggacattaaacttggtttaaaaaattacttttccaagtacattaactatgtcttatatattatccatacacgattactaagaaaatataaacattttttcatatactggttaattggctttaaagaaaaaaatcccctttttaatcccatcaggatttagtttgacaaatttttcagaaacttataaagatgaaaacacctggatgtatttctctgtaaactttggctgttagcatcctttttcaatgcttgtgtagtttttcagaacagaacctaaccttcaagatgagtcatttgttcccaaacttgaattgtcatgaaacactccttgggtttccctcccgtgctgaatatgatttctaagaatgggatggcatggttactgtataaagatcatttgttctacaggtcagaaggcctgagttctcatcattaattaactttgtgatgtatgttgggtaaatcacttaacctctacagttttatcttctgtaaaatatgaaagaaagactttgagctaaagtttgtttctactgtaagaacatgagatattttatcttggtgacatcatggcttatgggcaggctgaggtgggattagtaattgcaaaagcagtggtcataaggtgaagaaacctggacatgacttcagacttaacctgggaaataaaatcagggaatgtggacaaagtcagacactactttagcacaggatgagatgccagaagatgatggatccaacaaagacatgcatgaaaggccacggggctgtttctgggcttaaacaagctagtcttaattaggagaaaaagcggagggactggaggagtggaggagaggaagtcaatagtgatgcagtacttccatcctagagggtttcttcgagagccaagagttccaatctgtgcatggcattaccccttctgaggtaaaagaaaaagtcctctacaaaaacctgacagtattctgccctcaagccccttgttaaccaggccaaggtgaggcatgggtttcatgccctactgatagcagtgcaagatgtcttgttatgagtattgatatcgaagtatgcttttaaatcatatttcactctgacaccgttagctacgtaactaagtcttagtgctattgccagtggtccaatctaaatgatgtagtagagaatctagttcattactctgagctgggactctgatgaagatgtagggtgacacactgtctttgtgaagaaggcatgtgtggaatacttggtgtctttggtgagatggcagaacttaaaccgtgaggaggatggcaatcatgaggaatggtatcaggaagtttttccagcttgatagatgggaaggaaagcagaatggcaggaagggggccaggtgctatctccttgaaggagggatgaaccgtcctcagggtctgtctgctcacaggcaggagacttataccagaactgtgtttactggaagtcttttagagttcaaagtgaacttatctgagtttgacaaataatcccctacagcaagacaaagagtagtagatgaattatacatttggatactgttggaaagggagaggtaaaatccaagttggaataaagcatatgttatgggagatcatcaatatcattgagcacgggctttgaggattagagttatgatgaagtataatagtacagaatcagcttgagacacagtcttatgtttgttttggtcatctgcctagaagtaaggtgcagaaaatgcttatactttgaaaagtcgtgaattaaatagaactttctagcaatggttgatgaactgggtgggtgtcaaaaatcaagacttcatgattgggaagctgtggggatggggaattttcttagaaaagagagagactctaaatggtgctagtggggtggcctaagccctgacagtggaatgggacctttttggaagactgcacctcggggtaaggatgcttgtgaccctgagactagcatcaacccatgatagaacccaagggtgcagaaacctatgatagaaagcaagggtaccaaaaccttgagggtgttggcagactgaggggcactcagttcacccagggacatccttcacctgagaatgacttttctagatctccctgcagtggttttgagaacctgagtcctagttgagccttctgtgatgccttccaagtcctagcagtgtggcgtgcccacacatctttctcaacaaaggatgcagaaataggaatgtaattagagcagttcatcctcggtagagagtcctttgtggttcccagctgggcagtagtttaaaggatagccctgtgaatctactcaaatagtatctttatttaagatgtcaataaaaggtagtaaacttgagaatctctgagaagcattgatccatagtggaaattacatgtatttaagtatgaaggtagtaaatatatattaacaacacattatatgccagatactgtcctgggtatgagctatagctggaagtcagagcggtacaaaatctaccatgggggagtttaagaccaagttttcaagccaaacggaactggattctactaatttccagactgatgccttggagaggttacttgaatttttctgaatgtccattttctcatatattaaatgaccattataaccttgctctgtaagactgcttgttagatgatataatatctttcaaatatctgttaaagtgcctaataatagcataatagctactcaataagtagccataattgttttaacaaatgaaatttagactcctaggaaaattagaaagtactgcactggctttcctgttttcctaatggccatgattatttatccagtgactcagtgcagattttgatttattttccttttcatagccaccttatcaaaaagtcctgctactgttatttctacttcaaaatgcatctcaaatctattcacctctctctgttcccatctgtatcaccctagtccaagctctcttactccctagagcaatagccggtaaccatgtgcttacaacacattctctgcaaaggcagcagagtgtattttttacagcatatatcagaccataagggcctcttgcttataaaggaccagtggatttttattgcatttactatccaaatctgaagttgccatcataaccagacttctctcattctcttccatgtcttctggtatcacattcctgcactaacctctacaccctgcgtcctcccacctcacctcagcttcaccgtgttctcagtttccagcacgcaccaagctctgtgccacttcgaggcctcacacctgccgatctctctgcctatgattctcttctctatgctctttgctgaaccacctccttcttatccttctgccctcagccttacctcaaccagcccatcattctctcagcctccaccgtagcacttctcatgactggtgcttgcttatttacatgttttctcttgcgcattggccaccacaaaggtaaattcttatctgttgtgtgttcaccttggaatttcccatccttaactcgataggaggctcttattaaatatctttgtaaataaatgatatttttatgatagataattgcagattacatgattgttcagttgttaactctgtgcagtcgtagagtattctggttttaaagattagcacttggtttatatgtgaatgaactttcaaaattagacacgatcttctcagttttcttgtcaaagactgtttctaaagatttgcatgagctagtctggtcctggctatcttcctatcagggatgcattcctgtattggtagattctgtagattaactttctaaatcattcatggcccttccttctgcgccgttaactaggaagtataaagtactttagaacatttcattattagtattcccaatatgaccgtggaaatgtgggcagtgggatgaggcaatcaaactgaggttttctttcatgataactatttttgaaaactacctgcagtgagaaagaattctcaagcaggtgcagtggtgtttgagagaagcataaatggagtggttgagcccagaccttggagtcaaataaacctaggtttgcatctcagctctgttgcttacaagctatgtatttaaactctctgatctccaaagtggttttggtgattcaattagatcattcatacaatgagagtcttaacaaatggtaagcatttttaacttttagaaaaacacaaggcagttagtagacgaagtgtatgaggacattgctagcttaatataaggttctttaagggtaaaataaagagaaagggaagaaaggcagagttctttcttttttaacttcttaaaccttttcttatgaaaagatatgccacataaccataattcatcctggcaattaggtaaacagtatacagaatatgactctcgccattaaataaacttaagcaaggtatctttatcctgaaggaattcttagagatttcatcatgagtaagcacttttcagtatagaattgccaaaatacaaaagaacaccagagaaccactctaacttctaaaaaaaataagaaacccaaaaccttgtgattgaaaaaaaaaaaaaaagtaagaaaaagaggcccttagtcattctgttcccttttgggcctctatctttcatttcctctggggaaataaagttataaactgtgctggcagtaatctagggtgatgccaagtcagttacccacccccaactccatgtctccaaaagattctttaccaccctttgactctaattaaagaaaacaaatgtttccagttttctgtcatgtacctttccactctgaattatagaatagctttcttgaaattcttttaattgttttttacaaaggattagcattaaattcatagataaaaataaattagtaatagtgatcaaaatgacctaactccactttgtttttacttttcttctgggtaggagggcaaataacataactgcttatatggtgatttattttaaattgaatctgaatttctatttcttaaggcctcattggcttcatggcaaataagagagttttaaagaatttattgtgttaatttctgagaaaccaggagtttactgttgacaataatggcacaaattacaactcctacacagctctaccccctccacttttgagtttcaagacttttgccaaagttttctggtctttgttcacttctattattaacatctcttgtgtgaaggggaattttgaatgaatgggatgaaatcatctaaaccagcttcggtcctaaatatagtgtctggcatcaggtctgggaaaaaaaaaattggtcaaagagatagcctgaggttatttttaggaagttggatgtttagggaaattgatactatgaaagttctggcctctatctctgaagatattccattgagagatacatgcatgcattcaacatctcgtttttttccattcctgccctttgggtgttccgcgtcattcactatcttgtcattacagcattaagcagaagcttgaggcagaagatagctaatgcaacgtttccatttggtcctgtaatttttctgcacagagctttataggatttcatttcgggttaataaggggaagttggaaccgaggagaaagcttatgctctgccaacatatactgaggattactaaacttggaggtagaaaatagaacacaggaataaaaatggaaaagtcctggcagatttctccgtagcagacttcatccttaaaaagcagaattccatccagctcttcttggtggcataattccttatcatggaattataagataaatgctctgtttttatgcgtctctcttttctaaagttgaattgagtgtctgaaagacagatgatgtgtctaataccaccgttgttttacagaagggaaatctaagaaaactatagctaccctcctgggaaaacatatctaggcatttgctaacagtcatttaggctgcatctatgcacttccacacagaaggataaatgtcacatgttcgttgaatgatccagatgtttcaaatatacagttgttttatatttggtaaacaatgcagttaggtcatgtaaattttaatttttcatttggagtttatccctatgcaggcaatcatagattagaaagttatttttttcatgtcctacctctttgaattgtcaggttcttttaaatgctgttatgtagcaataaataatattttatccataatcaaggtggatgacttactggatatcagatattattattaacaaaaagtttactacattgtacaagtatcactagacaaagacaacctctagaaagttaattaaggtaactaaggttctcaactgcaaccacaaaactttcacagttaataataatttcacagttattaacataactttttcaagaggtactatactaaaccaaggatgctaaatataacttattaatttctgtgatggcttctggggatatcaatattggtatactttcctcactgcaatgaagacacttctgcatctacttttgagatttttttggtcatctttctagcagccagctgtcacctcttgctgctgtaacagttcctagtaatagttcccttattcttcaaacctgatgttagcagggaggtcagatactcaagcatgattagaattgtagaagcttgagcctcatatttaaatgtgtgtaaatatatgtttgaaaaagaattaatgagctcttaattgcagatcaaaggatatggtttgatagtgaagtggcccaatgaaagttgtttgaattttccttttgtctttctgtaaatggaactgtgttcttgaaagcctctacgtctttatcttgttcctcaagattcttagggcagtgcgtgtgggtcaggggtaggtgtgtctgggaattaagagtatctagttgatttagtagctatatttctcttctttagcctgtttattgggaaatgaaagacaatttaggctatttcattttcagtcagtgtctgttatgaattcattggaaatagcaatgtgaaaagaggaatgaatattgtagatttctttcattgtcatatttgtaaattactgggtgggatttataaacaaattattgactaattatgaacaaactgttgtttttttcttttcaatcaatatgaacaatcaagtgacctaacaaatttaattttaaaaatagatttgaaaggtatatagtagttaaaacaaggccccttgattcagattgcctgagttcatatctcaaataggctacttttttgtggtgtgcctttaggcaggatgcctcagtttcctcatatgtaaaaaagaaatgttaatagcagcttaccttgtggggttgttgtgagtgggtcaaatgacctactatgtgtaacgcactagagcagtgcttggctggagtaagctccatgtaaatgttagtccttgaatgaaagtagagctctggtagagatattccataaagacaaccttaaacatttttgaaccttttatgcctccaaaatatacacttccaaactcttctatcactgaccatattacttataccctaacaaggaagttattaagaatcataccagagtacaggaataaatcatgccagtcaggaaaaggggtacattggttattctatttataacattacttgagtatttataacaacaagtaaacaaaacgttttttagaaaaagaagagattactgtgttgtacaaatattactagatgggtaatttctctcctttttttccaatgtattccagaacccccatggatatcaaaattaaatgctcaaatcccttacataaaatggcatagtatctgtatactttaagcagattacttataatacctaatataatgtgaatgctatgtaaatagttgccatactgcatttttaaaattaatattattttttaatattttaacctttttttttttttttttttttttttttttttttttttttgagacggagtctcgctctgtcacccaggctggagtgcattggtgcaatctcagctcactgcaacctccacctcccaggttcaagcaattctacctgcctcagcccccaagtagctgggattgcaggcacaggccaccacacccacctaatttttgtgttcatagtagagacggggtttcgccgtcttggccaggctggtctcaaactcttgacctcaagtgatccgcccaccttggcctcccagagtgctgggattacaggcatgaaccaccgcgctcggccacatgtttttaacttttatttttccaatatttttgatctatgattggttgaatttgtggaagccaaacccacagacatggagagccagctgtgtattgttattgtcatgtcttttattctcccctgttcttttctgcctaaatgccttaggtacttctttacagagttagatagcatttaccattgataccacccagagtggtgtggtttgcttctcctgaccctttcatgagcaaagctggtttcaggggaaactcagggatctgaactgttagtaacactgattagaaatgcagcagttttattcaggccttggttttattgaccatttttggttggctcttatctctgtgactgatcatgtatgcgtatttcaaatggataaataaactaaaaagtgtttaatactccaaaatgattagaagtgtattgttaaataccaaaaagaaaataattctggggtgtttcagcatgttattctgttaacatagttcacgttgagtgtttgtattcatttgttgtttgtttgtttgtaagtaacaggttttgactaaaattccacggactgtggaacagcacacactggggtctatcggagggtggaaagtgggtggagggagtgggtcaggaaaaataactaatgtatactaggcttaatacctgggtgataagatagtctttacaacaaacccccatgacacaagtttacctatataacaaacctgccattgtacacctgaacttaagtaaaaaaaaaaaaaattaagtcatgtagatgcgtactttgaggtacaaccacgtgaatgattgtgccaaattattatgacagaaaagtctattgttgatttagaaaaagaattaacactgggcatcatttgaataatgggctttataaagaactgcacatattggttactggtagtaaaattcacagaatgttagatataaaaagtcctaaagggtacaaggaaaacttggtttgtcctaggtcaactagtaagattaatctacaacccaggcttctgactctatttcaacattcttctcataatgtcattgaggttacacttaataaacaacgttaaacactctctcttttaaaaaaaattgttggctatacatgttggctcacgcctgtaatcccagcactttgggaggctgaggcaggtggatcaccagagttcaggagttcgagaccagcctggccaacatggtgaaaccccgtctctactaaaactacaaaaattagctgggcatggttgcaagtgcctataatcccagctacttgggatactgaggcaggagaatcgctggaacccgggaggcagaggttgcagtgagctgaaatcgcacattgccctccagcctgggcgacaagagcaaaacttcatcccctcccccccaaaaaattgttaactactacaagcataaatatgaatatctacttacctgcatttctgaagctagaccataagtattaacagtgcttatatctacagtccctggcagatagtcggtgtaagaaatatagattaattgaatgaatcatatgatcatggttaaggttcttcttttgtgcgttttagcatttttaaatttttacattgatcatgtattgcttttgaaattttaaaaaacctggcaaaatgtaattacgatagaaactgacatcaaaaagctttgtagctgaaatagtgtaattttacactgagtttgaaacttctgatatcaggaactttgatgagcctaatacaggtgctatacgggatgaagtgaatatgcttagaatttttgatgaaaacaaatctgactactcaggtttctctatgagaagggtaggcagtttgatttgtaattatgggaagctgaatgtgaggcttggatgaggctttgtcagtatcagaccagctccttcctattgggggctgaattcccttgggctctccatcagagagaccaacaggaagcaatcatgtagttcttccaacacactcagaagtcagtaggtccactccacaaataaattgtaattggccatatagtaaaatatttggtagtgttattcttgtccttttccatatgtacaagagagaaaaataaaacaacttcacatcctcctaagcaagtgatcgagtttagatatttgtcccctccaaatctcatgttgaaatgcgacctcctcatgttggaggtggggcctcactggaggtgattgggtcataggttccctcccagtggtaatgagtgagttcttactctgttagttcatgcaagaattgatggtttaaaagagtctggtgattctctcccctctctcctgcctgtgctctcaccatgtgacatgtctattcctccttcaccttccagcatgattgcaagcttcctgagttcctgaccagaagcagatgctggcaccacactttgtgtatagcctttagaaccatgagccaaatcaaccacttttctttatgaattattcagtcccaggtattcctttatagcaacacaaaacaggcaaataccggagcaacagatcagaataaataacgctgagaggacctgacctgatttgctataggtattgttctagggtagcccctggtatccattgaagactctgaccgtgagctctgcctgcattaatataactggaccaaaggaaacagaactttagttttatgaatgggtgtctctccaaacaatttttcctggctgagctttgttcattaacatttttcaatttctaaagaacaaataatctccatttctctttttatgtccggcccactctcctgatagatataacctccctcctgtttagttccatgaattgtactccagctgcccaaacctgagaaaaggaattaatgactcattctctctgttgagtgagggcttattccagctggctcgcgctattctgtgtgtatggattctgtcagcagggttgaaataagatgttaactggcagttattcattaatttacagcaagaacaatgacttgactctatgtcaaccatttctgaaacattttgactaacatttttcctgttgcttagaactgaacttaaaagctgggacaggcatatggaaagaagcaaggatccccagttatgctgattggaactaggactaatggttttaacacagaatgtttatgcatgtagaatgaaatacacacacacacacacacacacacacacacacatacacgcacatacaaggggtcatactttatgtttgcattttcctctaaaagtatccctaagagtatttgtggttagtactacatttttttcatcatagtttgtttaaaagataaagcagatattataattattttctttacaggtgggaatgagttaaacaataattaactgaacaaaagcaatgtccaggtactgcaaaactttacataaattactcctattcattttcacagcaaccctctgaagtaaatggtattatcccaacttacagatgtggaaactaatactaattaacttacctagaatcgaggtggcagagccaagacacgaattcaagtttctcttcctcaaatttaacattctttcttgtacaaatgtaaatgttctttaaaaatgaatacataatggcaggattcatatcaattttctgccagaattaccatgtttacctgaagtaaaatatgctcataaacaaagcagaaagtgcagctggtgcttacatctaggatgattaactggcatgtacagaatttttttttccttcaattgcaaagtgaatgcagtaaaattacagggcaatgggtttcttcccacacaagacaaggtgatctgaatgatatagaagagaaatgccacatgtggaaataatatatcaaggatttattatgtgtctgtggtcattcttaaggtcatttttgatgtctacacatttcagcatttgagaagttgtatattacatgcatacaaacccatattcaaatatacaattggctaaacaagtatttgttttaataaagtagtagtaataaaatatttatagcaaaggggacaagactcaggactgagaggaaaaactcaattaaaaaaaagacaacaatacttaaatctcttgatgcatctacttagcaatgtctacaatagcttttttaacactatcagaatatagagcataaattataatgtttatcctgcttttaaaggaaaatttttctcttatgcaatcatggtgggagaaaagaattcttaacgtgattatttgtctcatattttattttaggattctgttagtgtttttaggattctatcaatgcaaggtgtaagaacatgtcctggcagttgaaggaaaggctaaggaaaaagatgaaagagaagtgtcgcatcccttaccctccttttaaagaaatgctgaagttgctgagcagaaggtgccacagtcatgtcccttaatttatccctcaaccttttccagaagtaaagtgactacacctaagctcagacagtgacagtcgtgggagaaaagctttatagaaacagtgataggaataaaagtgtgtgcactgggatagatgtattttttaattacagaagtaactactaatctatataagagaggctccttccactctcagagcttccaacttaaccatctgtgaagagtaggtccttcaaaaccaactgtagcggcaaagttctgagatgatatttccagactcagcagataggaacaggcatgctaggtgagatatggcagggaatattagtcagggttctccagagggacagaaccaatttgtgtgtgtgcgtgtgtgtgtgtgtgtgtgtgtgtgtgtgtgtgtgtgtgtgtgtgacagagacagacagaaagagagtgctttagtttaaggaattggctcacaattatggagactggcaaatctaaaatcttcaggctgggttggcagtctagagactcaggaaaagctgatgttgcagtttaagttcataagatttctgttgtcagaattctctcttgtttggggagaggtcagtcttttgttctattcagatcttcaaccgattgaatcagccccactcaccttatggaggacaatttgcttgactcgaagttcattgatttaaatgtaaatcttgtctgaaaacaccctcctagaaatattcagaataacgtttgacaaaatatccagggaccagggaccatggcccagccaagttgacacactgaactgaccattacaagtctagttggcacccatatacatctccttaagccattcttaatctccaaatgtggtcacattctgaggaactggtggttagagcttcaacatatgcattttgaggagatacagtgtagtccacatcatggaggtagccctagaatttttttgtttccattcctattggcagagacaattgaggaaaagggaaagttccctttcatttattttactctcctgcacatctaatctttaaggagagaatagaatgagagttggggcacaaaacaaggattgaagggcagctgacttgagtccacgtagccccagaacaaagcaaaggaacattagattagtggggtagtagagattaaagaagtaaacagaattgaaactggcagaagatagggtcattgtagagtggaaaaacatatctgaaacatggttgttaagtcataagctaatatttggaaagacagactccacttacttttttccaatagatatatatttactaaaatcttgggaaagctaagcttatgatcaggtgtaaccaggccatatcccttgggtcccaaagtcaataagcagggagagcttggtgtttaagtccttaggaatgggtcatgccactcagaaaagagaagagatgtttcgatctgtggattgttatcatctgcaacccaggaggctctttgattcttcatatcacgttatttttacctgaggattgtagataccctacagtcttaaagcctctggccaatctgccttggaaccacaggatacattaggcaaggtctggggctggctttgacaaaggacacagtattgctggcagaagaaatcactcttaaagggaatatagatgctactgtgagagactgatcaactaattaagatcttgttgaagattctcaaattgagtttgagcttgttgacaaaaaccaggcttaggcagagggatgatgatcctgagagcatcctatctccatcaataggagtatgttttcaacctagtggtttttttttttaatttttattttaggttccagggtacatatgcagatttgttatataggtaaactaatgtcataggggtttgtaatacaggttacttcatcacccagggattaagcctgttacccaataggtattttttctgatcctctccctcctcctaccctccaccctccaccctcaagtaggccccagtgtctctttttcacctctatgtgtccatgagttttcatcctttagctcccgcttattagtgagaacatgtagtatttggttttctgttcatgtgtcagtttgctaaggatgttggcctccattcttgccatgaaaaacaacaggaaaataaagcactacccttgagcatgcctctagaacttgaggttcaagaacaacagaagagtggcagaaaactatatcttaaatatattctttatcttttgtcagtcctcaatctggcaagaacattgctgctacctgacctcatagacatgcatttgaactcctacttttagtatctgctctaagatctgatttaagaacagatagtagaatagaataagcttggttctctaggtatcaattttcccaaatttcacagtagttctatgtacagtcacattgtatattataaaatatatgtttaactgtcacatgcaagtatatttcagtttttaaaagctcaaggtgcatgctgatagtcactataaataaataaatacatatgtcaacatctccctatccccaattcctccctcatcaaaaactaaataaagggcaaatgaataaataaataaaaatgtttaaactgctgaccttcctgtcaacaaaggtgatgtgagttacaagaatctgttttctagctggagatgtgggcgcagtcatgagtatgcctccaccattaacagcactaaacccaacgtactcacaaacaacagctgcatgaaaaggccaagcttagtatcatgtgtaatttatgagagcttgttaaaacacatacatgcacacaaagttgaatgaataataccaggtgatggttaggaaacagaaaattcctgaagcatctcttctttttaatgaagtatcaaaaatactgttttattaaaatcgggagaaaaaaggctttaggccaagtgtgttgggttggccttgcaactctacttcggttacaaatttaaaggccaaagagttagagattgtgtatatgggtatgtgtgttgcaggttggggtgtgggacatatcaatacaataggtaaaatgaatggtggattgtgtctgggataatgtggcatattttatctcaaatcccaaccttatctcccaataggagatttggatcatgagcaagatttggcttaggctagttttcaattcccaggattccagctccttcatagcaccacccttatgcttactaatcccttcatctttaagacacctggataatgagctatctgcatggttggaaatagtctgggtttgttctaaattttacattagataacaggtcagcaacaaaataatgggagggggaaattagaaaacattaagtcttatttcatgtcatgtgatacagtatatatgtatttttttaataaaagaaagtgacatatattgtagttcaattggatatttacatttcatgtagaccataatggtagcggtaattatagaaatcttagcaactttcaaaggaaatttttcccagcaagatgactgacaaaatttttgaaagtaatagagagaaactgaggcataaaatttacctgaaagcagtcctgtttaaattggacaaaataattaccttttcttacatccctcttttagagttttcctaatatcatttaatacatagatagtactagaaagaaaaagacattttaaattaagaccaatgtgaagcattatacccatttagtatcattttgcccattacccttatagaaactaaaaatagaatgagtgctcagagtttgtactgtaactgcctgccacttacatgggataactatttttagttccatcgtccttattaaaggctttcattatgagttcatttatggaaatgttatctcacagagttttttttggagacttttctgagatctcaaaatgaggtctcagaaacatgattagaacatagtcatttagtttcccagcaaatgctgatcctttccaggaaagttctataaataaggaaccaaagctggttgtcagtaatttgaagtagctgggttggaccgtgaatattaatatgtaaattatagcttgtgccatctatacacaaccaggattgtatgcatatcttcccatggtttattttaagtctgaatttgcatacaaacactggtctaattgagtttttaaaaaaaattcttaagagatgccatgtgttacttaaagatgttttgttttgaaactttgtgataggtaagatccactaatgtttgtaaaatttaccatttgtaggaaatattctattctcagtaattcctggtgaaagtggtaggtgggttagagatcataaaatccagtcttcacgggaccaagctggaacatggctgggtagctggtggggtagtgacagccctgcttcaaggagagatcagaaatgagggatgagactgagtgcaaagtcaaggtcaacacaggctaatcttggcttttggctacttttctgtaaagagtaatgtttctctatttgaaggagtgattttaattcagaagtatattggaaaagtgaaagaattcctagagaaaagttaatcccagacaagatagtgaatgacatatagtttattatccagtgacctttagcacaacaactacacatatgcgcaagcgtaactgctgggctgctctggagttcgccagaaaccccttgcccttagtttgaaggagggaaagaaatatctgtaattattgctctatatcctttgcttttgacataattgattctctggcatttaaaatttatatccactcgcccataggattcttttaactctttcattgtttatttccttgtataagaacaggtctgctagtcagagagaatgttgagtatctttcataatccttgtctttatgggaccaaacatttctgccttgtgctagaaagatttttcagcccagccccaggcaaccaccattcattctactctctgcttctatgagtttgactattttagttacctcacaaatgcttttgctgcatttgttttgtattttaattacaccgtttgatggcaatgctagaaatttaggagctacagctcctctctaacatgaatgctatcttgtcaatgccttcagaagaataaagatcataattctttcttttacattgtgatttctataagaatagtttcctatcttcctggatctagatggaagatattaactttcagactaactgttcactggacaatttttctttcattattcctaaggtctttattgtacatatgatggtgtctccaatagttaaatatgcctctaactacaacatataatttaaactcatacctcacctgggattatattgatgatttttggttcaactatttctcaaatttgagatgctattcagaatttaagtgaggtctaataccataggcagggattagaagtccaggccagaagtctgaagtcatcagcttgggttctgttgatgtgaagtgaattggatcacacagagatagacatggccacagtcaggtgtgatacttgatgtgcctatgctttgcctcttagccagttcttagtcattccatgcaccgtgctccttagtagaagagagaacccttcaggtagacttctgtgaaatcctcacaaggcacagaaatttaatggcatttctgagagtcacaagggttctgtgaagtagaaattatgctctcattacattagcttaatgctgagtatattgggactcttgtaaatggacattttgttcatggatattttgttttagcaatttaaagaatgttaactagcttaatattttagagtgaacattttaaagtgataaagaaaaataagaaactttcttatctcaattaaaaatatatatgtatttttggtccacacaaatcacatcacccaaataattcagagcactttgctagaaaaggcaagacaaggtgtttctgagagtgtctccgcatttagatagactatttagttccatacttagagatcatccactagggtttctttgagcttggtgaagaatattcagcaacttgcctaagctctgggaatgtgagcatcagttatgaatataggtcatctcagtttgtgcacagcacactttctgtcagtccaatataaacttgtatgagtagatctgtttattgtgataactacaacttatattaacttgttgacatgctttttctaacttattttcttgggtctgcatttttcaaagatcaaaatttctgcatcttcagcacaagtagattgaagaacacataatacggatagtgattaggaacattcaggcatggggaacgggtgacatattgtttactgtgtttaaaagatgtgttataaatttcacttagtcaaactaacttgatgaaatcaagatagcctatgaggaagaataagctctgcaacttacatttttatatgggaagaaataatgagtcagtcttcttgaagttttttacattattatagtaagaacatttaagatgagatatacccttttaacactttacattttaagtgttcaatatagcattgttaactctagataggacgtttcatagaagatcttagcatctgacgtaactgaaactacatgcatcgaatagcatctccccatttctcccacttcccagccccaggcaaccaccattcattttactctctgcttctgtgagtttgactattttacatacctcattgataatggtttggatgtttgtcctctccaaatcgcatgtagaaacatgattcccattgttggagatggggtctaatgggaggagattggatcgtgggggcagatccctcatgaatggcttagtaccatctgcttggtgataagtaagtttttgctctgagttcatgtgagatctggttgtttaaaagtgtgtagcacctccccaaccgatctcttccccttttgccttccaccatgattatgagcttcctgaggccctcactagaaatagatgctggagccgtggtggtacagcatgcaggactgtgaatcaattaaacctcttttatttcttaaattacccagcctcaggtatttcttttctttctttttttttttttttttgagatggactgtcactctgtcactcaggctggagtggagtggctcactgcaaccttcgcctcccgggttcaagcaattcttctgcctctgcctcctgagtagctgggactacaggtgcgtgtgcccacgcccagctaatttttgtatttttggtagagacagggtttcaccatattagccaggctgctcttgaacttctgaccttgtgatctgcccgcctcaggctcccaaagtgctgggattacaggcgtgaggcgctgcgcctaaccatatttctttatagtaatgcaaatggcctaacacacttatgtaagtgaaatcatgcagcatttgtcgttcttgactgggttatttcctttagtgtgatgtcttccaggcacatccacattgtcgcatataatgaagttttaataactgttctaagacttagctgaagtcaaatggaatgcttctggtacttccctcatagcttatctcctggccttgactatggccatttcctattcccaccctgctctccaaggtggtattctagccatccttcaaggtcctgtgcgaataccatctcctctaggaaggcttcctttggtttcaaggcagagttcaatcgtaccccatctgaaaaccaatgacactttggagtacctcatgatagcccttcacaaacccctttaatgtgactgtgtgtgtatcgtctctctacagtgagaataaaagctccaaagccaggaactatatcttcctcacttcctcattctccacgggaccttgcgtttaataatttaacgaaaattcaacaagtatctgttgatggataaataatcatggaaaataaattccagacgaggtcagataaagtggattatatgggtaaacattgtggaaagtaagcttttcgaaatattgtaactggtgaaaagttgtccatcatagttaatgggctacctgagcaaatacctttcctgagctttttcttgaattcatagaaacttgggtctgaaagaaaacttacaagtcatcactttttttttttttttgagacaaagtctcagtctgttgccaggctggagtgcagtggtgcgatctgggctcattgcaacctccgcctcctgggttcaagcgatttttctgcctcagccttctgagtacctgggactacaggtgcacgccaccatgcccagctaatttttttgtatttttagtagagatggggtttcaccacgttggccaggatggtctcaatctcttgacctcatgatcctcctgcctcggcgtccaaaagtgctgggattacaggcgtgagccactgcgcctggcccaggtcatcacgtttagcctctcagtcctctatgttagaaaacagtaatccaaaaaaaaatgatttctttaatgctagatagtggctgaagtaggactagaactcaagtattttaaagcctgcttcacatttcttgttactaagctgcactgcctcccacacatggcctattttggtctctaaactgtcatgaaaacagatgctaggtccctgtcaaaatgtttgtgtatttctgggtgtgaaaaggtatgtgtgtgtatgtgtgtgtttgtgtctgtgctcatgtgcatggatccctggtggaggggagagaaaggcaatttgtagctgcagacttctgtcattgcacgcagcgcactctgccatggtgagttcatactccacagcaacagaacagctgctgcaaagggttggtgtgctattttcatcttgggtgtgtgttttgcatcaggctcttggcaatggcaagagtaaacctctgtaaagaacaccttcttaaccttttactgttacccacacttagtcaacagaaacaatatgtttaacaggagtttttcctgctggacagttaaatatgcagttcttgcatatgaaacatgaatattttgttcccttctgtggaatagcaataataataacactactagtaataccagctaaaatattttaagtgcttatttcaaacggaaaattttttttttaaatgccagattttttctctctagggcaacagtcatcttgtataactttgaattcacactaaaatcctctgtagcaacataaagatagaaaaatcctcctttcagcaatatggcactgtgtgcaatgagcaaatgcaatgatatagaaggaagattgagtttaagagtatcagcagcaaagtgacagaaacgctcatacattaaaaactaaaaattagacttaattggttataggtgggaggagcctattacttttggtgaggacacatataggtgggaaaaagagaaagaaaaaaagaacatatctatgacaggaagcttcacagatttcattttcataatactttttgagactaaaggaaatagaacattttctgtcatatgtgttccaagtaatgtcattctgtttctcatttgtcttttgacctggctgtataatgtatgtggtgaaacagaactcctttattattaattttttagtggctacattagtaactcttttcctgacaattatgaggaagctcttgtatattgacaagagcataaatctatcaacagccaggttcatacatagagtccacctcttaaaggttataagatactgggcaagtcatttcatttctttaaacctgtttcctcatctgtgaaatgctgatagaatcataccttacatagatcagatgtaaataaaatagtcgtaagttagcgctcaggaaattacagtattctgtgcaaatcttattaactttgattttgtttcatatattgataaatttacatctagctgaaaatacattgaatcattgtcatggactaaattttaatatgtcttaggaaaagagtccgggttgaagtgcagtggtgcgacgttggccccctgcagcctccgcctcacaggttcaagtgattctcctgcctcagcctcccgagaagctgggattataggtgcatgccatcagacccagctaatttttgtatttttagtagagatggggttttatcatgttgaccaggttgttctcgaactcttgacctcaggtgttctgccggcctcagcctcccaaagtgctgagattacaggcgtgagccactgcaccggtccaggacaagaatatttttgaaactatgagctttatcatcagagacattaaaacttcagaaggaaagagacctttgagttcttctgagccaactccttccttttatcactaccaacaacatgaagtcagagggaaatgacttgcctacagtaagatgagcaggaagaagtgaaagcagattaggggctgaggtcttcttagtttatgtccagagatctttccacttcacccaccatactctacattagtcactaccacgaccatcatcatcattatgaccaaaattaaatctaaacaacttttcaccaagtaattccattttcatgctaaagatcaggcagttcacttccatttcctcttttgtcagatgaaggaattgggccgggcgcggtggctcacacctgtaatcccagaactctgggaggccgaggtgggcggatcacgaggtcaggagatcgagaccatcctggctaacacggtgaaacctgtctctactaaaaatacaaaaaattagccaggcatagtggcgggtgcctgtagtcccagctactcaggtggctgaggcaggagaatggcgtgaacccgggaggcagagcttgcagtgagctgagatcacgccactgcactccagcctaggcgacagagcgagacttggtctcaaaaaaaaaaaaaaagaagtaattggatgaggtgatttatgtaattcctacaacctctcagtgctaacaaagcaacattcaatgacatttacaatgatcatggtggcaagttgggagagagaaagggcatttctgaagtaataataaaatgagtaaaataagatggtagtgccgtgtgttgatattgtgaactttacatttttactttctctcatccaaatcacagtaaaggagctgaaataagattttagttaattggtagccacacatgcccacaggctggtatgccaggctttgtttttctcacactgctgtaccatatccaaggccagagtgaatttcaggtgtcatgggctctacaagggcaagactggagtaggagctaaagtcaagttcccattggagaggattgaccaactgatagaggatggaaacgaagagccaaaggggagaagggacaggaagtactgagatctgaaagcaaattgcctaacatttagaggtgagaatgtgaaatgaggccaaccagggctggtgcagagccagaacaagggaggtcagaaagctaaggtgaaattctggaaataaatatgatgagagcttattgtaggggagacttttgggggactatggcctcgatctgatgtgtctgcttgtccccagtgctccttcaaacatgctccttgaagcttcatgcctgccttagacagccagagattgaaaatgaacatatattttgaaaacaaagacactaagaccattcacaaaaattcaagaagtaattttttaaaaaaaatacagtaacatttaaaaaatatatgttatttcacaacatatgtaaaaccattaaaatacattgacatcccaacacatattttggggtgtcaaaaaagaaatatggcagggtgcagtggctcgtggctgtaatcccagcactctgggaagctgaagcaagaggatcgcttgagcccagttctagactaacctgggcaacatggcaaaaccttgtctctacaaaaaatagaaaaacttagctgggcctggtggtgtgtgcttgtagtaacagctgctcaagaggctgaggcaagaggattgcttgagcccaagagtttaaggctgcagtaaactaagctatgatcatgacactgcattccagcctgggtgacagagcaagaccctgtctcaaaaaaaaaaaaaaaaaagaaaaagaaaaaaaatagaaatagtatatgttgataggaagcttagtgaagaacattaaaaagatttgcttgagctcttggttgccatggcagagctgcgggagctccgggctcagaagatggtggactctataaagaagcctcttgagggagttacatctgggagttgtaatttttcatgttcagcaccagatgttttgaggacaggcaggtgtttatgcagcaggtgtggcagtgcacagaggactgccacatgcctctggctcaagaccaagccttgaggaccacggagataaagaagttccaatgccacctgtcccagtgcaccatgcattgcaacgacaaagccagagattcactagatgcagggagtgaggatctttaggcgaagtgacagctggacagttgtgtgaccaagtgttgatcacatgcatgtcaccctgacaatgaccaaggagatgaaggagatgttctcatccactgggatacgtatcttggccagtaaccatcagggctgaggacaggaatctgtttaacaaaaggaaggagaattttagtctttaaggatgtggggaaaagaaagagagatcagactgttattgtgtctatgtagaaagaagtagacgtgagagactccattttgttttgtactaagaaaaattcttctgccttgagatgctgttaatctgtaaccctagccccaaccgtgtgctcgcagagacatgtgctgtgttgactcaaagtttaatggatttagggctatgcaggatgtgcatagcccgagaaacacccacaggtgtggaggggcaggccaccccttcaaaggcaagtgtcatgaatgaagaaattaaggatagcaacaagtataaggcctatgtcacttgcctttggacaaaggtccctttatatttcaatcctggaaagtgaaatgaaaaaactagtgctaaaattaggatcaaagatagtacaggaaagtgtatttaagtcaaaatttcatgtggcaagtgcttctcctggcagcaggaatatccttgtaccaagccagagccttccaaggtacaagttctttttcactatataggaaccgacagactggcagggtcctctaatctggctgtgatctggtggagtttgaggagaggtgtttctgtttggtgtgaggctcctgtttaccagaagtgttgctgcaccattttccataaacaataaaacaaaatccatgagataattcatttagtggggcaaaaaacgtttgttggtctttgttttgcttggttttgttttatatgtacaagggcataaagttgacttaggatgtggagttgggaaggagagtagtttggataagatctttgaaaggttgcttatgggtatcctttcctggtcatcaagatgtggatgtacctctcttgaaattcttactcactgcatctttcagcctggatatgatgcaaaaacatgagcggtgacttcacatttaggtttgaaagcagagcttccctcttattggctgatggttcctgaggatgtctgcagcagagtggcaggacaatctagcagaaatattttccacttaaagagatagggggtttgtgtttggatttggttctgatatatacctgtatccaggaataaacagtgaaagaggaaccgttggctacataattatgagagttgtgaagtgctgaatttggaaaaacccggctttcatagaacagaatggaatgaaagcccaaacccagcattgcttacgtagcccctgaattaacagaaccctattgagataataccctgccaacagcaaggtcaaagaagaagaagtaagcgacttggctaggatgagctgtgacttccttagagcaaaggaggggcagccccattaccaaataccacttttgcccaggcttttgtgacatgcagtgctcctgcccagcatggcaccttattttgacaaggaccttgttatctttccaccaagttatcacttgaaatgataatatagcttgtatgttgttcccaagctgtcgtatattttcctggttgtttgaatttaacaatgagaataataaggtttaatactcctccctaagaaaagatttgcttatttcccaatttgaaattactttgctaagagggatataatgagttctatagtgaaacaagtatgtgttttatcctaatttctgaaattattcctgaaaattcaagtccattgtttgtctcccaccctatcctttggttctgtcacctcagaactaacaccttgacaaagtgtttcttttttgtccttctaccctccccgcaaaagtttattttttaataaatcgtttctggcaccaacccaaaccacaattacttaaaaagaaaaaaaaaatagcccaggattccatttacttataaacttgctttctgaactttatttttaatttcagcatttttttttttttttttgagatggggtctcgctctgtcgccaggctggagtgcactggcgtgatctcggctcactgcaacctctgtctccctggttcaagcgattctcctgccttagcctcccaagtagctgggattacaggcacacgccatcatgcccagctaatttttgtatttttagtagagacagggtttcaccatgttggccaggatggtcttaatctcctgacctcgtgatccacctgcctccgcctcccaaagtgctgggattacaggcgtgagcctctgcgccgtgccattttcagcattttttgatgtcagttatgggttcattgttttcaatataagataacatgagcagagactgtgtaggtgggattgagagtgaagactgggctcattgacaacctctcatcatctcgtcaagcagagtttcccatatcctctgaatctatgcctgtgtaactccaaatattagcataaatataaaaaattcatccatttggatattttatctacatgatattaattattgaaatgaatctaaattcttttcacaatgattttggcaagaagcactggcttggagtaaagtcagaaaacatgacacatagcaaacatttatagaccatctttttaattgtccatatgaaaagaataacatctagctgattagatgtattttaggggaatttgggaaagaataaataactctatgccttatgactgtcctgatatctgctatttatatctctgttctgggcaaagaacaccaaaaccgaatgaattaattgttgtgcatgctattatgtcttggatatagtaatatcaacatttatacaaatatcgactcagtacagataaaaaatagaaagtaattttcatcttttgtttttaaagaaggaaaaatattattatagaccctgaaccttcttcttcactgaatgggaggaaataaaagatatagaagcctgaggaatataaaataataagaaggtaatgtgatagaaagtggctgaggctatgtagtttgaatctccagaaaaggcctctctgagaaggagactttgagcttggagatctgagtaacaagaagaagccaaccatgcagggaacagtatttcaggcagagggaatagcaagcacaaatgctcaggtgtgaatgattccagctgtggtagccagagtctatgatgcaagggctaggaggggtggtagtgaaaggagtttgcattgtatttgaacaccaggaggaaaccaacacgtagcattaagcaaaaagtggtatgatatgatttatagtttcaaaagattacaatggttgttctgtaagaagataccagaagaagcaaggagaccagatgtggctattttaaaaatttttcgttgatacataataactatacatatttatgggatacatgtgatattttgatatacacatacaatgtgtaatgatcaaatcacacacttaacatatctgtcacctcaaacattatcatttctttgtgttgggaacatttcagatctgttcttctagctatctggaaatataaaatatattattgttaattatatgtcttaggctgtttgtgttgttataaaattaatttataaagaaaaatatttatttggttcacgtttgtgatgtctggaaaaattcaaaattgggcatctgtatttggtgaaggccacaggccacttcccctcatggaggaaggtatagagagcccgtatgtgcagagattacatggtgagagaggaaacaagaagggaacaggaggaaactagcagaggaagaactcactcttagtttctgcaagaggaattaactcactcccgatctccccactccctgggtaaggcattaatctatttatgaaggtttcacatctatgacccaaacaccttccattaagccccaccttcaacactgggaatcaaatttcaacatgaggtgtatagaggcaaacatccaaactgtagcactatagtcactcgaatgtgctgttgcacactaggacttatttattccttctatctaactgtatgtttttgcacattaaccaaactgtcttcattcctcactccctcatccttccctgccttcagtactatatttctactctttatcttcataagattcacttttcagcttccacatatgaatgagaacatgcaatatttgtgcttttgtgtcaggcttatttcatgtaacataatgacctccaattccatctatgttgctgcaaatgacaggatttcattctttcttgtggctaaataatattctgttgtacacatttaccacattttctttatccatttactcattgatggatatttaggttactttcatatactgttattgtgattagtgcaacaataaacataggtgtgaagttatccctttgatgtgcttttttccttttctttggatcagtccccaaattgagattgctggatcatatggtagttctatttttagttctttgaggagtctccagactgttttccttaatggctatgcaaatttccattcaacagcgtataaaagttccattttctcggcatctttgtcagcatttgtaaaattttttttgtctttttgataataaccatactaactagggtaagataatacctcattgtggttttgatttgcatttcccaaataattccaggaaagagatgacattgggttagattagaggggaaccaggggatgagtacaaaagatgaggagaagttagaatctattttagaaacagagtcaacagaactcaccaaatagatgcagttaaggaagcaaggaaagtaactaagggtaacacctgtttgtggcttaagtaactgaataaatgggggtaagacaatatgagacagcaaatatttggggaatattttatgtggtatttttggaaaaaggtgaaaatgttattaatttaaaatctattatgcttccaattgaagatgaaaagaattgcctagaaaagtctggaactcaaggaagaggtcagggctggagatataaatttagaagacattggaatataggtttaattaaagccagttggccagatgagatcctccatgtaaagattatagatagagaagataagagggatcaaaaccaagccttggggaattccagtattaagagttgccagagaaagaaaccaacaaagacagaaaaagcaatcagtacggtgggaagaaaccaagagggcctgatgtcataaaggcatttcaggctagagaaagtgtttaattaaagagaagaaagaagaacttccattgcatttggcaatggaggtcacatttgtgatctggacaggatagttgcagagagtaatgagtttaagttgtacatcaaagtaaaagacacacactctggccaaaggaacagccacagaaggctggcatatgatgtgcctggcacgcaagttttggttttgtcctttggattctcctgttagatatatgtggctgttaaacaaggtctcagaaataacggcttggtaatggatgattctgacaggatacaagaaatcccagagtgttaagctcatcaggtttattgttagttcttgtttcctggaagtgtttgaagccttgactctattaggtgaaatatgactccattaaattgtctgacattttaatactttaatttagtgccagggaccacttttagtgtaaaatgtttcacagagggttctattttaaactgcctggcttttgtaactctcagttttttcttccaagcctttcaccagtgtaaccatcccaaatttgcatcttgtctgatgctaactgaggaagaagggcacctggagtttgaccagcaggaacaaaacatgttaaaattgttgcagaagatgatgaggtaaaaacacatagcactggggcacaaaaccctggagcctggagcctgttgcaggtgtttagcactgaccttccacataaccatgggtagccataggacctctttaaccctcagttttcacatttgtaaaggcagtgagcaggaattgcattttaaatatacaattgttgtcactggtagcatctatctggggccagtggcacaggagtaaagagaatttacccagacagttgtgaggaaagaaagccatattgattagagaaagcatgaaaatacgttgcaagggtgcaatgggcaaatcagcaagataggagctgactgcaaggagacaaaggcttgctggggattttatgggatggcgcttgtgctggggagggctatgtgctttactgataatgccaaagttgtagtaagctaacttgcagttttctattgtctgagggtctgatagtaagttgggcatgagaagattgttagtaatttgcacagaagggctatgtgtcctggaccatgaagaaaggcagacttgtagcttatctgctttttctttttggtttctcctgctcccaacaacctgactccttttctctaattaggacttcacaagtgtggcatctcatgtattctaaagtatatggtgaccatctaaggaagttggtttgaatgtgcaggtctagcaaagaacatgccctggatataaaacctaggaatcaccatctgatcgaagatggagatgaatgacttcaccctagggcaagaaggacttaagaagaataggaaggatggcaggaatggaggaaaacattttggatggaaagatgagacactgaaacaatttgaagattggaaggtgagagtctgaggtccaaagctttacaccagttgttgaagaaccttgatcacaggccagccaggacctcaaaggctcaagagaaatgatgacaaggtttgcttggcttatttagagctgggctatagagcgggaagattgtggttaaatcttagcagaactgataaaaagcatgaagttgtactgagagatttttcaactgtacatagttgcagaaagaaacaacctgctaccatagtaaatatttgtgttagaactcagtggatgaaggtggaggggggaacatggactggaggggctaacagagtatatgtagtaggcaagtgggattggagtacaagggaaggatagctgggggtgacgaggttgagtctgtgaatgagaagggcttaggtcaatttctctttctacccttcttccagctcttctcctccctctttattcctcccctcttccccttccccctcttttcctccttccctctgcctcctctcttcttcctcctttctgcctttactttatcctttaaagtcttaaaaaacaaaacaaaacaaaacaaaacaaaaactgtgatgatagaacccaaagtgtactgagagatttcttaactgtgggcaggattgttaagtggtagtaaactcaagacaacatttatattgcactttacaatacataaagcactttcacgtaattaactcctttgatttgatcatcacaacaatgcctgaggctaatagttataaaccttgttactgatgaagaagctgaaattcttatcagttaaatgtgttgctttgggcttagtaattggcagagcaagccaagtctgtctccagaccccgtggtcttctggttccaaattccatgctcttctcattatacagcacaatactttttttttttataaaatgggaaagtctttttttttaatgtatttacagacagttcatggctttagacacacacacaataaagccatttttattaaatataagaaagtggagcaaatttgcgtccttttttattttctaatgacaatgctaaaagctaaaaggcaattggccattgacgggagaacaaaggaacctgaataattgataaaatgtattctaaatccagaaactgtcaaagtaggcgatgtcagagatgctgcagttgcttggttgttcgtgatatctgatgacgctgcatctcagtcataaaaacttcagggaatctgaaagaaataataatgcgccatggtattttgagcttatcaccacaagaaatactctgtaattgcatcaaatgattataaatggcatattttagggacataataagcaatgcaaaggacaggtctgcttattagtgccaaaatttgtatttattcccatattgctttttttttcctaggcattttccggcatctcatttctgactattaaattataccccaaatagaatatgtaactacatgtaaccaacctattttggtctacattaagtgcagcagcataaatagaaactgaaaataatcagaagcatttagaatttcgtttttattcatctgatttacttggccttttgtctgggatgtaagtgattctgagcccctctccagactcacactttccccaggtttcagtacctggggctcacaatctcagtggaagagtttcaaggcaatcttccactcaggactccttatgccttgcatgcacacaaagcagcgttgctcaaaacataggaaacaactatgaggaataaaaaggaaaagcttgttccttaaagaacgagaaggaggccagcagtctttttcataccttcttgtttatagaaagcagatttttttttttttttttttttagtaaaagcatatttggagcaggaaagaaatatgacctagactgtgttgttttcttttattgtatctacaaatagtttagctgaagtgagcttttcagttattgattttaaatcataagtttaattcgtcatcaaggcaacaacaaatgtgatgtttggggcagatgcaaagttgaagtatgtctaaagaaatagcacgctagttgcgtttaatgtggaaggtaaattataacaaaacaaactaaaaccccacaaactctaaagattttcccttatagttatagaaattaggaaatgccctattgtgcatctttccttcccaactgtaccgagattttgaattttttataatttgtactaatatgtaactagaccagatataatctgttgaggctttcttgtgatggaaagcaggtgaaatcaattttcagttgaaatatgcttttcagttcactatatgatgtttgtagggcttttttagagaagggctttgcatttagacttgagcagtttagcaggcttcgtcggagggtaaatctggctgctggatctagttggaatgttttcctttcataagaagagttggagataaagtgattcttgctttcaaatacacttttaacaatacaaaagaataattgaagactttttcttttgagacagagtctcactctgttgcccaggatggaatgcagcggaacaatttcgactcattgtagcctcgacctctcaggctcaggtgatcctcctacctcagcctcccaagtagctgggactacaggcgtgtgccaccacatctggctaatttttgtatgttttgtagagttggggttttgctatgttgcccaggctggtcttgaactcctgggctcaagctttcctccctccttggcatcccagagtgctgggattacaggtgtaagccactgatcccagcctaattgaagacttttgtatgttaggtgctaagtaatacaaaagtaaaagtgccactgtttctgtcctcaaggaatttacagtctggagaaggagacaaaatataaacaaacacactgataagtaaatgattacaaattgtgccaagtgccatgatagaaaagaattgatgtgcattatctctgtgctccctgttaggggcacctgacccatcaggaaggccattgatcatacccatcagtcttccaggtataccaaggacattggattgaatgtcacaggacctggattcaagccctgccatcgaatccagctgggtgtttctgggcttcagtttctgtatattcagtaatagtatcgaatattagtgggagtaatagcattgaatgccctccatgctcactggaacttcatccacaattacaatgtcttggtggctttctaagtttttttttaatttttaatttctaatttttgtaggtacacagtaggtgtctatatttatggggtatgtgagatattttgataaaggcatgcaatgcataataatcacatcatggaaaatggggtatccatctcctcaagcatttatcctttgtgttacaaacaattcaattatgttttttaagttattttaaaatgtacaaatacattattttggctatagtcacactgtcatgctattaaatgctaggtcttctaattattttttgtaccctttaaccatctctacctctccctgatcccccagtacccttcctatcctctggtaaccatccttccattctctatctccatgggttcagttgttttgatttttacattcagtaaatgagtaagaatacacaatgtttgtctttctgttcctggcttatttcacttaacatgatgaccacagttccatccatattgttgcaaataacaggatctcattgttttcatgaataaatagtactccattgtttatatgtaccacaatttctttgtccattcatgtgttgatggatacttaggttgcttccaaatattggctattgtgaacagtgctgcaacaaacatggatgtgcaggtatctctttgacatgctgatttcctttcttttgggaatatacccagcagtgggattgctggatcatatggtagctctgtatttagttttttggggaaatcccaaactgctcttcattgtggttgtactcatttacattcctagtggctttctagaacctcctcttggggagccatatggaaattttgctgaaggtgagaatatggcagcttgatgcaatgcagtgttttttcaagcttcttaatttgttgttgttttgagacctaagtctcaggagagatgcaccgaggctgctgcagagctgtagagaggagatgaggagcgagcaaaggaggtagggttggaggcgcagggcatctcccaccctgacttgtctcagacatgcccctcctttatctgttgattataccaggcttacagggaggattttatccaaagaattcacctgctaaaagaggaaaacattttaaaattactgttgtagtccaaatagtctctggaactagacgattctggattccaaatatagacatgtggtgcttaacgacagggatactttgataaatgcattattagactattttgtacttgtgtgaacatcacagagtgcacttacatgaaccctgatggcaaaacatactacagacatactacatactaggcttatgtggtctagcctcttactcctaggctacaaatctgtacggcatgttactgtacttaatactgtaggcaattgttaatacagtggtatttgtttatctaaactatcaaaacctagaaaaggcacagtaaaatatggtataaaagattttatttaaagtacacctatataaggcacttcccatgaatggagcttgcaggactgcgtgttgctctgggtgggtcagtgagtgagtggtgagagagtgtgaaggcctaagacattactgtacactactgtagactttataaacactatatttaggctacctatatttatagaaaaatcttctttcttcaataataaattaatgttagcttactgtaactttctgacttaataaatgttttaatttttcaaaactttttgactctttttcaataatagcttgaaatacaaacacattgtacagctgtataaaaataatttctttttatcctcattctacaaacttttttgaatttttaaattttttaatataatttttaaaattttgttaaaaacaaagacacaaacacacacattagcctaggcccacacagggtcaggattgtcagtatcactgtcttccacctccacatcttgtcctactggaaggtcttcagggtaaataacaagcacgaagctgtcatctcctataacaatgccttcttctggaattcctcctgaaggacctgcctgaggctgtttcacagttaactttttttttttttaataaaaaatacatgtagaagcagtacactctaaaataacaataaaagtgcagtatagtaaatacataagcgaataacagtttttctaatcattatcaggtaatatgtactccatataattgcatgtgctagactcatacaagtggtagtgcagtaggtatgtttacgctagcatcaccgcagacacatgagtaatactgtgacattatgagggctatgatgtcactaagtgatagaaattttttagctctgttataaccttataggtccacatcatataggcaatccatcagtgaccaaaatgtcattatgtagagcatgactgtattagttcgttttcacgctgctgataaagatatacctgacactgggcaatttacaaaagaaagaggcttaatggactcacagttccgcatggctagagaggcctcacaatcatggcagaaggtggaaggcacctctcacatggcagcagacaagagaagagaacttgtgcagggaaactcccctttatgaaaccatcagatctcgtgagacttactcactatcacaagaatagcatggcaaagacccgccaccatgattcaattacctcccaccaggtgtctcccacaacacatgggaattgtgggagctacaattcaagatgagatttgggtggggacacagctaaaccatatcagtgactacagtactatagcagttgaatagttttttttaaatcccttgagtatcttatgatctataaaatggcagtcaagcctatcctgtggatatttgcaaggcttataaatattgtctggaagagaaagatgacttaggagtatattataactcttgatgtttttattatatttgtcattaatgtgcacaaattataaatgtattatcattaataataatttatttaaaaaagtgatgggatatcataaaacccttgggtgaattcaaacatggccactttgtatgacaaattacatgcttctatttctgttccacccagggtttcttttgagcagtggaaattcatctggaaacttaatgttatcccactatagagagccattcttgatgtgccactaattctgccaaataggctgacttgactactctcttaggatacagaattatatgaagaaaaatagagttgagaaggaaaaagtacaaacgttgtgtgtgcatataacaaacagatgactgctttagacatatttggtctgtaaacacctgtggaatcttgcctgtgtctctaatttttccagattttgctcatgggagagacacaatttgttctttgaatgtagccattatattttaacatacatgctgatttaatcatgctggtcaaaattttctttttatagcatccagacagcttgtgcatataactacatgcagttttattttgtggccaactggcaaccatatggaagtcagttaaaatgtattttgattatatgactctgtgcacataggcacatcatctcaggaaggctcaggtagcatagaggcaagtgaattcagcctgagattacagtaaagacatgaatctgatagtctggcatttctggactcacactgatttcttgaagaaaagcccatacagttggaatcagtgccttaaattaggtttcttaatatgatgagctcataaaatatgtgttgtcctgccttcttcagatgtgagagttgatgttacagagatctctttggtaatatgactattttaataaaatattcacaattaaaaatatatagaagaaagcagcaaggaaagactagaactaatgattagagttgttgaaaatgcatacataatttactccctttttaaaaaaaatggaactgggctattctgttgtacatagacttttgtcaaaatcaaattaagaatactttactcagttttctttttcttcctttattcatctctgtaaatatgattttaaaggcccttgaaaacaaaataattatcttattaaaatttagttacatgttgtgtttaaaatgctaaagttttggccagccgcagtggctcacgcctgtaatcccagtactttgcccgagatgggcagatcatgaggtcaggagttcaagaccagcctgaccaacatggtgaaaccctgtctctactaaaaatacaacaacaacaacaacaacaacaaattagccaggagtggtggtgcgtgcctgtaatcccagctactcaggaggctgaggcaggagtatcgcttgaacccaggaggcggaggtcgcagtgagccgagattgcgcaacagagtgtgactcagtcttaaaagaaaaaaaaaaattctgaaatttatcggagaaaacaattgggatctatttttagtctcaaatgtaggcatatacaaaaataatacatagtagttttctaagtactattagacatttgtttcccattttgccatttgctttcagtttacctgacatgaagataaaaatgatagctatttctcacttggcatttgaaagacaagagcaataagaaacccagcaaaactcctagagaattttcatggggaaaataagcatattgacattctttgacttttgtaaattgattttttggctccagctgctctaaagccattaagagttagagttaatcattcttgatttttttattgttagtcagttcccttattcataacactgaataatagcaatactactgagttttatttgtgttcacattcagtgctatgttaaaaaattcacaaagtaacatactgaaattcttgcaggtaactggtaaaatatgtagtctttagtagactgttgattgatattctagtaaaagagtaaatcttgtgaatttcagaggtggtcccaagatggtcttaaccctactgtgttaaaaaatatcagcatctttttcctataaagacaacctgaaggctcttttgaaatatgtataagtgcttctttttaaaaaacttattgatcaaatcagcttaattagctatgaaaggaatgatccttcacccctatgttaatgtctgtttacactgtgagtttgtaaaagcttctgatagagattgatgccatatctaataaattatcccactatatattcataaagtactatgattatatctatatgaatatatatataggtgaatgtagattcatatcaaaaattgaaacccagagaaaaaacttggaatttggtaggcagaaccatgaccctcctcaaagaagtcctcaccctcatccccgaaacctgtcagtatgctctgtaacatgattaagggcaattaacattgcaggtagaattaaagttactattttagtccatttgtgctgctataacaaaatgcctgagactgggtatgtataaagaacagaaatttgttttctgttctggagcctaggaagtccaagatcaaagtgccagcaggttccatcatctggtgagtactgcatcttcagaggggaggggaaaggaacagtatgttctcacctggcagaagaacaaaagagcaagctaccaaacactgccaagcctcttttatagaggccttaatcgcattcgtgagggagcagccctcatggcctaattacctcttaaaggctctatctcttaaaactactaggttggcaacacctgaatttaagagggggcataatcaaaccatattattactaatcagttgaccttaaaatagataatcctggatgatctcggtgggccccttgtaattacaagtttccttaaaagtggaagagggtgacacaagagaagtgagagtgacgtaatgcgaacaggactcaacacaccattgctgactttgaagaaggaggcctgaatttcaatagccacggaaggggacaacctttagaagctggaaatggcaaataatactacccaaaagccctcagaaaggagttcaaccctgacagtacctttattttagctctgtgcaacctgtttcagactgctgcagaaccgtaagataataaattcatgttgttttaaggcactacatttgtaataatttgtcaaggcagcaataaaaaaccaatgcagcaaaagacaataacgtctgtttaaccacacagtcacggaacatctattaactagcaacttattaaatacagcttactgctgcaacatctttggtgtaattaaaacatcctccatgaatcagagtgagaattatacttaagtgtctgccaattgccatgataatagaaaagcttatgatctctctactaagtaccttaggaagacaagggcccaatgatatgagcagtgtggtggaaccccaaacatcttcccactttcatgcacacatatcattcattctcctttttcccaaggttcgctgttagtatagaggcacaatagatcatgattagctctgggcatgttcacagtttagctgcctgagcagattaatttgagagtccaggaaaagcttattaaacagattatgagaactagacaagacttttgagaccatctgtccaaaactttggttttaccagtaagcaaattcagacccagcatcactcagctggtaggtggtaaaactgagaagagaatccatgtattttgttttttcctagttctgtgttgttgcactgcataatgaattccagccagaaccacacattcagttcctgactagtccacaattagaatcaccatcaagtcaaacacaagtgaggcattacatccaggaggtcatagttagttgtgtgtgtgttccctagatagattccctgaagctttctcatcaacaccaagaagctgaaggggaaaatgaaagttccccttcagttcccctcaattcaagagtaattgagaccaacatcattcatggatattaataatatgaccttttttaaagaatcaccaaatcattacatcataaagaacaatgatcttatattttactaggtttattagttgcagtctcagcctctaggttgctagaaagctctgggctcctttggatatggacatggccaaatctctttaactttctagttatggcactttaggcaaattcaacttctctgagtctaggttttctcctctgttcaatggaactgacaattctatgtcagagagctattgtaaggattaaaggaactaatatttgcaaaccccatactgttgcttggaataaaacaggtgctgaataaatggtagctatttgattgttagttttaaaaaatcttgctagaaatcattaagagtgtatttatctaagtgggggaaaagaaaaacctaagtaagacccttggatcttgaaagaaagaaaaagagagaaatgattgtcaacacaaacagaaatgcttgaggaacttcaagggctcaagagtcaaaggacaggctagaaaaaaatgtcagagaagaaagagctaagagaagaaagtcaaaggaaaggagagaaggggagaatggaaggagaactgagaaaccagcagtgtttttttaaaggtgataactgaagaaggtgagcagaggaagaaagaacacagtgagtaattgaaatcaccagttattttcttctgattcatctcttaaaggaaataccttctaagagagatctttgctcttttgtgtgctggtgaatgtaaggtgagaatctctcctttctttttctaatgatgaccctgaacaaggccgtgctcttcttttaaacatctcttctgtttgaagctctgttacaatagaatcaaatagggtctccttggtttatgtcactgatctaaggttgaatgatgtacttgacagatccttttgaactgccccatctgggaactgaaccaaagactggatcgccagtcatggtactcacaattacctttccctttccgcacagtccccacattcactacccgaaagtataaaatccatctcataagatgcagatgaagtagaatgatgcggtttcccaaacttgcctgattatacaaaagcccagaagcattgctgtctggagattcggattcttacctcaaggtgattcttatcattagaaagtgaaaggtacagaaatgaagaaactttcgagtaagcaacgtttcctaccaagggactgggtggttctgaatataacaccatctttctcctaacaatagaaggtgacattttgacaaataagcttaggattcgtattcttccctaaggtatcattttgctgagctatcattttttttctttctttttatttttgagacagagtctcactctgtcacccaggctggagtgccgcggtgtgctcttggctcactgcaacctctgcctcccgggttcaagcaattttcgttcctcagcttccagagttgctgggattacaggggcccgccagagtttctggctaatttttgtatttttagtagagacggggtttcactatgttggccaggctggtctcaaactcctgacctcaagtgatgagcttaccttggcctcccaaagtgctgggattacaggcatgagccactgctcccggacttgctgtaagctatctttttgccactcatgatgatgattgtatggatgactctctggtctgtgttgtcagtattcaagtggtacctccactctgtcacatcttcattttgcttgtctagcagacttgctagtcccttctgtcttgttccatgtcaggcttggacatatgaattgcaatcacattgtgagacaattaattgtccaatatttctcaagactccctgtcctttagaaactattttgcattcatctttgagtcctcagtattttgcctagtaaacagggtttgtcaagtgaatatccaatatagactcaggaagatccacatggggagtgagaaaattgagcgaatcccaggaaaagaacaggaaatggaggtaaaagactcacgtaagtttacccttctatccaggcatgcctccagacaccagcttccacttccttatctgtctggaattggtgttgaattgatcttcgaggtcagtttgaggtttcttactctctatatgagtctctgatacttagaatgttattttgtgctcagattgccagaaatcatgaagaaatgaaaggggaaaaatggtggcaataatgatgactaacaatgttttattgtgtgacatgaagttaaacagtaataatttattgttatattgaatgctgcagcattaaactgctgcctccagtgttaaaagcaatgctcacaagacagatcttatgagaaactctatgtaacagcaaaggatcactgaaatattcagatacagaatttacaatagttgcattagggcttcctttgaattaattaatatttcctctgagatgactcctgccaagtggttttgcttcattcctgatttaattgctaggaaaatcagaattattccagaaagtgaggctatgaaggtttcattgtaggaaaatcttgtgtctgaagccgtgaggctggacaaagggaaatgagttgaatgctgttgtgaatgggcagaagtcagcaccagcaacttccattcatttcgaagtaagagttgataagagaattgactgttgaagtcaaatctccgtatattttcttatttccttctttgcatccatcttgcaaagcaaatttttaagagaaaacgagtgtttcattcttgatagtgaattgctctgcttcttcagcaggaggtgcaggagaaatcctatttgcatcctttccactgctcttaacaagcccctaaaggctgagttaatgtttatttgtggcctggagtggccaaaagggaatagcaggaattattttcttcatagaagtggtggagaatatgagtgcctccctctataaactggagaagatttacctgcacaattctcctctctgctttttagtactgcttgggggatgaaagggacccatggactttggcctcagacacaccaggctggtttcaaattttccttttttctgaaatccacagtaagccacttaaactctctaagccacagtattctgttctgtacaattggaataacaatgctgtgtactggaacagcttcataatttgtaggcccagtactaaatgaaaattgggacccttttgttcaaagaacatgaacttcaagacagtaatggcagagcatcaaataggtgtgtggcccttctgagcatgggggctgtaccactgggcaggccacataccacgaagttgacctcactgtgcagctggattggctgttggatgtcagatatctttccctttgtatctctgtatctcagagagtggatccctgaaaatggcatttgcactggctgctagctagatttagccatggaaggcagtagtaggagactgatggtgagaggcacggggaagccaagttatttccctcttttctcctttcccctgtctctatttccctttgaaacgtatctccaatagtaactgctctcctctttcagttccagcatacctaggacagcccaccttctggggtcccacctttcctgatcccactcactgctagtcagttctctgcaggcagcccagctcctcatgctctaaaaccaccatttccttggttcctccagcctgacaggtgctagctgcttcctgatataactaatatcttgactacctccctgttccctatgaggcatttcagctcttccaagcctctttaactagttccccttattaactattctttattcttcatagaatctgatataagtgtctaccttgaaaggttattacaaggaacaaatttgtctaaggcagtggttttaactgtacattgcaattcatttgtgagtaatacaatcagtttgatgggtcaagaccggtagtttagaacacaaaataacttagagcagaataagaaaacatggtagtgcattgtatgtattaaggtacatatgatttaataaagcttttagttgtctctgtgtgtatgtgtgatgtgtaccatttcatgctgtaaaaatgtattactttctagcaggtgggagaaggaaagaaaggccaatggtctaagacttctggtacataattagcactcaataaattgtagaaactattgttgccatccaagaccatgccatttaaacaaaaggcagtcagacagcccaaagagtttaccattccaactcactttagctcattagaatagtttcatgtagttgggccaacttgtactaaaatggccaaagcgtttacttacatttgtttgtttacacctagacaggcccagcttgagtcaccagccttggctgaaagagaagccagccaggttcaaagtaaagaaacagttttaaaataacattttatttttctgtgagtcatagcaaatctgtccctgcaacatctttctcctgcagctaaatgctttaaaatggtcaggtctcacccaggaaagtgggactgggaggaagtgatgcgataaaacagcttcccaatcagtgcattagtaggagtgcaacctctggcattcctcttttttcagaagtatcaaaaagctctgcagagataactgtgtctccagatggccatgagattggtaaatgacaaatgtttatcagcctttcagcacctgctgatggaagaactaaaaaaaaaatcgcaagtgactttatgagcccacagccaccccagctgtaatgggtgctagtagctctgtgttgctgacctcacatgggtaaaggaagagcagaagaatttttagtcccttggctacttcttatctatttcatcaggtaaggaaactcaacttgaatcctttcaactctgaagaatggtagatctgaggaacaacaaagagctataggtcatgtggatttctctgctcagtcagagagcccagaactctccctggagctgaagatagcccttgcaagctatctcatgatggttttatagcacagtgggctcactcatactggtgctggttttgagcatctatgttgacaagacaaatgtctgtttctactactgcagaggatagagtttaaccaaagtcaggtgacagagaaaaagaacagaaactgataacacttacacagtatccttatatagcaggctcttgaataatgcaggcattggggtgacaaccacccttacagtcaaaaatctgtttataacttttttttttttcagatggagtcttgctctgttgcccaggctggagtgcagtggcatgatcttcgctcactgcaacctttgcctcccgggttaaagagattctcctgcctcagcctcccaagtagctggaattacaggcatataccaccatgcctggctaaattttgtatttttagcagagatggagtttcatcacgttggccaggctgatctcaaactcctgacttcaggtgatccacccgcctcagcctccccagctgtgtagataacttttgacgccccacagccttaactattaatagcctatcattgactagaaatcttactgataacagtcttttaatgcatatgttatatatatacattacactatattattacaataaagttggaaaataaaatgttattaagaaaatcacaaaaaaagagaaaatatatttactattcattaagaagtggaaattgatcatcataaagtcttcctcgttgtcattgtcttcaggttgagtagctgaggaggaggaggaagggaatgggttagtcttgctgtctcaaggatggcaaaggcagaaggaaatccgcatgtaagtggacccacgcagttcaaacctgtgttgttcaagggtactttatgttgtccgggatgctatattgagtactttatacatataaatttacttaatcctcacaacatgcctacaaggtggatactactattgtcctcatttccagctgagaaaacagatagagaaggcaaataatgtgctcaaatctgcacagttaattaatcatagagcccaaattcaaacaaaatagtgtggctgccaagtcaatgctcttgacctctacccagactgggagccagagggtttgcattctaattttatcattaaccaatctgactgatggggcaaatcaaccctactgcaatctcctcttttcatctgtaatataaggttattgcttgagatattttcaagtcttagtgccacctcccatttagagctttagtgttgagaaagatgatattaatgtattccgttgtcctaaatatttcaaacacgtcagtttctacttttccagacaactccaatggggatatttttttattcctccacttcctaattaaggctgaaagggccccatattcagctgctgagtctctgtctcccgccttcttttcctcctgtacgacctaaaactgtcttttgtctttcagcacttggggagaaactctgggaagctttctaaatccctaaatttgtcacacccatccttaaagcagtgctgaattaaaaagtgggattcgtctaagcagaggagatacttaaggaaggagaggggctacagcactaaatgatgtttccaattaagagaagtgtaaggtcagagagaaactccctcctggatggagctcttcaccacctgatgagctgattaaatatcatgccgcaaaaagtaaatgtttactccaagccaggtgcttggactctaaagaactctattaggcaagagtaagtggtttaattggctcaccttcattcaactgttagtatgttcctcataagtgcctgtcagagagaatcttttgtgtttcccttctaacagctggctcataaaaacataaactcatcttacaatgttaagtaaggatcttttaattcctgttttctttcctccaatttgtattaatatgataggagagaaagaaagtgaaagcatgcttctatagctggctacttcatcaaacttaatggaaccatattttgtaattcattctataatttaagttttggtcattttatctcttaaagatgaattccaggccaggtgcagtggtttgtgcctgtaatctcaacccttgagaagccgaggtaggatgattgttagagcccaggagtttgaaaccaaccaatatagagaccctgtctctacaaaaaaaaaaaaaaaaaaaaaaaagtcaggtgtgatggtatatgcctgtagtcctagctactcaggaggctgaagtgggaggattgcttgagcccaggaggtccaggttgcagagagccatgatgatgccattgcactccagcctaggcaacagagcgagacactgtctcaaaagacacacaaacaaaaaaatatgaaaccctagctaaacactgtggactcaaaataacctgtgaaatcacccaaccgtagtatttatctatgagaatgtttcaaagggagatatgtagttgtatgactatttcacgcagatatttgttattaataaaagactttgtggtcagcatgacgtgttagctacagttgaatccatgcttctttacattttgtggtttggttgttgtcgaatttactttccatgcattatttccaaatatatacttattatttcatcagcttagaatggtttggatagaaaaatatatcaaggtctcagaaatgccccccattaacataagggtagccatgacttgaacccaccccactggtttcctttgtctttctccatttctgattctctttctctgtggttacctaggatatataaattacttgactttgaaattcatgattaactcagaaagttatagctagtgattcacaatatttgttttaaaaacagtatgaagaatgtagaagcttggtttttaattataataatataaattagtatcattttatgtactcaaatgccacacacatatgtataaggcattcctatggaataatcttaacctggttctttgacaatttttgtaattcattctctagtgaaatatttccccaaagtgtatccacagattactatctcaccaatatgcttccggaaaaaaagtgccatggtctaataagtttaggaaaccttgcacattctttttccttgggatcaatcattagtattagcagatttagcactaagaaatcctgtagtagagaaattcatttacttttaattcagtatttctcaaaatcattttaccctattactcaaatccctgcttttattctgggaattgttacctctcctttcctttgcatacacttgagaaattgactctagaaatactagccttatgaaatattgatagtaattgctatggtttgttagactcctccaaatctcttgttgaactttgatccctagcattggaggtgggcttaatgggaggtgtttgggtcatgagggcagatccttcatgaatacattaatgccctccctggggtgggtaggaactgagtgacttgttgctctattagtttctgtgagagttgtcccccgactcgccgcagagctggttgttaaaaagagcctggttcctcttccccctctctctcttgcttcctctctctccatgtgatctctgcacacaccagctccccttcaccttctaccatgagtgcaaacagcctgaggccctcacagatgcagatgccagatcattgcttcttacacattgtgtagaaccatgagccaaataaacgtcttttctttataagtaactgagcctcaggtattcttttatagcaatacaaatggacgaagacagtactgattatttgttgggcatttcctatgtgcgaggaactgttacaggtattttggcagttgtaatagcgaggtatttattttggtgctttaacagagactaaaatggctgctttaaataagattgattatttctctctcacatgaaagcctaaaatggtgagcagtgtagcaacttagggcagcaatctttgggtcatccaaggcatcagataccttctgtggtgttgtttcaccgtcctttgaagtgttcctttcttcataggttgaaaccagctccttgtacctcatctggtcccatccctaagaaaagagaccaaagagccatccttgagaaaagagaccaaagagacatccctgagaaaagagaaaataaagggcaaacagcttcttgttaagaatctggtctggattatgctcatagctcattgtccaactgaataaattgctcaatttattgagctcataaattgctcaatatgacatggccatacccagcttacaaggaagtccaagaaatagtctcttattggggaacatttgctctcctgaaacatagaaggttctattatttaataggtagaaggaaagaatgagtattacaaggcaattagctttctctgctgtgtttttacctcattaaatcctacctacaacccatgaaatcagtactttgtcttcattttaatatgagaaaactaagatacagagaaagtaaaactaaagtcacgtagcgactattcgcttttggttttgataccatgctacctaattccatagcctgggttcttagctgatacacacagttgcaatgcctttccagaaaatttctagtagtttccaccattcctggacctattcttttctaactttaaaggcaatccatcttctaagtcagtgtggcagagactctagtttcttcacccaaaccatgttctcctgtctttcttgggctcatgtttaaactatatttctcatcttctcttaggtattaccatatgactaaggtctagtaaatgcaatgtgagaagatctgttgtataccacctccaggcttggcctgtaaaaacttcccatggacatgagctcctccatgccctttcccctccagctagatgaattggaaatgacacccaggacaactggaaggccatatgtcaaaatggacaaggcttgctcaccctgaattctagaataattttgtggaggagaactaccctaacaatctgttttcccacctagcaaaaaaaaatgtgaccacaaaaataaacttctgctgtgtttgatccatttgaaagtttttgatctattagttctagcagttagcttcctctaaaaaatacaattgattaccatgatgtcatggataacaagttggcaacctgggtcaaagtcctattcttgtttttttctagtgataagaccttgggcaatttattaaatctctccaagtctcagttttctcagctttaaaataatcttcaatcatagtgttgttctaagaagtaaattagtttatcttaaaaatcctattccctgttaattattccattctagcaatcaatttgtgcttattctagttgtcccactgtttaaaacacacatgccttagtattatgaaaacatttcaaaagaaatatgtcttagatttctacatttatattagaaaactttcaaatttatacttcatgccttttaaaaaaataatactagtaaaatgaaagaatatcagttttggaatcattccacagtcctggataaaaatacctgttagaccacttactagtggtatcatctatgtgagactcaaattcagcatcagtaattttggaagaatggtagtcctactttcagaattgttaggattaaataaagtgctaaaagtctgtgaaatctccttgcacactgatgatttcccttctctccccaaatagatttccatatggagcacttttagtcatttttgctggactgcaatcacctttctttcttcaaatgttaaaactgaacagtagtagctagcaatttggaatctctagaaagaagttttttttattattatagtgctgaagctcagctcattctctcaaggagcctatggatttggagtgcatcataagggaagaagttaacctcctgctgtattaccagagaccaaggacaaatgttggttgtcacctgcctaaccaggcaagtgatagtcacagactgtccatctcacaacaaaacaatgctaattttgttgagggatagaaatgttgtagttgatctcattttctctagcacagtgtccctttttgaatgttccttctcaaatagggcatggtataaactctgcaagaggggagttccatttggaagacatgtaggcaaacaacattcaggctccacacccacttcgcctgctgagatttgacttattacacaactgcagatgctggtcaattagtttctcatactcattcgtatcacagaagggatgcagtggttataaattgcactgattatgcacaccttggcttaccctattgttgcataaaaataggcaaggcatgttagtcattgcatagtcttttcagtagaaaggaaaagtgattgagaaacagcaaggaaaattgtgtttacagctaaggtttttgttttgttttgttttgtttccactccgttcagtgtgtatataaagttaatgcatttttaacttaacagcaaccaacaacagcttcactttgagtgcatgaaaaacactggggcttaagtgttgatttgttgccaggcatttcctttgggaatccatgtaggctgatcatttacctgggaaatcgtgtgtgtgtgtgtgtgtgtgtgtgttacctttacctttgtaagggacatcataaaacctcaatttcctggtgtgttccagttaattttctgctttattgaatgtcactctgaattccctatttcctttaacttttgtgttgaaaaatcattcaaaagactactgagccattttcttcttcattaagaaaaatattgggttagacttaattcttgatagctgaaaattttggagcattgttttgtttgtttgttttacatttttgaaacaaactattttgagaccgtaataagaacaatggataatcttcccagaaatcagagagagaaagagagagaattctgcataaatttatagatccttgcagcccacatttgaggccccagcaatagaccccaggttaagaattcctgccatagagtgttttgacattatcattctaaatatttaattttgtccaaataaaaatatagacagagaaaagggaacttagcaaaaatcttcatttacattcaaaacaattcaaggtgcattaaaatcatgaaaaactttgttcctctataggccagggaagtttcttgctacttatttcctttattaaagtatattttattgatttgtctttttcttttaaaaacagaatatccaatgggtaagactgaccaaagatttggggaagttgattctaaataggtgagctgtgttttaagagttcttcttagtactcttcaactcagcatgtggaaataaatttcaaaagcttttcttaatttcacaaaaacaaatataaatagttatggggggaaataaacaacaggccaaataccagatggcaactcaaagcacattgtctgctctcttgctctaagctactggttctcagtaggggtgggacagctcccaaaagggggtctttgggaatttgtggtgggtttttggtagtcacaatgttaagaggtactataatagctatttagatggcagagttaggatttcctgtttctttttctttttggtatccctcatgactatatagtctccccaatatattcacatgggtgaaaatcctattcgtaatgattgaactcaattataactccatttacagataaacatgcacaaaattttcatggttttaatacactgaattttccaagggtgtgtgaaattgctgtacatattgacagaagattgttgtttgatttggttaagaactttttattattattattattattattatactttaagttttagggtacatgtgcacaatgtgcaggttacttacatatgtatacatgtgccatgctggtgtgctgcacccattaactcgtcatttagcattaggtatatctcccaatgctatccctccccgctccccccaccccacaacagtccccagagtgtgatgttccccttcctgtgtccatgtgttctcattgttcaattcccacctgtgagtgagaacacacggtgtttggttttttgtctttgcgatagtttactgagaatgatgatttccattttcatccatgtccctacaaaggacataaggaaatgtggcacatatacaccatggaatactatgcagccgtaaaaaatgaagaacttttttaagagttatttttcactttagaaaatcagctagagaccacaatgctgtttatggtattgaagtccccatgagaatgcacctggatcagtgtacatttgtaatgatcagattcacagtgattccatgtgtaggtataagcttttctctacttcaccatgtgtccttgtatagttattgataggggttggctgtggccccctcccaaatctcatcttgaactgtagctctcataattcccatttgtcatgggagggacccaatgggaagtaattgaatcatgggagcaggtctttcccctgctgttctcatgatagtaagtctcatgagatctgatgattttataaaggggagttcccctacacaagttctctcttgcctgccaccatgtaagatgtgactttgctcctcatttgccttctgccatgaatttgaggcctccccagccatgtagaactgtgagtcaattaaacctctttcctttataaattacccagtcttgggtatgtcttcattagcagcgtgagaacagactataacagttatcctgcatcttaacatatttcaatattatttattatatacttatatataataatataaaaatattcattgtgcatttatatatcataatatatatattatgtaatttttcattctgtcttataatttattctaaaaattatatttttaagttaatttataacttattaagtcagtgtttctttaggaaatgtgccctccgtcaaaattttattctttttggtctctttgctagtatgctactagctaaagaaaattcattcccactaattctggattcttatagttattcacagccatgctgttaaagagacaagtgaattactaccttctcagagttgaactcaagggggaagtttgactattggctggcaaaataaagtagtggaaatttatttcttttgttctcaataaaataacctgtgaaccatcctaaaactaaaaaaaggaaattatttatgaagagaagttgtatcatttaaattcgttttctctcttttccctttatttcagaaaccttccataataaaaacttggatataatgaaattttgcataaatgacatgtgacaacctaatttagtggaagccagggaacctgctaatactttaacttcaaagctcttccattttattccttcattacttttcctcctttcaaagcattctttagccatgcaccaagttcgaacaatgacgaatcaaatcctcagagccaagaacaatgttctaatatttccatgcaattaattgctacttcttggtgagcatccagtatacttgattctctcatagaagattctccaagcctgacactcggttgaagtctgaggacttcactgaggacaaagagggatcaaatcttcccaacaaacagtgaactcaccatgcaaagtgaatagaatcccctaatcaataaatcactaaatatttatggagccccgaaatcatattgtgacaagatttttcaaaaaaaaatgtagaaactaagttatgatacaatcacatgtcaggaaggtatattggagtactacttgtccaggactccactgacacccccttgtgctccctatgtcattttgatgtaccaggccattcactgtatctataacgtgaatttttgcccctattttcaatgtcccccatcctattagcttttcctttccagtaaacttctccaaacccttcctcagtgtttcaaaggcaacaaaagttatcacaacaaaagtaactagtatttcttgagtgttcacagtgggctggacaagcaaagtgctttacctgcattgcctcagttaattctcttaataacctatgacatcagctctattattaacctcattatacacatgggaaaatagacactactatgggctgaatatgccccctccaaaattatgttgaaactaaatccccattttgcagtattaagaggcagggcctttttgagtggccagccttcatgagtggattagggccttatgaaggggctggagaaaactaacttaggccctttttgcctttctatcttccaacatgtgaggacatagcatttgcaccttctaccatgtgagaacacagcaagaaggccctcaccagacaccaaatgtgctggtgccttgatctttgacttcttagtctcagaactgtgagaagtaaatgtatattatttgtagttacccagtctatggtattgtgttatagcaacatgaagccagacagaaaaatttacagttttcatcacttggcagaggtcacataacaggtcgatttgattctcaagccgtctttactattatgcttacttggcttttatctctgtagactttaattgctgagttatctttccctgagtcattgctgcttcaaatctcagtctttaggaatcacttctgtaatctgctgattaattatgcatagatcataaaagttatttaatccagctgctgtccagagtcaatatcactatcctactcaaaaatctgcaacaatctaccacgaaaaatcaattctaaactccttagtctgacattaaacagcctgataatctgatccaatccagcctctctgcttctacctatcttgtttacctgtttgttgattcttattcaattgcttccttgatggaggactttcccacccactccatcactacctcttgtttctgcctgcacacatcatttccccaagtcttttgataagaaagatctcctttttacaactatttctctgctctctcctctccaacatatcttcctgacatgtgattgtatcataacttagtttctacatttttttgaaaaaccttgtcacaatatgattttggggctccataaatattttgtgatttattgagtaggggattctattcagtttgcatgtggagttcactgtttgttgggaagatgtgatccctcttttctctatgcttccatcatgacctggatatacttctagtatggccctttctaattcttcacatgcatgccttcactggactgcagactccaagacaggggccatgcagtattcatctttgtgtctttccagttactccacaacaatttattgagtgaataaagaaaatgctgagaaacgaactcaagaggttttgtagatttaataccattgctctgggtatcgcaaaagataatggctattaatgaattagtaccccacttcccaccacctcaccctgttgacatagtatgatagaatgtgtaaccacttaatctaccttaagatgctattgggcaacaacaatgtcttgactttaggggctggaaagcaaatagtatataatgtccaattgctcttgtttggggcagagagcacagatttaagaaacaaggatacaataaaatgaaatttggctgcagtacaaggttaatgtctctcctcacctcccaaagagtaccaagggatcattcattgtcacagctgttggggtttagagctctcttctcatccaaatgccagtactttccacaaaaagctcttccccagggatgccctaataagccagtgtgtcctgtataggtgagacttgccctggctgtctctatccaagtggtgacataagctcatctaaagcctttcattaatgcaaacaatgacccagcccatggtggcactgattcttgaagctgaagacttggagaaggagcctgattttccatcacactgattgttgttttcagtaagatgtttagcttttcaattttctctctgccaaatacaaattagtgtatttccaacatcccagagtcttagctgtgcattgccagcttccactgcttctccttaattaacaaacagctgtagaagagcttctcaactgacatggggggaagagctctaaggaagatatggactatgtctcatatcttcaaatcctccacagtcatctcctgttagatcaccaagaagaaatgcccagtggagacacttcagttcaatgaaaagtttatgactagttgggtttggtctccattttgtattaatgtagttgggttcagtctccaatctgtatgtatgtagtttcctatcccagagagcaggacaagaccatataagctctatttatgtttcctttgactctttagctgaaagcctaggatgtaggacaagtggctaacctgttttagaactttcttcctaggctaacattctgaacttggccttgtggattttacctcttaaactgcaccaaaaaccatggaaacaaagggcttacagcagtgttagcctaatctgagccctctataccttcctatactgtggccacagcagtaaagctacgtggtcttgcaaaagaccttccaagagaaggttggctacagaccttgcttatcacaccatgaacctgaggaggaaagaaaatactcacaaatagtttagcccctttcataaattgttggtccttaatccatttttgaaccctactctgttgggtggaatgtgtgtgtatctgcacgtgtgtgtgtgtgtgtgtgtgtgtgtgtgtttagaaattcaaaaaaaatgaggagatcttggtcttccatagagggaagactgcattatcaatagagtctttcttagcagaggatgaaggctcctgtagctcctaatcttcccatttgtgcacaaatacgtgaattctgattaggttgaaatcaggaagacactcttttgctgcttagtggccacatctagagctaacaacattatcagtgggatggtgattcatggtttaagaacataccctcgccattccagctactcgggaagctgaggtaaaaggatcgcttgagcccagagtttaaggctgtagtgtgccatggtaacacataactagccactgtactctagcctgagcaacatagttagaccccatttcttaaaaacaaaacaaaaacatccttctcctcttctcctcccccagcaattctggatggctcatctaataaagtacatatattttacctaatctagtcaaatgtaatgacacaataagattattattattctccaatccctgctctgcaacatatttggctgaacatttttggctgcaacatttttggctgaagagaatgaggtttcttcctccctgaacctgggaactaacatgaggtgttttcttccacttggtggagctgtgcacatgtgtgcttgcggagaaaaagaagagtcccagcaggccctctactccagctgttggagattgagctttccagtgcattatcctggctttatgcagtgatgccttccccctgatggcagtaaaattttaattagagggcaatgtgcattcctatataatggagtgcacacatggcaggaagttaacaggacacgtttgcagttccagtttcattgtcaaccagctgtgtgattcctggcaatttgctttattttgttgtgtcacagttcttgactaggtaaactggagagtcatctctggtctactttcctcttcagtttggtggaagtttcacgtaaaattacatgtgaaagtccttgagaattgaaacaatgggcaaatctatagcagaatgcttgttgaattctatcagctttcccaaggtgcaggctgcccatgtttagtctttctcactttccaatccattttccacactgcagccagcgtgttttttctcaatggaaatctgatcatatcaacctcttttttaaaaaaaatcctaaatatcttctccctctcacagaataaaaatcacaattccttaagaaactgtcaaagccttctcaatctgtgcctttcatctctgaccattggtatctttcttctgataggataaaagttcattgaatgttcaagccttctcttttgcttttcagagcttggccatgtggttttctctgtctgaaacaagcttcccccattcctttctaggctaactcctactcatcctccaaatttcagcacaaagtcacttacagtgggaatgcttccatggccctctattagcagcctctgatttatgctcccacaatagtcggttctgcctctggaccatgttttatcctattgtttttcctccataagagcacagtcataatctgtataactcagtgttgtaactctggcagctagcacaatctcaggttcataaaaagagctcaagaaatatttgttgaatgaccaattagatggcatattcatttcctagggctcctataactaacgctagcgtggtgccttagaacaacagaaatttatcctgtcgtacttctagagggtgggggtctgaaatcaaggtgttgtcagggctgtgcttcctctcagattctacacagaatcttcccttgcttctttggtggcgatcagtcctttgcatgctgtggcttgctgctacatcactctaatctctgcctttgttgtcatatagcattcctcctgcatgtctctctttgcacatggcattttcctcttataaggaaaccaatcacattggattagagcctatcctaatggcctcatcttaacttgattacatctgcaaagactctatttccaaataacgctacattcacagatactggaggttaggactttaacatatcttttggaggaggatacaggtcaataacagattgctaaaccaattaactaattactaattaatataaattatgggtggaaaaagcttccccagatcacgataaaaagctgtgtcgatctaatcaacgtgcttgcttaaataaggcatgtgtataatatatatgcatgcatctgtgtatatatacatatgtacacatgcattaattatgttgtgcaaaaaccccaaaggctatttatcccaaatagaaaatattgtgtcgtttgtctaaagcactttaaagacatctgcctttttcatatgtaaatttcttggatgacaagaaattactgctttgctagcttttaaaacactaaattatgataatccatcaccaaataaactataagcttctatcatttaaaaaatgtaagaactctgaggttagtagtagtttttagttgccattgaaagacggcagtttaacgtcatcgtttattcagatttccaaattaaggagatctctgtggttagacattcctttcgttatcactctccttttcttcaggcctgtcatttgtccattgatgtcttttccttccaaatgattcatgtacacattaggtcttttccctaagcctcatattatgaaaagcaaagctacatgaaaaaaagcaaatgattgctaaattatgtcctaatttctagcattcagcagtgctaaaatgaagcagagaatttcacaaaattctcagataaagtatatttttaccaactaacattgggtaaaagggactgagatagagatttatttttattattattaataactttgaaaatggtgcatttgggaaactacttactaatgttcattggaattggtggtaatactgaggtcaggatttaattccaggcattacccaaaaagtccatgtttgccttgtttcaagcctagagttcttaaaacaatccctgcaaggaaccaggcataaattatctttcagattggtgggcgtaggaatctatactgcgagctaactgtgctgaaatagacattttagaggatgtgaatgtctatctcagacaaaggagattacaggttattaaccaaggcacttttcaaatgccatccctttgggctttcttacttagagtttcagattcatttagccaaataccagccttatcccttccctaattttcctaaatatttgtggctgaatatacttttagctttaggagtgcagaagactttgagggaaagaaggcagggttgaaaaaggatgagtttcaggtcattacattgcttcaaggcagtttgcagcttgcattcatatttttaaagtctaaattagagccctttaacaccaactatcttgggcacacatgtatgtagaagcataccaccatatggcaaaaggcagagttgctaaaactataaataacaaagaggaaggttaattagcaaattaattagctgaattctatacaaggtactaacaataccttaatttccagatacatttgttatcaaaaatgtctaccttaataaagctgtggggacttactaagtgtatttgctgggcatggttcccagttatgaaatattaataccttgaaaaataaaacatgcttatgaaaatgcagttatgctctcattttcagaggaatatgtaagtgaggaataatatagaaatcctaaaacaactggaaattcagactaaaatgaagtagactgtagttttgtcattgcatgttctgctcatactaaagcacctatcctcccactttaccttctttaaactgcagggcagagagttatatttttcatcttcatgttgagtagagaatccatgaaaatctaatacccagttatcactcaagtgtgacaaatagaaaggagcttcagaataggatcttcagttctaccaaatgtctctgcctaattacatcaatatccatgttgatgagtgtacaaacctgtggctaattatattttcacttcttctaagggtaggtacactaatgtgtgatcccacagaaaagggcatgaaagtaaattaaaggtgtgtgccatgtatattaatgcctttgtggttattattgctattgtcttactcccatggatattggaggattgttgataagacacttaaatgttgataaggcacctaatgagtatcctgtgtgataggagtagtacacaatgataatcatttccttctttgtgcattagtattgacatagccactaatcaggaactgtaaactctaaacttgtatctgcagccctcttattaaaaagattcctggatttttttccctaagctagaaacagacagacaaacaaaaacaatgattaaagggcactaaaagatatatttaaaggcagaggtttttttcctatgtgtataagattcaaattaaattcctctttttggctatttggacagttttggcaattgggctgaagccactatgtttttgtcataacaggtcaaggattgcttactcatgtttgagaagcaataatgatatggcaagagagaggtaagggactacaatgggaggcttattaggaattgtgcatgcctctttcatgtgtgttgtctccaagctaaccttgtgaggtacgaattatgacttcttcctgaaggagaaaagcaagttttagattaagtgcctgacattctgatgtcataaaaagactgaaataagcaacattttagcacaacatttgaacagcccttttcttaaggataagctctttgctctacaccatactaatttccaaaaaggtgtgagattgacatatgaaacttgtacgtttatataaatgtgaatgcagcaagccagagaacagaatgttctgtagcccaggcaagaggcagaggaaatacccagtgacagatctacttggccctcgactaaaggggcgctgtaactttaaaatactaataaatatttagcttggctttttctttcctatttgctaagtcctgtcttgattctctggctaaggggtgtaagaaagtggctgtttgtgataaatagttgtgtttgtgtgtgaatgcatggaagaacacatctgagataatatagtgtttactgctttgccattagcacaatgggctgtctttacagaatatgatgtttaaatctatgcaccagtgcactttcaaatagagaattcgcttcctgttttcacttaaaactctctttttattttaattaacgaaaaagcagtttaatcatccatctttgcagctaaggaagttttacaggcttataatactgtcagattctgcggtatataaatgagaaatagacacttttggggaagaaattggccagtcttccttccttccttcctttcttcctttcttctttccttcccactcctcccccctttccccccactctctctctctttcttcctatgaagagactgttctaaaagctaggaagtttcattgatggtgtgtgatttcacaagctggattttatttcagaacacctgtcaaattcagagctgtctgaagcttctccaacatcattaccccagggctcccagttctatgcacatgtttttataatggcaggaaaaagaattcatatacgcatttgtgtgttagaatcagtggtgtgctggtgtaacaatcagctcctagagggtgaggcagggtgggtaggggatgtttagaaaaagtgggtatggagaagtccctgaattctagtttttgccaaattctgtgatgcaaatactcccaccacagccaatttcaaggttatttttcccagttacatttaatcagggccatacaagatgttacaagaaagaaaatgacaggaacccatgtggttcaactgatactcactcaggagctgagatagcatttcatttatgcaattcaaatagctattggtttggataccttagtattgtttcttccaagaaatattttcattctttcctaaagggataataatagacattcatgacctaatttaggagataatcattttttattttatcactcattattaatgcttcatacgaaaactagatttatgaaaaggcccatggattttacatctattatatcatctcctgttggtttgagaatgaaatgtttgttttgctaatatgtttttctgattaagaagtggaggcagcaggctattaaaagtttttctcaaggcagtaaattggtagactagatatcttcaaattaaaaagtagtgatttcttaggcctgttcatagattattcaaaaatgggttaaagcacaggttgaaaatacttttatgggccacaggataatttaagtgattatttttcagccacttttttttggaaaacatatattagctaatgtctgtaactttattaacttaaaaacaaaagtccagataaaagaattttacactctgccaagcagtggtgcccagcttataggtggttggttctgcatcttacattttgttacttgtaaggtctatgaagaaaggactcccttttctgccctgctcactgtcaaaatttcagtctctacagcatgaagactctacatatagaagacactaaaattttttttaaatatatgaatgaagcagttaatttaaggcagcaaagtcacgcctatacattatttctgtaatgtttaattttaagtataattgcttattaagtagataggatgcttagaaactatatttacctggaagtggcttaaaaatttccctatagacaaaaaatataatttgaagtagttcgtcttcaaaataaaggcctccagatggccagatacctttcatgtacatgcatcaattagactgtaccagaagataataaaaagaatcctattgttttaattatctcttttattctccaaggaacccctattcctgccaattcttacagacgttattaaggcattcagttagtttttcattcatttatttaaaaaatatttatcatgccaagtactatttaaatggtggagataccaaagtgaatgagatacatacaaggggccctagttctcaaggagctcacattcatgagaaattaagttcacacatgcaagatataccagatattaataagtattactcagatcattaaactagaatgaggccaggcacagtggctcatggctgtaatcctagtgccttttagaggctaaggtgggaggatagcttgagcccaggagttccaggatacagtgagctatgatcactccactgcactccagcctgggtgatagagtgagaccctgtctctaaagaaacaaacaaacaaaaagtagaaagatttgacctgagaataactagatagctattttagatcaggtattcatgaataaaataacacttaaagtgagatctgaatgacagaaagaaaagccatgcaaaaatcaaggagtagggtgtgcagatttcacagatggcaaatacctaacatggtgatgctaaagtcagcatgaacctccttctgtttcttgaacagaccacaggctggagaagaaaaggtaggaagaaggctggtataagatgagggtgaagagagaaccaaggccagatcatgggagctttatagccaggctaaggtgtttatgtttaattctaaatatagcagaatacattggagaagactatgctgaggaataatgtgacttgacttaaatttttaaaagactacctaactgtgtatggaaaatgaattgcatgggacaaggatggaaactagttgggagatgagttagaagattattataggagtccttgtgggaagtgttggtgactgttggagggtagtggtggtagtgaagatgcataggagtttctgagcttgttttggaggtagaggaggcaagatttgttaaagaactggcttagcagggtgggcacaaaggaaatacagaattaaaggataattccaaaggttccaacctgagcaactaagtagaggctggcatttactaagatgggtgagattgagagaaggggagtatcaggaggcaagattacttgttattttttagccatgtttacatttttttgagatatcttctgagtatctgagaagaaatttcaagtgggcaatttgttggacaagtttttggttcatgggagaaattaggacatggatgcaattttgtgagcctgtaacacacagctagtatttagagctaagggtctatatgaaatcacctaaatagtacttatagatatgaaagagaaggacagagcccaggggtactcttacatttacaggtgagcataaaaaagaaatcaaaagaaactctaaaggatcaaaagcaaagtagaagaaaaccaaacagccatgcgggagtgattgttgagatgttttgaaaaagagaaggttgacagtcatttaggaaggtgaggaatcaaacacagtgcagatgagggtggtgtagggagatcattctctaggtgccctttgcatttttgctcatcttacgatcagagtcactaactctcttggttcaggagttggaagatacagtggcctgttccagagcaaaggcaggttcagttgctgttcaggataatgaagataatgcctcccactgaggcaaagatcaacagagcttactgcccattataaaatattcagattccttaagcgcatggttcctctcctataatacaaacctcttgcaggtactgttgtcacctggcccttttcatatcaccctgtgaggagtggggcccagagaacctacacaaatgcaaacacttcaaccactgctattgtcataaagtccgtggtctctgacccaaagtctcatgtcccctgctagcatccatgaaacagtggcaggtgaactttgaaaacaggataggctaaaatctcagatccttcactactcttcacagatagtaggccattgtgatggtctacttgagctctgttgttgtggtggcatatctttctgtaccgatattcagttggtttgatgcaagcatggtacaggtagatgggtttatgccttagatatttaataagaatgccttaacacatgatcatatgtcttctttcttcactgacaatggcaccccactaatggagtgtgcaaatccaggaagaccagtgtttgaacgttgtggggtaaagtgccgataggtaagcccgcatatttagatatttctaagaggttctaaaatgatgaatactttcctcaatcatttgtcacaaccaaagtctatattcttatgcttagatgtcataattcatattaaagaattgggccttatataacaccttaatattaatagtacttggctaagcacagacgatcaacaacacttaattaatgaaactagttctgaatacattatatactttcagggtatataaggaggtaattacattttacagaggcatatactctatatctggtttattcgattgtgaatcaataaacatgggggttttttttaaaacatgatttctatgatgaatttttaatttaattgtaggaagctcctttaccgctgagtcaccagtgtcttcttgtataatataaagacattatggcctggcatggtggctcatgcctgtagtcccagcactttgggaggccgaggcgggtggatcatttgaggtcacgagttcaagaccagcctggccaacatggcgaaaccctgtctctactaaaaatacaaaaattaggcctggtggtgcatgcctgtagtcctagctacttgggaggttgaggcaggagaattgcttgaacccgagaggccaaggttgcaatgagccgagattgcaccactgtactctagcctgggagacagagtgagaccccatctcaaaagaaaaaaaataaaataaaagacattagccatctggagcagttaagtatatatttttctataaagcaatttaatgtagatgatattttctctctgtgtgtgcacaattgcatgcatatgtcaagtgtcgtgagattccaagtatttgacgatctgcttcttctatagacagttgggtacataaaaggagagccatgtgcaaatccagtctctggttctaggtttatacctcctcttctccacctccgctttccttgataacccctgatgcacacagccagccatcctcatccctcgagatgtggttgatttctctctatttgggtttcaggaaattgtttttcctcccttctgagagtctatgcgctgctgcaggccagtcagtattgattcaattctgggtgaatcctctctcactctttcctaagtgtatattgtatatgtagttcttctgccaaaagcagctttgtattaagattgtattaagatttaagttttcttaaatttgcaagtcacctaaaatatatcctgtgtctgctgggatccttttgatgttgaagcgtcttggagtagacaatagaggattttcatatggtggaagaatgttaggtgtccttgttggagaagagaggaagagtagagaacccctttaaagccctcttactgcctgttccttgcatctcatctctacatatttagcaatcacatctgctgatttggcaaacactaacagcagctacacagcgtcagtgaggacaatagtgagtggatttaaacatcaggggcgatgtaccagtgcaataaatagaatatatcattgtttcactgcggacagaatgtctgtgctctctatgaggatctgcatttaagcccaacacccaaggaaggcaaacatctaaagctcagcatggggtccttcaagcaggggaatacaaacaaagcatttttctcccaaaacacaagttttaggatttcatgtcaaagacatgctgccaatcagaagacagcattcccccttcttagagctggaaatggtaaccaggacacattggtatgcacaattctgctggctcagagcacacgcaagctcctaggctgtgactggcaggaggctcacagcgatttctttttttttgagacagggtctcactctgtcgcccagactggagtgcgcagtggtgcagtcttggctcactgcaacctcagcttcccaggttcaagcaattattctgcctcagcctcccaagtagctgagtttataggcgcccaccaccaagcgcagctaactttcttgtattttttttagtagaaacagggtttcaccatattggccaggctgttttcaatgtttttgaactcctgacctcaagtgatccacccacctcggcctccctaggattataggcatgagccaccatgcccagcaagctcacagcaatttttaatgcaatatgatcagacctaattttggctttttgatttcctcccttaaacctcaggcaggcactttttcaaaagagaaatcaatcagtcaatcaatcagtcaatcaacagtgagtgaatgaatgactaaattgtttgtttttagcatggcataaaataatccttaatattttgacctcaagcaaccattctgaccatatcttcttccatgcgcctttgactgagtacccagatacatgcagagtcaagttttctagatcacagccttgtcctctaattcagtgccttggtatgaaatctttcttcttctatgtcctttttttgccagatgaaatttcagtctttattcaagatcaagtgcaactgtctctttgaggaaagtcctttgaccgccatttctccccttcagaaggcaaacacctgggggagaagatctgcttaaggacctggtaactgacaaagaatggaatgggagcgagaaccgcctagccatcccttctccttgcacagtcatgaaacaaaagttgaaaaggagcctggttttacttgaccagtcataaattaccataaaataaaatgagatattaggaacctttgatctctgaaaaagtaatatgtgttgaaaagaaatatcactgttacatatagacaaataatagaaatatttgaggcatgcatttaaaatgtagaggccacttatagcaggcatattaacatgtgcatttgctttttaagaagtatacacacgtgtacctttagctttgaaagggtaagattcaatgcttgggtgatggatgcactaaagtctcagaagccaccactaaaggacttacccacgtaaccgaaaacaacctgtactccaaaatcaatgaaataaaataaaaaggtaagattcataaatagcaagttgagaatgcatgtttataccatgtagacaatgcatgataaattgttggcaataagacccatgtagctgactttggggatacaaagtagcttctgaaagaggttcctaattagccctgcctgaggtgactgcttaaggtatttatctgtagctggaatgcattgcctcagagacttgaggattcaggagctatgagtttcaaggccacagatgcagtggaatagtaaggcttcttcccctgcctggcacattgacctaactgatgagaggtgccttagggacccagcagctatggccatttatgtctagtccctcactctagaaaggaattgcttgaataccacggtgctggagtttgtagccacaatgctgaaggtcagggcagtccttcatgatgatgcatttctgtcagccatacttgcacatctctttaatgtctgcaatgtcattaagcagtggtgtatcatttttttttaatgcagaaactaaactgatactcaaaacctatgacaatttgaatccttcctgcctatccaaccttagtttttctgctcgataatataaattctccctttcagtcaggtagatagtcttcctgtcttcctgtcattcttggtttctctttgttgctcttgtcttccccacctgctgaaatgcttttcttctttctttcttttttttttttctgagaaaagacctcactctgttgcccatcctggagtgcagtggcataatgacaactcaatgcagtctcaagctcctgggtcaagtgatcatccttcctcagcctactgagtagctgggactacaggcatgtgccaccacatctggctaatttcttcatttttttgtagagactgggtcttgctatgctgcccaagctggtcttgaactcctgggctcaagtgatcttcccacttcagcctccaaaagtgcagggattacagacatgagccacccatgtacctggtttctctcttcttttctaactaatcaagtactttaagtcacaactcagggtgacaacctccacctccattgacttctccagagcatttcatttcctcttatcctttctctgcactttgttagaacttacattctgatttgtactgttgacctttgagcccttaagtttatgcaccttctctctctctctctctcgctcactctctctctctctgtctctgtgtctctctctgtttctgtctctctctttttctctgtcaattattttattctggtatttggtacttatgagaaatcttattagtatcctaaactctctcaaaacaggaaatgtgtattttccttctcatctaattcttaggaaacttcatataggaataaaaaatatgtagtagtggattgtctggtaaatgaataaaagagggatttgaggtcagtgggctgtttcaggacatgaccaaggaatgtggtaccagggcagcaacaagcttgctaaggggcgataaagtagtcattgtatataacagaggaatttgggctcaatgcagatttgccactaactctttggcagtatagaattcactagagaaatattagtaggttagttagtattcctaataaagaactgctaataccttatagagacataagccatgtttctcgtctttcgtttctgaaatgaaattttggccagggaaacattttgcatccctttttgatgtctacaaatgtggcatttgtcagatgtgagatagttaagtgtgtgtgtgtgtgtgtgtgtgtatatatatactttatatatgtatatatacatatcctatgtgtgtgggtatatatatatatatatatatatatatatatatatatgaatgatgcatggagagatatctctccatgcatccaaaatattcacaacttttcactaatatctgaataacatttgaaaaattgacaactcttctggctaaagatcagcatacacattcgttccacagagacttgtgccaaaatcttgctcagctcaaggggtactgcacaataaacaataagaaacttttataactccgactaatagaactcattgcttttccagtttgaagataaaggatgtctgcttgctttccatgcctaattttcctgatgctgtaaagctgttcaggaaagttcccactgcaggagttttgctagtaatcttcagctccgtgggaagcctttggactctgttgctatccctgaaagtggctgttcttctccatcagtttcctgggcaagggctcgaaccagctattagtgtctatttgcactgcatgaaaacaaaatttaatgtaaagacgcttatagcttgcctaccctaaaaccccaggagtctcattctgcctgaccctggacattttttgaactgatagagggatgggtatctggtgggtctcttcagtcagctcatctcagcatgttgaaagtccaaatgacccttgcctgaggatggtgaaagtaatttgtatgtgtgtatacataatcctgctttttcactatttccagtcacagattgcagagatagttgactgtgcttgttagtgtgagtgttaataactttgctatgctgatttttagacttcctatgctatatgatctccctgaagagcatgacagagcattgctttggaaaatcaatattcggcgtgattattccttctttcatgtgtaatcaaactttgaagaccaccaataggccaaatctacaagcattaggtttctaaacatattgtttagtcaggagaaattgtgttttctagctgaggtatgccagctactggtatggagaaaatctgcctagcaaattggaaggggccagaagctcaaatgctattgagaaccactcaacaattcttttttcttatacacaggattgaagcacagagcaaaaggaaaatccagctttgggatttgttcccttgaacttacaaatgattcattagaccaatgacattgtgagaatttggtctctgacaaagaaataaatgttttaaaaatagtgctaatacataggtacaaatacagaattatgtcaggcatgtatttttttaaagatagagtccagtgaaaagaatacgtgttagaatatggattaggtttctaaaggtatacttatgtctgccttcgtcttcagaaaacaaagttgtatgtacactttaagaaaggtcttagtgtggtaaacgtgaggcaaaccaaagtcctgttacttcttttgtcatatcattaaagcctccagacggaggtttcttcccattatgtgatgtgcagaatttcagatgtcagtcagcagctgaagtcaactgttggtccaccaggcctctaagctgcagcctctgtcagcttggggacagtgggatccatgtgacttgcctgctactgcccttgattgggcagatcacagagcagatggcctgtgtctagagtacaaggtgttaaggctttttttttggggggggaagaaataattcacatgtgctaatattcctggatgtttcactgataatataatatagaatgtatgaaaaaatcaaagtcaattagaaccagaaatctcctgatactggatgattctatacataaatatcttgcactaacagcaagaataataaaagttgtacaaaaaatgtctgttcttccccagaccatgagctccatggaggcagagaccttatttggttggtttactgcccttccccaatgtttctaccaagctgaacatgtatccagctctcagtgccccattgagttgaaataaattacagtgacataaactatgttcttcatcaaatgctggacaagcacgtttctcaggcaacttctctgggatcaacataagaacagggtgatgaaatgtgagaagcagtgagggcaaggacttgagcctggtgcctacctaaagtttacactccacaagtattccacccaacacttcagataccttctcttctttcaaagtcaacagtttatgcccattgaaaataaatacacacacccactcatgcccataggcatgtgtgtgctaccagaaaatatgtacatgttaggctctttggaagcagtggtagtttggtgagaattgctgcattggctcatcaacacagacctgatcgcactttgatttcatatcttgctatgcagggctcccattatctgcctgccatttgtgtgcatttatgtttagcgtcaatttctcctcccatgaggctataatctgccttgtaaggagctaaaatgggaaaagcagttagaatgatgagtccagttggagcctgctggggaacaagacagtcatcacaggccaatcggcagtggagacagggtggcccttatcacacagaggcatctggagactgagagagacaaagcaacacagctgcaagccgaccatgatctgctggaagcttcttcagtcataaagcaaaggacagtaattctgaatgacaatgtaggaaaacaaaaaagaagaagaaagaaagaaaatggttgagcccagacgatcatttttagttacggatgtcacaaatggtgattgctggtagtgaagtatctgaatctgaagaccagctgtatatagtatgtgtgtttatggaggtgtgtgtgtgtgtgtgtatgtgttggagaagacctgcatgcctagttgtagcactagccagaaattcttgtttcatcgtctagaatgtggccagaggtttgcctaaattctcataagtccattactgttcttctataaatcaggctgcctgttttgcataattcaccaggtaattcacctatcactaggcaaggcagctgccatggagtgcatgcaggaattcccttcattgactcaggctggtaccattctcagcatttttgctgtttatatatttttattttggtctcggttttcctttatctaaaaacgtcaagctgggatggatccttggagatgctcgcttaaacaagttcattacacttaaaatagttttacaagcacaagtgaaaataatgtaataattgcagcagattcttagacctccactggatcctgggttgcctgtttcctttactcagttctagtttctaagtttattgctgggttttgatgtatgtatgtgtgtgttaattttttaatatagaatatgaagtttgagggaaaactattgcccttattcttgtcgatttgttattcgatcttttcttttcctctttgttggtatgtgaggagttgcagagcaaagctgctgagatcttatatttgactgaggtttcacaagctctgcgagatatcctaatcttcagagtgacacctggtttagccaaccacgtggaaaaaactaagggtttagatataaccacattcaaccacagcctttaccttctcccctgtgctttgctgtatctaatgacggcccagaaaggtgcaaagagagacttttcagaaaaagcataaaaacaatcaagaaggaaaaaattgcttggttgttttctgagatacctgaaccagaagcaattgagtatttaggtgtaactttctatgacctattagaatgaatgccattcttatggcttaaatttttttcaagatgaagagggcacttatatagacaaagaatatatttcccataaagatatattagcacaattctaattaatcttaaatctaagtttttgttccccaagtccaatactcagtctagaacatatgcccttttctgtgatgcctgctggccaccatgtatgatcatggtatattgtgcattgtacaaagtgcccagccaagggctgaaatcaactagtgctctacttatgaggaattaatccaggcatggcgctgtgtctaccccagaggatgtgccttttctaattttcgtaaagttactgcaatgggccagccctgaagatatacagataacagaatcctatgacttttagatgacattagccatcatgagagcctgcctctctgtaaatggtgttagggtgtttattatcagcagcattgggaatacagttgttttgatgtgttttctgatgccctgttctaaaattcactacttctctgcaggctttggaaagtgggagtgtaaccactggtcctttgggttctttgtgaagttgtgctaaccataagatgccgcatactctcctagtgaccacagtttttatgggaggtgatgtacagcagcaaaagtctaatgtaaatctcatgttggttcttccagagcaggggcagctagagtctaataatttcttgggaagagtttctgtacctggaaattttagatgtatatcaaggacatgtgagcaaatgggaaatctaattgcccagtgcctctggagcaaagtgtagagacagaaccagaatgttttttaccggcacatttctgtattaaactaagggagggaagctctttaactatatgggaactttttctcattggttcctttaagtgtcttaaaaaaactgatgtcttcctaagagaacttgtgaaaggtggtaaaatgtttaattggaacttaagaataacttcctactgaatagctttgttgatttcactttcctgtggggaaaagatagacattgacaaaactgtttcgatgagaattaatcatagctgtagatttcaaggtatgttatgatactaggtttcatctcctggatcttcctcctctacattaaaatgattagaatgataaactcaaggcatattaatgatccctaatcaatgtaaaaaaattatcatttctcttctttatgctgtatttactgtcagaaatacagacatacatattaggaagatttttcttgaagggaattggcacaaaagggttgagacctttaattaatcaaaaaattgaccattccttgaaccttgattgtttggtatcattaacaaaggacatgagacaacatgttcaagctttataatttgctggaaataatattttctttttttttaaaaaaagcaattttttgttgtaattgttaatcttactatatatttgtctcctgaaaatggtgttatttgccactccttctacgtattaattggtgtaagctcttaagttatataggatagttttaatttctccaaaaagctgcctaaggaaagtaaaacaccataaagaaaagggtatgtacccaagaagtagcaagaaactaaagagaagagattgagatattatcatgagaatttaataagagaattaaatatctagaaaaatgtgtacatacttagaagtagtaaacattaatttcctttcttccatctatagttcacctctagatcactcttttctttctttagatcatcagtatccaagattggaaagagtaaatgagtgttgataaatgggcactctcttgttctgttgatataagcttaagttggggtagcttttctggaggactgcttgacaatatacgtcaaatttatattgtgatgtcctttggccatgcaatttacccttcctggaatgtacgctaagtagataattgaataagtgaaaaaccaaatgtcttcataaggatattcaccatagttttgttgaaaattatttacaaattggaaacaatctaaataaatgtcaatacaggaatagtttaattgcatatagaactgtacatacaatgtaatcctatgcagtcactaaaaatgaaaatgtataggtgtattgattgccctgggcaattaccataacgtataaatgaatgagtaaaagtatcacagaataatactcttccctcctaagtaaatcctcaccaataaatcctattatacaaggcaaaacctgtatattatccctatcccctaattttcatcatctctcatatctaatccaccatgatgtctttttcattcctaagtgtgtttcagatcatccacttccctctaactctatcactgtcttctggtccaagcttggtattcaattaatacttgttaaatggattctgaatatgattccattcataacagcacacctatccacgtacgtatgtgaagacacaggtgcctagagaggtgttcactgaactactaatggtggtttcctcttctgtggtagaattcagcattatctttatttttttatttgaatttctcttgttgtttgaaatatttttaaataataatgtgtaatttacccctctccaaaaataaaacttataaaatggggatgataactattattctacctttctcactggataaacatagtggtcaaataaacaaatactcgtgaaagtcttttataatgtgaaaacaaaggtttttttgttattatgtgcaataataataataataactatagatactaaaatttgttgaatatatttcctcagtattttgagtgtcttaactcatttaaatctcacaataagcctatgatactataaatatacccatttcaaatatgaggaaactgaagcagagacagacgaaataatttatccaggtagacacagccagtagagctgaggcaggatttgaccccacacaatcaggccctaggacccaagccctaaccactgtgccaaaatcataatacctgcaggaagtggcaaatgttgaacttagctccatatatcagactcttgccactgtgaagcccttacagataatttcttttcttttttgagacggagtctagctctgttgctcaggctggagtgcagtggcgcgatctcggctcactgcaagctctgcctcccagtttcacaccatactcctgcctcagcctccctagtagctgggactacagccgcccaccaccacgcccggctaattttttatactacctcagttaatttagaaagattttcaggcactgatgaatgattttgggagtaatcccaagccaaatgacctctgttggaagtaatttaatagatgtgtttaaatattagaggtgggtgagatggtgaagaattaacatttgaggaacatttggtatcctctgggcaatatgtagacaccctttcaataaatcctcacaacaccccagtaagttatgtgttatttgtttctattgtaagttgcagtcatagataaggaaactcagatatgtattaagtcatttgctcaggtctttacagctattaagttgcagagttgggagcccatctaaactcctaagatcagggtctggatcacctctattattttacattgggcatctatcatccaggacctatgtgctgcaggaacgtaattaagaatgactttgacaagataaatatttggggacatgaagcctgatcacagagtctaccagttatgtggacttgggcaagcaacaccatgaacctcacttttttcattctcaaagtgggactaatgaaatttttcctgcttctccaaaagataattttagtcactctgttggtgagttttgcaaaaacattgtagtataagccttcacaaggaattacagagaagaagataagtcttagcattcaagaagcctggactgtacctgtctcaaaattattttatgctaaatgcagacaattttctctatttggagtttctttcccatcttagttggcctcttctcagttttctgaatgaagcgtgcaccctcggatgtctggcctttactcctgcatgtcttccggtctggaataccttcccctccctcaggaacttaaccagcttcaacatgcagccttcctgaacactccaacatgaagggatgcccttctgttctaaatgtccactgcactgaacaaatcatttaatacaaatttctctgtagtttatacagaggatttgtgtttatgggcttatatgttttctttaaaaataagttataaagtttttgatgctagagcattcttttgtatccccaggagacactcagaatatatttgttgattgttttgattttaaagaaaaaggcggaagaatgaggtaaaatggccactatctgtcaggaacttcatataattatctctgcccagaaataaattaaaatagttttcttcagccagttgcaatagcttatagaaaaaaattaccttccctagatgtcagtgtcccaatttggaaaacagagtttggtcatatattttgtccgctgttgtacaacctttagaaacataaaattcaagaggaatactaaataaaaggatcaatcaatactgagttcagctttaaaattatttcatctaataatgctggttttcttggcagcactagcaagggctagaattttttaaaaatcatccttatatatgtattgattgaatttattaaaatgctttattaccatatccatttgcttataagaaggcaccctgatgtgtcctatatgagtttcaaaacacaattaaataaaaccatgcagagcaacaaacactacgtagcatttacaaactgcatttgtattcatttttatgtacatgaagggaaaaaaaacccaaaaggttgaaagccttctggagtgataaatgccacaatttagtggaaaatacacattgtaatttgagaacatctcccactaagagtcagtgtagctacagggacaagaagcctggtgctaaattgtctgaacattgatgtcccttcaaaattcatatgttggatcctagtacccagtgtgatataatcaagagataaggtctttggggaactgattaagtcatgaggggttctccatatgcatgaatgggttcatgctcttataaaagaggttgaagagagcaccctagggcctcttgcccttctgcttctgccatgtgagggcgtagcaagaggcactctttatgaagcagagtgagcccttgccagacactgaatgtgctggcgccttaatcttggacgttccagcctccagactgtgataattaaatttattttatttctaaatgactcagtctaagaagttttgttatagcagcccaaacagactaagacccctggcccacaggctcctgagcatctcagtgcctttgaggctataaaggacctcgaccttcactttcagcacatgttcaagtaaaagagaaaaatgtgtgtaaagaagtgcccatacccaataaacatacccatatttattgcaaattatcctctaaactgtttcattgtggtcaaaacccaagttataaatttttagtgtccttttaagagttcagtatttgtcaacctacggtcaacatttgcatcaacaaagaaggtaagatatgttgtgttatctttgtcatttttcagctgtcaactaggataggggccagaaatagcaaaactgtaaacttgaaattgtttcaggaagaagtgtaatagctaaggggtgtctatgaaatggaatgtatatcaatatgaggtaagacagctggtaaaaaataaaaaattagcaggaggggcaccggattcatgtaccagggaaaataatgtcatgttcattgcccagagagattcccaggaattagagattgagaaatattatttcttgacatgtctagaggctacgtggatagaagttctggaaaatgtttgagataaaggccaataaaaagcaaaaggacctgaggattctgtttattcactgaacagagaagctaaaaattgggctctcattttggacaaaaataaaagccatagtaataagtaaaataaaataacctaccaggtagcagagctcttagcaaaggattctgcaagcaaaaggcaggtgtgaattgggaaagtgagtctgggattgaggtgaggtggggttaggtgtagaacagggctatgaaggtcagggcagtggaaggtttgattctggaaagcatggcttcaagggaaaacttgagtggtgaacgggaaaatctgtgaggatcggaaatgtaagtctctatacttgctggggaaatgagcaagaaatgaaagggagagagccagatgacgcagctggaagcagaaatctgagcagggggaacctggcaacagagaggaggagctggaagaacaggggcagatcagatctagagccaagctgtattctctggccccatactttaatattctacctatgaggcgcagtgcctttgggtgttgttcataaaattccagtgttgaaaagggtttcagacattgtccgtgaagctcctctatccatcaagccctttgcaatatttacagtaaggaaagtgggagcgcttcagaaagagagagagagaaaaatgaaaattcctagccccatctagacatgccttatcagtgagttaggcgaagtgcacaaaatttaaaagtaagattctagttgtttgtattttagctattcacgttgcatcacaagagctccacaactggatttaaataattgtttctgccttagcaatcttaagtgtgcatgtattgttcagctattcctttaggggaaagattgctagatgggaataaaatggaaatgctgttttctaaaagttgtggtcttcatagggagatagctcttcacttcgtgtgttagtgatgaacatttgcaagctgtagagctgtagagaacactttgtggttcttctatttgaagaaaccctgatggctttgtcacatattccaagtttaacttttatttttaaagagtttatacatcatatttgaaaaagactcaaacatgtctagagttatatgttagacactaaacatacttgaaaaagatttaaaaccttggttttagtcatctgtaagtactctattttaaggacaactaattaatacttataactcagataattcaggagacgatcaatgattatgaaataacttcctatgacatacttttaaatagtaaatgccttcactgcatgtaattcacacatcaatatatactaaactatttccattaatatagccagtctccaatttacaggaagacattatgtttcacaagttgattttaagtgaattttttgtaatatagaaagaattgtcccaaagagtgactgctgaactggttaaatccacaaaaaaaagcatcacatgaattcatctactaggcaaatttgctcatccactttcaagtcaaaaaaaagttttaaattagataaaaacctgtgtatcccctttcttagtaaatttgcctgctgtgataaatatacacgtgcacacaaaaataggcatgcatttttaagaggagtagaaacccatttgaacttgtccaggaactcaagtttagaggctcaaatgtagagaatactaataaccacctataataattcttttggagaaggcatactgtattatgcctagtgcttaataggacaggggatttttcatctctcatgtgcctgggaatgagagccaggggcttcccccaattctaaaaaaattagcaattcagcagaatctacagtggggccaaattgtggctgggatttgggggatttcatcaaagtgggtcagaggtagaggtggaagagaagcagaaggccggtgggagtaggatacagtacaggggcgagcttccagctggctccatcagttgaggaagaagaagcaatcccaggaggtccatactcttgatattttatccctcctctcactaaggacagctatgccctttgtgatctgccctagactgactttttaatacagagaatgaaggccagtacagaaagcaaggagagaaagaagagaaatagatgctaagttgtccccttgaggaagaatgagggaaaatggagttcctgccaccctagtctattagctgacattgttactcctaattcaaggtaattattggtatgcaaagaaagtatgtattaactatatgtcaaccagtaactccctgaaatccacttgatgatagaaaattagtctatggccatatcactgtgaatgcaccaaatctcatctgatagcaaaatattgcatacatttcttctagaaactaagaattccaatgaaaagctatgaaagaatcctacttaggtctgaatttccatacattcctggtatctcagagggtggcaaggttagaaaacttgagaatctgtgggcacactagggatgaagtgatagtattctttgttggatatcaaaagaaatctaagcaggagaaccaaaatccattggtggaaccaaaaaaccattggtggtctgaaaagttaggtgggagaattgaatagcttagttctagggatcaagtaaccaccctgactattgagcttcccgataagacaacatgatggaaactacatggtttcatccaggtgctgggaacaagtcctactgaacattggcttttggacaaataacaggcagattctttggtgaagctttgttcatctgaaactcttccctgtcctctcttctccacttcatttttctgatgaggagaatggaagtttgtataaactagagtgctcaagcagcaggcagtggaagaggcaagacctccaagtagatctgcaagctctgaaccaagtgacctatctctaggccatattgaggaaggccaatgcagttttgcgatctctctacctcttcatttttccttttcctcctccccttccccttttgctctccccctcttcctctcaagagagtaatgtgctagtagtacctgatggtaccccagtgcttcctgccttcctcccttccacttcctgccttcctttctcccacttcctgccttcctcccttccacttcctgccttccccagtcccacttcctctcttccttcctggcaccccccagcactcccttccctccttctgttctccagtaccttcctttcttttcctttgcccttctctcttcctccttctctctttattttccttccttccttcctctgcaaggccttcttactagtttccacccattttcctatgtaaagcgattttgaattctagccatctgttaatacaaggcagtgaaaaatgttgaagtcacatcaaattccacttgctctgccagttaaaaatacagatgcttcctgttttatgctttcctctcactttctctagagtttaaacatgaaaatatgttccatgataaaaaccagcacatattccctttcatcaggaaacatattccaaacaatgaaaggaaggggagggggattattttcacaagtccagcaaggatacttggatgttgggggaatcatttgtagaaccataatttcacagagcaagaacataattattcacaactatcacattttatagatgaagaaactgagatcgcagggaattgttataattgttctcatatgtgctgcatatcgacttgccaaaattcacatcagcttaaattttcacccaacatgcctggtcctcaattgttccacaatactttttgctatccgctgatttcagaaagggttcttttggctactgggagaggccaaatcactaagcaatggataattaacctgaaactcagtaaatgcactggagtgaaaaaaaaatgtgagactaagagtcaagacacctgggttctagtcacaaatctgttactaactacccatcccaactcatagcaaaaatttttattaatactcttgctccacaaagagactagatcaaatggtctctaaatttactttcaactctttgaatcttgagttttcttccttcaattttctgctgactcagagcgtatagccttggccaagttatttactgccataaatctcattttttttccaagatgaaagggagaataacacattcccctattttcccagcatatatatatatacactatataatcttgcattaaattgactatctttagaaatcacattaaatcctttctatctatagactttggattagtcactaaagctagaataagacatgggccatatcattaggcaatgtctctggctgtagttgtattatcaaacactgcattgacgcttgttcatccttgcttccatcatacctttttatgtaagctgttctaattcttacatgactataacatggagcactgtatgtcaccatatctcttcctctcattgaatctgatcgtattctaatatctcctatctcaatgcctagttcttcacccattttaccaatgcaatatagaaactttcttactgcctttttatttcttacttttcttttgaataattcaccaagttattattgattttgtctgcctgatgtctttcaaatttatccacttttctctcttccatgatatcctaatctaagctaccatcacccctcaactgaactacagcagtcaaaagggttatttccacacagcagtcaaaaggattgtttcaggtgctaaatttggcaatgtcaccccactgaatggctttcttctggtcttaaagacccgattccagaacaaaacttacatggtaggcagctcctggcccttgactgtgtttctagtgtcatagtacatgctcctgaccttttgccctctttgagttcctcctcctcactatcctttcctggagattcaggtttggcagttccccggggttagaatgctcctccatgatttacctagttgctgcttattcttctggttttgtactgatggtcatgttctcagagcagccttctcagcctccctgggtcagttccctccatcatgcaccatcattgtgccttgtatccttgctgttattatacttatcagagtcgtaattttacatttgctcatgtcatactttttagattatgctttgctttcttctccttcaccagagtgtaaactctatgatactatgtctatttttatgtcaccattgtaattccagtgcctggcataatatctaatgcatagaaggtgcaggctaaaattctattgaataaataatgaatgaaaagaaagaatagaagtgcctgagttcaggccctgtatccccattccctcatatatgtggttggaaccatagaaggcaaaatttggtgttaaaagaataaagctggcaagcactgatgtgcctaacaggataggaagttcagaattcttttttaaaagtgttcaagggcccaggagtgcctggctaacataatgagacccagtctctacaaacatttaaaaattacacaggcatggtggcatgggcctgtattctccgctactctggaggctgaggtgagaggactgcatgagcctaggaggctgaaggcttcagtgagctgtgatcacaccactgtagtccagcctggtcaacagagtgagaccctatctcttaaaaaaagttctaggatattggagttgataatgtttgtaaagatcaacgctaacattgcctccaaccaagtctcaatatgctccaaaaagaaatacttcaaattaaaactcgtgtgtgtgtgtgtgtgtgtgtgtgtgtgtgtgtgtgtgtgtaaggagaggtggctcatacctgtaatcccagcactttgggaagccaaggcgggcggatcacttgaagtcaggagttcaagaccagctggccaacatggtgaagctccgtctctactaaaaatacaaaaattagcgtgctggcatgcacctgtagtcccagctactcgggaggctgaggcatgagaatcacttgaacctgggaggcagaggttgcagtgagctgagatggtgccaccgcacttcagaaacagagtgagactctgtctcaaaaaaaaaaaaaaaaaaaaaggccgggcatggcggctcacgcctgtaatcgcagtattttgggaggccgaggcgggcggatcacaatgtcaggagtcccagaccagcctggccaacatggtgaaaccctgtctctactaaaaatacaaaattagccgggcgtggtggtacatgcctgtaatcgcagctactcggtaggctgaggcaggagaatcgcttgaacctggaaggtggaggttgcagtaagcagagattgtgccattgcataatggagtgaaactccatctcaaaatatatatatttttatatatttttaaatatatgtttataaatatataaatatttttatatacatatctatatatagagagaataaatatgtatccacagagagagggagagagataccaagacaaacttataattgctataaattcaaataagagagaagtcagtaaaacctagagtaactaggaaatactccctagaggccaaatttgacctgtgctttgaaaggtaattacaattgggacaggaaacggcacggcttctttctcaaagattgattattctgactattctccattagctcttccttatacactttccactttcccaaactctgtcccgggatgctgacatgaaccacgtcaacaggactccctcacatcctgtcttcaagtagcatttgcccagagagaggcctcaggcaggaggttgtaggatggaaggagagatttgcaggcattcatttccctgctccctccctgcctggctgcagtgggtagtagctaattcctcttctgaaggccacagctcctggtggatgcccccttctcacttacaactgagcttctcagtgggttaccccttcacaactagggttggtcatggctttctgatgctgtgatcacccagggtacttttaaactctctacttatccgtctggggtgccatgtgttatttgctaagaatgaggtaataggaattttttaaaaaaagattaaaataatactatcagcctgtcaatggggattcctcccacccccaaaaatagagttgttcgtttctctttgtttggtttacatgatatatatatatatatatatatatcatgtatatgtatatgatttacctcaaaacagatcacaaagctgaggtcacttgaaactgactattacaagctagctggtagaattaaacttgtttccctaagtaaaatagaaaaatttggccaagagataagaaaatagctgcccctcaccaccacaaacacatacatacacactatactgaatggatcttcatagagagtaagttaataagaggccagcccctacctctgcttccctccccagggacatacatataaatagttcagttatgtctgacttaatagatttgggaaggaggaaacgtgagaggctagtccttctgaagggttgggaggtaagggtgagggaagggaggggagcaaaattacggtactgggatttggacccagataaaagctgctttgtcacatcatcccgatgtaaaatccgtgcatctgagagatagcccctgagccaccacacaggctcctcccaccagagtctgtctggcaggggtcagtgctgcctcgctgtggattagagggagtcatcgacatgtcatctgccatcaaccacacttattgtgaggaaaagaatgccccatacacatagaggccacccttgggatggacttttgagttgactaaagagtaaaaatcacaatggatcatccactagtcagcattattacctttactaacaaaaccagtagcttagccacgatcgtataaaacaataaatgttggttaatttctaaagtacattgattgttttagtttttgttttaagaaaaaggcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactctggaggctgaggcaggagaatggcgtgaacccaggaagcggtgcttgcagtgagccgagattgcgccactgcagtccgcagtccggcctgggcgacagagcgagactccgtctcaaaaaaaaaaaaaaaaaagaaaaaggctttatgtggctgttgggaataggattatttcctctaacatttatcccagtatttttaaaataaagaaacatttggtcgatgaaaagtatagaatatttgtggtaattataataagtgaatacattacataatgtcctttgtgaaaaaggcttacattattataatgggaaggaggtaaattaatctgagtagtattagtataatagtcttagtaattataatggaatgaatcaccctatattataattatgattcaaataatatatatttttagagatcaaccgtttcatgatgtgctggaatgggatgtggtaataggagagcagtgattttggctaacacattaggtattctgagtcaatttggcacaacagcagaaattattttctctattgtcttattgagaagaaacgtcctaagaaggatcttggggaaaataaataagtatgtgagtctgacataggaagagagggtttcttcccctgcaaggcaccttgtgaaagcctagtggggagaaatagtgggatgatgaaggatggggcaggttacttctggaagcaaaattcagatcccgagtgcaggtgttgttcaggcctctgtgccccactgtaagtgtgctggcttcattgaaagggatgagaataaggcagacacgttcaaatatgcagagtgagggaaaatacaaagagcatatttgatattggttgaatgattgagaatatttgatatttgatattgattgataattgatgagcacttactgtgtgactaggaactgaactaaatgctgccccagagatcattcttatttatgctcacaccactcatgaagcaaaccattgttgttattttcattcttcagatgaggaaactgacagtcagtgatgctaagaaacttgctcaaggtcactacagtagttattgtgggcctggggtttgaattcagcctaactccagagtctatgaccttaaccattaagtgaaataagtgaacatcttcatgttcaggacatgtgatgtgtgtgcacacgcatgtgtgtgtgtacaaaataaaatatttgaagccaacaggatcctaagtctgggtgggtcctaatgccagagtgcttagggacacttcctttttaagcaagatagtttgacattgtcagcttttaattgtaatttaatttcttgtgtgaacattattaaaatgtattaaaaccagatcaaaacatccaagacttttatccccctgatttttatagaagccctctgcttacaagcacttaaagagagatgaatccttatttttcctctggtaagtgatttctaaattcccgtagaaaagcctttaaaaagaaaactcaactagctgcatttatggacttgaatacctacactctactaaaattattgccttttcttaatgatgttcctgactcatcctgaaaattgatcatatatgtataaggtgatgctcactttacaggtggagaatgttgtagccacaagtaatgaagactaatatatagatatttaaatccacattttgtccagaattctcaagcagggagttctaacctagccccacccctcattccctcattaagcattgttttcttagaaaggattaaaactggtaatatatctgtaatcaattagctgacatgacttaaaattgataagtcatttgatgaattctcatctcaaattccgaatgaataaacaatgagaaatgggaaagcctttggcagagagagactcattgaatcagttaattaaggaaagagaaagagccagagtacaagctatcaatatcacctacatgggtcaagaactcatccttatgtgtgtaataatagagctactcataaacctgaaatgatacaattaattacggaagttatagaatattggagcatcctcgggtgaaaaataattgtgtctatattataaaagtatgcaacataacacattttatctgcatttaacattttgttggtgtttcatgcaaatgaaaaaaaaaaaacactgtttttatgatttagccaaaccatgctaactctagtaacaaccctcccaatctcagtgttttaatgcaacaaacagttgtatcttgttggtataaattccactgcattgttcttggttgggttgttccttaaagaggatactcaggaatccattctcttcctatactgttccagaggaagatggctcctccattttcaatacgtggcttcaaggtcacgctgacgttgttcagacagtgttctgttggaagagtgagagaaaaaagcatgtacatacaattccttccaacacacatacacttaactgctttggtttgaaagtgacataaaccttctgctcacattccattggccagaattcctcacacagtccccacctggcttagtgctcaggaagaggaaatagatttgatgatcatctaggcaatgtctgtgatgagattggttcaaaaaatgtaccagtaaaaataaaaataatcctgttcattacattccagaaaatgaactgattaaagacaaatatgtatgcatcacttttctctttacgtagtgaagcaatgtgaaaaacatattaattgagctattcatggcaagacttctctttataaacttcatacatctgtcactaaattgatatgaaagaaatatttgatctcagaaagaattttatctatcatgatggaatgctggcagccaaatgtatacctaaaaattgctgaaatattggagtaaaaaggaatagttagatcgatcatcttaattttgtgaaagcatgcgtacatttttcaccttggattcagttgtgttggcattttataggcacagttataaatttgcctaaaatacagaatggcattacaacaaaactcagactcatggtgtaatcattgtttttttcaaactaaaaacaaagaatgaaaaataaaaacctctaagaacaaaattactccatttaattaaattaaacagacaaaacttggaggcatagtagagatggcaaggaaaggcctcagaccccttacccccatccaggggaaatatttgccagccactcctatcttcagcaaaacttgagttatgatgtaaactcaagactcttaaatttgtgattaatcctgggtgtcttgaaaattggagagtgggttagcaaattcatagttccccaaatttgtgctatctactgctgttttcttgtggattataagcttgaaggaaatgtgctgcctagagatatgagctgtgtgtaattactcccacctgctgggtaaaatctttattacatgggcattagacttcattcccatcgaggggtgaggaggggtgcaatatgaaccaaccacaccacaaggcttgtgaacatccttcctctatggtgtctcctgacacttctttccagcttccaaatgtgatacaactttgactggaaactgtgaaccaatgtgtatccaatgaaccaagggagatttagctccttaaaagaaaattaaatgtagaaagatgtggaaggatcaatgaatcatatttatccaataagtggttcaacaattacaagagcgagacaggaagggaacccttccaggcagagtggtcctcagctctggttttccagcctagagacccatgtggcaggaacttggccttcatcattgaataccctgcatacacccttcctcaagcctcctttgtatgtgtgagagcactgacttcagaaacagaaatgagtttccagccctcaagggaactgtttgctaaagattggcaggagcccacaagactacgacacagtctttgatgagctggctctccaagtgtgggcagacttttgtttctaagttattgggaggctttctgtgggtataaaacctgcaaaaaacacaagcatcaatgttgccatattaataactgctttcatccttggcaagaagaaaaagaacgtggggaaaagagtcaggcgcaaacatggtttgagttttattgtcttttacttgctcactgcctacacctcccaccagtagctttggaaagagagtttcagaaatgttatcttatgttttttatccctaagaatggggtcatagtcttcaatttatgcctaaagtgtttaactactccttcttaatttactcgctctgcccaggaagaaaacagacataacttgcaaaggtggaaacactggtacgttaggaatatcattcattttcggattcttggcccttgagtttcactgttacttaattgacaaagctgagctgtttcatttcacgctaggaagtctttggttaaattgcaggcttgggtttctgtcctttggcagtggaagtaaagagaaatcagaagcaatgtagcatttatgaaccactggctcctctaactgcctctgtggcttcaaatcctgatgatgtcaattgtggtttgtgtatatgtacgtgtgtgaatgtgtacacacatgtgagtgcgtgaacattcgattcatttctcatttttgttctctctcttttcccctcacctccggaccttttcatccttctttatgttctgttgccttcatctcttagtttttctattctatgccccttttgtttctactcttttcatctgacctattattatgtcatcagctataagcaccatggaaaacactagtttcatcatctccatctgaaagaaaaaaaaaaactcaacaagggagaagctgaatatatctgtcttcagtatctatctttgaatttggaatgcttcctgccaagaaaattatattctgaaactccttagatcttgcagtcttcatgaagcacaccagccaatagctgcctcctgacatcagctcagatatctggttgacttttgctgctagctcttccagccaatgaaagtagataccttaggccagtgttcccagacatttaggttttatgggataataaaatctccaggagcaaaatgaagaggctgatatattgccttctctttaaattttaacacttttgaaaaactgccatctacacactaccgctttttacattttaacacttttttaaaactaccatccattgtcatcattattccataaaaagaggtattttaggaaggatactcacaacataagttggataaatttagcaattaaaaaagcactgctttacttttatcttctcctttaatcaaagatgggatatgaatatcaaccagcattgatccaattttaggcccttagttccaataaaattgttccttttcccatataaatggttatgcctttgggccaattgctctgtctctcagaggttattatatcctgttgcctctatattgaggattgctgtttcatctttggagttacaatgtcccaaagggatcactgatacattcttagctccagtatataaatagaggcactaagaaataaaatgagagggttttgacacctctccctctcccccaccccccaacacacacaaacaagtaaatgggttagcttttatttctacaattgcacagcatatttagtgagagagggaagttggaggtgggtatcacacatgtaagatattgcccttattttttttttttttcagagacagtatctcattctgttgcacaggctgaagtgcagtgcctcgaacatagttcactgcagccttgaactcctgggctcaaacaatcttcctacctcagccttctgagtaactgggactacaggcatatggccaccatgcccagataactttttaaaaacatttttgtagagatagagtctcactatgtttaccaggctggtgtcaaactgctggcctttagtgatcctcccattttgccctcccaaagtgctgggattacaggtatgagccactgcacctgtcctggcccttattattgagtagattgtagtctaatgaaaacatatgagtataataaacaaaagaaaaaagaaaacatatttagccaattcatagcaaaaggcagacagaagtagatgctgaatagagaaacaagactgttagagggcagagaaaggagtaattcattttgctggaagaatcaaggaagcaatcacaaaggtttaatgtgtaattctgaatttatgtgattgctatataatcattctgtttcatggctgcagtgtaagctgtgtgagggcattgtttgtatcagatgtctgaacctctttatctcatcccttatcatagtgtctggtatctagtctataacccataatatctcctgaataactgaatgggtgcctacaatgataagtggtgtgaaagataccaagaaaatcaagtatcattcattgccccgaaagcacctgtgagcacataggtttgcaaacatgccacatgtgttcggtcagcccattgcttgtgtacatgatcatagatggtcatagggatttacttcattctgaaatggaataatttcatcctcaccctgctttaccttaggtaaagattttgatgccatttttattaagacatttacttggaagtaaatgtcatgctgtgaagagccattatagacaaatattgtagccacttgccaagtaatgacttatgctgggaagttgcttaaaaggctgattttattcattttatttgctatacccttgtgctacttagagaagggtagagaatgagagaggagcaatatgttttgttctcttttttttcataaatcagtaattatttgcagagtgttttgtgtaaagtgctcagctcacaactggaaatagaatcctgggttagacagtggccatagtgatatttacatatctccagcttgtagtttgccaattgaaatgcagacatatgcggaaattgcctcattgtcattccttgtttttgtaatattatccttggctctacggattcattttttttctccttctactgtcaacactgttttagcagtgagttatattatccggtgacatcagagaagcaaagctacatgtgtcagcttggcaggaattgtccacttacagcaaatttgtgacaagttgtatttttctaccattttcacctggagtgacgaagaatctacagttgagggagacaacatggacctcccctgatggtaacagtgctatgtccaattgagctgctgttgcttcagtaccaaagaggaaggagctggtgatctttgaataatccttcccctatgaaaagtaggaatgtatccccagagttcattgtctgtatctgtaggtaatggaggcttaactggcattaaaatcatagccagtttcagacccattaagtttaatggtttttgtaatgataggctgcaactgatggaataaccaaaagaacaattcatggactgtttatggaagaataccttcaccattcaaaatggacattaaactatggctggtttcattgcaaggcaaaagttccctctttatcttctagttaggtccatgtgcagcccaggaggtatgtaaaagctatactttaggagaaaagttgacttgaagcttttaagctaatgagtttgaacttggcatgttttctattatcattgtctttaatcagtggtgttatataataaggagctaataaattaatctaagtgtaagtcaaattaatataagttaaagtcaaaatccagctaggcaaagccagataggcatattaaaatggcagcccctaccccaattccttgataatccattaaaagtagaaagttttggttaggaagccacctcctgttacgtaaatcagaatgtaagagccatgagattagggattttcatttgttttatccacttttatatcctcagtgtctagaaaaatgcttagcatattgcaggcactctgcaaatattgaacatacggggttgatgaacatataacccattttggttgatgtagttttatttcttaagaggtaaaaattctttcagaaaaagaaaagtaatcatttctacaaaataaccctccactggttgatattcttcccagatctacctttcttcacacagatctttttttaagagaaaaccacagggatatgtggctggtgcaatcaatgataggtttgggatatgataaaatgtaggaaatggctaaatgggagagtacatgatttataaaatagaatttaaaataacagccctcaacagcagatctttgccagcagcacatgatgggaaaatataaaccccattctggggatggcatctggtacagattgagaaataaattgggcagcgaaacagaatgtgtcttcagtggtccttaagatcaaaccaccaatgataagcatggatcattggagcctccaccttgctctttttgaaacagctaaaatcagcaagggaatgaaaaggaaatggctttatcatctgtgagcagcttgcccctccctctggagatccaaatctccaaacatgcattttgatatactttgggagttctctttatctagtaatttcatttaggggaaaaaaatatagctctccctgcccacatcccacattgttacatcactgattcctcaccatgctaacacattcaataatctgacgtgcaactcaactagaagagcaatcacagccagtgatgggccggcatcatggagagtaaagacaaatggaaacaataataactgtggaagaagcagatctcaaatgggaaactcaatcccagtgatcagggaaaactccaaaggaaggatatgagttcaaaaaaatcaattcaacaaaaacttattgtctgtctaccatgtatcaggcatggggatatattactggtcaacacaatgtgctttgctgcctggtgcctgtgttctgatatctggtgtgcatgttctcaatggtattgcaagttgcattgggctagaatcatgaagtattatcaggggatttacttgaaattaaattagtcccattcttgtggaaatctggagctggcatatgcatggaagtgaaggtcttgttgctggttgaatttagtgccctctgcaatgaaagccaaatcccaactttagtctgtgactggggggccttctacaaagagaatgaattttaacaattaaccaacaatctaaattcttggaaagtgaaagtttctaaaacataaaatccatgaagacagaattagaaaatcaatgtgtcctttttggaggaagaggaaagccgctggctgaccacgtcactttcatgtttctactcaaatcttatcaacaaggcctttgttgaccattcatccccttcctaggcccccttatttctatgtctgtcttgtatcatctgacacattgtaaatgtccttatttatttgcttactgtctgtctcttcactctgaaatataaattccatcatgtcagggactttttcttcatcttccccaaatgatgtttgaagcctcccatctaatgctgagaggtatttccctagtagccctgtcatcactttcctaccactgtccctgttgccacataatttaagattccctgtggccaatgctgatgtcattatcatggacgtccttaggaaacgaaaataatttaagcttctaaaatgggcaaattcgatgtagagttgatgggtacatcacacacccatctagaaaagagcatctcaggttggtacctgaaacttggtagactccaccccaagtcacatggccaactgatgtgttacttcttagacatcctgctttctctgtccataggcctggttgggtggtctttttcagatactaaatcatggtacaattggttttcataaaactagtactctaattctacttttccagtagccttgagtaaaggaatgttgaaaacttgtagtgatgaaacgtgtaggatttgcgatttgtcggagtagggacaaaactatttgagaacatagtccagctgaccaaaagaaaataagttctcatattactaataacttttagggatccaataggctcaagaattctgaggttgggtttgacagtgattagtgtaaattaagtagaagtagttaagaaagtggctgaaattgaaggatcggttgtggttagtaaatatggaggattgaaacacaatgcaaacttgataattgataaccttcatttaattctaactaaaagcccactttctggtccaaagttggaactaagaatgaattctttttactctgagaggatatttacaaagaaaacacaaacacacaaactatgggtaacacaaaagcaaactagaatgatttatcttattattctgttatgggttgaattatttcctcaaaaaatatatgcttgtcttaaccccagtgctgctgaatgtgactttatttggaaatagagtctttggaggggaattagtaaagatgaggttatactcaagtaaagtaggtccttaatccaatacaactggtgttcttattgaaagagaaaagacaacgtaaagacatagacacacaggaagaacaccatgtgaagacaggcagtggtcagaattatgtatctacaagccaaggaatgcctgaggttaccagaagctggaagaggcaaggatcccctccagagcccttagaggaagcagggccctgacaacactgtgatttcagacttctctcctctagaaccattagacaataattttctgttgtttgaagccaccaaatctgtgatactctgttacacaaatcctaggaatttgatacaccttcctagacccaagtggggaagaaaagggagaaacaggtttagaggtggagtaaaagataacagcttctcacaacttgaggcaagatgcgtatgctgatggcagagaaaggagttggcattttctgaaagcctgtcagatcccctgctttgtctgggaaggggaggaatatccacagcgtcttagcaggtgaaatgcagcagcgaagaccaggtgcctgtattgttgcctctggttgtgcagatgaagagtcattaggctgacctcatctatggacccaactggaattagccctgactctagagccactggatgttcaggcaaaactgaccctaaaattctttttaaatgcattgcttaagccaagcattctcttattcaaaatcaagctgctgcattttcatgtagcatgaaatgcaattttctatttaaggtgttcaactaacttagggataggttgatggccaaacaaagaaggtttcattaagatggaaatgatttggagtatctagtctccaaagtgattgctctagagacatttatcaatccaccggtggcttctagtcgatatttggttttataggttggggcaaaagtaattgcagtttttgactttttaattgcaaaaccgcagctacttttacaccaacctgataatattccccagatccttccctgcttcctctcattagtaaccagagcaggctgagaatcacttacctgtctcttgtgttccacaatgcacactttgaccccatctagtctcttccaatatcatttactcttgtccattagcggattttctttacttcctgtgtgtctagcttgttggggggatagggaggagaggagaggctgaggatattttttctgtgtgtgtgtaaaggttattcaaattctttatcacttgcttttgctttttaggaagaaaaaaacatgaatatcttataacactattttttaaatgaaattgttcagcaaattatacttaattatatttttaattttaagttctgggatacatgtgcagaacatgcaggtttgttacattggtatatgtgtgccatggttgtttgctgcacctatcaacccgtcatctaggttttaagacctgcatgagagggtggagccaagatggccgaataggaagagctccagtctagagctcccagcatgagcgacgcagaagacaggtgatttctgcatttccaactgaggtactgggcttatctcactggggaatgttggaaagtgggtgcaggacagtgggtgcagcgcacccagcatgagccaaagcagggagaggcattgcctcacctgggaagtgcaaagcgtcagggaattcccttttctagtcaaagaaaggggtgacagacggcacctggaaaatcgggtcactcccaccctaatactgcacttttccaaaggtcttagcaaacggcacaccaggagattatatcccacgcatggcttggagggttgtatgcccacggagcctccctcattgctagcacagcagtttgagatcaaactgccaggcggcagtgaggctgggggagggacgcccgccattgccaaggcctgagtaggtaaacaaagcggccaggaagctcgaactgggtggagccaaccgcagctcaaggaggcctgtctgcctctgtagactccacctctgggggcagggaatagccaaacaaaaggcagcagaatcctctgcagacttaaatgtccctgtctgacagctttgaagagagtagtggttctcccagcatgcagctggagatctgagaacggacagactgcctcctcaagtgcgtccctgacccctgagtagcctaactgggaggcaccccccagtaggggcagactgacacctcccacagccaggtactcctctgagacaaaacttccagaggagcgatcaggcagtaacatttgctgctcaccagtatctgctgttctgcagcctccgctgctgatacccaggcaaacagggtctggagtgaacctccagcaaactccaacagacctgcagctgtgggtcctgactgttagaaggaaaactaacaaacagaaaggacatccacaccaaaaccccatttatacatcaccatcatcaaagaccaaaggtagataaaagcagaaagatgaggaaaaaacagagcagaaaaactggaaactctaaaaatcagaacgcctctcctcctccaaaggaatgcagctccttaccagcaatggaacaaagctggatggagtatgactttgatgagagaagaaggcttcagacaatcaaactactctgagctaaaggaggaagtttgaacccatggcaaagaagttaaaaaccttgaaaaaaattagatgaatggctaactagaataaccaatgcagagatgtccttaaaggacctgatggagctgaaaaccaaggcacgagaactacgtgatgaatgcacaagcctcagtagctgatttgatcaactggaagaaagggtatcagtgatggaagatgaaatgaatgaaatgaagcaagaagagaagtttagagaaaaaagaataaaaagaaatgaacaaagcctccaagaaatatgggactatgcgaaaagaccaaatctacatctgattggtgtaactgaaagtgatggggagaatggaaccaagttcgaaaacactctgcaggatattatccaggagaacttccacaatctagcaaggcagggaacattcaaattcaggaaatacagagaacgccacaaagatactcctcgagaagagcaactccaagacacataattgtcagattcaccaaagttgaaatgaaggaaaaaatgttaagggcagccagagagaaaggtcaggttacccacaaagggaagcccatcagactaacagctgatcctctcagcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctaaaagagctcctgaaggaagcattaaacatggaaaggaacaaccagtaccagccactgcaaaaacatgccaaattgtaaagaccatcaaagctaggaagaaactgcatccactaacgagcaaaataaccagctaacatcataatgacaggatcaaattcacacataacaatattaaccttaaatgtaaatgggctaaatgctccaattaaaagacacagactggcagattggataaagagtcaagacccatcagtgtgctgtattcaggaaacccatctcacgtgcagagacacacataggctcaaaataaagggatggaggaagatctaccaaacaaatggaaaacaaaaaaaggcagggattacaattctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtccttagagaccaggaagagacttagactcccacacaataataatgggagactttaacactccactgtcaacattagactgatcaacgagacagaaagttaacaaggatatgcaggcattgaactcagctctgcaccaagcagacctaatagacatctacaggactctccaccccaaatcaacagaatatacattcttctcagcaccacaccacacctattccaaaattgaccacatagttggaagtaaagcactcctcagcaaatgtaaaagaacagaaattataacaaactgtctctcagaccacagtgcaatcaaactagtactcaggattaagaaactcactcaaaaccgctcaactacaaggaaactgaacaacctgctcctgaatgactactgggtacataacaaaatgaaattaagatgttctttgaaaccaacgagaacaaagacacaacataccagaatctctgggacacattcaaagcagtgtgtagagggaaatttatagcactaaatgcccacaagagaaagcaggaaagatctaaaatggacaccctaacatcacaattaaaagaactagaaaagcaagagcaaacacattcaaaagctagcagaaggcaagaaataactaagatcagagcagaactgaaggaaatagagacacaaaaaacccttcaaaaaatcaatgaatccaggagctggttttctgaaaatatcaacaaaattgatagaccactagcaagactaataaagaagaaaagagaagaatcaaatagatgcaataaaaaatgataaagggtatatcaccaccgatcccacagaaatacaaactaccatcagagaatactataaacatctctacacaaataaactagaaaatctagaagaaatggatacattcctcgacacatacaccctcccaagactaaaccaggaagaagttgaatctctgaatagaccaataagaggctctgaaattgaggcaataattaatagcttaccaaccaaaaaaagtccaggaccagatcgattcacagccaaattctaccgaggtacaaggaggagctggtaccattccttctgaaactattccaatcaatagaaaaagaggaaatcctccctaactcattttatgaggccagcaccatcctgataccaaagcctggcagagacataacaaataaagagaattttagaccaatatccctgatgaacatcgatgcaaaaatcctcagtaaaatactagcaaactgaatccagcagcacatcaaaaagctgatccaccatgatcaagtgggcttcatccctgggatgccaggctggttcaacatacgaaaatcaataaatgtaatccagcatataaacagaaccaatgacaaaaaccatattactatctcaatagatgcagaaaaggcctttgacaaaattcaacaactcttcatgctaaaaactatcaataaattaggtattgatgggacatatgtcaaaataataagaactatctatgacaaacccatagccaatatcatactgaatgggcaaaaactggaagcattccctttgaaaactggcacaagacagggatgccctctctcaccactcctattcaacatagtgttggaagttttggccagggctatcaggcagaagaaggaaataaagggtattcaggtagtcaaagatgaagtcaaattgtccctgtttgcagatgacatgattgtatatctagaaaaccccattgtctcagcccaaaatctccttaagctgataggcaacttcagcaaagtctcaggatacaaaatcaatgtacaaaaatcacaagcattcttatccacccataacagacaaacagagagccaaatcatgagtgaactcccattcacaattgcttcaaagagaataaaatacctaggaatccaacttacaagggatgtgaaggacctcttcaaggagaattacaaaccactgctcaatgaaataaaagacgatacaaacaaatggaagaacattccatgcttatgggtagaaagaatcaatattatgaaaatggccatactgccaaaggtaatttatagattcaatgccatccccatcaagctaccaatgactttcttcacagaattggaaaaaactactttaaagttcatatggaaccaaaaaagagcctgcattgccaagtcaatcctaagccaaaagaacaaagctggaggcatcatgctacctgacttcaaactacaaggctacagtaaccaaaacagcatggtactgataccaaaacagagatatagaccaatggaacagaacagaggcctcagaaataatgctgcatatctacaaccatctgatctttgacaaacctgagaaaaacaagaaatggggaaaggattccctatttaataaatggtgctgggaaaactggctagccatatgtagaaagctgaaactggatcccttccttataccttatacaaaaattaattcaaggtgattaaagacttaaatgttagacctgaaaccataaaaaccctagaagaaaatctaggcaataccattcaggacataggcatggacaaggacttcatgtctaaaacaccaaaagcaatggcaacaaaagccaaaattgacaaatgcgatctaattaaactaaagagcttctgcacagcaaaagaaactaccatcagagtaaacaggcagcctacagaatgggagaaaatttttgcaatctattcatctgtcaaagggctaatatccagaatctacagtgaactcaaacaaatttacaagaaaaaaacaaacaaccccatcaaaaagtgggtgaaggatatgaacagacacttctcaaaagaagacatttatgcaaccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccactgtggaagtcagtgtggcgattcctcagggatctagaactagaaataccatttgacccagccatcccattactgggtatattcccaaaggattataaatcatgctgctataaagacacatgcacacatatgtttattgtggcactattcacaatagcaaacacttgaaaacaagtgaaatgcccaacaatgatagactggattaagaaaatgtggcacatatacaccatggaatactatgcagccataaaaaatgatgagttcatgtcctttgtaaggacatggatgaagctggaaaccatcattctcagcaaactatcgcaaggacaaagaaccaaacaccacatgttctcactcataggtgggaattgaacaatgagaacacatggacacgggaaggggaacatcacacactggggcctgttgtggggtggtgggaggggggagggatagcattaggaggtatacctaatgttaaatgaggagttaatgggtgcagcacaccgacatggcacatgtatacatatgtaactaacctgcatgttgtgtacatgtaccctaaaacttaaattataataaaaaaattaaaatataaaagacctgcatgcattaggtgtttgtcctaatgctctgcctcccttttccccccatcccttgacaggccctgatgtgtaatgttcccctcgctgtgtccatgtgttctcattgttcaactcccacttatgagtgagaacatgcggtatttagttttctgttcctatgttagtttgctgcggatgattatacttaaatatttttaaacaaggctttagacctaaatccatcaaaataaaccactttgcatgaaaaaaaatcatgggaccatttcagcatgttctataggtgggctgatttaaatgatttccttatacatctctttctgcttgtgctattgaataattgagaagtttgcagggggtgtggtgccttgcacagaccgagaaggaagagaaaggaagcaacacttgcaaaaggactttgttgtgtacagtgatagaatgctctacctgtgttactcattgaatcaggaggattgttgaaggaggagggctctctggaattgtaatctgaagaatgagggttattcatcaggaaaagagggcaaggcaaggggagggggaagcataggagaagaaataaaaggcccagaattctgaaaaactccatgctaaaagacccagaattccgaaaaactccatgtcagcagggtcaaaataaattttgtggaatggttacttagattgagagaaggactaatgagaaatgaaactagaggtagagtcagagatcagttaatagtcttctattttaggttaaggaattcccatttcattctgaaggtcaaggacaacttaggtaaagggcagtgactaagaaagaccaccctggtcaggctcgatggctcacccctgtaatccaagcactttgggaggctgaggcaggcagatcacttgaggttagcagttagagaccagcctgaccaatatggtgaaaccctgtctctactaaaaatacaaaaattagctgggtgtggtggtgcaagcctgtaatcccagctgctctggaggctgaggcaggagaatcacttgaaccctggaggtggaggttgcagtgagccaagattgcatcattgcactgcagcctaggtgatagagtgagactctgtctcaaaaaaatagaaagatcattctggcttttgggtggagaatagactgtccatgggcaaagtcagagtccaggaggccatgccagaagctgctgctgtactttaggcaaattctatgtggtggtggcattggtagtaagagtggagaggaatatacaagttagcgatacatttaggaggtaggttcgataaaacttggtgatttattaagtttgaaagtgaagaagagggaggagtcaggattgacttacacatgaaacatataagacttctttctgtcctaaaaaaaaaaatcaccgttgtagaaaatgatagaaactgatggacataagaaagcaatcaggatctcgattctcaatgccatgtgaagaaccacatgctcttttgacattttaagtagagatgtacatttggtttctgcagatccatttcatagctcggctatgatttcagactcattactcaaaagcaagggtgtaggatcaggggagggtgaacaagttaggcagaggaatgagctgctctgtgaggtggtttgctccacagcctttcactccttcttcccaacgtctcacagtcataaaaaaaaaaaaaaaaaaaaaaaaaagtaggagggagtgcctatatccagtagaattggagacaagttagggacagagctcagagagctgctcctgatgcggaagtggcaagaaaagacgcttcacctccctgacaacaacacatccactgtgtgtagcaatacgtttctgcctaagacaatttacccccagggaaatacaagaagggagacatctcccaggaaattaccatttgtttctactactgaaggattttcgtctatttatttgagaaaagtgagaagcttctttttgctgagaacatagtaaatgctgcaaaagcatttgatgtcatgtccattaagtaacttggctgaatttcttgaagctttaggtaccttgcttcaattcctgcatactatttactgaccctctgtaacaggacttttcaactttcaactatattagaacatgtagtttctctattaccaagttccagctgaacagtctatctttaatattcagaaagtgtttggtgtctactagccaagactgtagtctgagcaatgacattgacagtggaccttgatcttccttcctttgaagcataagtgccttgtatcattttactttcctctagtagaagtccttcctatggttatagtatttagtttctactttttgcatttaatcggagcatctttgtaatttacaatttttaaatctttttttttcaaggactaaacacgaaggtttgaagtccaacaggcaactaaagatgtatacaaaccccgcacaaatcagcctccattctaatgccattcctcttctatacttccattttttaaacctgagcatatattttgttttgagtcttttcttactcttttatttgttaatactctttattcagtttttgtcaggtaaaaatgttttgccttgccaaagaaccatctaattccttctcaggtctttttaatatattgcttccagatatttttggattggtggtttctgcaattctccctaaaacaatcttcgtttctcttacacatctcattctctacgctttggcagacttttgcagatgcattctataactgcacaaattacccttccaattttctccagctaaacaatctaatccagggtcctaaatatttttggtgccatagactcctttggcattccagaggtgcccagggattttactcaggatagtgtctttaaatgcatgtttaaaatacatcagattacaaagaatgtcaattaaattgaaaaatagcttaaatattttaataattgtgatatagtaataaatgaacttctttaggtgcattaagtaacaagatctactaacagggctaataacttattatttcagtatgtctgtggtttctattggtgacaaaaatcacaagtactgttaatatttttgttttattttgtttaaaattatttaaattttaattaataaaacatatatatgtatatttatggtgtacagcacattgctatatgtatacattgtggcatggctgaatcaaagtaattaacatatgcattagctcacatagttattttttgtggtgagactgcttaaaattcactctcctagcaatttttgactgtgtgctgcattgtttttttaactatagttagcattttgtaaatagtcctcttagaattattcccccaattgaagttgtgtgccctttcaccaacatctctgcattttctccttccaccactctctgtcctgagtaaccaccattctattctctgcttctatgagttcaactttcttagattccacatgtaagtgagattatgtggtatttgtcttctgtgcttagcttctttcacttaatgtaatggtgctgttcatattactgtggttttggtgcctacattcaaactcagtggaaattctaatttgcagttagtttttcagaaagaagaaatgtgtgaatagtttcttatggtccaagcccttggatcctctgtattttatccacagatgcttgggaggatctctagatcccagattaagaactccagctagttattagtcctttgtgctttgaaactcaaatcaaatacccatctcttccatagaactttttctaaattcactagactcacttatctacccttcttcctatagtttcattcactctctgttatgaaatatccatttattatcactattagtttttctgtattgctctcttctttgtaaatatctctatactttattctcttttatttcctttgtatccaggacagtgtctggcatatgcaggcacacaataaatacttgtttaataagtgaattaaaactctagacagcttctggtaagtttttccaggttaccagtaatacaaagacctgaatgttatttattcacttctacaaggggcacagtgtccaagtcctgacctttaataagagatgtgcttccagcagtgtcttcttggcatagtcttaaccttttattctgccctggtgcacacttaatctctcatgaagtcacagctattgatttataactgaatcttcaagatattttaatactttataaacatacaaacaacaattaattgcattgttagataaaaatgtattacagagatcaccagcacaaaaataagtatttctatttataactgaaaaaaaaactggcaatggaatattagttgtttacaaggcaagtattctgaataatgtgctgggagattataaataaccttaactaacagtaaaaaaaattgtgcttacagaaaaaaattatttgagttagtctaaatgtattaaacttatcagtaagtagcatgaattaactactattcaagtgtaaaattctacttccatattacctaattcagttccatatgaagtcagccagcaaggatcagctgaggttggctgttgtgaggtttcagccattatgaaaaagaggagctgggcacagcctctgatgaataataacatggcatgggttctgataataagcacagagaatcagaaaggaaaaaacacagagaggagtatggagaactggaacctgtggaaaatgatacacaatttttttttttctacagagtctcgctctgtcacccaggttggaatacagtggtgggatctcggctcaccacaacctctgcctcctgggttcaagcaactctcctgcatcagcctcctgagtagctgggattacaggcatgcgccaccatacccagctaatttttgtatttttagtagagacagagtttcaccatgttggccaggctggtctccaactcctgacctcaggtgatatgcctgcctcagcctcccaaagtgctgggattagaggcataagccactgcacctggccccacaggcttcacagtcagtaggcccaaaggaagtctggtgtggtcgatcaagaatccagctaattctcgcactctcactgtctctctctttctctcaccttccactgacctctcttccctcctattttgtcttgggaaaaggcaggtgattacaaaattcttctaattatgtattttaattaatataaaatctttacaaaacagtgttaataccagcccactatggtttatattttttgctgtgaaaaaaaaatctcctatgctttagcaatactttttaggcagagagtcatcaaaataaaagagtatcagtattgctgaagtaggtcattcctgctttactttaaaaaatttcaaaacgtttcatttttcctccgtaaaatttatttctatcaaggaaatggggagagaaaaattacaatgaaaaactgtgaggataaatgaggtcatatgcctatgaaatatttggaaaagaattataattatcaacttgttcatttttaataccatagttagatttctcattttaaaaggggaaggaaagaactccattacattctagggattctaggcaagataagtttccatcacagttgctggatggtggagctgggctggtatgacattctttccttgtagaacgtgcgttctaactgaagactagccctttattagaaatgcacattgagaagacaggggatttatgagtcacaaaggccaagatttctaaccttgctacatgtggggcgggacttttctatgctcccaaggacttaaggtcaagtcactttcttcctgttcccgtctccttctgtcttcctctcttttttggttctaaccagaaaatgtattccaatttttcttttctttttctgttcaagtcttacagctctgccaaaggcaaaatgctgcagggattagaaagatgaagcagctaagtcaaatcgatagtgacagccagtgaacgcatgtaaatttcaacaagtgaacgttcagcattgtctctggggcctcccaccaatattaacatcactaaattttctgatttaacattctcacaaaacaggaatcaaccaaccaagtgccagccactaatagccttcaggttaataaatttggtcttcattaatctcaaattagagtcctggagtagacttatgtttgggataggagtgcccatcctacaagaagcttattacccataaatcaggtaagagataagaaaacactcctccaggtctcattagccacttcagataggctctgcagctctttaatgttcaggtggcatgtccttagaagatgagctgagaatcaaagctcctgatacaggaagaagcctaactcagcccatctctcttcttggggcattcacaattatttcctttaacccttgtgtagtttcagttgtgttgattcaagtcattattttcttacacaactagggtatatagtttagaatgtgatagaatcttggaaaaatagcaattccccattatgtatacacacaatacacatacacacacacagtactatatatgtatgtgtgtgtgtgtgtatatatagatcacgtaaatatatatgatatatatagatatatagagagagtacatgtacatatatgtgtataatatattcttcactttcattttatttgtctttatgatttcaggcagtggtataagaagatagaaatagcatatgagcacttcacacagtatctgctataaaagtttattttgacactttacttataactccttgaaagtgataaaattttcctattttcctgaaggtacatttagacaaaaatctcagagcctaatattttgaagtgttagttttgctgaggccaaacaaaatcaaggcccagcatataccccgaatacattctcacttaccataaatttattatgaaatggtattgtgttgataggagagtttttgttacagcctataacatttcagggattttgatagacatgatttccaatgggataacatttaaactgagatagctactatttttttttaatatatgtttagttttgtgaaaaaaaaaataaggaaagcatctggtgattgaacaaatatgtagtagagctaaagacattttccttaaaagaaatatacttgttttatgctttaatggttagagctgttccattatagtgtatcatctatactcttctgatttttattacaagtagggatacaacttaaagatttaaaagtccttcccaaagtataagcatgtgtttaattttcagaatggcagtgagacttacttgcacataaagttaagatacctaggttgtgggcttccaaggatacttccttgggaagtctttagaagttgtttttagttaaggacttggtagcatcaagggaagccatgagtggtgaaattctcagagagactcttctttctgtggtcctgccttgtagatgacattctggagacttttgtgtgtaaatgaatgattgaaattccatagtatatttgtcatttttcctaagcctgtttactctggggaaaatcttctttcatccttctaagttcttactccacactcccgtgggtgctcatgcatgtgtgcatgcgtacacacacaaacacacacaaatatgcatgcacacatcttcagtacttgaggcattaacctgcagaaccataacaccgtgaatatagcagtaaaggcaattatttctgtaaacaggtaacagggtgtattaatattactgttagtacctctgaattctttcttccttaataggatgtattaatattaccgttattacctctgaattctttcttccttcccatcatgctagagccatcttgaatatgacttaagaagtgatctttacattttgcctctgtctcaaactaggttctagtggctattaggggctagaccaaagctaaactgagaataaggttacgatagcacaattgttcataggtggtctctcaagacaacagcattgcaaaagaaggaataattgttatgtttattttacctatgggggaaaaacagtagtccgggcagtctaaatgatgtgtccaccatcatagaataatagagagtgaagctgtaagtataattccggttgactttgtatccagtaaaatgttcattcaacttttgttcatctctcctctagtcacactttgtcatgcattgacttcttggcctgatctcaccagtgaaaacccatgggaacagttaataattccatgactaaggctattataatcctatagctacagtttctccagtgaaataatgaaaatttcttcattaatttattataaaagttactgagtttaattgtatgccatcctggatttcttacagaagtgattcttgataatcctaagaaaattcttcttcagacagattttcaaaatgtttttgtctctgcaattactgttctgaggttagatcttatagaagttactccataagaagccaaagcattttcctcaaagtatagtggctaatggctatgctgttaccaaaagctgtgacagaaaacctctggctattaaactcatatctaatgctatttggcctagctattatgtacaatttgagaaactgatttttctcttctaaaatgaaacacaaggccgtgtgcggtggctcacgcctgtaatcccaacactttgggaggctgaggtgggtggtaatgaggtcaggggatcgagaccatcctggctaacacagtgaaaccccatttcactaaaaatacaaaaattagccaggcgtgatggtgggcccctgtagtccctgctactcaggaggctgaggcaggagaatggcgttaacccagctggcggagtttgcagtaagccgagatggcgccactgccctccagcctgggtgacagagcgagactccgtctcaaaaaaaaaaaaaaaagaaaaaagaaagaaaaagaaaaaaaaagaaagaaagaaatgattcgcattgtagggtcatgaatttcaacacatattacagttcagccccttctctgctgctggtggcacactggagatgtggagatgcagattctcaccacacaaagtggggtccgtcctggaagcttgtaagaaaagcagaatctcaggccctacctagaacctactgaattagaatctgtgttttaacaagatctcttggagattcagaggtacagtaaagtttgagaagcacagctggaaactgtctgaagtctgctatgatcatcttaatcttgggagctgacttagcacagtttctgcctctcccagcccagcctctctgccctatttaggctacttctggagagttccacagtcagaaccttagctatttctgtgcctggtctttaccacacacaggtccaaagatgcccaggaaagctaaatcatagacttccccctactgagcatgttgggctgcctgcagtctctccctttatcataggttggccctctttccacattgccatgcagctttgaatgactgaatgttcaaatttttcacagtgttttcattgcttaacaggacatccatggctgtaatttttcagtgaagcatagaatgtgttaattaaagtggcaatggaattgggacaggttgaatattaaatgtcacttctattgtgaataccatcatgctcttaacatttttattttgttttcatgaagacttagtaagggttaaaagtgggcgcattagtgagctggtatttgcctgcccaccaatgctgattttgatttccatggcgtagttctttggggtcagcatgcatggtgtgttaaatgttaccggggacctgaggaataggagagccctttccttatgacacttaatcctgaattatttatctaaataattaagggcaagcatttttaacttcgttaacctatagtttctgaataaaagagttattgagagctctgactcaaggacaaatgacaaaagatgatccctggagtcagggcatcaccctccataagtctcactggaggtttgcttcctgcacaaggagacatgtctgtgatttgtgaagcattcatcttgtttcacaagactttatgctgcacttaggctaaagtcactgccgaataagtcacttcactatcaagaaagaaggggatggcttttctgggggagcagaggcatattaaggtagaggaggggtggcgcaaagcagtccagccaagaaaaaaaaaaaatcttactaacaggcttagaattaccagcacatgttgatagcagaaagcagattggcttttagccagttttattcttgtttttaaatctctaaagacaacgtacccacttagtgcctgcacttggggcaacatgctcccactcccacctcctccttggtatgccagtgcagaggagtttgttcacacatttaagatattacataaaatacatctctgaaggtcgacactctcagggaagagcaagaaatgactggagcatcttagctgcaagataatgtcttattcagatatctttactctaggattatagattttttttttttttgagatgaagtctcactggatttcccaggctggagtgcaatggtgtgctcttggctcactgtaacctccacctcccaggttcaagctattctcctgcctcagcctcctcagccgctgggattacaggcattcaccaccatgtccagttaatttttgtattattagtagagacagggtttcaccatggtggccaggcttgtctcaaactcctgacctcaagtgatccacctgcctcagcctcccaaagagctgggattacaggcgtgaaccactacgcccagctggattatagattttgacactcagattactttggctggtctagtaggcaaataatgacaagacatgctcctgccaaagatgtccatggcctaatctccagaacctgtgagaatatgctacattgcatggcgaaggggaagggagactgcagatggaattaaaatagctaatcagcagataggaagatcatcctggtttatccatgtggacccaatgtattccaaggagtctttaaaagtggaagagggaggcagaagaagagagacagagtaagatgtgactaaggaagaatggttaaagaaatgtcgctggtatcagagacaagaggaggaggccgtgtgcttcctcttcatgtgggctatgcatattctcactcataggtgggacttgaacaatgagaacacatggacacaggaaggggaacatcacactctggggactgttgtggggtggggggaggaggagggatagcattaggagatatacctaatgctaaatgatgagttaatgggtgcagcacaccagcatggcacatgtatacatatgtaactaacctgcacattgtgcatatataccctaaaacttaaagtataataataataaaattaaaaaaaagtcaaggaagtgaattagaggtccctagaacctccaaaaagtaatgcaaccctggatggcatcttgatattagcctggggagacctgtgtcaaacttctatcctgtagaactgtaagataacctgtgtttttcttgtaaaagatttcaacatttgctttagattcagggggttacatgtacaggtttgttacatggcatcacctagatagtgagctagtacccagtaggtagttttcctgcttttgcccccttccgtcttccccctcagtagtccccagtgtctgttgttcccatctttatgttcatgtgtatccaatgtttagctcccacttataagtgagaacgtgtagtatttgattttctgtttctgtgttaatttgcttatcaacctgtgtttttaagcctttatggtaattacttatggagcaatagaaaactagcacaatagataaagtcaaaattggtatggtatgtagaacctaacagagcacggtcctggctccacatctgattagtaatgtgcaattggtaaatttctttagccttattatccttatctgtagaatggacataataatatttaccttatggggttaagagagaatgaaataagaaagcaactataaaatgtctgggataatgcctatcagggtggggctgcccaaagatactaaatttgattttatttctttcctcttatacaatttggtggccctcttagtgagtggccccatatcgttaaggcttactgctaactggcccccctgagtccttagaaatatcaccacatttattgatatttcactgtgttcctctgagaacctcatttggccatatagtcttctaccaatcactggagttttcattagtgctagattggcattagacacatggttatagaaggatctagtagattattattttgtaggagacatcatcagtgctcatgttaaatgaatgatacattctgttgaattataaactgcctctcctacacctttgtctttgtacatttcagtccttcttctctattcaaaactgacgaagtaaatcagttgggaagaatacagtaatttatttgaataaacatttgtcaacattgtttaggaaaataagttacaaattgactgtatcgtcatgttcctgcactaagaaagcattaggagtctgcctaaatccttttatcaaaatgtattattattattattattattattaatttttttctatttactctttcttttttaaaaaattgctctcctctagatattttttctgccactctttataataaaggagacaatatttctaactgcccaacagacttcaagatgatcttgacagcctctgtagccaaattatcatattaatttgatctcagcaacacttctggttcactctgttctgtactcaaatccaaatcctgagctttttcttgagcaaataaaggcaacagctgtgaggtcccagttcatctttccggttttacccatacaacaacaggctgtgcaaagttgtgagcaattcacacatagtgctctcaactctatttttattaagtactctgaagagcaagcaatcttcaaactcctataaaatttcatgaccaaaacagctatcgggatggtgtttcccttgaaatgtctctatgagtacagtcatttattattctaggcttcctgataatccttattagtggataccagaactgtgattttaccgtatttgcaacctaatgagtaagtctaccacatgaatgctggcagaagatacaagattcctgggtcagagatgaaggatagtttattgctacaggatagcagaataccagcatttatgccagtccctaaaatttaagtcccatggggcaaagggaagagggccagacaatgcctgcagatgtaataggggagagttgagtttagggtacccccaaattttataataggcagtactttggtccagataaagacatgttttttatactggatagtagacaaacatccatttgctccagttggagacaatacttctgtcttcccatagatgttcactgtgcaaacaattcttgaaacaattgcctggaacaaagttatcagttattagattttttttttttttgagttggagtctcactctgtcacccaggctaaagtgcagtggcatgatctcagctcactgcaacctctggctcatggattcaagagattcttctgcctcagcctcctgagtagttgggattacaggcacccaccaccatgcctggctagtttttgtatttttagcagggacagggtttcaccatgttggccaggctcgaactcctaacctcaagtgattctcctgccttggcctcccaaagtgctgggattacaggcatgagccaccacacctggcccaaagttattagatcttctgttcacaagatacacagaaatgtgagaggccataacaagttgtcaccctacaatgagtttcttagatgtaaatcgactcttcccttcctatgttggtaagaattgtgccatatgaaacatcatcataggcatatgtaatgttaagcttttttgccgtaagagaaaatttttccttgcttccttagcagaatacaggcttcagttatgtgatcaacctgtttggatctgctaggttaaactataaatgcatttttaaaaatactacagatatttcactggacaggaaatggggatggggaagacagaggagagagtgtatggcctggtaacaaagcattaccctttctgttgcacactgctgcccattttaatgttggccagcagccaggacaaagagccaaggcagctccaaaggatctcagagttggaggcaagagagagtcaaggaagctcccacatgctgaaatgtcaaacctaagcagacctggcctcagagtacaacacaatcagatcttccaccatcagagtcattgatagccacactggctcccttgctgtttctggagcacagcagacatggacccacttcaggtcctttctgctggctctggtctgtcataggtacactccttcacctgatcacccagggatcgctttcttatttccttcaagccttcttcatccaagtactgaccaggcctcacactgcttagcttccgagatcagctgagatcaagcacgttcagggtgataaattagttcaatcactgtggaaagtagtttggtgatttctcaaagaacttaacacagaacaagcattcaacctagcagtctcattactgggtatatatccaaaaaagcacagattgttctaccaaaaagatacatgcactcacatgctcatcatagcactattcactataacaaagacatgaaatccacctagatgcccatcaacagtggataggtatacatatgatacgtatacaccatgtaatactacgcagccatacaaaaggtatgaaatcatgtcctttgcagcaacatgaatgtagttaggggccattgtcctaagtaaatcaatgtaggaagagaaaaccgtatgccacgtgttctcacttttaagtgggcacaaaacattgggtacccatggacgtaaagatgggaacaatagacactggggactactagatgcaggaaggtgggaggggtgaaaaagctaactattgggtaccatgctcggtagttgggtaatgggattatttgtatcccaaacctaagcatcacataacataaccaagtagcaaccctgcacatgtaccaatgaatctagaattaaacttgaaaaaaataagtaagtaaaacataaaacatatagatttttaaaaggcatcttcaaatgtcaccttgtagtgccccaccctgaattgtagtcacctacacacataaactcacacacaaacacacactcccatacacacatcaaaacattcaatacacctaccttactctatttttttttctgacttccaacatagtacatcatttatttaacaagaacgtaagctcaacggggaggaattgttctctgtttattttctgatgtttcctaggtacctagatcagtgcctggtgcatatataaatgaatattttgagtgaatatttgtggaatcatgaatgaatgaactgatgaatgttaatattggtatttttcattgttatttgtcttattcctaggaagacaggactagtcatttgaggtactttttcagaacagccagggctggggaggatcctttatttgtgggtgttaaataatagcaagtgaacacagtgcagcagtagtgaccctgttgatgatgataatgaatcacattgatatagtgcttttctttttctacctttgtgtgtgtgtgtgtgtgtgtgtgtgtaattctcctcagtgtcagggtgatagattatgcccattccttctaggaaaatggttattccatcttaatgcaggcttttagaaatgaaaaataatgcctgctacaatcaacttttaattatctacactaatggagtgctgatgctaaagaaataatccccaagtcatttacatttgactttaggatgcaaccgagggcttgtattcagaaaagcacgttaaaccatcgtcagcagcatgtgattgcagaacaaattctggcctgggagttgggaaactggatttggtagaggctcggtgttatgggttgaattgtgatgccgcccccctgccaaaaagatacgttagaatcccagcccccggtaactcagaatagaaccttatttggaggtagtgtcttgacaaaggtaattaagttaaaatgaagttgtttgggtggaatctaatccaatatgactggtatttttatagaaaggggaaatttagactgagacagagacatgcatacagggaagaatgccatgtgatgcctggaattatgctgccacaagccaaggagctactgcaagttagcaggaaggcctgggacaggcccttctctagcacctgcagaggaagcagccctgtggacaccttgatctcaaacttccagggcagtaagacaaccatgtctgtggtttaagctaccccattcatgggactttgttatgacagcccttggaattgaatatgcttggtgactcaactcttatgtgctcatctagcatacagttccctctcatctccaagcctccgtttcctcatccctaaaatagaatccaaagcccctagctgtttaagggctctataattagaaagcttctgacagaaagtccccatcagctcctcccagtttagcagtaaacccatccacctaggtgtcctctaaattaggtaagtgaccctagaagaaagttccacacatcatctgaaccgcggataaaatgcatgcagaaatgactttattcaaattcaagagtttacattttacttaactctggaaaactcagagtttaaacattttcacatttttttttaaatagcaagaatggcatgccacatcatgatgattcagctctcatctctatttctctaggcagaatgcatttacacatcatccaatcccaccctatttccatgtactattagcagaagcaaatatcagccttcttcaggccctggcaggataaaaattcagcccagtagacactgggaggacaagaatgaggatgtgacttacattccccagggccatggcattcaaaaccaccatacccactgaatgtgcttctctatcgctttgtttaatatttggagagtagtgtttgctccaaaacttgtaaaaagtgagaccaatggaaaccattggtccaaagcaatcttacctgagaaacattttaaaaagaagtctttcccttatgattcctcttcttactctacttttttgaataaagagattaatacccaaccgatgactactgcaaggatgaaggttattctttaggagaaaaaaaaattgtaacatacatttttatgaaaaaaagatttctaaatatgctgataaaatcactgacatctcagtaaatatagtttattcctaggaagtgactagaatgattgatttagctatatgtaagttatttaatactgtttgaaaggtacttcatcaacaccatttactgtgatcaatagcattttcaggaacacttcagacttggggaggttactcctttgggtaaccttttaggattatctgttgtgggaacaagaagtagccatcaaaagccactgagcaggctgggtgctataatcccagcattttgggaggctgaagtgggaggactgcttgaacccaggggtttgagaccagcctggacaacatggtgagatcccctatctacaaaaactatattaaaaaaatttagcttgttgtagtgtacacacctattgtcccagttgctcaggaggctggggtgggagaatcacttgaccccaggaggtcaaggctgcagttagcattgcttgtgccactgcagtccagcctaggtgaaagagtgagaccctgtctcaaaaaaaaaaaaaaaatgtccctctaagcagttaaaataggtcaacatcaaagctcatggttctggctcttagtcaaagcctatttatatctgacataattctcatatattgcatatattgacctgtttggtttactaatccacattagaggccaacagtatagaaccagaatcagaaaatctattaaaaggaaatgaaagaataaaaaagcatggcaatatcaggccattaggtgtgggtacaaataatctcccaaaccacagtagtctctgagtgtttcactgacaaagtttagttatcgataattataattatgaccttgaaatcctagcgtagacattgaatactatgtttggaagtcagggaattgtttaatatatttaagaaagatattcccttcaaagcagttcaagtggtcttagtattgccagttaaggaagtgggttacaggatcctggaatgactcagtgatatagaaaggctcagtccctggcaatgtcagatgagtgaagaggttgatgcaaaagtaattgtgatttttgccattacttttaaatgtaaagtacaggcactaacatagtattagttactaatagtattagttatttagtaaattacttttgtactaacctaatactatgttagtgcctgtacaaataatgtgcagtaaaaacaatgagtgtgtgtgtgtgtgtgtgtgtgtgtgtgtgtgtattggaaagcagttgatctgtacacatacttacagtttactaaacaaatgtttgagtgcctactgtgtgtcttgctttggctgtgctctagacagtcatgataacagagatccctggtctggggaggtcccactctcagagcaattacggaagaagggtagaggaaatcatgcaagtatgtagggataggctgatgagagcggaagcatgagggctgagagctgcaggctgtcttcccactagtcagggaaggctttctgattaaagaaaattttcatcacctatgcttagaagtttagactcagaataactgatggcaaatggaaaagatgaaataaactaggatgagaagacaagactgcccaattcacacaatgaatccagtctctgaatcagtcgggtgctagccaaagcagaaatatttccagcagagccctgggaacagagaaggaggcagtttttattaaagtcttagtttccaaatgatggatgccaacaagaaaatagtttaaaattccaagagaagccttcacctttcattccattgtagagtaatggctttttcaaacacattcaaataaagccagggttgttaagtagtatgtctcaatcaacatactcaaagtctgtgaaccaaaggcatagtcttaggcttcctcttatagtctagcatgatattattctatttcatctttttttatatgtttgctcccttgagtgttttagaatgagactgctagattttatgtttctaaagctggttttctaccaggcctgttctcagaacattcttttttttttttttttttttttttttttttttttaagatagagtcttactctgtcacccaggctggagtgcagtggcgcgatcttggctcactgcaaccttcgcctcccgggttcaaacgattctcctgcctcagcctcctgagtagctggaattacaggcgcccaccactaaccccatctaatttttgtattttttagtacaaaatgggatttcgccataatggccaggctggtctcaaacacctgacctcaggtgatctgcccgcctcggcctcccaaagtgctgggattacaagcatgagccaccacgcccagcctagaacattctttcttggaaaggaagaacatcacagccttctgtgcattctcttgttcacccacataggcaaggtgatgtgtttgcagccttctttttaccctcacctctgggaggtggccttggctcatcacctattgtttcatgctctctcttaaaggctgatttggtgactgaattcatcattgctgcctacacacccatggggctagcctgggcaaaatgtgcctcgtaggttgcctgaccttttgccttttggcaacgtttatcacctctgaggattcagcttctttcgtcagaaagtgagaacttggatcaggtcatctctaaggttcctttcagttttaacctttcagaagtcacacaaccataaacatttggtgtacctagactgttggcttattgtccgactttaagccagtcatttcagttaaacaaacaaaaatgggggcttgccagagtcaagtcatacaagactgctttcctaatatttggtgcttcttaaatgaagttgttatttatgcatccctcaatcccctccctcttctgcatattttgaacttgcaaagccttctgatattttaagcagaaggttgcaaatgcttgtcctactgcctggccaagtcttaggtaaaaattgtcacctaaccacatcctcagatcatttcccctgtactctagatcactaagcgcatgtgcacacacacgcatgcacgcgcacacacacacacacacaccatccaggatcctcctgaggatgaatgaatattcctgggccaaatattgcatgaggatttgggcaatgttttggctagttgaacaacaacaatgctcatatttatgccaattggcaggaccattgcttgatcatcctgtacttggtgaagggcattttttattgtttccttttttgtttgtttgtttgtttgttttgtgaggcagaatatcaccctgtcccacagactggagtacaatggcatgatcttggctcactgcaacctctgcctcctgggtcctagcaattctcctgcctcagcctctcgagtagctgggattacaggtgcccaccaccacatcgggctaatttttgtatttttagttgagacagggtttcgccatgttggtcaggctggtctcgaactcctgacctcaggtaatccacctgcctcggcctcccaaagtgctgggattacaggtgtgagccaccatgcctggcccaagggcattgttttctaatccagataactaagctatccttagggtgatatgtaatgcagcaattgctagaaaatgacatgttttcataatggatctttctccaccatctagaaatttaggtaaagttgaaagaaaggataggaggaaccatttactgtgcacctactttcttcctgagattttatacatgtcatttgatgtttacaccaagtttttgaggtcaatctcatatccaaagctctaatcaattaactttaaattagttaatgacagggctctcttattcttaaacctgtcatttcccctaaactatgttgttttcctaaagtgagattaaaagtttgaaaacaaaggaacaaaatgttcatttatttactacgtttctgaaaacttgcatatatcttaatatatatatatatcttatttatatgtcttatttcattgttatgaaaacctagctttctttccttctatcctttcaatattatgctacttgtatttagtatttacattgtatgattcaaaatattgttcactgcagagccaagtagtagactatgaccgctctgcttattttgaacaatcttttatttttttctggagttgataattgcttcagatttttgtctggctttttataagcctgttgataatttcctgtttattctaatgtctgtcatatgcctatccatggagttaacctagtttcattttgtttttcatggccacatctttatcctcctttctgtgggggccctcagcttctgctttaattccagctagatactttctgctttcattcccgctatatactctaattccagctagatactttctgctttcattcctgctatatactttaattccagctagatactttctatgtgggctgcaaaggtgtagccctgatacttttctcatctatcatcctgagacttcatcttacaattaccctgttttccaaatctcatgccttctacttccttcctttactctccatttagaatatttttcagcagcttctaaattagcctacataagacataaactcttagatcttacttgtctgaaatgtctttcacatatgattggtatttgagctaaacataaattagagattgaaagtcatttctcttcagaattttgaagacttctctactctttttctttctgctgttgtttttgagaagtccaataacatatttctaatcctttgtattttgtttcctctctgaaaactacttagatattcttttattacaaatattctaaaatttagtaatttttaaaattctctcattgttttaaactttttttttgagtggagtttcactctttttgcccatgctggagtgcaatgacacgatcttagttcactgcaacctccgcctcctgggttcatgtgattctactgcctcagcctcctgagtagctgggattacaggtgcgcaccatcatgcccaactaattttgtattttttgtagatacaggatttcaccatgttggccaggctggtctcaaactcctgacctcagatgatctgcccgtctcagcctcccaaagggctgggattacaggcattagccactgcacccggcctgttttaaacatttaatggactcaccagggaattttcttgtcttattactttgataatttcctccactccattttccctctaatatttttactttcggggattcctatgagtttgacattggttcttctggactaatgtttcctctagtgttttttgaagatgtctttttggattaaattctagaaaccgcctcaactttatatttcattgttgctcttgatggttttaatgcagatactgaatttccaagagtgctttagttgttctcttagtgttcatttcatagagcacgttgttctcctttaagaggtcatatcttctctttaacttccaggatttttttaaccgttttgtctgttctttatattatgttacttttctctcatttgctccacttcctccccaccccacccctgtttatttagatctcttcctttcatagtgaaggttcttctcaattcactagctacctcaactgtccctttgtatttgagaacaaggcattgagaagcattattttggaagctctgtgtgcatgaccaggacttgtcaaagactggagcttatcacaaggggatcagatagaaagctgtcttttctataagaggcattcccaatgttagtgtctgcaggccttctagaactggaagcagaaagtccctcctcggcatgtagagtctcactcattcccgtttgcattccatcacctccctgccctgagccctttgcacttgtggtacatgttgtttgaagtatgatgcttcattgattagattccttcaggggtaaaatctccattctcgtgtggggaaggtgatactttaagtcacctggctgtgcagcaacagagagggaccaggtagtctaataacaccttatgcagacttccaactcttgtttctcactataccttattctataaacttctggggaaacggctttctttgaattctgagcctttcttaggtatatttcaggccaacttacttgtaccttgtccatacacttgtcaactggcacccaagttcaggcagtctccattttaatcaatcagctgctgctcatccacctttcattttatcttccaaaatattgttataattcttatgcattggttagcttcttttctttaactttgtccttgtggattactactcattttggtcttttattgttactttagtggcatttcaggaggaaatggaatggaagtgtgaggtcaatgcagcatatcaaccagaatctagcctgaattgcaactgtctcacaataggtgccggactctgcagttatggttctagatagtacaaaatttcctctctcttatgagaaatatgaaatcatttaaagcagttaccttttctaaacaattccatggactctgagtcaaaataatttggcaatcatttattccaacctctcctggatgcctaaactatatccctaagaggtgattttacaatcttgaattgaatctctccagtgataaggaatttacttacacatgaaatgattcattacattttcaagtcatgttgtggtaagagttagagtgcttctaagtatctttgttaactcctaaaatctgagtcttacaaataactgacttatcaagttgtaaaaagtaaagagaaaatccccatttctcctactttaaatagaccgtagaaaataatgatgtccaaatttgtcaaatacgtcaaactcaactgcatataggaccattggtgtacttataatccaagaagtgccaacacaaccatatggcatcagttgaagggacctcaagaagttaatgtggatttcacagtggcaaggctgatggctttagtcttgctgaaagttctgcttgtttgatgagaaatatttatataatattttcagaggcttatttcttgtatgtaaactctcagatgtgaaagggaattcatttgctgcatattgattagctcgttgagtgttaatttctcatggttgtggtctgcatgagagaactacaatcagctagagtcaaagaaaagtggatgcttccaccagctgatttttattttatttttatttataatatggaacactactgtaaaagaatctttgcctgtctttccactttataattataaagaaaaggaaaaaaagaggttagagggcccttcaaggtactttaaaatgtttttttcttagcaattcaaaatgtcctagtgaaacgggagagttccctgactcccttcacaggacttgtgacaggggtgtcttgtttatttggcctcagtgctcaaaccccttatgggatggggaacatgcaggtgcacaggagcagaagccagggtgagtgcttttgggctccagccccacagtggtgtctaggggtgttacaatgctcttttagccctgccatctggagatggcttaagtgttaaacagctcagtgaaaagtcagtgtgacagccttttggggttcccatacccagtgtgtcctgaattcttgttcagtgtccatgaagaatgaggtcatacagacctgaaggctggtgaatgtggggattttgttgagtgatggaggtggctctcagcaggaaggggaacgggagaggggacggagtgggaagatgatcttcccctgtagttcatcggtcccgtagctgatttcctctctgtccacagctaaactcctcttgaccttcagacacttcctctcttccctcctctgctgcactgctctgctgctctgccactcttctgcttgtggagcctggatattggggtttatatggatgggcacacgatagggggttgcagtgggtcaaaaggcaacatttgggtgcaaaaacaggaatgcctgttctcacttagggctgcaggtctacgcttgagggtggaaccctcgccaggaactcttttgcctcctgtccatatcactaggaagaccattgatgtgtttgatctttgtaaaactacatatgactctcaagttgcaagtgatactgtggttcagcttatcaaatactggaatttggcttctgtcactgactctgccactggctttgtggtcctgaacgcagccctgatgtcagatgtgttggtaatcttggggaactttaagcaagccagctttttttttttttttttttttttttaggactagatggaggtaagggaaagtgtgagacaataaaactggcaaccagaaacagaagaagaaaggaagagagaaaggaatctacggagtgtggaagttttaggagtaaatttctatataagttgcaaaattttagtaattctttagttcttatttcatttattcacttattttttttttctttttagacagagcctcactttgtctggagtgcagtggtgcaatcttggctcatgcaacctctgtctcccagcttcaagcagttctcctgcctcagcctccccagtagctgggactacaggcaccagctaactttttttatttttagtagagatgggatttcaccgggttggccaggctggtctcgaactcctgacctcaagtgatccaccttccttgtcttcccaaagtgctgagattatagacgtgagccaccacacccagcctcattcattcatttattcattcaacaagtattaattgtgtgcctactataggccaagtgtattttgggccaagtgcatttctatgagctaaggatatagcagggaataaaacagttacctccatcctcatggcacttacattcatgtacctgcaatccccatcagaatcagcaactaggaagagatgatatcagagcttgaacgtggatccagtaatacccatggatagttctgtggaagtaccacagagaaaaattcaaaggaaagaggaataggatatattgagatacaaaaagtgtagcaatggaaaatcaggtgatcagattattgagaatgaaatatctttagtaaagatttgaaggagttgagtagagatatctcctagatatctacacctacatagaagatcatgccaagaggaggagcagcatgttcaaaggagagaatgggtatgacatgtttgaagaatagtcagtagtttggtatggctacagctgactcagtgagatgggaatgaggtcagaaagatgaggaaagggcagtccagattgtgttgggctttgcttgcaaaaacttcagctcttacttggtataagacagcaaaccattgaaagagtttgtgtagaggagtgacatgatctgacttcttttttaacaagatggctcttattgtatcattaacagcatggttttacatgaacctatcgttttgtttagtttgtgggtcaggactgaacaatgaaagtagaagcagtcctgtgacagtggcactaattacatttattgtcatagagaaagctcatgccagtcacatactagtcagaggagttttcagtcctaattgccacagaacaaatgactttggatgttaaatggactatagtcccctcatttgcaaagtggggatagtagtatctatatagtgaattatgagaagtaaatgagaaataacatttgtgaaaatgtctgacaaaatgcctgaggtgttaacggatcttttaaaatgttaactgtagcctcaatggattgtaagaatatacacatttaaacccattgacataaattatggctagaatgaaagttttgatcatcttgatgatagtttttgtcttttgggtttctttcttgtgtgttctatctgaagaaaatcatctgaaatccctcatttagaaattgaaatattttatgtcagcaagcacatatgttaatgatttcctgaatcagaaatgtgttcaaaatcatatctatagcaatgatcaccacagcggtagttctattagggaaaatacacgaaaacaaatataaaacaataacaaattaagtaactaattaaataatgtgtggcatggaaataaatgaaatactgtgcaaccttcgaacaccattttatagaacaaataatcattggagaagtagacgtgatatgttgttaagtaaacatatcatataaatggcttagaggcttagagatgtgtaggaaaggaaatactctaaaatgttaacaagaatggtatctctggtgcaattaaaagtctttttaatttggatgggtttttttatattttacaaatatttctgcattgattctacattacttatgtaatcaaaggtgcccaatacgtgttacttaaagaatctcttcaataattagaacgtaggcactcaatgctcatttttttccccagtgattctctgaacgtgtgttactaccatccaggagcagaactatatcttgctgagacatttgtgataatgacaaaacgtttcaatcagaaatttgagataaggatatataaatgattttttctcatgagaaataaaacgcaggtgtgttcaccaaaatcctgctcttttactcaatccccttggccaaaagtaagcacgacctctctggcattgtgaacaaaaagaggaattaactcaaaaagactaattttatgcattagatgatcctttagaataatcaagcatatgagtattagggtaacttatcctttttacttttcctgagggaggtaagagtagcaccgacttgctactgctaaagatatggactattggcctgggagggtaagcattttctgtctgatttaattaagaccactacctgctgacaaggctttgagaaagaaacaaaaataaggaatgcacaaataaaatgtaatgcaggtcaggcatggtggctgatgcctaagtgggaggcttaggcaggtaatcacttgaggccagaagtttgagaccaggctgggcagcacaccaagaccatctctctacaaaaaaaaaaaaaaaaatacaaattagccatgtgtggtgatggatgtctgttgtccagctagtcaggaggctgaggtgggagaatcccttgaggccagttcaaggttacaatgagctatgatcatgccactgcactccagcctgaacaacagaatgagaccctgtctcattcaattctttaaaaatctaatgcaaaaacattagaactgaaactagaaccagttttattggaagatgatggaaaagcaccttgtgatttatctcttttggtagcagagagctcatgatcgtccatctaactcccacaccatcttggagagccacagggtatcctacattatcctgctgaagatccttcagtacctaatggctctcgtgaagcattccaaagtgaaagtcatggagcctatgccactaaatcagatataactagatacatgttggattaaaaggaaaggaggaaaggcatagaagggaaaaacagagattattggagaccaaatacctctataaattctcaaaatttgtttaaaggctttactttttcaagatgcatattttggcaatagcttacgaagactgaagttttcttatttaatcttagagatactaatacttagaaaagaaaagtcttctatcttgttgaccttctctgtagccatttgaaatcttcattatcagaataatgcccctccatgtccacaattattaatttttatagatttagggggtacaagtgcagtttcattacatggatgtattgtgtaatggtgaagtctcggctttttgtgtagccatcacctgaatatagtgtacattgtacgcattaagtaattcctcatccctttcccacaacctccacccttctgagtctccagtgtctataattccactttctgtgtccacgtgtacacgttatttagcagccacttataagtgagaacatgcagtatttgactttctgtttctgagttattcatgaccagaattattattctaattattgtgaaataaaaattatgcctgactaaaatgactgaatccagaacttcaccataatccatctatctcctccgtgagtcagtgcatattacctattccaatgacctcttcagtactgtaaatattactgtgttccttttatttacttaataaatagatgtcaaatgtgtggaaaacaacatttgttttttcaaatacatgtttataacaccctttggaggaagtaagcctctagaacatgacagtctctggggtatgctattttcaggtaattttaaatgtcgctttccaacaaaaatgcaatactattatctttttttttaatgacaaagaaaagcaaaacaagtattatattggtgcaaaagtaatgcagtttctgccatttctcttaatgccattactcgtaagggcagaaatgaccattacttttgcatcaacctaatacctccagattttagatatttgagtgccattgcttgatatatcttttgttttttcttctggaaattttggttactttagttgcataaaggatgacttccattttaccctgttaagcatctctgtctggtcagaagctactactctgttctttctagttcagtagggaacaatcagtttccttctcaattttcagctaatctttatgaatgaaatttgattaaatctagcaaaactatgcaaacatcataacagcatatggggagccttcctgtagtaccagtgggctatttccgtctaataacagattcaaaaaatccaattagacagtttgaaaaaagaaagccagagttaaaaatatctgactgtttgactgagaacagcagggaatggtttataggccaatcatttatggtgaataggatcttagtggtgagcaactcacatctctagcccattagaataatgtgttactcatattgctcctaaagctttctacttaattataccaagttaaatagcagacattctcactcccttttgatggaaaatcacatttattcacccacacaataccatccttgggtgttaagggatgagagttgacctaatgggaagacaaacaaatggtttaggaaatgagacatgatttttttacacaaaggttaatgcacgagaaaagaaatgcctaggtctctgtctaatgtctatgtgttctcatcgaataattcttaaatgaccctatttagtttgattttctaactacattagaaatatatgaaacaattaagaaatcattttttacctgtcatatggcagatggactaacattgatcagggcagtcgaggaggttgtaaggaaatgggtactctcaaacattgctggtgggactatgaagtgttttaattttttttttttttttagacggaggtttgctcttgttgtccaggctggagtgaaatggcgtgatctcggctcactgcatcctctgcctcagcctcccgagtagctggaattacaggcaccctccaccatgcccagctaatttttgtattttcagtagagacagggtttcaccatgttggccaggctggtcttaaactcctaacctcaggtgatccgcccacgtcggcctcccaaagtgctgggattacaggcgtgaaccaccgggcccagccaagtgttttaatttttaaaaactatttgaccatatgaaaatatagatgttccattaaatatatatagcctaagaaatataatcagcaatgcagtaaaagattatgtatacggatgctcctgacagttggatttacaatagggaaaagctggaaacaacctaaatatttgaaaaaagagaatggtaaatacatcaaaaatacaataaatacagtgttaagtgaaaagtttgtgcaattttgacttgagaaatttttaatgtactatgactacttggaagaatatggatgtacctcaaaataagtaatgatctatatgaaagactgtttttgataatttttgttttcttatacataccttccaatattgtccaaattttcaataataagcatgcatagcctaatatatcatgtagatgagtgcaaaatgaacacagagattaagatcatgggcttttcaatgaaggtctgagtttgaatcctgtctctgccatttactagcaatataatttcaggaaataacttaacatctctgctcttcagtttcctcatctgaaatataaggataataatggtatctgtgccttaaggatgaccaaagttatagatatcttaagaatgaattaaatgcgtttctctccatggactattttaacaatgaatgcctgacatagcaattatgttccataatcaccattatttatttataaaattatttagtattatttaatactaacattctggttttataaaaccaaattttaaaaatagataagtaaatgaaaggacaaggaaaacctaatttcactgtttttctagctttttttattgctataacttttatatcataaatccacccatttgaagtgtatagctccattttactatactgttttcatttataaaagccttttataaatttatacatacctttcagtgttgtttgaattttccatagcaagcattcatagcatagtatatcatgtagcagggtttaaaataagcatagaagagggtttcgccaaaagattatttaagaaaatctactaaaagagggttcttctgaaaaataaaatgtatttgcttttatcaaatgagcaaacttcatccacttggagatcacccacatgtgaatttctttctttctttctctctttcccttccttccttccttccttccttccttccttccttccttccttccttccttccttccttccttcttactttctttctctgatggtaagttacattagaggacaggaaggctcagtgatcagttttgatgggatggctgcacagaggcacatggagaagaagcaaggaagccaccttcagcttctgggtctctttgttatacaggaaaggaagtcaactggggtaaacctgtttggaaaggattgagtccttctctcaattttgaagggatgattttttagttcttcagatttatcttctgtaaataaatttcttcagaagcttcctgcaatatgataaacacaaatgattaggaagtgttttgtaaggattggggactaaagaaattattgatgaagccagaatgtgtcaaaaaggtgtcgtaaagcagcaatacttaaacattttggtctcagagtccctttacaatccaggacccaaagaggtttttttgtgtttgttttttgtttttttctaaaatgggttatacctatcatttttttcatattagaaattaaaactgagaaatgtttgaacacaggaatacccaagtacatattccagtgatcagcagagcaatggcatcatcacatcatattgcctccagaaaatcccactgacaatttgttgaagactaaaagggaaaaagccaaacaccttagtatgctgtaaaaacagctttcatctcacagacctcccgaaagggtcttgaagatccatgagcaatccctggaccacactttgagaaccgcttttgtaacgtgtgaccttcccttatcctctgccatgcgaaactatctcagaatctaagattgtctacagccacggtacaaccagctctgagactttgaagagaagaaaagatgaacttcatcactaaaaaagccaaagtagttgaaagcaaacactagctgaattttcttcctccaagcctacagaccacctcacgtagtagctgtagtgggagctgctcccaagatttgataagaattagtaaagaggtttataagaccgtgtgtgcagagtctcacagttgctgatacttgttgggcttagctttatctctgtctacagtagcagcccaggacaaaacattcatatgatattctctctttcttctttaaccatagataaatgtcccaagaaaagggaagagaaacagaaaaatcatacatgctaaacaccagtttattaaatatatttgttgctgtttttcttttttacttggttgctcacaatattaatacaccctctttataaaacatgaaagcaatacaaaagtataatgagtaaaatgagaatcctaaaatgttttcttccataatcctctctctaatcgcatttctcagagataactgtgttagcattttggtgtgtttcttatagccctttttgttgtcaaaaataagcaaagataaaggggaaagattttgttctgtttcttttttctatatacacagtatatcttggagatagtttcaagtgccaaatacatgcatttatttttttcacagaatgcaagtcatgtcatagcatggatgaagttgggtttatttaatcattcactagttggcaggtatttaggttgtttacagtttttccattttagaaacagtgttcccatgtaaagaatgtcccttgtgcataaatcgttgtgacatgtgttggaatctcaaaagtggaattgctgagccaggggcatcctcattttaaaatttaatagacatcatcattatcctctagcatgcacatcactttacacaactgatggtaatttatgaggaattctatgtcccctcactccaacactgcatctagtcactctttgaaaattgtccagtctaatgggtgaattatggcatcttgctttgttatgcatttctgtgattaccagtgaacttgaacatctttccatatttttatttatgtttaacatcgaaacacgttacgttttgaatattttcctctactctattactgccttttatccttgattatagtttcttccatcacacagcaggcttgaatttttgtgtacttaaatttgccaatcttttcatttctggttcctgagtttttttgtttaacttaggaaccacctcctcccatactatctccaaggatagaaaaatactgttttctcctagagcttttgtgaactttattttttacaattatatctttagtccattgatggctgtgccttttaaataatgaaaagtccatatttaagttatttttttcccaaatagataaacatttgccttacaggatttagtaagcattttatcctttcttcctacatttgaattgccacctttaacacagggatattaggtaacttaagaggtaaatgtgtgtttcttgaatcccagatctaccacttaaaaattatgtaaggtttgatttactgattcatttttcctgccccaccaacttcatgaccataaaataggggcaggggagaaggaaatgataagacttagcatattataccatatggaaattaaataatacacataaaatacttaaaatagcgtcaggcaatttaagagcactcagtaaagttagctcttattaaatttttgcaactccatgtatacctgggatctgtttctggtttgttcatggcagcattgtcaactaaaactttctgtgctattcagtgtgatagttattggacacaatgaccactgaaaacatggctagaatgatgggaaaattaaaattttaattaattttaatttaaagataaacagccacatgtggtcagtaagtaccatattggacaggagaatgcccatatagtattttccatgagctttcatgagttatgctttattatataaaccagattttatttaagaactcatatggactagattatgaattttatgagatgattttccttgagtcatcaagaagaacacagtttttttctttaatctgttaaagttgggaagtattaatataaatctagttcctacttgaaatcaacattccagcaataaaccttattggttcttgttattctttgacctcacggttaaatttgatttgctaattttggttagagctcttctatattcatatttgagattattttaaatttgcattgtgcattgactgtgagatgagtattttgttggcttggtaaaatgaattaggagacttcatattctaaattctgaaatagtttgaatattggagttattatctgttcttgggagatggtttttatcaccagttcccctaaactcctttttaccttgaggtaaagcaaagtctaccttactatttcttgtatggtgattggctattcaggttttctatctattattaagacaattttgaactcactggtgctccaaagaaaatctgaatcattctattacaaagatacaggctcacatatgttcactgcagcactcttcacaatagcaaagacatggaatttacccaaatacccatcattgatagactggataaagaaaatgtggtacatatacaccatggaatactatgcagccataaaaaggaagaagatcatatcctttgcagggacatggatggagctagaagctattatcctcagcaaactaacacaggaacagaaaaccaaacaccacatgttcttacttataaatgggggctgaaaaatgagagcacatggacacaggagggtaacaacacacactggggcctgtcggggagcatgggagggagaacatcagaataaatagctaatgcatgttgggcttaatacataggtgatgggtcgataggtgcagcaaaccaccatggcacatgtttacctatgtgacaaacctgcacatcttgcacatgtatcccggaacttaaaattttaaaaaaatttaaaaaaaaagaaaatctgaacttgggtagcaatatctctacctaatgatactcttgatttttaagtacttaaaatgagtctgaaactgtagaggaagaaaaattcttcctaccaccctcctcctttctctggctggggctttgtaaattggactgacaaagacagcttaacaagagagaagcaggagtttattagtgtgtgcattgggctcacacgtgggagcactcagacgtgagtaactccaagggctggtaagaccttgagctaatatagaatctcagcaaaggaacaataaatttttagagaaatgacaagacaaaggaacgaactttgagtttctagggtggcagactgtgggaaagcaaatatatgggaaacctattgtagataaagattagttagggaagtttatgtggatgcctgtggttccgtctctggactcctaagggtctagagttgtctctgatgattaacttttatccttcctagtagagaggggagggaaaacacctttgcaaatttgtgtcctgcttttaggcaaacaggggcagggcagagagcttttcttatagctgttttctctcaaaattctgtcttcacatcaaaataatcccaatgccaaagtggcgtattttggggtggcatattcggctaccctacaggacctatgcaaagatatatctttatatatatttaaaccatagttttcaacaaagttggaaacaagaataaggattgatttaaaagatattatatagccattgacatcatgctgcataaaacctatttaattctcatctaactggtagattatacaaataataacattgctttcctttggatattagcattggaaagagtgttttttgccagccttgatggtgcacccctgcagtcccagatacttgggaggctgaggtgggaggatcacttgatcccaggggttcgaggctgcagtgagctgtgattgcaccactgcattccatcctgggcaacaaagtgagacactgtcaatcaagaaagagaaaaagaaagagagagagagagagagaattctttttccttttctttcaaggaaaaatcagaaaatgagtggttgatcttagttcaattaaagaaaacaaaacaaacctgctgggtgcctcctctgctctaaatactaagcaagaaataaagtgaataagcccctgccagtcatgtaactaaactctgaatgagggaagtagctaaaatgttacacataaaagaaagctgaatgggaaaaatgcatggaaattatgagtttagggacattttcacttggccaaatgccccattctctttctctacttccaggtcattgtgataggtattttaaatgaacttgaataatcccttaggacagggttgcctgaggaaatgggggacacccagtcaaattggaatttcagataaacaacaaataatttttagcagaattgtgtcctatgcttacttatactaatatatatacatatattttatttgcctgaaattcatatttatctgcactatatctggaaacattaagaataaattgtaacatcttgtatttgtataaggcaacattttaccaatcttttcttcagaatactagttttatgaaactcagcaaaaagggctatgtggtcccaaaagttgagaaggcatttcgtgctatagctcctcttgcttacagctgttaacttggagtgataatcacctgttctgacaaccagcatagactggactccttctagctgttaacacctctgcagcaggactgagaaaggactggagagccacgtgctatggtttacacctctgagcatttgctgtgtgccagccatcacactacatgctttacatacttcatctcactaatcctcacacacttatgaggaaactactgagagtgtatgcatgaggaaatgcctcagagaggttcagcaacttgcccaaggtctcacagttgtaagggacagagtctgaatctattgcctctatacttaatcaataaagattcattatatgcattagctcatcaaaggttctaagatgtctagagtaaggaaaatttttgactttgtttaaataaccatttcctggaagcaccatcgaaaacattggtagttgcagggtgcagtggctcacacctgtaatcccagcaatttgggagaccaaggcaagaggataacttgagcccaggagttcaagccccatctggccaacatggtgaaaacccgtttctactaaaaatacaaaaactagccaggctggtggtgtgtgcctgtagtcccagctacttgggagtttgaggcaggagaattgcttgaacctgggaagcagaggttgcagtgagccgatatcatgccactgcactccagcctgggagacagagcaagactctgtctcaaaaaaaaaagaaaaataaaggtagggtgttttatatttatatctacataaatctatacattatctagatattatactatattatggaaatgtatatattatattagaattaatatttctaattatcgtatacagttatacattttattgtgttattataacatattatatataattggttctgtttttctgaagagccataaataatgcattcaatttagaagacaaactcttttagttggaatgagcctaataaaaataattaccatcccaagccaactttaggttattatttgtctctgacagtattaaattatcattatattaaattcctagaagcactatagaaatggcagcagagtatttatattatatataatataggttatattattagatattaatatattacattacaattgtattatcatgatattatatataaattggttctgtttctcttgacaaccttactaatacatccagtttagaacataaattctattagttggaatgagcctataaaaataattaccattccaaaccaactttaggttatcatttgtctttgatattattaaattattattattttaagttcctaggagcacaatagaaatgctggcagagtgtttatattaaatataatataaattatatttttagatgtaaatatattactttatgatgacattattgtgatatatatataatataatgagttctttttccctggagaaccttaactaatacatctagttcagaacataattctattagttagagccagcctaacaaaaataattaccttcccaaaccaactttagattatcatttgttttcaaggccatggttctcagccttagttgctcattaaaaatattcggggagggcaggcatgatggctcacacctgtaatccctgcactttgggagaccaaggcgggaggatctcttgagatcaggagttcaagaccagcctggccaacatggtgaaaccccgtctctactaaaaatataaaaattagccgggcgtggtggcacatgtctgtaatcccagctattttggaggctgaggcaggagaaccacttgaacctgggaggcagaggttgcagtaagccaagatcgagccactgaaaccccagcctgggtaagagagtgagaccctgtctcaaaaaaaaaaaaaaaaaaaaaaaaaaaaaaatacttggtgcacttatgaaagcctgcagagcccagaaattctgatttaattgatctaagaaaagggagaggtaaaagctcccaggaaagtctagtgcccagccaaaggccatgggagtgatgagtgaccctgcccacacctaacggagcgtcccctgctctgctagtcagtcaacagaacaccagccaatttctctaagccaagagctggttatttccaacctcccctggaagagtttacttaataccataagaagtcattttctcttccatctactgcaagaaaaaactggatattgcaattgccatcctttttgagttaaaatactctacatttttaaacaaataaataaaaaagcttaaccattttgaaattaccagtagggaagaaatcgggtgaaaaaggagaggaaccatgcattactgagaatactcctgtcccaaatctctctccatatccatttcttaaatttattcattcattttaaaaactcaacttacaattcttgaaatctttacctaggatatgtcagccagtattctagacatctggtatacatcatagaacaaaacagtcctgcccccatgaagtttcattctagcttacccctagtatatgccaggctctgaactaagtctaaaacagatgatccctgcccttccagctccctgcaaagccagcattaataataggagggctttttacagaaaatgaaactgtgacttgtttaagttacaacctgtgagtgttgaagtcagagtaccagtctttcctgtataccttaccacctatttgaaaaatgatggatagttatcttaaacggtgaagaattagtgtaagttcttaaacaaaatagtggcgatattaagatcatgcttgagaaacctaattcttgctgtctccttacatattttaagtttggcctaactctgtctctgtgcatagtgagctgtaatgtaactggatgtgtaaacagattgtagcctactcttgtgccaatctccaagttttggccaatcaaaggtggccaaccattcaaaccatgttcaagtaaggcaaacatcaagctgtaaccaacccaactatttttgtaccttgcttccattttccatatgtcacttttctttttctgttcataaattctctcctaccacgtggcatcacgggggtgctctgaacctcttctggttctggggctgatccattcatgactcattctttgctcaattaaagtctgataatttaatttgtctaaagttttccttttaacacgaccaagagtcacagattgcttagtctggagaagctactcttggctctatgcagtccacaaaaaatgacatttagaaatggttttccttccctggtctccagagaagcagcggctttcatactctgaaatgcagcatcctcatctgtaagatgcaggtgctaaatgatgactgttgttctttcaaatgttaactttctatgagtcacttcttcattgtatgtgtcaagaagcacaacctcgaaagcctgcctttgacaatgcttagaggttagaggatgccaaatgagcctcatcttctttggctactgagttagtaaccatccttcatttatctcagggagcaaaggcaggatttccgtgggtgtccaaggtccttactcacagtcaggatgcatggcagtacccttaataactacagattcagaatcacagaagacatttaccgagtatgtattttctgccaaaccctgtgccaggtgttattagaacattacttatgaaatatttggtagtgtggatgaagaggcagcttttcctgcttacacaatacagaaatatgatttcaaaaatctattaaaattttattaatctcagaaggcatgatttctaattgtgtttgatcttacacttgttatgatttaggaattcacatctgagttggttgcatgatgctatagttggcaacatgattctgaccgccaccatcacaaatagaggttagaaaatattacttatgtgaaaataaatgccatttctggcacctaaaacagctcttttctcaccttcctatgatgaggttttattgagcttttgcaggaaagaaaagaaagaaatctgcattcaggtttcaggagtaaagaggctgctcattaacaaagccgtttcaaaatctattgaaatgctccaccacgaatacatgccctattactaaaatcactgtcatttctatgcttttcttctcccttcaatcacataccacccagttttcagttcctataattgccaaaagccatttatgaatctgccttattgtatgggttacaaacgtctattttcctgctctgttcatacacatttgggagcaccttaagatgctgaaacactggcaaatgcttaatatatttcatttgaaagaattatgatctaaatcttaaagaaacagtgagtaaagtgcagtttctgctgcttggttactgtagttcattcggggaatttcatcttggtcgtgttgaatgcagtggttagatcctgtgaagttgtttaattaaaggtgttctagtagtcaaagccatgtctaaaaccccgtttgtttaattctttagtaatgtcaacattcctaaatttcatgtagcctaagagatttttccactggcttcaaatctgagctttgccactttggtgtcctttgctatgaatgttcaatgaggcgttctgagatcaccaagaatagaagagacacacccccggctgtcagaagtttaaccttggagaatgccatgaagggcaattctggaagaaaaaagagaagggaattcctcgtaggtttaagatcagaaagtggggaaggcgggggtgctcttaaatgcatcagccctactgccagcacagtggggactattaacacatcatattttttttttcctgcagttactcaaccttgcagtgggacaagttgctcaatgacttaccaggagacaattgttatttttaaaaatgtctttcttattttaactacaaggacttggcttgcttagaggctcttgctcaggagtctttaaatgcaaatgagggaaaccccaggttataaagcatctgcttctgcaggttttcaatcctgttaccttagcaacatttgcccttgtattccacgcatcaccttgacagcctgcataatataagggacggagcggagcaggggctcggggtgggagcctggaaagaaaactggggctcaaggaggtttaatatcggttagtagcttgggatccttcggataacggctgggcaatgaaaataaaaagccccatttccagaaatcaaagaacttggggagaaataaacacgctggttcaaaggaggggaaaatatatcagaactagtcggacctaagggagcagatattttccaaaaatatccttcccaccagccatgctgcagatgtgtcactgtggctcagaggcaggccatctgctgcagtgtttccctggaaacccccagcaacgcccctcccggagctcctccgcggtctcccccactccatccccgcgcagcggaggagcttgccggtgatgtcactgctgctagctgggagggaatcccaggacctgcgtccctcgggtagagccaatcatggtcggctctggatgctggaaacctggggcttttaaccagaaagaattgcaaaagcaatatgcaattcatcacagtccacaaagcacagttcctaacagattctgaaaacgtgattttaaaaaaaatgagatttatccgtaaacgagggctaggctacagttggtagggcggctgtcaattcttctacggagttttaacctacactcaatggatgcatgaaaaaaagaaatgaaatgatttttttagctactttaaaaaataaaggtaatgaatatttcttatctatatgcatatatatatatatttcattataattgttgcttctgcagaaaattgggatagaaatctcagatgagctgtagttacacggagatctacagcaatgcaatgtttagctagcatgcattttgtcatccaaggctagtaggtgaaatatttcctttacctgtcttgatgcacggtggagaaaggagacccgcttcgttttccctctaatctagagagttaacctcctccaggtagggttgaaaatatgaacagagctgcttttgcaagactgtgttgcctctaaatgtgatttaactcgcatattcagaatcttagcaaaaataaataaataaatagtaagatggggtaaggcaaatacatagatattttggagatcttatcccttattcaaggactgtagattattacagctttgttgtcatattatctctaggcagtaaatcatagtaaagtagtaaattcatagggaatgaattaatctcctttttgttttgttttctctgaaaaagagggtgtgattacagcatatattgattgggtactgattatgggacattttcattgtatttgttgttgttgcagtagactaaatgtcgagcccgtgaatctcttgtgttggcattgtcagaaaaaagttgtattttttttaaactggtctaaaaggaaaaaaattgaacatatatctttatattttttttgctctcttctcaaccatgtttagtgttttgtttatattcaaaggattttattttcacacttacaattctttacttgtctgtcattcaaatctttgttaccaaaacagtttgctctttttcatcattcactaagcattcctttcacagctaagctaaagtgtctatatggaaacatacatacacacacacacacacacacacacacacacatgcacacacactttttccaggccacagacaggaagatatgtgtaaatgtatacatgttttcagtagcatatatacacaagggtctccaataagatttttctagaaacaaaggctgatactacttcatttcatattattgtaaagtgctaattctaagtaaaagtagactaaaaaagagataaaaataaagataaaaatgagtgggctctcacaaccttgtttttttctttttgtttttcacttactctcttggctttttaactccttccttctctgcctcttatgaatgacaccaggaagagttattgtaaacaattggaatttctaaagttctgtgtaactgttagtatattcactatatgcatggtataatttataaaattaatctttgaaactgttaacccctagaaacagaaagaaagaaagaaaaaaagaaagaaacataaagaaatcttgacccactataaatcctgttttctctgccatctcccccagttacacccagggcaagtctatcttcttcaaagacattcagtcagcccacagctttttatcttttcaaacctttaatggcaccattagctacggaaccttgatttccttaatttttcccccactgtcactgcaaccatcacatgtggctctcagagcttctagttccctggaaacaggagttctatctgccatcaccaggtataaggtgccaccacttgaagggatctgccctatcaaaaatgaggaaatatattgatcaaaatggctggagaaagtgaccagccaaaacacagcttcacagtcttgcctgttttaagtagattctatttccattttgccggtgacagcactaagcaaataagcaatgttgccaatccgagaacagcctgcattcaaggtattcaatcaatcaaagagagacaatggcattctctcaaagatcagatgttttgtagtgcaactatgttgttctgtttttctttacttcaattatcagatagacaggaaaaaatacaacaaaatagcatgtagttgatttgccaaaaataaatagcaaagaaaaaacaagaataactagaaaacacgtgacaattttagaaaaaatgtaatcacatttccaattactagacaagatataaataaagagcatttataaaatgtttaaatccattcttttaaaacgataaacaacttctctaactggaaattactgtgcagctgctactttgtattttattggtataaaataactttagagttctatttcattgcattgcaaaggtgtaatactttgccataattaggtttaaatcttgcaaaaatagaaacctgcattttttggttttatattagtttttttaggtgatgctattcaatgggaggatataattgctgtttctatgaccttgggtaagtcatttaacccctctgaaccttggtttccttctttggttgaaaatagagacagtaatacttgacctctctctccagattttgatcaggttaaagaggccaataaaaatgaatgtgattttgtaaatagtgatacacacatctgatgcactgttgtgtatttttgcacctcctcagcagtgctctagctagtctgtccttgtccttgtcaactgtacgtgaacatgatgccctctagtgactgcactttgtagatgctgtaggccccaaggaagccttgagaggaaaaaagagcttaatgaagttagagaagggaagggaggcccgtagcggaaaattatgggttataaaccaataaaagcagcaggaaaaataagcagcagctgactatgagtaagaggacaagatgcacaaagagggagaagagaaaataagcagaatagagagagaggtgagatgtagctgattttggaagagttcactgtggcctggaaggagaggaacaggaatctctgcccagctttgtttataaccggcagtaggtccttccgttcatgtaagctctgccctccacaactcaccctgtgactgcaaaatgagatagttaaaattaaggttcagaattctttgagtcaatgtaagaagatgagcgaaaagtacaatgaaaatgagaactgaaggaggaagagtctgtggaagcaatttccagaatcttgtttactgtgtctaaggtcacctcagtattgcagtaacttaataacaaccaagcggctgaatgaggcaagctcaggtggggtttggtcgatcgcaggatgatcctgtactcttgtagtaacaggagtgttttgcagtacagctccacccttcacaaggatccagcccctgtgagattgcatcctcttagactgaatgcctaggagtctcactgactacctgtctgaagagctccttcttcttttctgaattaatccttctttacttagaactatctgaggatcaagtgatcttccagtgggaggatatttaaacccagcttccccttgcaaattacagatgctataatcctgtctgcattaggcttaggtcatgctttctctaaacgaactgtgtattacaggaaagtaatcaaagtccacaagaactgtgtaattaaaccagtgatggtgcaaataatccagaagtctgtcattgctctctctagacaaaggatcactcaaagatgagaatttgaactaattttactgaaagacaggatgatgcagctgaatggaaagaacactgcataggggtcagaaggtgtggattttcattctgacatggacatttgctatctgcctgatcttctgcaatattctaaacttaacaaagccttatctatacaatgggaattaatccatttattcatatatattaaagattttcaatgtgccaggcactgtgttaaacttccagatggcagtgagaaacaaactctagaatttctgagtcatgataaagatgaaacaggtgttatattttaaaactcgaaatgtcataacagtgtaaggtactatgcattcctaaagcaacataaaacaatagggatttttccaaccttaaagagcagcatttaaaattgagtcttgccttgggagcctgtgacccacgggagcattggaaatgacatcaaccacgaagtcttttttcttccagtgaaatgcaaaacctgctacctccctggagctattagcttggccaaatagtcctctagttagtaagtggacaaagtagttactgcacggctaactgcaactcttcatttaaatatttccctcatgtccagataggatatgtctaatatcatatgcctaatagcttttcagcatctttccacacagaaagaaagggaaataagccttgtcatagccatgaagtgtccccaccaccagagtttcttctctgctacccctatgctgcctaggaatgctaaaactattttatggggccaccaggtggcagttagggcaaatggttttagtttttttctttctacattcttggggaagaccaggggcttaggaatggagaagcaagccttggaaataaaagcattatggagcatttgggggtgccaggccctgtgctatatgtgatatatgcaatacctcacccaatccttatatcaatatctgttaaatatactattgaacaggtgaagatagagtaatatgggaaataaaacatcttccgtaataagcagctagaaagtaccacaatgtaaattcaactgcagaagacatgacaccacagggaaatttcgtttcactgcagcagtgtctaaaaactgaagatggggaaagtgtagagtgtgttattaaaatgattttttcaaaaggttttaagagtctaaataaattgcataattagtcagtttcctacctcctagtcttcctacctttagtctttatttttagctctcctgagtttgtagttgttctccttccatggtttgattctctccttagctttcagattctatacatttcacttctctttataaataatttttaaaaattcttcatgtgaacctgttcaagaacctgttgcattgaggactgaagatatggctctagattccttactgtttccggtagagaatctgcagagagaatatttcactgaagcaaaattataaatggaacatttgactttatatttccatgtccccaaagatttactaaacattagatctgatttggccaactttttctaccaatatttccggctcttgatatgaaactagttaaagctattttttcccttcaatcagcacattttcaaacttagaacatctattactcaaatttggcataaaattatgcagccagctcattatccactttctgcatattgccaagggctcgctacgtatgtgtgttctggttggcagacattttgggtaactactattctcaatttgtacctactttatttcaatacatgtttcaagatgagtgttaaagggtacattgctttaggaaacttgtctttttctggcatttgaacttgcctaaattagaaaaaaaaattctggttccagtcctttttttctaaaaaaatattccaaatcattagatgaaactgttaaagataacgtttggaaagtttgtctcctctttggtgattaaaaagtgctttccatttttggcccatggctcttttcctggggcatagcatttgattataaagcttttctgatgaaagtatcacaggacagcaaacatgagaatgggagaaataattttgcatgcaattttttgtcatctggctgcactgtatgggaaatacattttccctgtcaaaatgtcaagttgttttgacttcacaacaaaagaggaaggaagttcttaaatgtagaacaataactcagctcactgctgatttctatttgttctatccttacatcacagtatagagatagaatgtgtcctacaaatgtccatgcagcaactcatattcacttggcataattttgtttattgtttgagaaagtagtattttgggtaaaaattctgaaacaggcagtgagtatgtctgagtatttctggcaagggctatttcttcctttctccttttactctggagttttcttgaactgagctgtttggacaaatgacacatatttcaagaattccaactgtgggagtgtttcactcacaggattgtgctttcttctaagagccaggtctggtgaacactctcaggagctttgtaacatgttccaagctatgcagaagtgcttagttcattcactagtcaaagactaacacatttacagcaataaaatgcattataagcattctttcttcatgaatctattcatcccattaaaaaagcaggaattccaattaagtgaggtaaaatatgctaagtagtacagtataagatttttaaaaattacaccatgtttttcatggattattttaagaaaaaaactattttaagaaaaaactgtcctatttttggaaggtctagtcccaaactgcacaggaaagttagaggtaaactgttaaagtctttgagaactggcatttttcaagccgcagtgaatgaaatcaagcatttctctgtttctcctttcctttcggaatttcttttcctgaggcttgagaaggcaatactggtcttacttttcacatgagtcaagtttatactagctgagcaccctgaatcattaacgtctttctccccaggggagaccaagctcaaatccatcatcagaatacatacttagaccctctcccttctttctggccccctgcttcttaggaatgtgctctaaccaccacagcattcctgatcaccacctccagatgacaaaaagaaaaaatgagtggcagtgaaccagaagagcttaggccatctattttatcctaaaatctgttcagaaatacgaggtttgtatcaattagtaagcacactgggaatacaggtatacaagttgttagcaatatttggttatataatgtctatagatatttattttgctttctctcagatattaagaattatgtctttcctttaacctccatcatttgtttttctactttggtggaagctttttgtttgtttctttactgcaacagtgaatttatccttggatttctccattatgattggcagtatttatacaataatttcttggtattagttaattgataccttatatttactattttcccccaaagctgagtaaagaatagaatgaaatggcctatacttatcagtgtaaatggatattagaattgctgctcttattccaaaaaatatcacttaaagttcacaaatgaaagttaataactgaattttagtaacaacaacttcaacttaaaaaattccatgtaattaatagctcatgagtcccactgagataggttgaacttcataacttctaaagccttttatgtttctactacttttcagttctaatgttcaatagtagcgtgagtatctggttagtttcagtataaaaaagatgatacccacttgtgatatgattctactttcaatgtcacggtggaatcatttattagttttttaatttaatttttcacatgtgagtgtgatacagaacacctgatttttctacactataggatgtcagttcagtaaatcgattttcctcattagcaactgcttatcaatgactatgctgtatagaaagcaagagtattatactctatttttgatcacagataattgaagtaaatttaattagatccatatgaaagaaataagaactctcacaattgtgacatatatacgtgtctgtgcatatgtcatatcttagtatatgaggtatttgcatgtgcatacttaccaagttaaacgacctcctatcccacaaagttctctttagaaataaacttgagtctcttgtttgtgaaaccaaagagaatttcccgccaaagaaatacctacaaagaagtgtaggtaaagaattcaaatgattgactcaggcttaagatgatttgatagctctttctgcaccaagaaacacagaaaatctcaaagcaggcctgtgccaacttggtataaaaaaagccttcctaaagagtgcattatcttcaatgggaaacgtcgcagtacaccttggcatcaccaggtcaattagtgcaccggaaagatgcatgatatttcctgttggcagccacgaagtgagagaattggacggctactagccctgttgtgtgccaaggcctaaaaatcatgcaaggaggtgaaatgatgcgtgccaagaaaatagcaaccacaggaaacagcaaataatgtaaggttttgtgtctttactctagatgtaaatactcatttaccagggcagctttaaattgacagcttttgggtttgtgaggatattgtgagtcagggttctcctgattgggcaagatgaacgagtgaacaacatcactagggggccggagtagatgagatactcactcattcgtgtgcctgctttagcaccagcagtgtgggaatggggagaaggccaatggtctcaaggcagtttccagctctctggcaaacaagataaggccatggctgtaacagacaccctctgccaggttctaaaatctctctcttatgacctttttaagatctttaaagcaccgtctgcccttggccaacaaaagagaaaaaacagagtcaatgcggaaaacgctgccaagacaacattttcttcttaagatcctaaaagcaccattttccctttgctaacaagacaggagcaataaagagtcaattaggaatatgttgccaagacattggccatataatttctactccagtcggttttgggtttgatgcagtttagaattctctagacacattttttcatttttttttcttactagaacgcagaatgtttttgagagtagaggtggatggcactgctcattagaaatagctgtcctgccccagaacaatcttcaagacaaaggttgcaagactatctttgaccttcctgtccctaaacactccccaaccccaagccaaacacgcgcctaaaagttttcacaccttgccctttactaacagcaatcatatttaggaggaatatattattgttagtcaggaaattctacctggcttcaggaggtagcttagtgggtatttgctaagtctgatacctttcctttcaacatttagctgagattacctatactaagagcacgaactacaactgtggaaaacagaagaaaggagaatgttctccaaatcaaagtgtgctaaggtcagcttggggcagccaacaattcctggaaggtgacagagataaagttgcagagagggaaatggttgaagacaaatgtctcacgccttaaaatgttgctaaagtaagatggctgtttggatgagtcatcaacaagaacatcacctttgctctcttcctgccacccctgcacttctcaggctactgctcctaaaacctagaactcaggagtgatggaaatagagggcacccatggcaaggaagaaattggagagtaggaaactcagggaagttaatcctgaggaaagtggaaagtgactaaaacattttgagcagagaaaagtcaataaatcaaatatagaaacaagagatgataggaggttctcataacagtccaaatgagaggaccaaaaggcctggagtcacgtcattgcagtaaaatggaagaaaaaacaagagtataaatgaagtgtcaaagatgttaagaaacaggatcttttaaaaaattatttttaattattatgggtacataataagtgtatatatacatggggtacatgtgaaattttgatacatacaatgtataataatcttatcggggcaattggggtgtccatcacctcaggcatttatcatgtcttatattagaaacagtccaattctcctcttttagctatttgaaaatatacaataaattattgttgagtatcatcactctgttgtgctatcaaatactagatcttattctttctatctaactatgcttttgcacccattaaccatccccaccttctccccatgctggctatccttcctagcctctggaaaccatcattctattatctatctccatgaattcactaggagaaataggatttttgactaatgggtcagaagaagcaaaggaaaggaaaggaaaggaataaagaatgactcaggtttcttgcctaggaaattggttaaaaaaagggtatttttaattaaaaaaggagagttgaataggagactaatttgaaggagaaaatagcctatttttagatgtattaaatttatcaaatttgtgtgctgtatatcagggctcaatcacaattctggcataaatttatatattttatagaacattattaacttgaaagaaatgcatgtattttgttaattgatagaaacaagatcaaagggcatattatattattattccgctttgtaaggaaaaataggttttgcatatttatataaaaagggaaattgaatgtgatatactctggggtattaataataattgtgaattaaattcctttctttagtttatattgctgtctcaaatcttctgatttttctaccttgaatgtaaattttttgtttgtaatatggcactttaaattaaagttgtttttcagctgggcacagtggctcacacctgtaatcctagcactttgggagaccaaggtgggtggattacctgaggtcaggagttcaagaccagcctgaccaatatggtaaactccttctctactaaaaatacaagcaaattagctgagtgtggtggcatgcgcctgcagtctcagcaactcgggaggctgagacagaattgaattcgagaggcggaggctgcagtgagccgagatcataccactgccctccagcctgggcaacagatcaggactccatctcaaaaaaaaaaaaaaaattaaattaaagttatttttcttttcttccattacccagactggagtgcagtggcatgatcacagctcactgcagcctcaacctcccaggctcaagtaatcctcccacctcagctttccaagtaactaggactacagatgcacatcaccatgcctggttaatttttgtaatttttgtagagatgaggttttgccatgttgcccaagttggtctcaaactcctgacctcaagtgatcctcccacctcagcctcccaaagtgctgggattacaggtgtgagccactgcactaggccttaaaatttatttttcaaaaacttgatgattcaaatcattgaagatgctcttatgccaaagaaaaggtagttctaggaagttcatggaatcttacaaacacctttacagctcaacagaattgcaaagatgggtagtgttttgttttgttttgtttctctgattgttctacagcttatagatactgaggttacattttatgaaacaaaagtaagaatacatgatttaaaagtaagatcaattcctaaaaattggacctgaaaattttatggatagagtagatagacgtgtagaattcatcccagcatagagttgctgggatattactggtgcttcttcacagggaaagaaacctggctacccagactacaaagggaaagggggaaaatggcctataactcatatcaggtgaattagcaaacattctcatttcagacgatttttgctgtccctggtcatgaaatttccttaactgggttctatcttttactttttatcccaggcttttagcaagggtcataggaaaatggccatttccacatatctggtatatcccatttgaagatattgcctaacaaacattactcaggatcccttacataaaaacctccatgataaatttcttctgtacttttttccccaaaaagctggattctcctgtaaaactgttatctattctctttatatattataattatggaattcattatcatttctactcttatctacatgactaggtcaccaacagctaattatatagctaattcatggtagttaattttatttacttctcttaagtcatgacttacaaaattgcatttctatgtatgccatcttattacctccatttatttaagttgcatactacttcacatttcctttgaagtgtatattattattagtagtagtagtattttggagacagggtctcactctgttgcccatgctggagtgcagtggtgcaattatggctcactgcagcctcaaccttccaggctcaagctgttcacctacttcagcctccccagtagctgggactacaggtgtgtgccaccatgcttggctaattttttaaaaatttcctatttcttgtagagatagagtcttactatattgcctaggctggtcttgaactcctggacacaagcaatcctcccacctcctcctcccaaaatgttatagacgtgagctaccacacccagccatgagtgtacattataaataaataccaataatgtactttcacatatgaaaaggctataaaagtatgcaaatatattatggcaacatctgttaagggataaagtgacacactgttgctcataactcgaaagaatatatatatatatatatatatatatatttttttttttttttcttttgaaacggtgtctcactctgtcaccaggctggagtgcagtggtgcgatctcagatcactgcaacctccgcctcctgggttcaagtgattctcctgcctcagcctcctgagtagctgggactacaggcatgagccaacatgcccagctaattttcatatttttagtagagatagggtttcaccatgttggccaggttggcctcgatctcttgatctcgtgatccacccccccatcagcctcccaaagtgctgggattacaggtgtgagccattgcatccagcctcaaaagaatagtataaaccttatgtgttcatataagcagtagaacctatccctaatagttggattttattgtgtaagtgtttcattaaggaatgtctgaaacatgtccagatttttatttcagtggcttagttttgccacagaacttcagttttataaatgtgtgtactggcttaactgtgaaagtattaaaattattgtattgatttttgcttgcaaatgaaattcataaacagaattatcactgaaatttacatgcaagagaaattgatcaagatgatttgaaaacttatggaaagattgaaggttgccaaaatctttctctttctaacttcctacctttatgtacatttacactctaatcacaggtatttacaggccttaattttaacgaaaatgaagaaaaccaagaaagaaacagctctttagagcaatggaaaatcttctatgatttctcactgacattggctagatactctgcatttatgagcaatcatgcatgtatatcatcagatttaaccttcacaacaattccatatatattatcagatttaatcctcataatagtttgctatcctaggttttagtttagaaaactgagcctcccataagctaagaagttacttgtccaatatcacaactttagataatggtagacttagattaaatccatatttgctcgctctacattccatattcttcccatttaattgaacaagattttggaataaagttgaaatccacaaaaggaataggacagtgacttcacaataaaaatattaaatgtggcagaaagtatggatgtcaatggaatgtaaattctgggcctcctcaaaaacttgatatactcatcctgtgttagttgtgaaataaacaggttggagagtgaggaaatgtggtttttgttcccagagtcattactgaccaactgtgtgctttgatattatatttgctttctgatactaattatattaattctcgctcatagaaatcttccctccttcataccccacctctgtttgattcttaatctcatacataagaggtttttattcaatgtctcatttttctttccaggacaagtatgttgtaagaattaattaatagtcttagaaccattcaagcagtaggttctaattgagtatttttctccccggttagcacagcaccctgtcagagccctcaaagtcagacaaagaaggatgaaacatgttttggtccttaataaagaactgctgattgactgtttgaaaaacaaatgccgcacacctgtaatcccagtgctttgggaggccaaggcaggaggattgcttgagcctaggagtttgagaccagcctgggcaatatgatgaaacctaatctctacaaaaaaaaaaaaaaaaaaaaaaaaaaaagagccgggcatgaacctgtagtttcagctacttgggagactgaggtgggaggatcgcttgaaccctagaggcagagttacattgagctgagattatgccattgcactctaccctagggtgcaagattctgtctccaaaaaatgaaaaacagctgtatggtttggagagccagtggctgacaaactgaaggtcatggctaacagagtctccatatcagtgaatctcaaacatctgtttacataaatagcatcttcttataaaaaaatacaaattctgagcccccatcccattatagttggtaagtctaggatgagaccagaaggggtcattttaatgagattttcagatgactttgaatttatatttaatatttattctggtttgcctggggttgaagggttccccagggcatgagactttcagtcttaggcaaactggaatagttggtcactcagatttcggtgcagtggttaaagttaacactttcaaaaatattgtagtgatctagatttggttctaggagtttggctcaattcagggctaacaaaaaaatctgtttagggccacttggggattagtgattctcaaaaggtagtccttgaatcacttactgaatacctatagttgaagaacagataactgcattttaacaagattcaaaggcaaattaatgtttgatgaccgttgacatcaagtctcagaatcagaactgttcaacttccaagcaaatgaaattactaaactcacttctctgagtgaggctgagagcaagaagttaagtataatgttttttgagctaaaatacagagtctactatcagaatcctgtttcccaccataaggattaagatttttttgtttttgtgtgtgtatgtgtgtgtgtgtgtgtgaatgtgtgtgtgtgtgtttgttttttgtttttctgaagtgaatgacatcgttttttggaatgaaaaggtcttgccccaccctgcaagtgtatctctgcctttgagacaatttagccctggaatcaaacctgggggggaaaatcaaattatgatattaaagaaaacgctgacaaatttctaaattcctttcctctactccctgctgcatacaacttccttctttctatctataaatactatatctgctctagaaacgtgaaaaataacataaatattgaacagagtgtgaaggaatttaaactttattgatgagtagtagtattacccttctggactgatgcagatgagagcaccataaagacaaagtgagttcttttggtccttaagccatgaattggagtctggatagtagggatggaaatgggttattagatcatcagttcactttcctctccaagcagcaattaaatttgttttctttgtctcagcttactcgttgctcaaaaaaaagaaacatttcagctcctcttcatggggaataagaccaaacatagaacacttttctcttaacatgtgtggtgcttgagaggagaaagaggcaggaaggaaatgcaggagaaatgtgggaatcacagttaacctgaaggattactttggctgtccccttcagctaatgtgaacattctggcagtcagatgcagccctgtgagaaacatctatcagacatcctaagtagatgctccaactgctgtttttcatgtacagctgactccaagatgagtgtgatgctatcacggtgcaggataacagagatgtaccgcgaacccaacactcaagatgggaatgataaaacttcaataacaaaaacaaaaaaacaaaacaagccacactatcctttcagccttcagggatcgcctccttaaactgttttctaaaatctttctgcactttatatcaggtgcaggagaagtagactacatacattatttgttgtctatctttgaaaggatttcattccctctactgcacttaatcattcccttatctgaatattaactcagtgtaaagcttcccaaattttccaagttcttgaaagagagcaaaacatattgcaaagctctatatgtttcctgctagatatatttcgtgaaagacttcattatgtccactttcttttgagtttttgtgttagccctgcattgctataatttccaacatcccctggaacataatgaaaaccagagaattgctttttttttctgggtccattttattacattcttttacatctcttacttaactacttctaatgcctttgctctgaaactttgtgcatttgagggtttttttttccccgtgatttggtggactgcaagggcacacaaaactagcttatttttcctagtcaggcagttttgaatagaaggtgattgtgttttccagagataagtatgtaagtcttttctgctaccggaggaggattctattttagtagtctattaagtagacaataagcgctgagttatgagttgataagtggatctgcttaccacctagaaacatcaattgaaaccacagcttatggtttcttactgcctctttttggtttctcactgagtctttctggttattgttatcatttcgtttttgacttgggcttggactgttcagcttggctgtgttaatttttcagaatcaatgacttttatagttacttccatgagtttttcctcctgcattttatttaagcaattcactaactatttataagaccatctttgaaagcctgagatacatatctaggcaaatatccatggaaaaaataaacactctgcaaatttgcaaacaaatacagcaattgccaaagtagggttatcttttgcaatcagtactgtggtttcagtttgaaaaaataaagctttcttgtcagttttgctccaagggctatctgattcggtgtgtagtcggtgaggaaataaatacaggtataataatctgtgcttgctcaaaaattaaaaaatcctttaggagggggccaggcgtggtggctcatgcctgtaatcccagcaatttgggaagcagaggcagacagtttacctgaggtcaggagttcttgagaccagcctggccaaaatggtgaaaccctgtctctactaaaaatcttagctgggcttggtgacatgcacctatagtcccagctacttgggaggctggggcaggagaatcgcttgaacatggcggagattgcagtgagccaagattgtccagcctggacaatagagactctttctcaaaaagaaaaaaaaaaaaaaacctttaggaaggataaaactcatttcctctatcagcatagtgtcaccatattacagaagtatcaaggtcaagtattaagactactgaggctcaggtgtccttggctgaagggagagagaggataccattcttgcatagtcttcagggcagcagtaatcagcaaactgataggttgcttctgggtctaaacccactgtaatcatttgcttgtagagatgacaaagttatcagttgtacttacatccactttttttgttgtttcagaagcttaccacacttctcccagtttccttttaattagtttgtaattttaaatcattacattaagataagaggtttttattaaatttggtagaactcatggtaggtcctacagaaatcactgaacttggcagccaaaaacagtgaccaggctgaggatgtgcctgaattgaacagggagatgctatttacttcttaacagagacatacttttcacgcagaaacttggcaactggaggagaaaaacacagaggtgaaggggaaagaagactattctggaaattaacaggtttcaattttggttgttcttcaacttgttagctatgtggccagaaataagcctcttaaactctctattccttggtttcttcacccactactctaaatctgatgaaacagagcagtaagaatttcttaggatatagcttaatttatttttttttaaaaagctcaatctaaaaacaagcttaatttaaaacagagacaaacaaatatgcctaactttgagttttgacaaaaaatgcaaaagtaattcaatggaggaaagatgagctttaaaaaaaaaaaagtgatactggagcaattggatatccaaaggcaaaaaaaaaaagtgcctaaattcatttctcacatcttatacagaaattaactcaaaattgattacagacttaaacataaaatgttaagcaataaaactttaggaaacaaacaggagaaaatgatgaggacctaaagctaggtgaagaacttctagacttgatactaaaagtatgattttcattttaaatgaattttaaaatgaatttcaatgaattttaaaattcattttaatcaactgggacctcatcaaaattaaaacttttgttctgtaagagaccctgtgtaaagaattaaaagaaacactacagagcaggagaaaacatttgccaaccacatattcaagaaagattttgtacctagagagtataaagaactctcaaaactccacagtaaaatccaaacgatccaattaggaaaatgggcaagaaacataaacagaaattttaccaaagatgatatacagatggaaaataagcacatgaaaagatgttcaatatcattagccattaggaatatgcaaattaaaacaatgagatagcactatctacctatcaggatggctaaagtaaaaaagagtaataataccaattgctggagaggatgtggagaaactggatcactcatacattgttgatggaaatgtaaaatggtacactctgtaaacaatttgcttgcttcttataaaactaaacatgtatttaccatatgattcagcagttgtgctcttggacatttatcccagagaagtaaaaacttagactcagtaaaaacctgtacatgaatattaatagctgttttatttgtaaaagccccaaactggaaacaacccaaatatccttagatcagtgactggttaaacaaactgtagcacagctatactatgacatactatgaagcaataaaaaaggaatgagctattgatacagacaaaaccatggatgaatttcaagggaattgtgctaactaaaaataagccaatcacaaaagatttcatgtgatgtgattttatttatataatattcttgaaatgacaaaaatatagaaatggagaacagattagtagtttccaggggtcagagagtagaggagggagggaggtgtgtgtgtccataaaaacgttgcgccagggatcctggtgaggaagctattctgtatcctcattgctggtgttcacgtgaatctacatatgtgataacatttgatggaaccaaatacacacacaaacacacacatacacatatgagtgcatataagaccagagaaacttattttggtggattccgtaaatgtcaaatctttggttatgatattgaagtgtagtttggcaagatgttactattggggaaaatagtaacattgtactattgtcctgtgaattattgattcacaggaaattgtaaaaaaaaatgctttgtcctatacatttttttagaatttcctgtcaatccataattatttcaagataaaaaaagttttgtaaaggaagaattttagagactctttcagattttttattttgagatttaatcaattatatgagaaaaataagctttaactgaccactctttccttcctatccaaagcttagtcaatgagaaaatgttgcaagagaaggagaatggggggtacctgagactccaggagagtacataccctttttaaaaaagcaatacaagccagcagaaaaaggaaagatgggactctggagcgattatgtgaatctgtggttctcaaagttcagcatgcatcagattcccagagggcttgtttaaacaaaaatttctgccctgcaaccacagagtttctgattcactaggtctgggggtggtgggtgtggttcaagaatctgcatttctagaaagttcccatgtgatgttgactccagtgctgatgctgctggtcagaccacactctggaaactactgccatagaacatctgagagtcacaatttgaaactgtctcaagaaatttctaagtaaaatgcaatgcaataaattacttaagaattctctatatttacaactctttatttgtatagtttccttccccctcagtatgttggctggtaagaatgttctttttgattattcatctgtgtgggctcaagagtgtgtcactgagttaatttacaaagcctcggattgcatatccatcacatttgtagaaagtattatcccagaaaaatccatcaacacaacacataagctccaaaatgtactgcacaattggcgtgcaatagagtagtcaaagaaccaatgaaatgcaaaaagttatctatatggagatctcaaaatgaattaacaaattaaatcctttgacattgtatgagatcccattagggttcattgttacagttttctttaatgtttctaaaatagaaatgttgtcctgggcagagcagtgtaatgtacttgctttggcatcaaatgccacattttttttttttttgagacggcgtcttgctctgtcacctaggctggagtgagtgtgcagtggtgcaatcgtagctcactgtagcctcgaactcctgggcttaagcaatcctcccacctcagcctcctgagtagctgggactacaggtcccaggtgcccagctatttttaaaattttttgtagagacaagtcttgctatgttgcccaggctgatcttaaactcctagcctcaagaaatccttcagacttgtcctcctagagtgttgggattacaggtgtgagcctccacaccaggcattgtttctattttaactttgctacttacgagaagtcttaatttgaccaacaactaatgtaagctctagtttccccatatgtaaaaagaagataatgcctaaattgcagggtttattgggagaattaataagaacacgcctaggccaggcacaatggctcatgcctgtaatcccagcactttgggaggccaaggcagctggatcatgaggtcaggagttcgagaccaccctgaccaacgtggtgaaaccctgtctctactaaaaatacaaaaattaggggagtgtggtggtgggcgcctataatcccagctactcaggaggcttaggcaggagaatcacttgaacccgggaggcggaggttgcagtgagccgagatcgtgcaattgcactccagacttggcaacagagcaagactccatctcaaaaagaaaaaagaaaaagaaaaataagaacacgtctaaaataattagtgcagtgtctgacacttaagttctcaaatagtggcggtgaagatgtgaaggagggtagagatgactgtgattattaatcatcttatttgttgatcatattaaaatgacaaaaaccacaattattttgcaccaacctaatatttcagcagatgtcctctgaatcagaagtaaatagccatgataatcttaccattagttattttattgagcaattacaagtcccaggctcttacgtttttatattaattttttacaaccagtttatgcgatgcatactgtcctcatttatcatataaggaaactaaaacttaaagagtttaatatattgctcaaggttatccagtgtattggtttgctagggctctgtaacaaagtaccacaaaccaggtggctcaaacaacagaaatgcattgtttcacagttctggcgtcaaaaagtccaaaatcacagtgttggcagctttggttccttctgagggctgcaagggaaagattgttctgggtccttctccttggcttgtagatgtctgtcttctccctgtgtctctccatgtcattttttcctctatgcatgtctgtctctgtgtccaaatttttccattttaaaaggacattagtcattgctgggcacaatggctcacacctgcaatcccagcactttgggaggctgagagaggcagatcacttgaggccaggagttcgagacgagcctggccaacatggtgaaacgtgtctctgcaaaataatacaaaaattagctaggtatggtggtgcatgcctatagttccagctatttctactcaggaggctgaggcatgagaattgcttgaacccaggaggcagacgttgcagtgagctgagatcatgccactgcactccaacctgggtgacagagtaagactctgtctcaaaagaaaaaaaaaaaaaaagggcattagtcattggattagggcccaccctatggaactcattttaacttgatgagctctgtaaagaccctatctctaaattatatcacattctgaggtgctgggaggtaacactccaacttatctttattgaggggggcagaattcaaatccatagcacatagtagtaagatgtcatgctgaggtatgaaccagacttcatacgcaatgctgtggactaaacttttgtatgcctgtgaaattcatatcttgaaggcctaatctctactgtgacggtgtttgagatggggcgtctgtgaggctttaataggtttagatgaggtcaggagagtgaagtgcttgtgttggaattagcacccttataagaagaaaaaaaggccaaagcctcctctctctctgccacctgaaaatgcaacagggaatggccatccacatgccaagaaatgggcccttatcatacaccaagtcttcctgcacattgatcctcgatttctcaggttttggaactgcaggaaatcgacgttcattgtttaagccacgcagtctatggtattttgttatagctgcctgagctgactaagacaggcaatatatgacatggccgtttgctccaggacttttaggaaatgtggatcccattggtagtgctcagcaatcaaatttatttgatcctcatgttcagcagacatgttgtttttttcttcatgtattgccaactcttttatatgatacataaaacatattgaaaaacgtagacttgctatctttatattccacatgttggcagattctttccaagaaaagtgattttcagatcattccttaggagcgttgaggctgagaagtggtctttgcatatttatatttagaaattatcgagtccaaaatctaaatattgagtcttggtagaagagaaaaccagtcacaatttatgtaaaatagttgttcctaggtaatgaaccaaagcagggactatatttgagaagtagaatggtattgtcaaagtcagtgtacaatcaggaaattaaagagattattttatccaaactattgcagttaatgaggaatgtctcaaaagaaagggaagcagggttttatagatataggggaacaaaaagtttaagggatttcttaaccaccacttttttctagaagcatagggattaggtcacattcaacattttcagtccccacttctacttcagatcaataaacattataggatgctgaacaacatagaggtgatcatcagaaacctgagtaagactgagcagggtctaagaaatagtctctcaagagttcttgttggcattattgtcgtaacatcacctaaaccagctgttgagaagtagtggcaaaggccagttgtttcaaagtcatagagatcaggctccttaaaagagaagtatttaaaatgaaaaacattaatatcaaagattatgttaaagaccagagtttaaccctgagcataccagtccagcaaattccaaaaggtgggtggggaaaatctttcagttacacagtaccgttcgttgagtttcttgaagctaggatgtcaatgttcttgatgatgttcagtctcggttagctttcctctaagagaatgaaggacctgagcttttcaccagaatttgttaggggctcagacagtggtttgtgcagggaaaagtctggcctgcgtgtaatctgctgcagtggtgagttcttcaaagtttgaatcaagtagttggacttcagctggcagaatttcttcaactcctggagaaaagagctagctgctagacaacctagagttccaacaggaatctgggcaatcagatgttatttttcagtgacatcaagttagggaaagagagaaaaattggaaacattaatttgtagggttgtagccagatattgaagcaaactggaaggcttcacagtttggtacaaattaacaatttgggcaagataacaggatccagttcaatttttaggaaggtgtccaaactgctttttccacaaaggaggggaagtcatttaaatcattccagacaagtcagaatttgcatatgtatcagttacctgcaatttatgaaactgtataatatggctaagagataattatgtctacaatctgataaacaggaaggagctgcttgctatagttttccactgaaacaaaacatttctctctatagtcacccctcttttgatcaaaaataatctcaaagaaagattattcttgatcacaaaataaagctagtaccatcagatttggcctgattatttacattgttgtcttaaagatgataattcactacatagggtttcttatatttgctttgctgaaagttttcataaggaatctcaaattgaatttttaaaaaccacttgaggctaggaagctatatcaagaactcaccaacagatttacctacagtatctataaatttcagtaaatgcctctcttttagaggtcccaaaaatatctcaagttttctgagcctgcgaggaagtatcctttacctgtaaatttgggcacctcattagccaggaatcaggctgattttcccaagagggctttaaatgagcatacctaatgtttccaatatttcatgcaaacaaggaagagttttattgaacctatgcaaataactataattttgaaatataatgagaatactcagtaagaatttctgatttctctaacagtcaggcaggaagaaaaagataccaatgacaaatgtttcatttatatttgcaaagcatagacttctgaattgttatgagtttcagttagtttaagagaaaatagaaagaagtttcctatgtccaaaaaatcaaccattaaaatatcagcaatattccaaacaaaagctacagtcattcctcatcagttccttcagtcctgtgtaattcttgctctgcttcctcttggcttaacagtttcatgcatacatctgcctctccaaacagggctctggaaatcctgactcagtctgctggtatggtctcaaggttgtgtaagtgacggcatcagaagcttctgccccaaatgaaaagtacctggcatagagctttgccatggggctctgagataatcctttgttaagacaaagcactacagctagatttgtaagagctttcagggaagcaccacaaagcaaaattctatttgtaaatgacaaaagccttaaaaattactttgaaaaatcattttcaaacgtgaaagatgtaaggagtgtttatcacaagaatctccatttgaaaaatactggcttataggcacagaaaaacaaagatagtatgttctcacttacatgaggaatcttaaaataatcacactcgaagcagatagaatggcggttacaggggatgggggtggagggaatggggaggtgatggtcaaaggctataaaatctttattaggaggaatctgtttttgttttttgagttctagtgtacagtgtggtaagtgtagttaataataaagtgttgtacatttcaaaattgggaagagtaaatttcaaatgttctcacacaacaaaatgactagtatttgaagtgatgtcgttaactggctcaatttaattattccacatggtaggcataaatcatattatcactttgtaccccatatacttacaatatcataaattgtcaatttacagtttttttttaaaaaaaaggaaagcactggcttagaagaagctaatttgaaattaacgaataaaagttgttaccaagttaacattttaaaaataactgaaacttatgactcatgtggtgctctctaataacagggcaaagtgacatcgggactcaaagaaaaacacgttatggacataaaagcctttgatgactctctaggaattttccatacagcatacaatttctgaaatatttatactgataacattctgcccatacagatttgtcctagggaaggttaagcatctcttctgagttggcaatgactcccgtgcaatttgtaaatagtaacatatcaaataaacctaattcttttcagcaactttcttttcataaggtgaaataacaaatcctttgtgattttcaaaggccctctgggagatatcaaagacagtttcagatgcaatagatatcacttaggaatcagttttgggagggaaaatatcaaaagttgtcaggagattgggacactttactaggatacggtcgtgagttactgataaacaatactttgctaccttaactaaggtgacagcaaaaagagtgaaaaagtaagcacaggcagtaacatgattgtaaagaatcttagctttttcaaaagggagaagactttattaaataagcaaggacgtgataaactcaatacacaatataggaagttattttaagacatggaatctttgccttctaggcagattactcagaaggtaaagaaaaaatattattaagagtagactaagaagtcaagaaaatgttatgtttttaaacagaggcaaaattaaattctactttgcatcattatggcatttgatattaaagatctttttgaaatcttataaatgaattcatcaagccttagctagcactgaccacagcaaagtttgtttcccacaagcgttttacaactttctacgtctattcagcttttgtcctacacattaacaactagctatatgacttcagaataaaatgactctatttttttcttaacaaaaacatgttctgcaaaccttgcatacaaaattgtatctctctgctattattatgccttgtagaatctcattcatgtatattgattataatttttaaatagaaatagtaacatctgttgcacaaagaaaaaagggaaatggataattgtgatctttctgtcatacataagctttttgtaacacactagtggaactcatgaatacacatctcacaacttttaatagccatgcatattatttacagcacgacttatgcaaagtggcaaaaatgaacacatttattaacaaaactgaatgtacatgcttctctatagcatatagaaacaaaaggcaaaaaagtatataaacttaaaattatgcttggttaccaatatttcacttttctctcttgcatagaaattacataaatatccaattaatattcattaattaattcaatttagcttcaatccaaggttttaaattaccaaatatcttggaatttgtcttcaggctgacatgctccaaaatattagtaccattgaaagtttgttagaataatgactcaatttgcttaaacacaaatttttattttctattgtattaaacattaagtagaagtaatgctaggttatttggttggtaaatctaagtttaggaagaacattcacaagtagaatagaagcatacttgtgttatatttaacactaaaaactcagagaaaacagctatttttactaaatcaacctcattaattgattatcaaaataataattattgttaaatattgtttgccaaacatttacctagattttgtgaacttgaattattgtctctgagttatgttcctacaagagacagctttttcccctacagtaaaagtgtttaaggctcaatttcctcaacttctgggaatttgggaaatatttggtttatataaatggttatttatttctaagccaattagaatagagctcctttaagagattctataacctaatttagcgacaccatcctgaggtagggaaatattttatttttatttttttcagagatgggctagattagaactcctgccttcagcctcctgagtagctaaggttgcaacttccatagtagctgaaattgtaggtgcatgccaccgtatctggccaacagggaaatattacatactctaacaatgagtggtgacttcctttctgaattacagacatgtagacattaaagcagagatagcaagaatttagtttccattctaacatttaagccatgggtcaagagtggacacagaatcacaaaacttactgtttcatatcaaagagctgttctgttctcatgattcttaagtgatttgagctcaaaacagacaaacagaaaagcgtagcaaaccaaattctctgttgtctttcacccataagatacaagatctctaaaagtcattaatcccctctcagagatcaccaagtggtcagaccacaaaaccaaagccagtgccagaaatcaagtgagtactaaaaccttgccttgctaccaatagacaagggtccatatcacaggaccaggagttagacttattcatagttccttggaccaggaatggagcacaaagggcccaaataagccttattacctgtgttgagtaaacaaagatcccagtgcaggagatccatatcatggcaccaaactatcaaatacaggatgcactaggtcattaaagagaagattttattcaaagcattgcaaaatggagaacattgatttatggtgaatatcttgaagaaaaggaagggggtctggggttctataggggcaagaaaaaacgggagtcatccagaagtcttataaaagtcatgaagaagggtggagatgggtcttatctcagaatatgggaaggcagtttgggcctttgcattagttgtttgccagacactaaagggtagagaggtttcttaatcattactcttttccggaagcacagggctcaggtaagattgaatatttttcatgcctttcatcctctctgtctgatctctttcaaactgtcttttttgttgaggctatatgaaatgtttactgttttaccttccaatcaactccataaaaacggttgatataaagcatctagccaagttccactacattttagtcattcattatggaacatcatcccaaggaaggctttattctctctgtctaagcaagcaatgaagggagatcttttggaaatggcctagtatttgatgagaagcaagaacaaggtctacattagtggatcacagactttttgccactgagatccaccatcgaaaatgcattcattattacctctgcatgtgtttatttaactgcaacaatagtttaatgattttcataacacaaaacttcacagtgtatgatgacactgataccttctagtctattcccagctgttctatttcatttttttatagcttatagtgactcattaaaatggatttccacgaatgcaatgcaacacacagtttgaagtccactggaaaatcttttaaaactgttattataaaatgaatttagtaaccttttcaaaattttactagtgtagtttctgtggtttttaagaatacaaatattttgccttctggtcttttttttcacacaagtatatggcagattcctataaatattttaatagatcagcagtttccaatgccatgtttcggtgatgatattttaccagagatagtctgtaatgaaaaattgagacaaatgatgacaatgtaatttgcagacatgtatacttatttataataaatttgtagacatgtatatttagttagttattcaacaaatattcagtgccttttatatcttaagaatggttcatgttaattggaggcaaacaagaaaggcaaagttactgcttagttgaaatttacattctagtataaaaattgccatatttattattattattattattatacttaaagttctgggatacatgtgcagaatgtgcaggtttgttacataggcatacgcttgccatggtggtttgttgcacccatcaacccatcatctacattaggtatttctcctaatgctatccctccccgctccccccaccccacaacaggccctggtgtgtgatgttcccctccctgtgtccatgtgttctcactgttcaactcccacttatgagtaagaatatgcagtgtttgtttttctgttcctgtgttagtttgctgagaataatagctttcagcttcatccatgtccctgcaaaggacacaaactcaaccttttttatggttgcgtagtattttgtggtgtatatgtggcacattttctttatccattctatcattgatgggcatttgggttggatccaagtctttgctattgtgaatagtgctacaataaacatatgtgtgcatgtgtctttataatagagtgacttataatcctttgggtgtatacccagtaatgggattgctgggtcaaatggtatttctggttctagattcttgaggaatcgccgcactgtcttccacaatggttgaactaatttacactcccaacagtgtaaaagtgttcctatttctccacatcttctctagcatcttgtttcctgatgttttaatgatcgccattcaaaccggcgtgagatggtatctcattgtggttttgagttgcatttctctaatgaccagtgatgatgagttgcgtttctctaatgaccagtgatgatgattttctcatatgtttgttagccgcataatggtcatttctctaatgttagctgcataatgtcatttctctaatgaccagtgatgatgagttgcatttctctaatgaccagtgatgacgattttttcatatgtttgttagccacataaatgtcttcttttgtgaagtatctgctcatgtcctttgcccattttttgatgggattgtttttttcttgtaaatttgtttaggttccttgtagatcctggatattagccctttgtcagatggatagattgcaaaatttttctctcattctgtaggttgcctgttcactctgataatagtttcttttgctgtgcaaaagctctttagtttaattagatcctgttcatcaattttggattttgttgccattgcttttggtgttttaatcatgaagtttttgcccatgcctatgtcctgaatgatactgcgtcagttttcttccagagttttatggttttaggtcttatgtgtaagtctttaatccatcttgagttaatttttgtataaggtgtaaggaagaggtccagtttcagttttttgcatatggctagccagttttcccaacaccatttattaaatagggaatcttttccccattgtttgtttttgtcaggtttgtaaaaaatcagatagttgtagatgtgtggcattatttctgaggcctctgttctgttccattggtctatatatctgttttggtaccagtaccatgctgtttgggttactgtagccttgtagtatagtttgaagtcaggtagcttgttgcctccagctttgttctttttgcctaggattgtcttggctatacaggctctcttttggttccatatgaaatttaaagtagttttatctaattctgtgaagaaagtcaatagtagcttgatggggatagcattgaatctataaattactttgggcagtatggccattttcatgatattgattcttcctatccatgagcatggaatgtttttccatttgtttgtatcctctcttatttccttgagcagtggtttgtagttctccttgaagacgtccttcacatcccttgtaagttgtattcctagggattttattctctttgtagccattgtgaatgggagttcactcatgatttggctctctgtttttctattattgatgtataggaatgcttgtggtttttaaacattgtttttgtattctgaaactttgctgaaattgcttatcattttaaggagattttgggctgagaagatggggttttctaaatgtacaatcatgtcatctacaaacagagacaatttgacttcctcttttccaatttgaatatactttatttctttctcttgcctgattgccctggccagaacttccaatacaatgttgaataggagtggtgacagagggcatccttgtcttgtgccagttttcaaatgcttcctgtttttgcctattcagtatgatattgcctggggggttgccataaatgactcttattatttttggatacattccatcaataggtagtttattgagagcttttagcatgaagtagcattgaattttatggaaggccttttctgcatctattgagacaatcatgttgtttttgtcattggttctgcttatgtgatggattacgtttattggtttgtgtatgttgaaccagccttgcatcccagggatgaggctgacttgatcgtggtggataagctttttgatgtgctgctggattcagtttgccagtattttattcaggatttttgcatcaatgttcatcagggttattagcctggcattttctttttttgttttgcctctgccaggttttgctatcaggatgatgctggcatcataaaatgagttagggagaagtacctctttttctgtcatttggaatggtttcagaaggaatggtaccagctcctctttgtacctctggtagaaatcggctgtgaatctgtctggtcttgggcttttcgattggtaggctattaattactgcctcaatttcagaacttgttattggtctattcagggatttgacttcttcctggtttagtcttgggagggtgtatgtgtctaggagtttatcaatttcttctagattttctagtttatttgcgtagaggtgtttatagtattctctgatggtagtttgtatttctgtgggatcagtggtgatatccccttcatcatttttttattgtgtctatttgattcttctctcttttcttctttattagtctggctagtggtctatctattttttaatcttttcaaaaaaccagctcttggattcattgattttttaaagggtttttcatgtctctatctccttccgttctgctctgttcttagttatttcttgccttctgctagcttttgaatttgtttgctcttgcttctctagttcttttaactgtgatgttagggtgtctttcccactttctcctgtgggcatttagtgctataaatttccgtctacacactgctttagctgtgtcccagatattctggtacgctgtgtctttgttctcattggtttcaaagaacttatttatttctgccttcatttcattatttacccagtagtcattcaggagcaggttgttcaggttccatgtagttgtgtggctttgagtgagtttcttcatcctgagttctaatttgattgcactgtggtcaaagagactgttatgatttccattcctttgtgtttgctgaggagtgtttcacttccaattatgtggtcagttttagaataagtgagatgtggtgctgagaagaatgtaaattctgttgatttggggtgtagagttctgtagatgtccattaagtctgcttagtccagagctgagttcaatggaatatccttgttaattttctgtcttgttgatctgtctaatgttgacagtcaggtattaaagtccccactattattgtgtgggagtctaagtctctttgtaggtctctaagaacttgctttatgaatctgggtgctcctcatattgggaatctggttgctccttgtatttggatgtgtatatatttaggatagttaactcttcttgttgcattgatctctttaccattacataatgcccttctttgtctttatctttattgatttgaagtctgttttatcagagactaggattgcaacctctgctttttcttgctttccatatcttggtaaatattcctccatccctttattttgagcctgtgtgtgtctttgcacgtgagacgtgtctcctgaatacagcacaccaatgggtcttgactctttctccaatctgccagtctgtgtctttaattggggcatttagcccatttacatttaaggttaatattgttatatgtgaatttgatcctgtcattatgatgctagctggttattttgcctgttagttgatgcagtttcttcatagtgtcaatggtccttacaatttggtatgtttttgtggtggctgttaccagtttttcctttccatatttagtgcttccttcaggagctcttgtaaggcagacctggtggtggcaaaacctctcagcatttgtttgtctgtaaaggattctatttctccttcacttatgaagcttagtttggctggatatgtaattctgggttgaaaattcttttctttaagagtgttgaatattggcccccaatctcttctggcttgtagggtttctgcagagaattcctctgttagtcttggactttcttgaagaaatgggcttctctttgtgggcaacttgacctttctctctggctgcccttaacattttttcctttatttcaaccttggtgaatctgacgattgtgtgtcttggggttgctcttcttgaggattatctttatggtgttctctgtatttcctgaatttgaatgttggcctctcttgccaggttggggaagttctcctggataatatcctgaagagtgttttccaacttggttccattctccccgtgactttcaggtacactaatcaaatgtaagtttggtcttttcacgtagtcccatatttcttaggggctttgtttgttccttttcattcttttttctctaatctcgtcttcatgctttatttcattaagttgatcttcagtctctgatagtctttcttctgcctgatctattcagctgtcgatacttgtgtatgcttcgcaaagttctcatgcagtgtttttcagctccatcaggtctttatgttcttctgtaaagtggttattctagtaagcaattcctctaaccttttttcaagtttcttaccttccttgcattgggaggagcttgttattacccaccttctgaagcctaattctgtcaattcatcaaactcattctccatccagttttgttcccttgctggtgaggagtttgtgatcctttggaggagaagaggtgttctggtttttggaattttcaggctttttgcactgatttatcctcatctgtgtggatttatctacctttggtctttgatactggtgacctttggatggggtttttgtgtggatgtcctttttgttgatattgatgctattcctttctgtttgttagttttccttctaacaggcctctctactgcaggtctgcaggagtttgctggaggtccactcgagaccctgtttgtgtctacggccataccaccctgaatgcgcccgatctcgtctgatctcagaagctaagcagggtcgggcctggttatacttggatgggagaccctgtttgcctgggtatcaccagcagaggctgcagaacagcaaagattgttgcctgttccttcctctgaaaactttgtcccagagggacacctgccagatgccagctggagctctcttgtgtgaggtgtctgtcaacccctgctgggaggtttctcccagtcgagagggatggggatcagggagccacttgaggaggcagtctgtcccttagcagaacttgagcactgtgctaggagttctgctgctctcttcagagccggcaggaaggaatgtttaagtctgctgaagctgcacccccagctgccccttcccccgggtgctctgttccagggagatgggagttttatctataaacccctgcctggagctgctgcctttctttcagagatgccctgcccagagaggaggaatctagagaggcaatctgactacagcatctttgctgagctgtggtaggctctgccaagtacgaacttcttggtgctttatttacactgtgaggggaaaactgcctactgaagcctcagtaatggtggacacccctcccctaaccaagctagagtgtcccaggtggacttcagactgctatgctggcagcgagaatttcaagccagtggatcttagcctgctgggctccatgtgggtgggatccgctgagctagatcacttggctccctgactccagccccctttccaggggagtgaacagttctgtctcactggcattccaggtgccactggtatgaaaaaaaactcctgcagctagcttggtgtctgcccatatggtaaccagttttgtgcttcaagccatatttcttttattggaaaatatagaacttttccttctcacattcaacttcttgagaggatctctttgataatgtgttcatgtacacagttcacatcaaatatatataacatgtggatcaaagtgttaagatattcttctttacatatagtgttagtagctgacgatttttttttcttcaaaaataaatttggaaacttgtcagtccataatttttttaagtattattttactatctcatgaaatctgaaaggctagaatacactagataactcttgatttccactcctaccctgccatgaagtgataattcacatctggctataacttcataaaaggggcagggcgacccacttcctaaaagaccactattgacttgaagacctgtgtctcttgtctcacttctaaaagtgatttaaaactcaataactcactctgaaatccactgtataagaaatagtaatgtttagggtcatttaaaagaaagattagtttaataaattttggcaccctgtttaacatataaaaccatgaccatgtgttaagtataaccatattttgtgcagaatgtgattcaaaagactgatttaatagctatagtccaagaagtgttgaaaactcttgcccagtttatggtttccaatataggacacatatcaacagaataagaaactcaagaattaaactgatgactgtgtcgacctctggaggaactcttttttaagacacaaagccaaattttcaccttcatttatgcacactcatctcctgaaggcttccttatgcatttacgtgtgaaggaaggagaggatttgactcagtctctttgtctgtcatctttcttcctctctcattctgaaatagcttttcacagttgaggaaaaaataaagatttgaccttcccacagtgaatgataacaatgataacagctgatctttatatagtgtttattatatgacagagatcatttcatgcactttgcttctaagaactcatttattccttacaacactgtaagtactgttatccccattgcacagacaagaaaaatgagcttctgtattagtccattttcacactgctataaagaacttcctaagactgggtaatgtatagaggaaagaggtttaattgactcacagttctgcatggctagggaggcctcaggaaacgtacagttatgtggaagaggaagcaggcatatcttacatggtggcaggtgagagagagagagagtgtgtgaaggaggaactgtcaaacacttataaaaccatcagatctcgtgagaactcactcactatcacaaggttttttgcacagacaaaaccacccccatgatccaatcacctcccactaggtccctctctccacacatggggattatggggattacaattcgagatgagatttggatgtgggcacagccaaaacatatcaggtacaaacaaatagtggagttaaaaatcaaacatggaccatctgcctctgtagtccaggcccttaaccactacattatataacctcttgagagaggaaaacttagattgggcaatattagcatccaattgccagtgcaaaaggaaatggaagtcagcacaccagcttattacttacccgagatcaataagagacctgcaaatacttgactccgggttatagacttggtaaatccaaatgatttctctcatgaatccgaatccctgccagtaatgcagatattctaacttgagacttaccttccagactgaaaatgccaaatgagaaaaaccaagtaagtttgagtttctgcagttacaaagtgctatggtttgaatgtccctatcaaaactcaggttgaaataaaattgccattgtaatggtattaggagatggggcctttaacaggcgattaggccatgagggctctgccttcataaatacattaatgtcattattgcaggagtgggttagttatcacaggagtgggttagttattgtgggagagggttcctgataaaagcataaatttcacccccgtccactccatcttcagtgctcacttcatccttccaccttctgccatgggatcaccatccccagatgccagcatgatgttcttggacttcccagccccagaaccatgagccaaataacttctcttctttataaattgcccagttgatggtattctgttatagcagcagaaaacagacaagacataaaggaagacacataattaccctcccccaacagttcatgttacccctcaacattgttttagtcagtgcaagactaccaaagtataggtgtctgaacatcagggaaatgtaaatagagaaggtaaatgaattcaaccttccttttccctatactctcatttctgtcaaatataaaaacctgtgggttttacccttgttccagtttacataatcacattccaaattacttatgtggacttttatgagggctttttttctttacacctctctccttttctcatcagcctctgcaatcagctttatacaagagttatatttcattcatttcattttcttttctttctatttcacaagttctgggacttggctgtcaaccgaatcttgaacttggtaattaaattgttcataagctccaaacatgttgtaactcatgtcatattcatgtacacttctctgccccaacttgataaaatgagtgatactgggacaccattgtcatacacacctccaaacctgggtgtgtccacttcaaatgcctgaacttgctcaaatagaaatgggattactaaaacaactatatatcctcaccatgctggttttagtaggaaagatgcatcaaggataaagctctccagtgaaaagcatggggctgaaagaaggaagtctctctgaggcagaagtcctttggaaaaactgaagatgacgtcctagataattttgaagtcttatgtagcaacagaagtttatgtcattaatttagcaaatagtcatagacaaaacatgcaactttagagcaagtgccaggctgtgccaataattccacccttcacctccacatggggtcagtccatagaacaaaataccaaaggccttagtgctcaggtcttttgctcctgacattctcccttcatcctttccctatccccacttatccttttttaatgcactatagatgagtatgtcttaatttcttaagttaatttgcattggcattaagcacctactttatttatttcctttctcaacaactctcagactttgattcttcatgtccttccagggccctgccccatgccttctgctaaatgctaaagtcatgcaacagtttagtactgcgtagagtaggatggctagcaaaaggaaatctctcaaaggagcttcatgctctctgtgactcagggtagcagtatatggccttcggcacccactgtgggctgggctatggcagactttgcttgccctcattgctctctttgctttccttgatcttgcccctgtctgtcttcattttctcccttctcacttttttccctattgttacttacagtttaagttatggaagaaaaacacttaatgcttattggccactggaggatacacctcataacttggaaaatgaaaataaacactttaatagttttgtacttgatatgatgactcttttaaacaaaacactttttatctaggcatgaccttagatttatgggaaaagaaagttgcaaagatagtacagagagttcctgtatacctgtcttctagcttatgctaatgtggaaaacttacataagtgtggcacagttgtccaaaaaataaattcacattggtataattctattcactcaaattcagactttactcatatttcatcagttttttcattattatcctttttcttttcccagatctaattcagaataacacgtgtgttactacatgatgatttaaaatgtttacaaaaacaagacctctacctatgctcctattagtgtgtgtgtgtgtgtgtgtgtgtgtgtgtgctggtgtgtgtatatctttatttaataataaaactagaagggcaatgaattcgaaacggaggcttttcttactagcctttttaagatagacattgctgacacatggacagggattgaattagtacaaatattaaatatcattaagccttcttttttgagttctgtctgcacatcaacttcacctgaagaatgtttgtaaaatacacatgcttgttccccacccaaaatctattgaatcagaatctctagggagtgaggaccaacagttgcgcttttaacacctccactccccccttgtattggacggtaaaggccagaaaagattaccttaggcattctcatttcagaagctaaaacagacattcaattttctataccctaatttgggacttatatctgagtgttaatatatgcatgtaatactttgtgatgaatgttaaatgtgttttaatagtgttcccttgcagaatattctttcctttgccggtattattaagactatcttgcattgggattcatgcccccaggcttacagttctctgagctatacttgcatacactgtcctcagtgaacctgggctttggatccagatcgccttgaattcaaaccctagatctgccacttaaagactcaagaaacttacataacctttttgtaattgttctctatctataataaatgaaaagtattactaattattacttacatgcaagattgttgtgagcgtaaaccacatgatgtgtggaaggtttggggcacagcattctttaccaattcagggtaaccctgaaaacttaggaaaaagagaggattcatataaatcacaaattttgcaaatgcattttaaatcctctctttgttccagctccttgtacagacaggactgcttgctactaagaatttccaacacaacctccaattaaatagttctttgatgtatagtgggtacagaagaagtccaacttatttgcatttgcagaatcaggagacccccccaaaaaatgctggaggtgtgaaagcaagaatcagaatttgtcaggattctccgtaaagtactagcggttttgtagatgctttgcagctgtggaactataaacactcaaccgcagacacctcattttatatctcttctatgtggtatatttcccttgtgaaaatgtgtatttttaaaattcactctgcaaaatgacagtcaatgttatcaaatatacatttatatgcccttgattgtaaaacccactacaaagtttattaccttaagtttaatagaaaacaattttgaaaaatgggaaaaaaatatatctgtcacagggaagtggttagaggttctaacagaggagatttcttgttagaataatttgttgtattttggttatacattttttgtttttctttcgaatgttgaaaaagttaagaatatattaatacatggacaggttagaaaatatgtaaataataggttggtcaaatcctgcagatgacaaatcatgagagtttgccaagctaaggggccctggccactcataccatccctttatctaactcttcctcctcatccagtcccataataaaaaatattaagcttgcacgtggtaccttctcttctaggctacttgttaatgggtcctcttaattggctatgtataaaataagattcccatgggcagaaatctttatctgatctgttcatggacatatccaagtgtcaactagattttggcacacagtagatgtttggtaaatatgtattgaatgaatgacagacactgtgctccacattgtaaacacatcatatcatttaatcattataacatccctatgctatcccctatgtgctattattagctccatggtacagacaataatcaggatagatcaggaaactaaccaaggttacacggacagtacctagatggcaggaggccccaaagcatgtgtactaagcattatggcacactgccttcctgtctggcattcttgggacatgcatgtgtgagcgataaggtaagtccaggaaagcgtggggcactgggagaatgtagaagtagggatgatggaatttcatttccacagtgagagccccccatcctgctcccattgtcagacccgcactttttgttatctcttttccttctgtcttgctacgtttgctttgtcttcttcctcgatagtttcccaaagactttaaacgactaactatcaaagaagagaatatatgtgaagtcactagttacttttctgctcaattagctatatatagattaactttttaaaaaaatattttccccatacacccactcacataactgtgaagcttaggaaaaatttcaagattatcgtgggtgggccccatataaatccccacactgtcaattctcccagcagctgtttcttaattcgtcatcagtgtagaaatctaaatcagcactcagtgaaatctaaaagtccaaaagatttatttcaaatttcaaacctcctccctaatgttctgaggctgtgtcaacacaggtagagagacggggagagctgagggtatttaagaatcacataatgtgagaaactgaggagaccctagggatcttttagccctaccccctcatttacacataaggaaatgggatctgaggccaacagcaaacttgcctgcctgctatctgggaagttctattaataacacactgtcatgggggaaaaaattcatacaggtaataaaggtttgttattttcaaagattaacattctttattaattaccacttttttgaaactgacacagccacaaaaaactcctgtataagaagaatttgtctaataaattgtatgattgtttattgggtatctgtttattttcttaatttttaattgtctgtcaatccttcttgatttaaagtagtcacataaatatataaatgtaaagagttaatataactaattgaattcatttgagggaaaaaaattaaattttctttttaaaaaaagaaagaaaacattaaagacagaggtaacattagcacaaaaaaatgtgtataatcaaagtctagagggaggcctaaatgtaaatcaagctttctagtaagcaaaaacaaaagagaaaacctggttaactccaaggttcagaattgctgtgatatgcagacaaaccagctgtgaagacactgcacaacagtctatgataaaaagacgggagggacatttcttgtttgtatagcaaaggtctacaatttgcaatgcactgtggtaaaacagaaaccataagctgaatgcttttgtcactgaacttatattttagttagaaaagacataagaaactaattgtggcatttaacttataatttagttagaaaagactaaaaaagctaactgtggcatgaatgagaaagaaattactgctctattagtggttccaatactgtgaggccacaggaaaaaaaaaaaggattctgaaagatacggtttggaaagacttcgtggaggaagtggcatatcaacagggacttgaaggctgcctagatatgcaaagaaaaagttcaacggaaatacaggatgaaagaattgggtggtcaaaggaacaaacccacttgctgatagattgtcaaaaagtatagtgtctgcactactatgtgacgatgacattttttttccctttgtcatctaaaattgctatcaggccgggtgcagtgactcacgcctgtaatccaagcactgtgggaggccaaggcaggaggattgcttgtgtccaggagtttaagacaacctggcaaatatggtgagacctctctacagaaaaaattttaaattatctaagcatagtggtgtacacctatagtcccagctactcaggaggctcagataggaagatctcttgatcccaggaggtggtggctgcagtgagccaagattgtaccactgcactccagcctgggcaacagagagagaccctatctaaaaaagaattaattaattaaaaaaataatattgctgtcagtaaagactgactagtctgtgtgatatttatcatagctatatttcataactccagtgacctttttaaataaaaagtaaggtccagttgaccctccctgtctgtaggttctgcatacattcaaccaaccatgggtcaaaaatattcagaaaaaaaaatttaaaaatacaataaaaactaatgtaggctgggtgggtgcaatagctcacacctataatccttgcaatttgggaggctgtggctagaggatcacttgagctcaggagttttaggtcagcctggcaacatggtgagaacctgtgtctactaaaagtttaaaaaattagctgggtttggtggcatgcatctgtagacccagctactggggaggctgagatgggaggatcacttgatcctaggaggtggaggctatagtgagccatgattgcaccgctgcactccaacctgggtgacagaatgagaccctgtctttaaaaaaataataaaaataaaaatcaatacaatataacaactatttagatagcatttatgttatattaggtattacaagtaatctagagatgatttaaaatataggaaagaatgtatgtagcttataggcaaatactacgccgttttacatcagggacttgagcatttgcagattttggtatccttggggggtcctggaaccaatactttgaggatactaagagatgattgtccattaaaaatgttttaccataaaggaaacattttatctcttctgtgtcagtctgtgaccttttgggtggaatctgaacaatgtgtaaatgatagtttcccaacagtgtgcgctgatgtgtaggagtagaaaatgatcctttggttttcatataaaaactttcttatgaaacatgaagctaacaaccaagaagattaatcccaccagtgagacacaaggaatgcttaattttggaagtgaagctacttcctcatccctgaggcagcacatacactttttcaataatcctttatttaacaagatccaagaatattaatatctaacagcttagcctaaatttcttgaaaggaccaagcccattgtgttgtctcctgacttgattttcccaaactgtcatggattttctatctaaggaagatgagttccttagttctgggaaaacaccattgaggaaggatgcttcagaagaggaagggatgtcagccagggcagataaaattagcaagaaatattaagattaagtgctatctaagaggtacaaaaaataatagtgtttcacctcaatagaatcttattgttaaaaatacagtgtatctacagttctgaagattatcaaaacacaatattctagccccaaaacaggaaaagaataatgattcttaagaaaaaattctttctgggctgggtagggtggctcatgcctgtcatcccagcactttggaaggctgaggtgggtggatcatgaggtcaggagatcgaaatcatcctggctaacccagtaaaaccacgtctctactaaaaatacaaaaaaaaaaaaaaaaaaaattagccagacgtggtggcacatgcctgtaatcccagctactcaggaggctgaggcaggagaatcacttgaacctgggaggcggaggtggcagtgagccaagattgcgccactgcactccagcctgggtgacagagccagactccatctcaaaaaaagaaagaaagaaaaaaagaaagagagagagaaagagagagaaaggaaggaaggaaggagggaaggaaggaaggaaggagaaagaaggaaggaaggagaaagaaggaaggagaaagaaggaaggaaggagaaagaaggaaggaaggaaggaaggaaaaatattctttccatccattacacactgtaatgtaaaatgatgtgtcccagacaatggtctgtaaaccacattttgtaattccattgtaaaagataatgtagtgcgagcaaggccaaaaatccactattctttggaaaagtgtgccatttaattccactgaagataaggcagttggcacaagtcaacttttccccctggcttagatgtagttgtgcctttcaaaatgagctctctcatttgccaaatacaaagaagagaatagtgttttctcagaggaccacaggatatcaaacataattaaaaataaaagtaagattccctttgaatctagaagaaaactcacccaaatttcttgtaccaaatgaaggtatactgcagattttatcacagtcattaccatgagcagtcaataattccctgaatccctgttggacagaattacatcaggtacatgtgttgtgatgttttctgttttgagttctgtttgttttttatttattggtaattcagataatctcagtttcaggaatttgttttcttctctcctaaaatggagctgatgttcatctcttccttatgttatacctgtatttatgcaccaatttcatagaaaaccatcgtgcattttcccatggaattttgggtgacagtttaagatcagcgtttactataatgggcagacttaaaatggtccccgtgatccctgactcctgaagttcactcccttgtatgcttccccctctttgaatgtcagcggacctttaacctagagaatacagcagagttggccagatatatgtgattccatggttatcttatgtaagattggagtgcatgtcttgctagagtcttttacttccttattgactttgaggcaccaaggggccatattggggaaccccacatggcagcctccaactgagccaccaaagaagtgaattctgccaacaatctgaaggagcctgaaagcacagccttccctggttgagcctcaaatgagactgcagccctagccagtactttgattacagctttatgagatcctaagtaaagaaacaagcataactgagtcaggattcctaagccacataacccgtgagataataaatgtgtgttttaagtggctgtatttgttatacagaaataaaaaatgaacatacttactaaaaaagtttttagctgttgtgagtcctggtaattggatttgttttccagtgatatccatggacactgtgtcaatagtgatgattgatgctgatttgttttactcttatttattcaggatctgggtattaaaaataaattcaaactttcaacaggctgatcacctctgcccctctccctattagcatgtgcatgtgtgtgtgtgtccatgtgtccatacatgagtgaatggatgtgtatttaagcttaatcatgacacagggggttgtttatacagggtttttagaaaacaaaaacattgtctctatgaggcagttccttagaagccaactctcaacagtgtctcagtgtttccctcctgtaatttttccacacattatgcactggattttagtttgtgatactcaggattagtcatgaaaccaagtctttttgtgttctatggtttgaccagccctgtgcaagtctccagggaagcacgaaggacgggtaaatcagagtcccatcccttgaagcatggtggtattagaacatcacttaaagaacagggatacattacccatttagtgaaataatctagaagtcctggaaactaacttagctcacaagatgatattcattagccaatttacttcagaaactttaagaaaatcactttacctcctctgtacattcctccttccctccttccctctcttttcctctctccctccctccttccctcccttctttccttccttccccatattgttattaaatatgctcattattagaatagtatcaaagacactgaggcatttttagatatcttgtgaaatactccttatttttgtctcttcctttagatatcttaattatcaaaataatctaataagactctatttggaaataaagtgaaggagggtaaagttgtgtttttaaataggctgatcagtgctagaaataataggatagttttaaattctagcaattatagatcaaggctccatatactatttctaaaaagtctgtgaacccctgggaattgtgaatgtttcccattacatcctgccaacgattcttattaacctattggtgacgtctttcccagaggtgaagctttgatctgcttgtcatctcacattctgtctcaccacagtctagagcttccaggtccatggggaacaaggatggggcagcagcttccctgtgccaggactgactgggaaattccagaattctatgaccaggtacctgggaagggagaagagctctctgagttacagttagtctgggagcttttgaagtgaaactgtcatagggaaagtgaaggaatttgctttgtgcaatcatcatgccatagtctgacaagacaatggaaaaagaaagaaggaattttctctcaagatgtcaaataattagctgagtcatgaatgcaagcaggtaggcagaaaacagatatttgtagagaacttatttctctttctcctaatgaagtttttgaacaacaacgataaaatggaccttttgcctaagaagcaatttaacaaccattgcttcagtaacacgagaaccaatgtgattagagtgcttgtgctctgtcccctcataaatggttagtattgaggccttataaagaaatataacatctgctttttatacataaatacctacacgtaaccatccacaaataacttacgaatacccataataaacacagaatccatcattatgttaaatgccactgtgattctgagcattttaatatgctgtgaaggcatcagagtaaaacagaaacaagttatatctaaataggaatgcccagtacatttaaagtaatgagacgttttgctaaattcatatgttagcaatatgtcatgtggagtcatgaaggatcagaaataaaaaacagtaattgtccaagccgtcaaggagggatcagaagcaggctttgatcccaggctctgagtagagttgctgtggaattgtagattacatagaatacaggtggcatcaccacagattcctgtttatgtatttaacttgtaacttctcattctgacatcacaggaatatttttccttaacaaagtgaaataaaaagtaaataagctctttaatattgggacataaccaaatcagagggcaacacaaatttacatgggtacttgtgaggcaaaagaaagaaaattcaaaattcacttctaaaaatggacattgtttaaagcacatttaataagtgttacagagtgatgtttcactgtcacctttaaataccccttactgtttctttgggattaccaatttcaacatgaaggtccgagtgaactttgctagaggtgatttgcacaggctcatatgcatctcttcctcatattcagtgacctcacattagcagctttaaattggccatgttgagaacattgacaccacagaaattggcaaaaactagaaatcaagtaacacatgctacaagtctttttttttcttttctcccttcttggaaaattgtaatccagttgttaaatatttatcattataaagtagatccttgttaaaaatattctaatcctcaccaatggttttattttctttctgcctctcttctgctgcccctaaattaaagtaggtctttttatttggggctaagactagttccatcaaaatataaaatagatgaaaagtgttttggggcctttttgccctcttttcctagaccttttctgtttctcctcttgtcaaaatctcacttttttcctttaccttttcagccctgcttcagccctaggtcttcctaaaccagagaattttccaaaaactgcgtgaatatatatgccacaggctgaaatagtcttcccaaaaattagtcattaaaaaagtagagaaagaagatataagttttacatgaaaccctatatagataggagttccttcgagtattttcaaacttgattaacaacagagtaaattatttaagaatgatttaagaaatcaaagtatgagaacttggggctgatccaaagatgtggggattcagagatgaggggcaggcatagaagaggagaagagactgagtatttgtcaccacgtaaattcctgggcgagttgggtaaattttttattataagaaaacactcctttttcttctatataaaatttttttcaagtgagttgctaagttcattgtgagtcatgcattcctttgttcaagtgtggacaaatggtccttattttgttggaattttacactggcagagatcaatggtacaacctggtgaaccccccacaccaaagacacacaggtgtacttaaaggctgatcttctacagtacgcatctatggactggctttggggtgtgttcccaaacactcagagccaccttgagctggggaactggttagtacaagtctctttatgtgtcccttactctacaatcatgcacctagggtcgtgcaaacatcctgaaaccaacccaagctctaggagtcagaaaaggccctgaatgcatcttcaatacaggatctgtgcacacagcatggcctgcttctagaaaaccaatggggctcagaggcagtccagacagaggccttattttaagggctgatagaataggctgtgtttccccaacagcctaccttggtgagtaaacaccaacaattaattcatttatttactcactcaggttagaacattgtgttttcaagtttctaatattaaatttctttttcttttttctggaatagggactatcttattcagctcaaaataccatagactgaggcttaaacaaagacatttgtttcccaccattctggaggctggaagtccaaggtcagggtgccagcctgcatggcgagggttctggtgagaactttcttcttggcttgcagatggcagccttctccctgttcccttacttggcagagagacagagtgagccctggcatcttcctcttcttataaggatgctatattccatcatgggggcccaaccctcatgtgcttatttaaacctaattacttcccaaagaccccacctccaaatatcaacacattgggagttagggcttcaacccatgaattggtagaagggcgggaggtggacacaaacgttccatccataattctagctggtaacatcattgttagaatcagttgccttgccagtctcagaaaacaggacactgagatgcaaagacatgtacatttccatttgaggcaggtgccaggagacaactgagaggacactgagtttagaacattggatcaggcattgagagggaatctgggttgctggatgcaagaggctagtaaggggtgatgagagttcttcacataaatcaacctataactcacccagcctctgtgtcccaggggcctatccattattgatcaaaatgtcagtagaccttttgggttgtgtttcaaagagtaaccattatcttagagattcatagcaaaatatgagtggttcccagtaaaataaatcagagtttcctttatcttagctagaaacacctattgggacttttgtcaaattatttaggggaagaagaaggttgaaagcaaacttccaattgaaaagaagcatatttattgaagttcagagggctggagcgttgttttttgattgacaaaataatgaactctctgataagagtccagaattagttggctgaatttgtattcatttctccataaatttgccaaagttagaagagaaaatccatagaggccaaatgaagaaccatttgattaagcgtgttatcagcctggttgtggccaaattccacctcatatattcatgcacacattctttgctatgagttgcatatgtgctttgtggttgtgggcagatttaggtttgtttttctttctgagtcttttctggtccaaaagctcatcatttaaagttttggaagcaatttagaaagctattagattcccaaccccctcccgacttttggaacacttgcagttatttttttctggcacaaaaacaatcaaaaaggaaaaaaatgtcaggatatcttccaaagagagacataaaggtaacattttatttataccatgatttgtttattcttatttgttgttaccataaaagttatttaatttttttgaactgaaaggcagatgattttaggggataaaaaacctaaaataagaagtgttgctatgtgattacagagaatagttgcttttgttctgcctgtgtttaattaaagcaccatttgagaaattcaagaatcaggtggtaccgttgagtcactggacacatttttaagcaccatcttgaaatgtgatataaattgattttaaattttaaatttgtaatcatacacttcctctaaattgggaatcatgagagcatttctttttaagtagtttgtgataattttggaatttgaaagaaactttaaaggtaatgtatttaaagttactcacagaaatatgctggatgtgttgactggtaactttaaacatgtttatattgctatttttctagcacttgaaaagtaatcatgttttatagccaaagtcatctcctgtccatagaacaattaatagtcataattgatagttttatgcatgaaaattaagtattgctcctgcaaaactgaggagttaatgtctttacgtgctttttcacaaacattccttataatggaacaccaaatgcctacaatttgaacacatggctggtggaaaaaaagaagaaaaagaaaatcaatcctaagccagaaatctgaaaaaagacagtgactttgggtcattttgtaatcatctttggtgcttcagtgactaaaaaatacatgcagagtgcaagagcaccttgctgaatcctacaccctgccctccttgtgcagttatgttacatgcaactccaaagcctccacagctgttgtctctactctccattcaaaacaatgcacgtgcaactttcccttgtggctggcttcgtcctccacacaccaatgctttgtgtgaaaaggtttcattaaaattgagtttagggtaagtacgggataggtggagaaaagattttcttctaatgcttctccagaccacactgtttagccttcaggagacccaggaattgatatgagcaaaatgtttttacacatgaactgttctttaatcccttttttgcttcttcaatccttgaacttcattccctttcttttcattaacatttacaacacacactttacagggaaagaaagtgaaagatatgtaatgattctgcctgctacatctgactgtactccatttctcacattctatcctcatctttttctagccacctgagtcttcagacagttttaccatcttccctattttaaccccaatttaaacatccacaggaagccaaacaaaatatgcccatctgctccagatgtgtcaaatcaagttctgctattttaatttttttccaggcaaaccctccaacaaatgtataaacaggttgctttttagaagaagtaaagattaatgtctctctgggaaaaaaaaatcccatgcattttggaaagtctggctgttttccccttcaaaaaacttcatgtaaactaaatgcatggcttgatcctcccatgtaccagaaggggagcagcatctttgagctctcttcccaaatcctctgcttggtctgggcgtatcctgtgaatgaggagagaatctaccccacagccagatgcttgcatttggccacagttcatttccaggcagcctggaagagagcatcccacaacattgaacagaggcagccaagatactgtcgggtgatcaggacagctcccgcctctgtgttcctgtggagcctccttcctctccaaggaatttgtcgcatgggactgcataattcagttgtccattcagtcaacagtgatttactaacaacctactttgtgttaggcactgttccagggtctgcgcattcagcagtgagcaaaataacacaaaatgcttgctctcatgaacctggagacagacggtaagaatatacagcgataggcaacatggtaggtggggatgagtgctctgaattaaaataaggcaggacacagagatggagagtgacctggacaggacagggttggcagctcagaagtgcattatctacagtggtcagggaagcctctccagtgaaaggacattaagacggagctgaaggaagggagagagtggatgaaagagcaaaatccctggaactgggacatgcttggcaggttgagtgtccacaagagccccaattaactacaggagggtgagcaaggagagagtagagggagttgaggttagagaagtaaccgtacgtcaaattatggaggactgagtttctcaaactccagtgtctgcgcaaatcccccagggatcttgtgaaaccacaggccttgatttagaagatctgcggcaggcccagggtctgcattcctaccatgcccccagatgatgcccctgcctctaccgttccccagaccatgctttgagtagcagagatgaaggccttcttgcccacagtacaaattctgctatttctttcctgttaatttgaattggtatgcaacaactgtacatatttatgggataagagtgatatttcagtgcatgtatacagtgtgtaatgatcaaatcagggtagttagcatatccttcactgtgaacatttatcatttcttcatgttgtgaacattcaaaatcctctcttctagccttctgaaaagataccccagagtattgttaaccatattcaccctacagtgccacagagcactagaattcattcaccctatctagctgtaactttgtatctattaaccaaactcttttcatctttcactctcccatacccctccctgcctctaatgactacaggtctatctctgtttctctgagttcaatttattttagcttctacatatgagtaagaacatgtggtatttgtctttctctggctggcttattttagttaacatgatgttcttcaagctgatccatgtttgctgcaaatggcagaatttcattcttttttacagctgaatagtattccattgtggatatgtaccacattttcttcatccatccatctattgatggacacttagattaaaggtactctgcttttactatgagtgaagtggaaattttttgaggcttttctttttatgagacaggatctcattctgtcccccaggctggagtgcaatgtcacaatcataattcactgcagcctccactcccagggcacaaatgaccttctgcctgagcctactgagtagctaggactacaggtatgcaccaccacaccctgccaatgttatattttttgtagaggaaggttctccctgtgttgatgaggctgctttggatgcttttaaatagtggggaaataggatcagactcatttttagggagcccctctggctgctctgtgaaaatagggcaagggaggaaataggagacctcctgggagataactggagtagtctgggtgagatacttcagtgccagcatctaaggtacttgcaggtgggacagccacaacgaatgccacttcaagtgaatgtgaggatcagctctgctgcccacgtggaaacataagtaaggttgttacctgtggccttgcagaagcctgcaagtcaaaggccttttgatggttggtgaaaatcacatctgatatgcgtgattccaggaagctcatctgcctcattcctgaatttaatttctatccatgatgcacatattactattgcattaaacgtgaagtcattgcctcctgccattgtaatgtatgcatgctattgcagaggaaatgtttttatctacctcccaaataagtaagcataacttgagctcgcattacaaaatgacacaataaactaaaaaggaattcatttaatatttttaaacatgattttggtgtccttatatttagggaaatattttattgtaagttcatcttacaataaaatttataagggaaagatattttattgtaagttcatctcaggacaagaaacttcacttggcatagaaattaacatccaatctgcagcctgtcattgtagtgagatagtcttgaattccctagctaagttatttacctaaacaaagtcttgttcactttgaatttcctagctaagttttttacctaaacaatcattatatatgtttcaaaatatttaaatttttcccttccctctgattttataattttcttgataaaccttcctaaatatctttaaatttcactgatctaatggttcttaaccaggggtgattttgccccccatcaagggatatttaacaatatctggtgacatttttaactatcgggagttgggggatgctactggtatgcagttggcagaggccggggatggttaagcattctgcatacctgggagggccttccataacagaggatcgttcattccaaaatgtcagtagtgccacatttgagaaaccctggccttctggtgaccacaaggccttcagctacagaaaataaaattcaccaaagatccccacagccatgctttgaaatccttcacagtttgcactgagccatgcttcccacaggctgctccaatgaaggggattactctgaaggccagctttggctcctggattctccaacatccgtgccaaacctttcttatgcagcacagtagcctcagacatttccagctcactcccacttttctctcaggacatttttcctataaaattcttgcacatttaatctcatttagaatctgtttctcagagatcctggattaatatatcatggcattaaatcattgaaaataatgaattaatgatctttcctcattgtagtgatatgggaagaaaacgttctgatacacagaacacagaaatggctcagaaatgagaaactgactgactactaaattgttagtaaaagcaacagaataagtaagtgaaaaatagagcaatttggggggaaaaaaagttgagaaaccccaatcttcaaaaaaaggataaaagtcttagcttttgttcatgtgttatttaaaacccaactcaggcctcaactgaaacaactaaaattaggaaccaaaattgcatcccctgcccattcacacttttggaaccagagtggttctggacatagtcatgaggtcatcattcctaattagagtaggaatttcaattcttgggtttctaacccaaatctcgctatcctcagaaagcttgacagtatttgcagctctgcccattagatgagatctaccctttgcctttggtcaggaagagtcctatgtatggacacatcaccacagaccactcagattccctcttaccttccctaggacactctgcctcccttcctcctttccatgatactcatcactctgggtagactctgcccaggcaacaattgccctctgtggtttgccaagacccatcctgctttctgggaatagatgagtccctctaaagatgggcatgtccccagccacccaccactgtgcaggtggcagctgacgtctattgtcctgcaactcacatatcctgatctctgctctgttatgaactccagccagagaaatatacagatcttattcctgattcataagagactgtgtttgccttggatttaaccaggtctgatgactttcaggatttattatgttgatgaataaagggaaattctctcccttaaactaacacaatgatctctctgaatcagattctccctatacgcagccagcaatactagagaagccccagagacgctgctacttgagggctggcctaccgcagagctggcgtttatgttgtgatgataaacattcttgaaaaaaccctgaaggagatcctggcattttcctagtgcctttatgtgccataccgagtgcaagctgcttttcatgtactaactaatttaattcctgcaagagtcctgtggcatgggtatttcttattcccattttactgacaaggacactgaggctcaaaaagttgtttttttgttttgttttgtttttgagacggagtctcactctgtcgccaggctggagtgcagtggtgtgatctcagctcactgcaacctcagactctctggttcaagcaattctcctgcctcagcctcccaagtagctgggattacaggcacgtgccaccacatccagctgatttttatatttttagtagagatggggtttcactatgttggccagaatggtctcgatctcctgatctcatgatccacccaccttggcctccgaaagtgctgggattacaggcgtgagccaccacgcccggccaaggctcagaaagtttaagtgacttgcccaatatcacaatgttagtaagtggtagaggtataatttggattttatttgaattggaaaaggctgtgatctttctaggtgatattctaggtaacactagtttccagcaggcactctccattacctgcgtctgttaggtctgagtctgctatggttttctgactgatgtgtagggtaacacaattaaggaactctccactggaaggccaagtctccactcaggcacgtaggtagctggcagtcctccttgattctgctagccagagccagcttattgaaaacaaaagcagtctgttaggacagtgcccagacttctgacttcactacggaggctaggaaccaagtcaatatcatcagtcattactttccatcaacctctatcatttacatgcagtaggtgctcagtaaatgctgataaattcctgtatgaataataaatgaatgaacaaacaagagcatttgtctgtacaagttacagagttttagaatagaatgtaagtgtgaagctcgataaattcaaacttctgcaatatccccaccaagtggttatctaaattccgtttgacttcccttggcagggaatacgcacgcacactttctaaaggagtttttccacttcatatgactctggctgttcagaaggaatcactaattaaatgagatctttgaaaaaagtcaagaaactggaaataagtaggaattgctttacctgatgcttatcagcttacaggctttactgctccaaaaatttggttcgatttgaaaacattatgctaagtgaaataagccacacacaaaagggcaattattgtatgattccttttatatgaggtacctagaataggcaaattcatagagagagaaactagaatggagattcccaggggccgtagagggagagtagttattgctgaatgtgtttggggtttcagtatgtggtgaaaaattctggatacagatgctcacatgtcattgtgggtgtctttcatgcaactgaattaggttttttttttgtttttttttttttttttttttttcagataaaccatgaatcacattttatttattttgtcctttcatttttttttttttttttttttttgagacagagtcttgctctgttgccaggctggagtgcatggtatgatctcggctcactgcaacctccacctcctgggttcatgctattctcctgcctcagcctcccgagtagctgggattacaggtgcccaccatgatgctcagctaattttttgtatttttagtagagacggggtttcaccgtgttagccaggttggtctcgatctcctgacctcgtgatccacccacctcggcctcccaaagtgctgggattacaggcatgagcctcaacttttattttacgttcagatggcacatgtgcaggtttgttacatgggtaaattgcatgttactggggtttggtgtacaaattattttgttacccaggtggtgagcatagcatagtacccaataggtagtttttcctttttttttttgagacagaatctcgctctgtcgctcaggctggggtgcagtggtgcgatctcagctcactgcaacctccgctcctgagttcaagcgattccccctgcctcagcctcctgagtagttgggatgacaggcacctgccaccaggcccccataatttttgtatttttagtagagatggggtttcaccatgttggccaggctggtctcgaactcctgacctcaggtgatctgcctgcctcagcctcccaaagtacttggattacagccacgagccatggcacccggctggtagtttttcttcctcatcctcctcccaacctccaacctcaagtagcctccccccaacagtgtctattgttcccttctttgtccccatgtgtacttagtgtttagctcccacttattaagtgagaacatgcagtatttggttctctgttcttgcattaattcgtttagacatggcccctccagctgcatctatgttgagcaattaaaaaaggttaagatgagctaagtgaggtggtatgcatctgtagtaccagctactcaggacactgaggcaggaggatcacttgagcccaggagttcaaagccagcctgggcaacatagtgagaccccccccatctcttttaaaaaatatttcagatgataaattttatgctgtatgtattttaccataatacaaaattggttgaagaggagtacatataaacacaacaacgaagtgtttaactcatcaatttcagatacacagtaaaagaatgtatatgagaattggtcaaggacattctgaggctttaagcttcaagtcaagaaaaacaactgcctttctgaaaacttacaccgctcacagagtctggtgggctatgaatttgatggtacaacttctaacttgacagtgtggagatcaagggtataggaatgtaaaaagctttgaaaagtttgagagtggagtttgcacagctggacacagggcaccacaaacacaggtggtgcatttgtgcctttggtggacaaagtatcacccacaatgcacaggcgcttccctggctggacaataggtctctctctccatcccctctctctctgtttcaagagaagacattttacgtaggaccttccactctgaatatgaagggtatatcatttccctctcaaatccagactcctctagttgaatggctgacagccaacagaaggggtgtatgcacccttcattaggccagatttactgtccgccttccatgagtggttcagcatgctctctgtccagctgtggctcctgcctgcaaagcgtgccatcagcttcctggttcagagagagctaattttctctaattgcttccaatgagaggtgggaggcaggagggtatgtgccccattcagagccgctgttctcatcagcctcaccaagcagtgagagcagctttcacattcaaggtcttctttccattatttgggtaaaaatgttttgtctcataacctgggatttaagaatcttcaacaggttgcttaacccttaaagatctgacccacctggcctttaatagatttaaagactttatttggttttatgatttttaaaggaatcataattcctacttatttaagaactttaattcctatataagaataatttattctcattcatacttgtaaaaaaagtgtatccattgttttagaaaaggggaaaatagaagacaggttaaaaaagaaaactaaaaggcatttggtgttgcttagatgtacatgttttgtagtatatatatgtggttttgatcataaataatgtatcaaagacatataataccaatttctgttcttttttctgaaatcttagaattgagtccttagaagaaataccaagctaaagggcatgtgaatttctaagtttcctggcacttaattccaaattgttattccaatttctagtgtgccatactacatctttattagcattcaggattatcttcttggttaatatagtaaaatatcattttgttgtttgaattttcattgctttgataattgatgatatttaaagatgtttaggctctttttttctttttcatttgctcagcttttctgaaaacctttaggagacaagtttctcccaaattttttctactgagatttatgcattactgatatgacttctaacatataagctagttaacatcaagaggattagtctatcacaccacttgtcacctggggcaaggtagtatccagttcattagggtaaaggtcaagtaagtgttttgtttgtttaaaggggaacacgggtaggagttatcccaaagttagaacgcaatgaaacccaactatatagtaaaatatatttggggctcaactctgttagccatcaaaggtagtacaaaacatcagaagatgaagagggttttgaaagaaagaagggccatgtcagattaagaggtagaggaacatcaagataatttttcttctattagagtttctcttttagggtttctattagagtttctctaatagggggtagagaaacagcaagataattttttttctattagaatttctccattagagtttctcacctgcaaggtgttgactttccagttacctggcatttcattctactttttggaatggcctgagctgaaattaatcaggctctgttgatgatgcatccaccagggtttcccattggatgcttagaaaaaattccatcacagaatatctgtgtcttgtcttcttgggggctaggagatcccccaaatttttctcttctgttcttgtttgataaaggatgtgtggaggacctggtgcttaagagtttcagtttgacataaaggtactagttctggagagtctcttgggccactttatgttaacaaagactctcttgatcagcctttagttaagcttctctgagctctctccttgactaggcttcaaccttgggcttctgtgtcagtccttgtggagtctggttttagcaagaatcttgcaaagtcagtttagagagaataccccaccttttatatctgatcaatttcctcaatccccacctgtaatgtataagcccttgacctgccttgagtagaaatctcctacccttcatgtctcctcctagtaattttccatccactgaccccacactctgctctttgactctaaatcttcatttgtccttgttgtcttcaatgtcgaggccaatctctttcccctaccataatatctctattgaaatagtcctgaacaaagtcttccttgccattttcacacgtgccagaataatgcttgcctccctgcctgcctgccttccttccttccttccttccttccttccttccttccttccttccttccttctttctttccacagaatctcgctctgtcacccaggctagagtgcagcggtataatcaaggctcacagcagcctcggccttccaggctcaagtgatcctcccagctcagcctcccgagtagctgggaccacaggcacatatcagcacgcttggctaattcttttttgccttttgtttgtttgtttgtttgtagagacaaagtttcactatattgcccaggctggtctcaaactgctgggctcaagcaatcctcttgcttcaaggtcccaaagtactgggattacaggcatgagccactgcacccagcctcacaattttttctttaacaatgcccagagcatatgctgagcttcccgtcactctctggggcggaatggaatattacacaactggcacggtaaagaatgcacttggttttggtggtggataacattttcctttgcacctgaagcacttccacaaatagcccatttgtcctccttgcaattaaattagaaaaactgtctctaagcttggtttgacctatctgtagctctttgaaaagactgcttgatctttcctcactctccgtgtacctaaatcttgttcaggctctgtccagaaatcaataggaaacataaaaccttgaagcattataaaatcaggcattctaaactggaaagggcctttgattatttagcccaaatgcatcacctgttttacagacgagcaacctgaagttcggagaggtggaacttcctccaggtcatctgctgcactggtgatagaggcaggactaaacactctcggtgcagtgttccttctctgagtcatgttgactactatatgctcattcacagtcacaaactaaaaatctcagacaagtcaaaagcatacaattacaggaccagaagactcctcagtgattatctgggagtccaggcatccaagggacttgaccaagtttttgcagctattgctggtagaccaagtacggaaatacacttctcttgactctcagtctagtgctcctttccctgcagtactctgtgcaataccaaaagatatggatctccaggattggctgaggttagcaattaatatggtatttttagtcatgtctacttggagtagggggtgctgatttttgtttcatgtgtgttcttgagactttttgatgaggttccgtatgcctcactctaggtgatgtttttattagtaccatgttgtcttcctataaagagtttttatggcgaacagaaagctgtctggattcttgctatggttgtaggcaggagggaacatggtgtgtggcttctgaacaaactctggctgctctttaagttcaatgaagtgaaaaaaaggcaagttaattgactacagacatatgcaagagagctctcaattgagccataagatcttttgggatgtgggtgtttacaaggtagctataagcactctcataagtactgcacctgtgaatcatggactttcattgtacatagctttccactgcttgcttcttgaggctactgttcagcccatcagtaatttttaaagatcctttagaaagttatatagaggaatgcaaatgtgagtaaacaaggcgcctctacctactgatggcatcttcaatatttacattggcccgttgagttttatcagctggatattgctataaaacacatcacctgaaaattaagtggtttgaaataatgagtatttgtagttgttcacaaacctgtgggtcagctgggcggtgctgcagatctgaaccaggtgtggctgatcttgaatgggctctttcctgctgcggaaggcagccagcaaggtaggtgggggctgatggtcagggatggcctcactcctatgttttcccattggctgactatcagccagggctgcagtgatgactggtgaaatagtttggatatttgtccactctaaatctcatgatgaaacttgatccctacagttataggtggggcttaataggaggtgtgtgggtcatgggggcagatctatgatagatggcttggtgccattctggcaggatccagtgagttctcactcttagttcttgagagatctggctgtaaaaaagaacctggcaccttcctctcctctctttcttcctttctgtctggccatatgatgcctgctaccctttaccttccaccatgagtagaagtttcctggccgggcacggtggctcacgcctgtaatcctaacacttagaggccgaggcaggtggatcacctgaggtcacgagttcaagaccagcttggccaacctggtgaaaccctgtctgtactaaaaatacaaaaattagttgggcatggtggcgggcacctgtaatcccagctactcaggaggctgaggcaggagaattacttgaacccgggaggcagaggttgcagtgagccgagattgtgccattgcactccagcctgagcaacagagcgagactccatctgaaaacaaaacaaaacaaaacaaaaaaaacctccatgcttcttgtatagcctgtagaactatgagccaaataaacttattttctttataaattgccctgccacaggtatttcttcataacaacgcaaatgaactaagacaacaagtctctgtgttctccttcatctatcatactacccgaggtttgtttacgtggtaaagacaaggttcggagagaaatggttgaaaccagcatagcttcttgagacacaatgacacttatgccacatgctattggccagagcaagtcacagaacatctggattcaagaggagggaaatggattccacaccttgatggaggagatgcaaagtcatatcacttgggacatggatacagggaggggtgcaatttgggatgtttttgcaattaacctaccacaggcttaaggaggcttttaggatttaccttctgctctaatgagtttcaaccaccatggcttagagaacatttcttaaaactcagtcatctttcatgtatccattgttctccaaagggactaagttttgttccatggtcagtcttttccatgtgttcttggaccttatacaaaacccaagcctggaattacagcacctggatttattcatcaagcattcgccagttcctggttctatgcatgtgttcacaaaactcagaacagggcattcctctgaatagagaagaaaaatagagtcagtcagaaaagaaattttttgtctaagaatacaatccaccgtactaccaccagacttggttccctttcaatgtcgagagtaacacattccttttatgtgttgcttaatttgcttgttttaagcagttccttgtttttggagtgtcttttttgataacattgagataccacatccactgatcatgtctaaaagctgacaatttctgaaggaaataaactgttcaaaattaactactctctcactatatatatagcattgtattttcagtacacatttttggtacacatattcgtggtacatattttccagctggcttgtgctaatgtactagtgattagaaccaagactaagaaaaaagtgcattgccattttcaatcaacgtgggtagagctgaatggttgattccaaatcaagttattttgcctaaagcaagacagataggagagagagagagagagagataatacagagatagataatcacaaactgccatttagagaaaatcattactactatcaattataagagtgattagcaagtttatggatagcatgatggctagcaatctttatacaaatgtggctgattttcactaagtcttttaattctcagaattgtttcatgacttttttggagaaaattgttgaggcatgaaaagaatttcatgactgagatagatattgtaccttaggaaatataaaatttaacaaatctgtagaaaaggaagacttaggctttgactttaaaagcccattccacttacaagatttcattttttgtttattcaatttggaaagcacattttcttatataatcaataagaagatttttatggcatgctcgagtgtagtctgattccaggtctcataattcctttgcactcaaaaaaggaactttgttacatcttgccactcatgctcactcttcagtgggcaaagtgactttgccatactgtcaccatccttgagccactgcccggtccttgaaaactaggattcttcatttccttttgcatcgtcagcgtgaggaaggggagggggaggtaagattctggacagctggactgaaaacaatggaaaatccctagtaacagcttgaatcactcactagcaggaggaaaatgtgactcgtttcttttcctctttagcttttgttgatttttttcataatgagctcagaaagagggaaagatcaatattcatgttgagttggtatccatcatagtgatattcagtgattataactctccaattctcactaggacaaatataaccacgcaaactggctaactgcacttgctggcatggttcctttggaaactcctggatttctctgaattacaaacagaaggagagttatagattttgtctctttaattttctgtctcttgaaatctcagatcacaaaaattgagtctttcttaactggtgatttcttattcgtcaatgactccttaaaagatatgcagaaagtaatggccctctaacccttcacctttgtaagctctttaatcctgaggggatggacttcctgatttctgttctctcagattctaaggaggaaaagactagctgttgtctctcaagtctacctattgctgtcctacagagcaaggacccctcttgttctccagctcctcaggaataggattcttggttccctaactctaaaataggagctcacaaggttattgtcaaggacaaatgagggcagtgttaacgtattaaaaaaaaaaaactagtcagagattgcttgattttcaaacttgatagtatgctttcgaagttacataatcaaaattatagttgtatttaaaatgttaagttcagcttacaaaccttcttaacctatttgtaagtcaagcaaattttaaaaatccttcttaagggaagcttgattaatgatttcttctcattttcaaatgtagttaaacatttttaaacacttaaagcttgatttgtaaatttaatacatttaattttaagtactttagcttgtctaacttaacaaatgagatactcatgaatatttgaatagctcatcaattagatacttataaatatgaaatatagtttttaagttcttttaaagttctcaatgtacttgtaaacttgtaaggatttcaggtcaaaacgataagtttaaatcatttactcgatttaacattttaaattggaagcacaattctaattcactattattttaataggccaaaatatcttaaaattacaagtatataaaatatcagggccaggcacagtggctcatgcctgtaatctcagtgcttttggaggtgaagccaggagaatcactcaaagccaggagtttgagcccagcctgagcaacacaggaggaccctgtctctacaaaaaatacagaaattagccagaggtggtggcatgcacctgtagtcctagctatttgggaggctaaggcagaaggataccttgagcccaggagtttggggctgcagtgagctgtgatcacaccactgctctccagcttgggtgatacatcaaaactctgtgtctataaagataataaaataaaaatatgactaatgcaaaattatttgatactatgggtttcatttcatacagtcatatgaaatgaaataattatgtatacaattatatatatatacatatatatagagagagggtgtaaatatataatttattcttaatgctcaatcttatcagagctgaaagatggttacccatgaaggaatcaatgacaccatttcacatatgattgcagttaccattcccttgtagttgctgggctagctctctcagctttccgagatttttttgaggctcagaggacctcctctcctgaatgagaactgggttctaacgaatgaccctaactgtgccctgttacagtggctctgtcttatgcccacgtgaagtgatgtcacagaccatattcacgatatcgaagctacacattactaaaccttctgccgacccacagaagcccaaaactcccatcctcatagtcatatcaatggattagattttattatatttgctgcaaactctttttataatgttcttcctactcaccttattcttatgtctattctattgagatctaattaaattatgaatgtctcttaagactctatctggctttatagtgacaacatcaaaggatatttgtattagttagggttctgcagagacacaggatgtgtgtgtgtgtgtgtgtgcatgcatttgtgtgtgtgtacacaagtcccaagatgtacaggttatgttggcaagccaggagaaccaatggtgtagttcccgtatgaaagccagcaggctccatacccaggaagagctgacatttcagttccagtccaaagtcaggaaaaagccaatgtcccagtttgaatacaatcaggaaggagaagttctttcttattcaggggaaggtcgccattttgttctcttcgtgtcttcaactgactagatgagatccagttacatgaggtagggcaatctgttttagtcaatttatatttaaatgttaatctaatctaaagccaccctcacagaaacaccagaataatgcttgaccaaatgttgggtctcctcataacatacaaagttagccatcacgatattttcctggcatacactgtgaaaccactgacctggaaccctctgacttctgtcagctatttaatagataagtctttctaatcttgagtgtttgtaaagcagttggatataaatttgaaaatttttaaatgaaacgataaatcatgtgtgacctcttgagcctattaatcctaaagtaaaaagtccttgtacaaatttttatccactttttttttttttttttttttttgagacagagtctcgctgtgttgcccatgctggagtgcagtggcaagatctcggctcactgcaacctccacctcctgggttcaagtgattcccctgcctcagccttcctctcaagtagctaggactacaggtgcacaccaccactcccggctaatttgttcgtatttttagtagaaatggggtttcaccatgttggccaggctggtcttgagctcctgacctcaagtgatctgctggcctctgcctcccatagtgctgagattattgctatccactcttgatactgtttggcatgtgacttaaaacaagcaacagttgaaaatataaactagaaaatgagcatatatgttcattgttgctaaaggcttggtaccagcaccagctacaggagtttatagcataccttctcagagaaaggcctcttcattctgggtttagaggtgttggtatcctctgttgcaagatgttattcaatcaattcaatcctgagttttcaacatcagcaacattacatgtgcatttacaggaagaagaccagagtaggaacactttcattttttcccccaaccatctacaaaaatgaagattacctgaaatgtttactttatactatgatcttaaaactatttattttaataatatctatataacccagatcaagaaaaccagtgaaaattagcctattcaatcctttcaaaaggcttttttattccaaaagattgaataaaattagttactccctttatcctgaatttcactacaaatattacatttgcaaatgtcccatctgactgtaataaatgccagtgactttaactctgtggttggtgatatgaagaaaaccatatgtgatagattctaaatatataaccacaaaagccaaactgacggtttggaacatctcagcaactattattgattactacagttgaagaggttgaatcagtttgcatggcaattctcctcctcttcttcctcccatacccactcctcctctttcttatttttctctcttgctctctctctctgttctccattcgttgtttctttctaattcgcagtagcagtagcagcaaccagaaaaatatttgagaactttaaactaaatggttaactaataaggcaataaatagaaggtgtgacactgaacgaggagtaaaagccaatgcattccactacattgagagacatttatgaagtatattgagttacacagacactaacattcagaaacaataaaatagagacagtgtaaaaggctaaaaatgggctgggctcggtggctcacgcctgtaatcccagcaccttgggaggccaaggcaggctgatcacgaggtcaggaatttgagaccagcctgaccaatatggtgaaaccccgtctctactaaaaatacaaaaattagccaggtgtggtggcacacgcctttaatcccagctactcaggaggctgaggcaggagaatcgcttgaacctgggaggcagagtttgcagtgagccaagatcatgccactgcactccagcctgggcaacagagtgagactacgtctaaaatataaaataaaataaaataaaataaagactaaaaatggcccccaaaagatatcaggttaaatccctggaacctgtgattgttccgttatatgataaaatatatgatttagttaaggatccccagaggaggagcttaatctaaattatgaatgtagtaaatgcaatcacatgggttcttctaagagagacagggggtgttttgagatagacacacagggaaggcaatgcaaaaatggagcagaaggggttatagctaaaaggaatgccaagggccaccagagctgtgagaggcaaggaacagatttttccctggagcctccggaggaagcaggccatgctgacacattgattttgtccttctggcccccagatctaagaatatatttctgttgtgttaagccagcaggtttgtagccatttagcagccacagaatactaatatggacaatgatttctgagaaaataaaaagattattttgagaaaataacaacattccttgtttgatttttaggaaaagccattttattttaatttttttctatttttttatttttattttttacattgaggttctctttattttttactatttcttttttcttttcttcttctttttttttttttttttttgagatggagtttcactctgtcgcccaggctggagagcaatggtgctatctcagctcactgcaacatctgcttcccgggttcaagcaatttcccacctcagcctcccaagcagctgggattacaggcaactgctatcatgcccagctaatttttgtatttttgtagaaatggagtttcaccatgttggccaggctggtcttgaactccttacctcaggttatcagcccacctgggcctcccaaactgcttggattacaggcatgagctacagtgcacagcctatttctgactatttcttgacggccatccatgctgggggaacaccctcatgtgcctgtcaagcccaaatcccactctaaaaattcagattcccttttctgactccgtaggatgcctgtccacggaggtctcataaatccccaagcccacattttccccaagtcctccccctgctggttacctttcctttcccactcacatggagcaggtgtccgaaacaatgggttttgggcagaaaacgcattttagtcaactgttgtataaatattctaaactagtaattaagattttaagcatgtgctctggctggtcatggtggtcagattgcaaacagttggcaatcttatttcagcagtagactagaatctggtcataatttatccaagggaaaaaagacttgtcattaaattctctccaacggtcctaaaattttaatttatccacgcctaccttgtccattactgttttaaaacagctttttaaacgtctagattccagccctgtgtagaatcaaatatattagaacttagtcttgttacttggtctgaattggaaacatttccagtgcctaccagttgcacacatcattatccactcataattagttgtttaatctgaaaagagcaagttctgctccatcacctaacatctgttcacttttactcttagctctgttcaaccaaatcccattattgtcaggagaggctctggcagacttgtatcatttacgaatggtttctatttctttgtagatttctaattctttgttctcgtagctgctacattctctgataataaataacattatgcagttatttttcggaacttgtgcttgttttcaaaataacaagactaagaactaaagatttatttgtctgaagtcacacagtgcctcaaaacatatctcaaacactaaaaatattaacatccacaaactaacacctacttataaaaactctagcaattctgagagaaatggattatttacaatcctctctctgctgatgttactgttaaatgtcatattaactcccagttatactgaaaccattttaaatgttatagtactttgaccttggttgtgaaaataaagtgtctagtgtaattatttagggatagtatagttcctaattaagacaaaattttcagcaaagatgattaaaatttgataagcttttaaatttttgtgtaatttctccaaataatgaaatgatttctttttctaaaaaaatctataaatttccagactgaaatatgcatgtcagaataaaggaaaattttattatggatctgaagtttgctccattttataacacatctagaaaatttggggtactggcagagtgaacccacagaagagattctgatgaaactgaaagtggattggtaggaaaattgctttacaataatctctactacttgcttttcatgtaggggtttgggaattagtctcttatttctacaactttctatttaactgaaaagacctaacatcttataataggattacactttctggtagaattttcatgatacaattcatttaaactatgttctttgcatgttctgatgaagacatttcctatgatggcattttggtctttctatctccagggaagtcaagtgattggaaagaattttaaagagacttgggctgagtgcagtggctcacgcctgtaatcccagcactttgggaggcccaggcaggtggatcacgggtcaggagttagagaccagcctggccaacatggtagaacctcgtctttactaaagatacaaaaaattagccaggcagggtggcaggagaatactcaggaggccgaggcaggggaattgcttgaacccgggaggcggaggttgcagtgagccaagatcgcgccattgcactccagcctgggtgacagggcaagactaggtctcaaggaaaaaaaaaaaaaaaagagagagagagagacttgatggttttctcttgaaaaaataatctcttagccattttccactgccacgagtacatgtacattgaaattagtgatactgaatttatcattggcaagatatctaaataagatttactgtagattaccagcgcattaaggagctcctggacaaaacatgtgcacattttctggctgagaagtgcagtcattgaagatttgtagaccagaacataacatattgaaccccatatctatctatatgccagtgtgtgtacttacatattaatttctcctatgaaagaggaattaataggaaaagaaaagcaaggaagtaatgttcaaaacttccttaatggccaggtgcggtggctcacgcctgtaaccccagccctttggggggctgagaggggtggatcacctgaggtcaggagttcaagaccagctgaggtcaggagttccagaccatcctggccaaactagtgaaacctcgtctctactgaaaatacaaaaattagctaggcatggtgtcaggtgcctgtaatcccaactacttgggaggctggcacaggagaatcgcttaaacctggaaagtggaggttgcaatgagccaagatcctgtgccatggcactccagcctgggcgacaagagtgaaactttgtcccaaaaaaaaaaaaaaaaagcttccttaaaaacaaaaaaagcttatgttgccattatttgggctattgatttttttctagtgcaaaacatatacatatttgatatataaccttggaaaatacacaaaagacaataacaaaacactcaaagtcctgctatctaaaaataaacactttgcttctagagttacttttattcatatttttaaaacatatttataggccgggtgtggtggttcatgcctgtaatcccaacactttgggaggccaaggcgggtggatcacaaggtcaagagatcgaaaccatcctggccaacatgatgaaacccccactctactaaaaatacaaaaattagctgggcgtggtggcccgcacctgtagtcccaactactccggaagctgaggcaggagaatcgcttgaaaccaggaggcggaggttgcagtgagccaagatcgcgccactgcactccagcctggtgacagaatgagacgctgtctcaaagaaaaaaaaattatatttataattatagtgagtattccatttctgtgtcctgcctttttgtatttatctaaaatttaatttaaaaatttctagatttctctgtaaaatcctgggaaaatcaaggcaagttcatagtgatctatgagtaatctattgaaatagcttggcattacataaaagcaatcccttcaggtctgaataaaaccataaatagaattttccttttggcatttacttcattttagactcatttaaatagtaggtttatcaatgcagtttattctgagcagagggatgatgtaatgtataatcagttactcaagtcaaaatgccaggaaagtatatgaataggtagcaacaaggtattgggttgaaaagaaaatgcttggctggctcttagatggcttgccctttagttgctactttccttggaccctttccagggtctccaagcatgaaggacccatctctcaggaagaagtccttgcccagggctgtttatcttagttgagtacagccaagtacaaaccagagcgaagttgggtcttgatctcctattgggtgccactgtctctgctttcttttatggctaacaagcctatactaccacaagccacatttcatttgatagcatgggtagtggaagagagcatccaaagccagtcaatcctaaatcatgtctgcaaaaatatctgtaaggataaggcctggtggacctcaagaactgtctccctctagtaataatcatataacattattattttgcagtgaaaaattatccagtacacaagcagtctatgcaatgtaatgagaagaatgctttgcaactgtactactagaagcgaactaattcatgatttatttttaagtgattagaacccttagtttatctgtgagaacatcacttaaataaaatgttttaaaatatgcaatgcatatgcaatagcattaaagtattaaatagcatcttaaagagcaaaagaaactattaagaataattaagtggatttattggctaattggtgtttccacatgtagttatttctgcaattattattcatttgctgatttacatagagctattctctaaaattactctggcattaaatgaagttagaagacatctccagtttggaaaatctattaagcaaatccttttcaacttaaagttgaggtgatactgaatcaaggcctggcagaactgactacagactcagagggagtatgtttattgcttttaattcttcctatttctgtttgaactaacatggcaaaggctttcatcttccaaactacacttatccagtctataaaacaaagatgatattgtttcaactataaagcacagattaactttgggaggctgaggcaggcagatcaccagaggtcgggagttcgagactagcttgaccaacatggaggagccccgtctttactaaaaatacaaaataaccgtgtgtggcggtgaatgcctgtaatcctagctactcgaaaggctgaggcaggagaatcgcttgaacccaggaggcggaggttgcagtgagccgagactgcaccattgcactccatcctgggcaacaagagcgaaactcagtctcaaaaaaaaaaaaaaaagaaaagaaaagaaaaagatcgggtgcgggggctcacgcctgtaatcccagcactttgggaggccaaggcgggcggatcatgaggtcaagagatcaagaacatcctgaccaacattgtgaaaccccgtctctactaaaaacacaaaaattagctggggatggtggcatgtacctgtagtcccagctactcaggaggctgaggcaggagaattgcttgaaccagggagtcagaggttgcagtgagccaagatggtgccaatgcactccagcctggggacaaagttagactctatctcaaaaaaaaaaaaaaaaaaaaaaagaaagaaataaaaagcaaatactaccaaattcttacctaccagagttacgactgctataacccttaacatttaaacaagggaaatcatcatttgggaattgtatttcctcttcatacaaactagtcttccatggtaatagattggctggatgtttttccagtatgttttctagataaatagtccttggagccattgtttccctaagaattaccaaaaaaataaaaacagaaagcaaaaacatgtttgctttctgctggaacatacatctcaggcagtgccgaggactaaagataaatttgatacctatggaggaatacattctaaaaataagattttatatctgtttgcatgttaacaaaacttatttgtaaagacacacattctagaaagtaacctcaaaagtactcttataaagcacctcattttgaaagtcaagtagagcaattcctgggcagatgataatgatactgcagagacatgtgaagaaggaaaaaaaataataatttcgctccctgtgttagtctgttctcatgctgctaatgaagacatacccaagactgggcaatttataaagcaaaagagatttaatggactcacagttccacatggctggggaggcctcacaattatggtagaaagcaaaggaggcgcaaaggcacatcttacatagaggcagtcaagagggcatgtgcagaggaactgccctttatcaaaccaccagatctcgtgatacttattcactatcacgagaacaggatgggaaaaacccactgccatgattgaattcccttccactgggtccctcctgtgacacgtgtggattatgggagctggaattagagatgagatttgggtggggaaacagccaaaccatatcactccctaagactattacatttcagcagttagatgaagagagaaggacagggttcagattgaatcattttggatggaggagaacatataaataattgaacaataggagcaccacctagtttagagacaacctaccacaggcaaatacctcacatgacttcattgttctcccccacaccttctctaccatcagatttcacccagaaccctcatgtgccacagaacttcaagtaaataccagccctggaatactagtcagaaagctgaaaaaaacgtgcaatatgagtttgaacactctgagatcgttaacacttttttcaataaggttagataactaagatgataaataaaaatattttaaaacattaataaagaggaaatgattctcatagaattagtatagccaaattttatcttcttaattgttgtatttcatcaagagacatagataggattaattttggttttctactataactgcttccatcagggaaaatagattaatttctaaaataccaccagaatcttagagttgtttatccaagaatctctaaagacactttacattgcagagtaagtcaataacatgggcaaatataaagctagggaacatgtgaaaaataaaattatgagttacaaacattaaacattatttcagtagaaacagattggtggctgcagttgattattaaagaatgccattaagttgtcaggaataactgttgtagttttctgaaaatagtcattttgttgtagctttagattggattagctagagctatacacacgagagatgcacatcaggccttagacacaaattccttcaggaaaatgattcactggctatttagggggttgacagccagtatatgttgttttcgagtcacagagaaaattgtatggttgtatattctgctttaatttacatcaatggaagatgagctacaaagcagctattgatacaaaaggcaaacccattgtagaaaatgaacattttctgtaagctacatctacattcttcctgatcagaaaataatacagaaagtgacatacttgttcctttttcacatttgaagaaaatgttacaaatgcctccatgatgcaattctgtatttagacaatctaagcattgagtcttgggatacttattctgtaactattttctaagaataacctgaatagaaaacatggaatttggtagtaaaagatataaataatgaaaataggggtagggtcctgtgcctcagtgaagtttaaaatttaattgaacttctaaataaatgtttaaaaatagagcagtttcaaaaatacaaaagctagaatattcatagacccctgaagatacttctacagtatcccacagttccacaatctctgattcaggaaattacattaaaagttatatgttggcattttggaatttcatttggtatacatacctgcagacagaggcaataaaatcacatcaatggtcggttacaaatgaagtcatccagttgacccagggtatgctttggctaaattttgttttagatttgccctaaaatataattgcaatattgaatatctctaatagatctcaagggccctctattagtccattttcgtgctgctgataaagacatacccaagactggacaatttacaaaagaaagaggtttattggagttacagttccacacggctggggaggcctcacaatcatggtgaaagtcaaggaggagcaaatcacatcttaggtggatggcagcaggcaaaaagagagcttgtgcagagaaacctccattttgaaaaccatcagatctcgtgagactcattcgctatcatgagaacagtgcaggaaagaccggcctgcataattccatcagctcccacgggttcctcccacaacacgtaagaactgtggagttacacttcaacatgagatttgggtggggacacagccaaaccatatcaggcccactttgcaaaatatcaaaacagaggggaaaagtataagtaactgaagagaagggtgcggtgtgctgaatacaaagatgctgactggggggagtgaatgtacctgcatcccaatttgcctgggaggtctggttttacccattgtctgacattctgtctaatttagcatttgtcctgaatatttcatttagtgatgtattattgttattagttgcattaaaacaagccaagatggattaggtagacctccacgttgtacttccagtttcgtcatgttatggtcttgggggtgcaggaattcccaggtttccttgaggtgaaatctgaaagctgagaaatatagcacagctcacaaggaagaagtggataaaacagtgtcctcagagcagccagggaatcctaacccctgacgatcttcagtgaggcatttggtactccaacctgttgtgccttagccctgagccccagtctgtgaggtgcatatggtcctagctaataggtcagtgggaaaagggagaaataataaacgaggctgtgtgtaaacttacgtgtaggaaacaggttaagctgttctgccctgttgcatgcagagagtagtctgaatgctattgccacagtggttttatttttattgtgtgatgtaaccatatgccaatttttttctttgactattgactcactattttataatgcatccttctggcaataatgaaataaaaattagtaaacagaagtaactgtttaatgaaaatgaagtatttgtatttctatttatcaagaaagaaaagacgaacctgtggcatgcagagagtagtctgaatgctattgccacagtggttttatttttattgtgtgatgtaaccatatgccaatttttttctttgactattgactcactattttataatgcatccttctggcaataatgaaataaaaattagtaaacagaagtaactgtttaatgaaaatgaagtatttgtatttctatttatcaagaaagaaaagacgaacctgtggccgagcacgggggctcacgcctgtaatcctagcactttcggaggccgaggagggcggatcacctgaggtcaggagttcgagaccagcctggccaacgtggtaaagccctgtctctgctaaaaatacaaaaattagccgggcgtggtggctgatgcctgtaatcccagctactcagaaggctgaggcaggagaatcacttgaacccgggaggcagaacttgcagtgagccagattgcaccattgcactccagcttggggcagaaagaagagaaactcagtctccaaaaaaaaaaaaaaaaaaaaaaagagaaaagaaagaaaagaaaagatgaacatgtaacttacacaaaacacttgttgccatttaccatggggatataatgaactaacattcagaagtcacacatatgctgaagaagcatcaggatctacttcaaaagttaaaaacattaaaaaaaaacacagaaaaaaagagtgcatcttaaaatgacttaacacacacaactgcagaaggtggagctacagaacatgcttggaagcacgactttttatttagatcagatgattgttctttgacattaagttagctcattggcaatttcatgatttcttgtgcatatcccaaaatgaaatgacacctgttaaagtgccagcaccgttagcaaaagaacatttaaaacagaaagtggtgccagttttatttcaatgtcatcagatgttccaaacagaaaatcactccagttaattcttgtaatggtttcgttttctcatccaattccgaggaagaaactaaagctttttgaaattaattctgttgaatgtattattcatactattttaaattcagttaatatttagcctacatttctagcatttgtctaatattaacacagtttttggtggagtactgcatcatgaagaaacctaacactctgaaatttaaagatacgaaatttacttggaaatagtttttatgtacatataattcatacttacatccaaataaatgttgatagtctctcaattaaaataaaagctgtaagtttcaaatttttgaaataggtacatatacaattggatcatctgaactgtgaaattttgttaggaaggtaatgttgactacaaaaaaaactcagaatatcaggattcactttttctctctgctgcctttcttcggttggattttagaaacgttcatgagtgtttaatcttctgtgcttttaaaattcttctgagtgtcttaaaatagtactgaagttttcatgacagtcttttcatttttggctgaatattgttttaaaatcatctagaaatctttcatcaaagtaccagtgaatggaacagcaaaagctaaagatttcaaagcttttatcaaaatgcgattttcgcaaacaaattatgaaaataggaaggcatggatatgtatctgcaaaggcaagggagaaactaaagaattgtagaataaagctcaaatattataaaatatgtaatttgaaaactccaattgtgttttgaaatattcagtttgtgggaataatagtttgatgaagtttcaatttttaattaaataaatttatatagagcagatataatgaaattgaagacttagtaaaactttcaaaaaaatcctaaagacagtttatttgatgatttttgacttttaaatatttgttaatgaaaagtattcttagtaaaaaaaatataaaatatttgggctgaaatatttaatataaataattgaattgaaaatattttctgtttagcacaagctctgagcttgttaagtaccttgtgcctgtgggagaagctagtctttaaaagtttaaatattggccaggtgtggttgtctcacacctgtaatcccaggcgtgattaatttgggaggctgaagcaggcagatcacttaaggacaggagttcaagaccagcctggccaacaggagaaaccccgtctctactaaaaatacaaaaattagctggtcatggtagcccacacctgtaatcctagctactagagaggctgagaatctcttgaacccaggaggcggaggttacagtgagccaagaacatgccactgcactccagcctgggcgacagagagagactctgtctccaataaatacataaaaataaaaataaaaatttaaatattattgattaaagataagaatgaattagttttgtcactaatttcatacatattaaccatatcatgccactttgaagaagattgtaggtaatttatgaaaaatgttcaaataagactgtatttttttaaatacttttcttagaaaaatactagtgatatactattaaagacagataaaactttaaaaaattgattaaagtacttgcattctacttattttaatgttcagattgattttatgaagaatttttgcgttagtgaatgaagctttgtgttattttatattttagaaataattctagcatagcatagaatattttataggtatacgaatataataaaaccagaatgttgttcaccagacgaattcttcaaaaaaaaatacaatcttcacttttagtctactttcttactctcaaaagtatcctaattagtctagtgctgaagagtttcaaactcatttaaagagaagtagacaaataagtgacaggaaggattgccgtgtgtatcttccagtctggggtgatgtttaaattcctcagagtccacttagctttgtctcttcaccagccttggtttgccccagtgctgttcatcattttaacaaaaatagatctcacaggatgttcacccagtcacctttttgtagggacaagctttatagtcctagcacttgctgattctttaaatactgtgctttggtccaggggatgttaccttaagcccattttttgtagttagtaaataagacttcttcccaaagtcacgtgcatgttcaagttcttgcattgccagtgtgtaatggataaagacaaatgtatagtaaaaaaatcatgaggcagtctttggttctcatcccagccctgttggctgtgtgatatttggcaaattattttacttctctgagcctcttttctttccattgtaaaatacagagaatgatagttaagagtatttttgtggaaatgaaccaacacaatgcagctcaagtatcttagcagagtgcctgtgttcaataaatattaataaaatgacccttaactcccctcagcaagtttaaaaacaggaagtttccatttcaccatttactttccaattctttgttaaagatggccataataagtaatgagagtgtgcatttgtaaatgtctgtcaccaatgtgaatttacttgagatgactcaaaccacattctatactggaaaaggtgcatttaacgggcaaaagaaaagcccaggccagtttctttctgtatcaaccctgggtaaatctccttaagaaaaaattaacaatcatgatttattcatagggaaagaatttaactacttgttagcattcgaatgggtcctaaggaaactcccaagttaattaaatcagaactttcttcttgagtttgatccattatagtgagttaccagctgggtatcaactgctttcccagaaaggccccattgaaattaatggactcagggctttgttgagtctggacactagagaattggacaaatgacactgtggtttattaaagaattatgactgcaaatacattatatgatgctttctccctctctctccatttaattatgaatctgcctctcaaaagccttgactctgtattttaaagttgacataaatggtaggacgaggttactttttccagtaatggagaaaggaggagaaaggttgctccgaattttgtgatcttgttcattttccgatgaagtttttttgctggtccaaatattaattaatcgattgattgaaaatgctacaaaagaggagccattcatcaaagaaccaaatccagtgattcgtgatctggggttttatcacttatatttctagagcatccttttgcttttacaacttaaatttaattgaaattttaatccctagcaggtttttaataatgggcagcttttgagacattaaaaaacattgctctcacttcccagataaggaggttgtccagatatccttatgctttagggagcatttactaagtgatggtacttcccagcgcacatttttggttttgttaaagtatcttaaaccgcccatgtgtagtcaacttccccttatggaatccattgataaatcatggcaaaaggaaaccactctatggaaataacgtctaaaggagaccctctttatcccggagaggaaaaccagagagcagtcacaatctggctaacataaaaagaaccactccttgatgcaaatcaaaagactagatgtagctaattagacatgggaaaagggtggttctcctgaaaatctggggcctcaggcattttctggaatgtgtacagtcagaacgtgcaagttagtcagcaaagagaaaacaagcagccacacctctcccaaataccgaatagtcatccttcttttgtggttcagaggtgtttgtttgtcttagaatgctgcaacttaaaaccaattgattttaaataaaaatggtaacattataaagtgtgaaagtgtggggttaggaatcatttcccaccctgtgaaaatggctctatggtcacccaggggtttgtgtgtgtgtgtgtgtgtgtgtgtgtgtgtgtgtgtgtttgtgtgtttaacctgtgagataagaatggtcaaccagttgactcctcaagaacagtctagattgctacaggcatgaagttgctttgagagcaggttgaatgcccacacatgtaggtttggtagaggtggtggtgaaagcggtgagcatggctgcagggtactcatgccactcactcctttttgttacctctcacaacctctctctgtctccatctgacatgcctccctagactgtctctaataccattagaaacttcagcgcaaattgtgcaacctctccgacactgaccacaaaccctttccagcctcagaaatgttcatagatagatgagggttatcagggttgctcagccagtgaactccgaccacgctgggtgaggctacatttgtaatctgttctggaaaacgggaaccatgctccattttcaacctgcactcacccactcctatttctttctagggtgtctctgtttttttgcttttaaccttgggtttgactttttccagtggacatttctaactaggaaacttgatggtttccacttagattcccttattctccaacttaataaacatcaatacatttagaatccttcgctttccaagactctaactgatttgtggccacagtgatctttaaaattcattagactttcgtcattccattttctttattaaggcatccatatgagctgccatgtgtttgctctctttcatatatctgaatttactgattgttgtctccaaaacatgttctatcttagacactatctcatcctcttctctgccagatattgattattcatacattctctgatcccaaccaccagctttactcattgttatgtctttgtagctttttcttcccttaaatacaaggacaacctattatttccacaattcagcactttttactgggtcttttacctctctaaacccaacaagagcatcaaagcatgatgttgggcttggtgcctctcttccaccattctttctctttttaactccacatgtgtgctggactcttgcttatgatcttccctgtgtagctaccaccacaaaaatgtgtccccggcctttacaaatgaagtgttcagatgcaagccattctcttatagacatggcagtaaagaccaattaaaaaagggggaaaattggtgctacaatgtcactttgcgggagaatgatgtctgtaaagtgggagcctatgtcttgcaatatgctgatgccctggttgaatagaccaaactattcattccttcctctatggcctggggagatctctctccatcacacctcagtgaagacagctttgatgcatttgactgtggtgccttgggcctcccagttttcaatttttatttgtttttttctggtggctgccttcttgactgctgatgtgtagcttatgaaggagtgaaggatgtgccatcccaaaatatggcagattggtatattgagtatttcaagttgaaaacattggagacagtgtagtttcagaaaaggaagtctgacctgtctcttcctgcatgtagcacaccataaagattcctctgggaggggtacccttgccttaccagggcgagaaaatagcccttaattaccagagacttggaactggaggctacactggacctgatatatacacttaacaaagtaacgcttatgtgcctgtggttttacacccccccaccccaaatatctcctagtgactcccctagaaaatgtactgccctggccagattttctttttgctgtcatttcttctcaaatgtattatcattcattgtctaaaaaatataaaagccccttcttcagacttcactgtcttgtgaagatcttcatgtacacgtgaaattaatcaaatgtgtatacttttctcttgttaatctgcctggtgtcgatttggtttctaggtcctgctgaggagcccactaagagctaaaaggaggattgggggtgatcactggctctcctacagttatgccctattgttttttttctttaaataccttttccaacaactcgaagctcagcagtatggtggacttcctcccttgtgcatagatattgttgcatcatttctgtcttccagagaactacacttgctaagttcagaatactttatcagcttactttgtgtccttgttcccatggtggtgacaccgatcttgaagcttaaaaaatcccccaaattccgcctcccacctctgtgacactcttttgcaaaaatatgcaatttttctacacacatttctgacaaaaaggaaaaaaatgttaagtccaccctagttctgtccagacaagcacagagagaggcgtgttagatttccagacaaatattttcgcctagattttgctcaatgaacttgattcactgcagggctttttttcccacaagcgcgtggcagaggtgggctgccacaggagtggccagtgcccgctctctgcagggcactgctatgaatcaccattttcatgaatggaaagaataggaggaggggaaaaaggacaagcagcttgttgctaatgccctcaaacaaggcaaacattttgtgaataatttttagataatatatgacggtttggatctttggttttgttgttttgaatggaatgcatagaaaaaagaacttgtttcaacaaaagtttgatctgatatcctattcatgggctgattctttctcaaatatttggcagctcatccagggcacagaaaaggcacagtgttgaatcatgttgctttcaagctctgtatcagtggaaggcactggaagggattatcgatcccacaaaatacacaaggaaagtatgtgcccacttcatttctgaggaaatttagggttcagatggaccttgccatagactcagtgtctttagtagaggccaaataaataaataagccaacatagatgccaggcaacttaccatacagcatgctgaatttcttccctcatgtctggtgactggttttatagaacccattcagtgagaatgcaggagaagtctaagaattagaaggaacaaagaaaagagaatgagcacgggaataaaagtaaataataatcatgtctattcttgattctggggactggctaacttctgtcactttaaaccacttcacctcatttgaaagtccaggcttctcagcttgatgtccaaggttctccatgacacatatcttcttgagcacttcacttcatgccccgaccaagcttggacttcttccccctcacatgcttgctgtttcatgtttcatgttttagctcatgctgttccctctacctggaacatcttggttcactcaactaattctacccatcagaatttagcacaggtgtcctcctctcttcatggtcttcctaaatacctcttgggttcattattcctcttccatgttcatagatcaccctgggtattactctgtgctagcactttccttctttctgctatgtagtaccagtcaggcactcaggggaaacgactatgccattcactcattcagtcattcattcattcattcaacaaagacgtattggattactattatgttccaggcactgttttagggactgaagataaggtggtgaacaagacagataagattcctgttgtacaggagtatgcattctggcagggggatagattaaaagggaaatcaataagctaacacgttaagtgctaccgataagatgaaaatatgtcaatgggaagaagagtgcctgctgatttagactgggtggtcaggcaaagctttgccaaagagatggctgaagctgagagttcaaatgcaagaaggagtctatgaggatctgggcacggagtgtctgagttggaggaaatgcaagcacaaggccctagaggaagaatgagaactgtgagctcaaaaacctagaataagccatgtgactagtgaacagcatgtcccagcaaaagtcacacttagaaaatatagggcctgagggtcacaggaaaagttgtttattctttacctgatgggaaaccttgggacaattctaagcagggagttggaagacgtgatttatattttgcagaaatcaccaaggctctgcatgctgaatagattttttctttgcatccccagaacctagcacaatgcctgcctctgtttcagtagggcccagagccgtgctgcttttccacacaggaaaattgccttttccaaggtgcatggctgcccagtagagaggaaagctcaaagtcatatcaattcaacacgcagtactaagtctctcctcttgctccattttctactggcctgtgaccaactacttcctaaagttgaaattgcttccgatttcttttttctctatttcatggataatccatgcagtgtttgctcaacctgtttacactgagatgtgttgaggaactgtcccacggcaagaccacaaggtggggcagtaatgagtaattggaagaaaactgcggtaccttctaaagctcaaatgtggctttctagaacacgatgaagtggagccctacattcattatttgaccttgtttgtttttttttttttttttttttttgagacagaggagtctcactgtctcccagactggagtgcaatggcatgatctcggctcactgcatcctccgcctcctgggctcaagcgattctccagcctcagcctcctgagtagctgggactacaggcgcaagccaccatgcccagctaattttttttttttttttttttttttagtagagacgggatttcactatgttggccaggatggtctgaaactccggacctcaagtgctccacctgcctcggcctcccaaagtgctgggattacaggcatgagccaccatgcctagccctgtgactttttctcaagggcttcaaacagtccctctgcaagttaacctaggcatactcacagagcaagaaggcattcatgataccacaagggaggtgaggtttgtgccatttgctccatgtcactgaggcaggacagccctgtgtggctccattcccacgagagaccgtcttgctccgttaggactgcctcccacctgctaagggtgcttttcttccatggtacagtgatctttaatcatttgtttcaaaaatgtaccaacctcccgggaatgaaactaaccaaacttccctccctccctctctccttcccttccttccttccttccttccttccatccttcctgtttgccttccttccttccttttggattatgttgtttcattaaaatatatttagctgggcatagtggctcacacctgtaatcccagcactctgggaggcagaggtgggcagttcacttaaggtcaggagtttaagaccagcctggccaccatggtgaaaccctgtctctactaaaaatacaaaattagccgcgtgtggtggtggacgcctgtaatcccagctactcgggaggctgaggcaggagaattgcttgaacccaaaaaaagcagaggtttcagtgagctgagatcgtaccactgcactccagcctgggcaacagagtgagattccgtcatatatatattcacatgatttaggaaattctgtatttcagcatcacagtataaagacttaagttctaagagttgatattgctgtagatgttgggaatggaatcttaggagtaacctttaccggaggcaacttctactgcccttgctacctttggtgtgacctgaaaccccctttcttcattagtaccaagtgacttgtttgccactactcagctgtcccagaatagcttgactccacacatccatgcatttctaggaagaaattaggtgcattataaataacgagtcctctgaaaatgccgaagtgtcttaatcttttgaaaaaaattatctcaaatttacattcacaaggagccatgtcttttgccactaactgaaactcagtaacaacactgaagtatgagcttgggccttgtctgacaataaaaaggaaatgctaggtcccagggaccacttcaagatgtgcttgttcctttaaagcagggagttgtcacatccaatttttaacacatatgtatattttaacacatatgcatattttaacacacatatatatttctgattatactgtaaaactggtaaattatttttaaaacatcataaggcccccaaatcccagagaaagttgtttctattacaattttagtctatttgtctcttttaagtttctcttccctctgagcatatgtatctctaatgcatgtctgcttatgtaggcatatttatacatacaccctttcttttacaaaactgatatcaatttttgtattttaaataaaatacaaatgttttacattctttctaaacaagcagacactacttttggcacctcccaatgctggccaggtcatgttaactacccttaatcagctttttttcttgcaatatttgtaatatgcatcatctcagggcaagagacaaattagatcatttgaagattaataaatccttacctctgtttggttgcacttagccagcaaattcatcacatgcttagtctttgctttattctgggccatgtagactagctgttaagtggaaaaaaaaaaaattcttcttcggggcagagtggcaggatggctctttggaaagagtcttggagcaggagtcaaatggtctggctttacaccccagctatgcttacaaaagctgggtaacttgcagttcccttaccactaaagtggaaacatggatgtctaaagcttttttacagctagaaaagtctatgcttggttagcattgtgctgatgcaattctgttccagataaccgagggagggaatggcggtcctcgcgtgaagactaagtagacgtgctattaccctcctcggttggctccagcaataagcctaatgacctctacaaagctgttctgtaatacagaagtaaacacttactctgcacaatttctccttgcatgtgcttcccactggtagaacattattcatcttgttggtctttccaaagagattcattacttccttgctccttcttattcatccttcataatagaaatgctaaaagtctgaaagacgaggaagggagcacatttcctccctgcagtctgaggaatggctgtatctcttcatgagcaccaagaggaagcccccagatgggtccctgtccttacagccttgtttccatgtgcatttccaccccagcctcttccataatcgctccccatctctatgccccagcgatgccagttgttccatcaaacactgtcctctctgttctcagcctcggagcttctgctccctctgttaggggtgactgattctcaccaccaccaggctaattctgactgttctggtttcaccgcggatgtcacctcctccaagaagctcttctcgactttctgcctgcagaccctcatctaagctttcacaacaccctgtgttctgtgtttacacccacccaactttttcttttttaaattttattttaagttctgggatacatgtgcaggacgtgcaggtttgttacataggtaaacgtgtgccatggtgttttgctgcccctatcaacccttcacctagatattaagccccacacgcattagctgtttgtcatagtgctctccctctgcccacccccctgacaggtcctggtgtgtgttgttcccctccctgtgtccatgtgttctcattgttcagctcccacttatgagtgagaacatgctgagtttggttttctgttccttatgttagtttgctgaggatggtggcttccagcttcatccatgcaaagcactggatatcattcctttttatggctacatagtattctatggtatatatgtaccacattgtctatccagtctatcattaatgggcatttgggttggttccatgtctttgctattgtgaatagtgctgcaataaacatatgcacactcaccgaactttgcttcactgtctatcagaaaactgccagtttttcagttgcatttatctcctagaatataaaggctttgaatagatccaatggtcttgtttaccattgaatctgatacctaacatggaatctgacacctgctagacaccctcagaatgtctgtgaaatgatgtaactctacgtgatgtgtgtctactcatagctgtaaaatgagtgagccctcctgtaggtcacagtgtccagcagactggcagggacctgatatgaacatcacagaggaaaaaaacacatacgaaacaattaatgcttgccattgggccaaatgctttgtatgtgttatttcatttatatttttatttaatactaagcagacttcatgtaccctgtattttgctaggcagtggagtacatagaaaggaacagaaactgcgtatcttgtcttcccaactgaaaggagacgattaacctacttgaagatgttagaatacaaatacatgatatctgaggacagggtgaagaaaaacaaacaaataagaacatgaaaaactgtgtttgtcttgactattcaggatatgaaagtgccgcaacattcatgtatctagaaactccatgaaggaatctacacttagggcttaaagaatcctaagggaccgggcgcggtggctcacgcctgtaatcccaacacattgggaggccgaggtgggcagatcaggaagtccagagatcaagaccattctggccaacatggtgaaaccccatctctactaaaaatacaaaaattagctgggcttggtggcgcatgcctgtagtcccagctactcgggaggctgaggcaggagaatcgcttgaacctgggaggcggagggtgcagtgagccaagatcgtgccactgcactccagactggtgacagagggagactccatcaaaaaaaaaaaaaaaaaaagaatcctaaggattcctggttcctgacaggtgcttgttccttgaagtatacttgtgccgggaagcaaatcttctctctctcgttttgaacttggaggagacagcagctcccttctccttttcatacaggttattgtttataagagcaatgtgatgaaagcttcctctgctaagactgcaactccagcgttaccttttctttacctcaccttgatcctcggtgtgaaacttcactcattactgatgcattgcaattaacagatctcctctttcaagacacattagggtatgttctgactatcagctccaaaaaaataaaataaaataaaataaaataaaacacattaggaaatttaaatgaattagtgtaatcagctgagatagtacttgaaagggaccgtgtaggcttgtggtggaataggtactttcagacagaagtctctagaatattcctgaggaagtattttctcctgcccttcaatgaatagagtggtaaggtttgtgaaaagcaggcctctggcctgagttagggaaattatatattgtttgtccaaagtagtaaactctgtctaaaatgaaactctagactagatattattttttgatgttagatgtatacgttctctccatgatttagcagactttccagggaatgatgagtctcccctctactgaatactataaacatgttatctcagtgggaaaaatagaaagagatccagagaagaagagggaacatcttgcttttgaagcatctctgcttacgagtccataggaaataaattacatttcccagggttctgatttggtttttaataacttactggccctgctaaacaagacactcaggagaaagtgcatgtgaatagatggagatctacatttttagaaaatatgtttctttcttttgggatcacaatcagaacataggcatcattgaaacaaagccgaggaagaagaattttctcatgctatgcagaagttttctgttaaagatatcagaggctttgcaccctgagagctgtaatcttctctccttgagttcttcattgagatttactgcagaggcctcagatgtgtttatttctattatccagttgctcctaatattacttgcaattgttttggcatgagggttagaaattgcaagaactcctagctcgaaatcacagaacgtacacaaagacaaaacagaaataaagcagaacaaatgcaaggataaaatagataaaaatatctccccaccctaattgtgctcttttaaaggaatgctattgaaatgacaaatgaaggagatttctacctgttgttatatagctgggcagagtgacatttttggctgtattctagtgttgagcagttgcaaagctttctttccccctgaagcagtagagggtgctatgtggatataattgaagagatgctaagtttctatatgacgccagggcttagggactgccctctcttttcaagccacttgcttttcccaaaataactaagaaaagggagaaaaaaaatgagtacagaggccatgctagaagacatagataaaatattaagtcttaagaaaggtaggaaataatcagattctaaagttctcacaaggtttggtattttgaagtatttggcagaaggcaagggtatggaaaactttaagaaattgtaagcttaggactttatcgtaagcttaagacagagatgttatctgtctgaaaacagagggaaaattttgaacagagtgattcttgtaataagagaagacttttgacaagttatgaattccttgaatttcattattttttcttgctgtttaagtagtatatattgtatatttgatgacagtcagattttactgatagagatttgaaatatattttgatagggctacctcatgctttttgtagaatcaaacattttagagctgttcagccccttggagccattaagtacaatcttaatgtttttgcataaggagacattggcaccaagaagttaagtgacttaacctgtaacaggctggtccaaacatccgagcctcaactagaaccagtgtccttacccctggtccaaagctctctgtcttttgctaccctgctttgagttacagcattttatatgctgacaatacataatcctaatacatttatatattgttttcacttacaaagcagtttatgtacatttttccacacttatgtaccaaaacgtcctttgaaaatatgttatttgttgatttactcaaagaagacttgcccagttttatgacaggctgagaagttaagtctcctgttgcaattccgtttgcaattcagtatccattacacctggtcaatcaagtttcttattaatcccacgttttccctgcctgtaaactcccttcttagtgaccgattttgctattttgtgtgagcacttgagtaaaattcaactgactcagagtagggaatcctggctggattaatgggattgtgtaacaccttcatcacttgaggcccagataggagtgactgtgcgatgtaaaaaaggcttgccaacaccactgatgtttgacgtgaaggtgaaaagttcagtggcccagagaagtgctttaagggttcttcttaaatctaacacctgaggaacaccttcagattatccagcagttgtgatcccctatgcagtgtctatttgtctagacttcttccccaacacacattccctagtacatttaaatggaaagaaaggtctgggaggttatttgcaggggtgttgatggaaacaggacccatcacagctagggtcatgttatcagagtgcagattttgaattcctttctgcctttcctgcatgactttaagtaagaaaatggtcaccttaaatttgcccaataagactcagcttggaaatcattcttgggatgcagaaggatctggtccagaaagcttcagagaagccttgagaactgcctattcaagaggagaagaaggctgagagagggaacctgcaaagatctagcaggaaaagagtcttctatgtgcaaacaacactagaccctttcccagaattggggcactaacaaaagataatgcctctgaaatattgggaaaattgttggagaatatgatctcgttccctatgctgtcactccaggtaacacccatgatgctcaaaggatttttttaaattaaaaggagtaccactttatttaacaggtagaaaattatggaaattattataccaagaaaggacataggctaataacataaattaggcttaaggagagtttcataaattatgtatctccaatggattaatgaaggaaattaggaataatttttatattatctctacttttttacttatatatttggacttgaggttttctgcatataatatgcacactaatataaatattaatataatgctaatacaaaggaatactctctcagagattgtgcattaatgtatgtttcagtgacaaaatatagtgcgtgaccttagccccaggaggaagaataggatatgtgaaagaacctaagattttgaacccaggataacctggttttaagcccaggtctgctacttaagagctgtacgactgtgagcaagttattttaaattgctggatcttgttttcctcatttacaaaatagaaacactgatatctgcatcatacatcatactattgttatgatttttaaattaaaaatatatgccaatgaacctagcaattggtgaccatattgtaggtacttcatggatatctgcctcttccttccatgtgcaaaaggaattctggcatcatcttttataattactaggaattttttactgccttcagaaaatatttctagacttatcctgctaatttttgtttagaagttagcctctgtttcagtccattctctcattgctataaagaactacctgagactgggtaatttatagagaaaagaggtttaattggctcgtggttctacaagttgtactagaagcatggctggaaaggcctcaggaagcttacaatcatggcagaaggtgaagaggaagaagagaagtctcaaatgactgaagcaagaggaagagagcaataggggaggtgctacacacttttaaacaaccagatctcaggagaactcactcactatcacaagaaaagcaaggggaaatctgcccccatggttcaatcacctcccacagggcccctcctccaacactggggattacaattcgacctgagatttgggtggggacacaaatccaaaccatacagtccctgaatatatatgtgcagaaatagactgctcacctagacttcaaaagacatgtcatcattacgcacctctgagacattgtatggtcttggttttaaatttcttgagtaatctggttaattctgatactagcgatcaacagctttggtgtaaaggtaggtcagattggtgatatattgctacagcaatttgaggaaatcaatttcctccctaaaagttttgacaatcttgtttatttatatattttatggtggtgaggggagaaattattcttgagatcttgcttctttgaaatatggttcttctcaggaatatcctatgttattagatgatctaaaacactgtggcacttcttaaataaccaatacttaagataccatgaaaattacaacccccgtgagatatagtatcaattaaactatgccatatacctcgattggttgagttccatccactagtcaatttcaaaattacctcgtaaatcactaagacaataggaaagaaagccttactataacttgccttactataacttgtcttactcccaaatttagcaatatctttttagcttattgatggtatttcaggaaaatcaaatgtagttccacattataaggatggagacatgtgttacctctttatgttcctgtatggcaaattagttgatactctttggtcttgtcgacatctctttaaccttgtaagattataaaggttagaatcatgtttaccacctgtaaaaaaaaaaaaaatctgacagcagtgggttttttttttttcttcttcttctttttctccaccacatcccctgataatgatttccatgggctggaaatactgggaggagagaaatatttagttgaattcattttaaatgaaaccaatagcttcactagtgatctcataacctcaaagcactttacaaactgagtaatcattgaagatgctaaatatagtaaatacaatgtttaaaaccttcacaaataaatccatattaaagtcttattctaccacaaagtagctttgcttttgatataccttttaaagtcatggatttcttgatggagatattgagttgggttgttcctgttgctttttgtttctttgatttttttttttctattatataagctagacctcactctcttagtcatttcattatatgtagagacaagatgctgccttaactagagctttattccaggtgcccaaaggtcttcatttagttcctagctcaattcgtgagtaaatatttcttttccagctttaaaattttttaaatgacattgtcaggcacggtggtgcatacctgtatccccagctacttgggaacctgagatgggaagatcacttgagcctggcggttccagtctgtagtgcacagtgatcatgcctgtgaatggccactgtactccagcctggacaacatagcaagaccccatctctaaaaaaaaagaaaaaaaaagaatgatagcatttcctttacttgtggagattttctgactataacatgcacactattattataaaataatagactttacaaaatataatggttgtagtttcatttgcactaaataacgataaaccttatttaagtgcaaccttattttatatatatatatatatatatacccattaatttgattgtttttaatgtagccatggacatggagagttcacaaattataatttataaatgtattaagatagaataattgcagaatagaaggatttttaaacaatttaaatagtcaccatttctgccacccattaatcctatatattggttctaggacttattcctggagttatatcctgcacattggcttcaggcatgaaggacttgatcccacatcttctccagtgggattgtggagatcgtgtcactgctggcctgtcctgcaggctcttgtggtgatcattataaaagccagccctggggtagctcaggacaggaaaggaaggatattctgaaatgattttctccttttagttaacacattttggttccagaacactgagcaaatcatcaactgaagccccatgatatattttcaaagagtgaatttctcttacctgactgaggcattttattctataatagcaattctctgggttttttttttttcatacttataacaaagcggattaatatatactcacctaagacaccaaagatactgatggctttcaccactctatctaagcaggagtaaacacctgggaactagaaatctgagaaagaggacaacacccaacaccacctaactatggccctcgatacagtcatttaacttaataaccttccgtgagagtaaggtcattatgaaatatgctcggttttacacaaagctttaaaaaaagccacataaaatagtatatgaggtcacctctgattcctatgtaaagaagattcctcctcccttccctcattcattgttctccacactctactccacacctcccctcaccctgcaatccaacttatcaaaagtttaattttccctttccaaaagcaatgtacttgaaattcctattcttagttatgtgcattttggtttcctctttgattttcctttttttccaggtttcctgttgataccaacatgaatctcaagggcttccctttgcttcttttggaaaaaaataaagaaaagagactgatttagagcctatagggtggaaaatcacagccaggaaaaggcaggcatagcatgcagcagttcagagacagggctcacccgcccatctcttccatcagccacctccctggtagggcatcccttggaacagaagccagcaatggtcctgcagggattggagaattgtgagctctaaatgataaaacgttgagtcataggttatcactgtacagagtgatcctttggcctctgccttgagggcacgtaagccattttttccttacttgttggaatttgattcatttcctctttttctcctttagctctctaatctagaattctcagtttatctataaaaggattcaatatctgggttgatcctgaggagtcaaagggttggttttgtgagcagatgggtggcagacaatagcttttgtagagatgcctctgaatgagcccacatggtggggctttgagaagcctagtgtggaatcagtaacaaagtccaccttggaataatagtaccatagtttcagtaactgctgattccaaaaatgtttcctatcacacatcttcctcatctgcctctcacaacaatcgtgtcaggagaaagctaatccaactataaagtggctacgtgatcagaaatgacaggatgggttcattgcaatgtcaagcctcagtagtttttcatcaaagccctcaaaaaaaaaaaaattccaccccaaactgattgtgtattattcaaccagacttctggtatcttcaggcacactgtttgcaaaggccaggcatctcttatgtcctgctgtctgtagacctctgtggtttatggatgggaaaactcaaacagtctgctcttagatggtccttattgcagaaagcaggcttatgccctgtaagccgggggtatctccaaatcgtgcaggaggagaggtactgattgctcatttgcttcttctgtgccttaaaatcaccatccttgttaaagaaatgcaagcattgagtagagaagtgtcttgcttgggcttgcttttgagtaccgggaattcagctttcctgctttggaaacctgagttgggatgtaggtgtgtagcaaaaggaatgggtggaggcttctaactaatggggaaggcatctctgaaacaagctgagatgtggatctgggattctgggaatcaaataattcttcccagcaccaaactttgatgagagaatactttaatgtctgtggttgcagaataaatatgattcactctgaggattctgcactgcaattgaatatgtcagaaaaggcaaataaaaaattggaaaatttatctgtaaatagttctcaatagttttagaagagcttccaaggacattaatttcttcctagccattatttattaaaaccttcaggatagcatctcattttttggccacactaatgtagcaactaagtgtgcaggccctggattcagagctaaatctgactctttcaagctgtaagcccttgagaaatctacataaatctctctgtgcctcattaatgtcaactgtaaagtgaggaataatgatattatgtattttgtaaggttgtccgaatgtttaaattagattataatacttaatattaattgaccactttggaagtgagcattgttctaaatgctttaagtatgaattttattgtcatcgccatccatatcaattatccttatttattatgctgttataagaagctttgatttcacaaagaaagaaattcaacacttaaggaggaggcatgagaaaacatcttattgaggtttttaatcatcttctagtgaaccaagcaagactgaacctttattgcaatgttttactaggctttatagcacttttaaagggtcaggtaaataaagtcataattcaaaacagctgttacggggtggggcacaatggcattgatatcaagagactctagtactgaatcagttacttcctatttatataattaaaaaatttttttgttgttgtttgtttgttttgagacagagacagctctgtcccccaggctgaagtgcagtggcacaaacgtggctcactgcagcctcaaactctcaggctcaggcctttcccacctcagccttctgagcagctgggactataggcatgtgctgctatgcctggttaattttttatattttgtagagatagggtttcaccatgttgaccaggctggtctgaaactcctgggcataagtgattctcctgcctcggcttcccaaagtgctgggaatataggcatgtgcccacacctggcctatttgtataattttgaataaatcatttaatcttgctgagcctcaaaaagcaagctttaaataaagaataaattaaaaattaaaaggttgaattaggtgatatcaaaggttcctttcacatctatgattctaaatattactcagtatttactctgtgcagaatgtctatttccacaggctattgcttacagcacaacacagtgatcatattcctctttcgtaactagggagctgagcaccacgatgctggctactggcagagtttatccctcagcccatattaagtctagaaatgattttgtccaactgatgttttctcttcacatcagatgtcacttttttttttttttttgatatggagtctctgtctgtcacctaggctgggtgcaatggcgtgatctaggctcactgcaacctccacctcctgggttcaagcgattctcctgcctcagcctcctgagtagctgcgattacaggcgcacgccaccatgcccagctaatttttgtatttttagtagagacagggtttcaccatgttggtcaggctggtcttgaactcctggccttgtgatctgccgaccttggtctcccaaagtgctgagattacaggtgtgagccactgtgcccaggcttttttttttttttttttttttgagacaaggtctcactctgtcacccaggctggagtgtagtggtgcaatcaaagctcactgcatcttcaacttcctgggctcaagccattctcccatctcagtctcccaagtatctgggactatatccagttatttaattttaaattcaccacactcagctaatttttgtattttttgtagagacatggtctcactatgttgcccaggctggtcttgaacttctagcctcaagcaatcaatctatctgccttggcctcccaaagttctgggactacaggcatgagccaccacgcgcagccagccatcacatttttagataaaacatcgaggaagtacttatactgatatatacattttactatagcaactatagtaaagagaaaccagtgagtcctaaaactgaatttttaaaaaaattagaaacatagagttaaaattaagattatactcaaagttcttcagagataagtattaaagtcatatttccaaacctttaggcactataaagaattccataaataagaggttatttaaaattaaaaaaacctatgctcaagcaatatctttgatcataagacaattctggcaatgagacaaattcttgaaatctcaacaacactaacatgggctcagatttttgctttcaataaatagaacctcatcaaagaggtcttggaaattctgctagtcaatggaataaaataatgaatcggatagaagtcctccagccctgtgctggaccgaaatgtctctgactgcctgtcatatttcagaggatcgtgctcctcagagcagtgtggggctggcacagagatgaaagaaagaagaggttcctccctggtttctgtttatttgaacctgaatcagaatagagaggaagcaaaggagaatgaatggtgtgatccaacttttcttccatatgtgaacaatattgacttatatggcataattatgcccagatgctgtcgtgacagggtgtagagatttctgacttgcataactgaatatattttttaaagacaacaaagaaaaagaaatcagtcacaacattgctttagcatcttgagtcttggagtgcttctgccatggaaagttatagtctctgctcttttctgcttagactgtatcttaaaactagcttcaatattggatggcctattttaagggagatcctgacacttagtatccaaattacaaaagatgactaggttactgaggatctgaagattgtcccatataagttatagttgaatcttctgtggaagtttaacttggataaaataagcagagaaatgacaaatgtgttcacatatgtgaagatcatccttgtttttcttgttttgttttgttgttttatattctaggaagcacagtggaatttgaaagacagactttagatcaccatattggagacctttataacaattaaaacataggaatggggcaggaagccttattaggtggtgagattgtgagattcctctgctgttgatggagactagacagaggccagatgaatgtgtcaataatgttgcaagcactgcttccatattggctagaaatttggaaggttagaaaaagtcaccaactctatcatcataagaaaactgagttgagggcagaaagtaatatgatatctgggttttggggaaaccagttacctctcttcaaatctttaatgtggaaagaatgaaaccatcttagacctttttgagtacagaatgacttgaagtcagaggaaggagcatggcagacacagaatgtcccaaattgagacagcatcttttaagcaaattgttgtccctttgggtagagtgggaataataatatcgcactcacatttatctcacagatgctgtgagggtgtgtgactcagtgtttttaaagagctttggatacctgctgtggttaatgtgtcactcactgcgaagctttccaaggcaattattttgatcagaatgtcactcagagttagtaggctggcttcatgaatcatttggggagggtagtataattcaaatttgttatgtattgtcaaacatttaaaaagaataatagtataaaacaaaatacttgcttttacactaaaatttaacatcttttttttttttttctgggaaaatagaatgttgcctaaactgaagtccaaacaactttactttttaccttttcaaatatccatgtggcatcaagccaggccatttaaaatgacatccagttatttaattttaaattcattttgtagaaatcccacctctctggggagtatgtacagcaaaagtaaggccatcacaaaagctgaatgtcccaaagtggtgctttttagcagaaaatgtaatttttttaagatgaaacttgccttcagtgttcttagagagtgggttccatattggtttctgaaggagagtcaagcctggtctccacagtgcactaaatgcagtagggggtcaagcaaatgatgggaaaagcataaatcatcttggaattatagattcctctttgctgtttgactttaaattcaccatctgctggctgaatcttgatgggagttgaacataaacataaggccagtgcatgactgtgacgtggaaggtggaagaaagttccttctgacttgttaaaacccttaaaatctacacattattattattataatttagacaatgtctcactctgtcacccagactggagtgcaggggcacgacctcagatcactgcagcctcaacctctccagctcaagcgatcctcccacctcagtttcaagtagctggcactatgggcatgcatcaccatgcctggctaattgtttctatttttttgtagaggtgggttttccctatgttgcccaggctggtcttgacttcgtgggctcaagagatcctcccacttcagcctcccaaagtgctgggattacaggtgtgagccactgcgcccagctgacatctacagattatcatctattattcttgtatttgttaaccatgatctcaaaatgatttaattataaaactcaaaccttaaaggacaattggattccaaaatgtagattatatgtagataatatttctgttcacaagtctaggtgtacattagtatccattcagaaaagtgaaaaaaagtttaaaagcatttttaaaaacatgatgaaactataacactcaaaataatgtgatgggggataaaaggcagttgattgataaatgagtcattgacaggtcaatgctgtaaaaggccgagtctaagttgatggctctcagtcctggttcgtcactgctgttgtggaacttggcaacgagtccctcttgggaattataggcttagcatcatgctcttgctcgtattagctgcttcttctatcactctttcaacagtaacatattaaaaacaaaaacaggaaaaaaaaccctcaaaacttctcaggtaagtagtattaaggacacaaaaatatttcaggcttgatttagaactacatttatgaaagtaaactacgtgatatagagcaaaaccacaacctttaggttttggggggttttggtcttatttctctttttaaaaataagagatagggggtctcattctgtcatccaggttggaatgcaatagcttgatcacagctcattgcagcctggaacccctgaccacaaagggatcctcccacctcagtctcctgaagctagaactacaggcatgtgcctccacacctagctaattaaaaaaaaaaaaaaaaaaaaaaaaaaaaaaaaaaaaaaaagtgtgtagggaaggggtcttgctgtgttgctaatgttgaactcctggccctaagtgatcctcctgccttacctgggattacaggcatgcaccttgtgtctcactaatagatttgctttctaggtctttcctgtcaggtccaccaatattttagatggatggagcacttgattagatcaggagtcaaaattctattcctgaatctattacttaccagttgtactactttgaatgaatggcttaattttttagtgactttgaattgttccagatataaaatgacaggataggtctagagagttgccttagatgaattaggaaacagtttctgagatagagatgttagtgcagtaggtttattggggagtgttctcaggaatgcctgtggggaagtgaaggatgtggaggaggaagatggactggaattcatttgccagagtcctcagcagatcctaccagctctagagctgggatggcccttcagagttatcctgatccacaaggggtcagcccctaggcattcataagtcactttgtccagtcattggggttgaccccaggaaaaggtatggtttggggtaagaggactcttcagttgagggtagttcctaggaagctagtgagctatgagttggcatcaggcaacatttccagcaatttggtcaatgagttccccttaaggctggatctgggccacggaccatggcactcactgccatattcacagcgtcgttttcagtgtgaaattctactgtgttaaagtattgtacagtcactgaaatgagagtatttttatatttggctacccatgacatttattctcttctgattatattgtttctctcctgatctagagttttagattgttttgtttgttttgttttgttttcctgtacttttctgtctgttgaggaaaaagagttttattcttctagtatgagagtttctattagtcctcctttttagacagatgaacaccctgtgacaattccttttgcctttttgtggcgtgtaaaaaaaaagaaatccataaatagagtcgttacgcaagtcttcatgagttaatttctctctccagttttcttactactttttccagttttcattttcttcaacagaaagcttcttcttctggctggacacagcggctcacgcctgtaatcccagcactttggaaggctgagggggatgtaatcccagcactttggaaggctgaactcctgagttcaggagttccagaccagcctgggcaacatggcgaaactcccaactctacaaaaaatacaaaaaaaaaaaaaaaaatagctgggtgtggtgatatgcccctgttgtcctagctaaaggggaggctaagctgggaggattgctagaggctgggatgttgaggctgcagtgagttgtgatcataccactgcactccagcctgggtgacagagggagatcttgtctcttaaaaaaacaaaagtttcttcaaattgcccctttacaatttaatatgcatgaacacatttctttacaaagagaaggttatcttttatctatattcaaaatcatatgccctggggatctttacatcacaatgcaaataaatgttgagttaaccaaaggaagtgtgagtaacaagttagtgactgggttagggggtggttaggacagtggcgtgtgattaagagatgaacatctcagaccgatgcttagtaaaacctacagggggaagcatgatgacctagccttgaatatctcatttaggaagttacacacgtgtctgggcttttcaaaatgtttgcatgccattaatcagcatcttacatcagcttgctcaatgaatgatgactatgtcaaatggaagtaaaacatataaggccagagaaggatgaagggaagttttttttaatgcagtaaaggataaagaaggatggaagtggccaggagtggtggctcatacatgtaaccccaacactttgggaggctgaagtgggaagatcacttgaacccaggagtttgagaccagcctgggcagcatagcaagaccccatctctgttttttaaaaataaaaaaatataaaaaaaagaaggttgtaagttattcaaacccataaggagttcagccaatgtattgaggtttcacactttagatatgatcaatttgctgtctttggccttaaaggaaaaacacaaacacagcagcctcgtgttcttctcagacattggtttctcctcctttcttcctaagacagctcttttcccactttctctctggccaagtccatgctcagcattgcgtgacttcactgttagtctaggtttattctgctctgggaagtttccctgacccccttcttgacagctgcagatcctgtcagtcacttctctgtgtgcttcccttgccttccttgtagatttttattacatcaattaggatacaccattacaatgcattattttgtataataaacacctgtatagtttctaccatatgccgggcactaatctaagtgatttacaaatgattattcttctgaccctcatcacaattctatgagagcagtctattattttcaccaatttatagaaaaggaaactgaagcatagagaattgaatacattttctttgatgtcatagcaagtaagaaaaaaggctaggattctaatccagggagtctggctccacaacaggtgcaattaaccaccagaccgtgaggcctctctgtcatatgcaagctcgtctgttttgctcagaagactgtgttttactcactcactcccaacttcttatggtaaaaattgctttttaatgatttaaataatacatgcccatgtaaaagttaaatcaatgactaaagcattctgaagaaaggaaaggttacctggaatcccatgaccctgaaataaccatcattaaaattttgttctttatccttccatgcattgtttaatgtaccacctacccacacccatacacagtaattaaatgggacaatataaccatttttttaaagaaggatggacatcatctgctctcatcctaccagagttgtctatcccaaaaagacaggttaaaaatctatgtgttttttctataccttttattctctcataggcttgtatctctcatttacgttaatggaactcattggtgtttcaaaaacatgatcatcttaaatgtactcttttagatgttgctttgctcactcagcagtcaccccatgtcacctggcaaagccctaatttatttttttcactggccacgtgacattcattccacagtgtagatgtatcacaatgcattcaggtattctcctatggtattaacttggcttctagaatgcaggggctgtctttaaccctggtgtttgtgacattgtgatgggcataatgggatcccttgaataaatatttgtaaaacatggatggaagtcagattttagaaagaataaattagttttttcttaattatgcatggatatggtcttgaatcggttctcaataaatcaaatttcagtaagggactcacttaaatgtatgagaagagacccctgtaatcaatgtttttaaagttaaatgattgtcttttacattttaactggtgtaaaataactaattattgttccaaatagaatttttgcttaaagatacgtacaatggaacgttataaaaccacctatatttacagataccttgtgctttgtgatctggcttgtatttttcctgttcctttcctgttaccctgtgtacgaaatgtatgttcttcccataaaaaaactaaactacttccagttgtgtaaacacaacagattctttcagaccactatgccttggtgtatgtcaaccctcagctaggaataacatttccatctctgtgattccattggcaatttctgctcaccttttcctaggttgaagtgccacttcttctgcaaaacttttcttgaatctcctttcctgttaccctcctgcacaattaaaaacttgcatccatttgatcccatagaatttatgctgtacttacatgacaggtacttacatcttttattttaactcatttatatcacttacaagactgtttttttctttaggacttggaatatgaccttttcatctttttcactgcagtctttttagtgtccagcatggagaaagtgctcaaaaatatttgttgagtgaatgacagtagagaaaataaaaatgtcctggattggaatcatgaaaactgtctacttatctctaatattaaaaagctcagtgtaatcttagaaaaaataatctgagagctctgacactttccagaggccacttccacgggaaaggaggagcaaagtctctgatcagaagttgagtaaatatcctctgaggtccctgattatccagacattgacaaaagaaaggctctccaaggtttgccattattactataaggaagtcccagctcagatgattcatagttaaatatttgcatctcctctggctaagaaaaataaaagccacgacattccagagcctttaggcatgtaagatcttggtactttcccagttattgctccttagaaaccggtaactgaaaaggccctgtttcagaaaagcaagatatgtcaaatgggaaggaagtagaatagctatctggttggaattcagaaagtatatcaaggccaacaatataattgttgaaattggttattaatgttttgatactgtgacatatctgttttctgttctctaccacaaacaagaaagatgttgaaatatggcaaatgttatgaataacaaagaggaaaatacaaataagttcttttggcaaatctccgtagcaggttgaactcagactcctttaatgtcaataaacaaggctcagagtcaatgccactttctttggtggtcactttaagtgtatttctcttacaacagccctgcacgtccagtgttattattactgcttcacagataagaaagtggaggctcagaaaaataatgatccataattgatatagtggtatatatataatttatatattataccataggatttaaactgaagtggtaaagcaggtggtaatttgcagagaatgattttggaaatgctccgtagatacctctggctctaggcatataaaactattttcttattaactgaaaatttacaattacaacttgattcttgtggtttaagacaatggaggctttctacatggtgcatgcgaattttcccaaaatctttcccaaattcatttataattcagtgtgggtgagcttaccagttcctttccagaaaacaattgtgattaaggagttcacacagacaattattctgttattctcctctgtcctcaggtaggcagtgctcctcgagctttgggtggcaatccttcaccaatccattgtcagtgtgggtccagcttttcctccttaggccacaaagatagagttgctcatattttatttccaaaatatagtgttaggggcctgaaggccacaaagaagactattctgaaagctcccacactgacatcctccccagtactggaaaacaagtaataaaagagtaggaaaaaagacctcagggccttgcacataataggccttccataagtttatttcataaatgagattctgcttgacggactggcagatggagcctgagtttatagtcctgtctgttattaccttgctttgggccctgtcataacacttcctctcaaacacgtttgaaagaaatgcagcccaacataggccgtctcctcgctgtgctgagagggtcttgggtctcacaaagcaacacacacagccaggtcatgtctctgagcatcggatctagaaaactacaaagccaggaagacatggacaatgctaacatcctccctttgtccaccacatacatgcatgaaaacacacctaccctcactctccacccacccacacacacacacactggaaattgtatcatacacacaccggaaattgtacccaaaggacgctattactaactatgaagcaagtggcacccatggcttgtccagagaagacacccacagggtcagacttcacacaacaagcctatgaatgggatagcccacatttaggagtggtcttctaatccagaatcttctctttatttagttcaagataacataaacttcctttttgtaaatttgtccatcatccactcccttgctcttatactctagtgagggggaggtcagatgataaatgacaaggaagatcatttccagccgtgatgagtgagatgcggaaaacagggcagccatggagcagcgagagaacaaccaggtgtggtcaggggattccctagtgaggtcgtttccaaaaccctcatgggtagacctgaggctgtgaggaaaagaggaatccaggcagagagaatcaaaaatgaaaagtcctcatggcaggaatgagcctatttcaaaaaaaattaaaaaacaaaaaaatctgggtggcttaatgaaaaagaacaaagagacccaagaggctagtcagtttcgactggtgcttagaggccatggtagagtggacatttttttgtttgtttgtttttgagacaaagtcttgctctgtcacccaggctgaagtgcagtggcacaatctgggctcactgcaacctccgcctcccaggttccagcgattctcctgctgcagcctcctgagtagttgcaattacaagtgcccgcagctaaacccagctagtttttgtattttcagtagagatggggtttcaccatgttggccaggctggtctcaaactcctgtgctcaggtgatccacccgcctcagcctcccaaagtgctgggattacaggcatgagccactgtgcccggcctagagtggacattttattctacatacaatgggaagccatttgagggatttcagcaaggagattacatgatctcaatggacttcttatttttctttaattttatactttaaaaatttttgaaacaggggctcaccctgtctcccaggttggagtacagtggtataatcatagcccactataatctcaaactcctgtgctcaaagctatcctcctgtctcagcctcccaagtagctgtgactacaggagtacacaccatgcccagctaatgttttaatttttttgtagagatggggtcttgctatgttgcccaagctggtcttgaactcctgagctcaaacagtcctcctgcctcagcttctcaaagtgctgggattacatacatgaatgcacctggcctgaatgtactttttaaagaatactaaggctattgaatgaccaggtggggtagcagagaggaacactgtgagtctgtggcagtgtctggataagggattatgtaagtaccactaagatggctatgttgaagagtgagggagcatttagtttgtctgttttataagtagaggccatcagacttcagaggaattcagacttaaaattcatgtgcctttgaatggggaccacatacatgtcacatcacactaacactaatgtttcattgattcattctatcccttcccaggaatcaaattttgattaagagaaagaccctaagtggctgaaggaacaaaaagagttattgcaaaaaaaaaaaaaaaaaaaaaaaaaaaaagctgatgcagttaggaaagggaagcctgagctattaagaaaaacacattgcttcttacatggtagtgctaaaggccaagcctgcatatccctgcaatctataaagtctgttttctctgacagtgtcagagttggaaagatcaataggtgtcactcacaccattcatcatctcagaaatgagaagatttaggaaaggagattgaaatgacttatgtggggtcacagaactagttattgttgagaccaaatttagagtcttgtctcctggatctcagtattatactttaattatttcttttttaacatgtaacccaatttgctcctaatagacttggaatacacagtgcctgaaatgtaaagatgacttactcttggccttaaggcatcaaatctgccacacgaaattttaagataagcataatacatcattggaattactcctgcttcttgtacctctttcacatgagttaccatgaagtgaactctatcttttatggaggagaggatatggaggagcataggagaaaggtaccatgtgaaagaataaataacgtctttgccttggactaagttgcattgcagttatcaccggaagttgacagctttggataataagcatggatcttttttgtctttgttggagcctgttgcccttcacctttatgtaacatctaaattctttattctggttgacatgggttgctttacaattttaacttggcatgtgtcatacgatcataggtataatattctacagttacaaaatatgtttgataagtatgaggcattcatgctcattgtgaaagccttcaaaatgtctgtacgctaggagaatggtgaaaaacaagcagtcaagtgagtctcagtgggttgttttctcagaccacgtggactctcttctcaaatctggtactggttttacgtgactttggagaatcttcattctcaatgagccccaaacttttcagtaaaataaaaaaaggattgatattttatgaaacatttttataccctaaaatgcagaagcatgttagaaatatatagttgctatcagtcttcaattaaatgtttaccacttggcaaaaatgatactttggtaaatccaaacatgcctaggtatccactctgtatactccggagaatgttcctatttaagcttattattgtcttgagcattaagcatctcacatcagttgttacatctggctttaagtctccaatgagccctggggaactcaatcccatcaaaggaatttcgagaggagttcacagctcctatctaccatagaagggagaaacaggataaggaatagatccctgataaagcacatgaacaaattaaatccattgttaatttgagtgactggcatagagaggtggcccctacaaaattgtcactttttagagtcacggtggttcacagaagaatagaaatcatcttttcctcttaacattatttccatgtactacagttccctctccctaaagtggtctacttgcatttgtcaacactgaaagcaaaaacaaagttgaatatacacccatggtgcatattgttaataaagaagatggaggcaattcagtggtattctaattgtaatgataaaaacttacctatttcatcagttcctctcctttgcccctaaaccccaaatactcactttgtctcttagatatcttgaagtagagttaataactaacgagaataagcatctccatccatgaaatattttaaatatagtagtgtggacctaaaaagatagtgaaattggataggccatgaatagaacaagtcctcatgtcataggcaaacatccagaaagttgtgtgttttgcatttgtgttttgttgtttacatctgttgcataggaatgatcatagttacaacagctgacatttaatgaggacttttcatatgttagacactgtgctaagagctttatttacatgctttatctaatttaatctgtacaaccaatttatgaaatgggcattttccagacaaataaaatgacgtttagtaatttcattttgattgcctgtagtcaccgccaataagtattagagggaatattgcaacccagtcaactttctccagagtttatctttctgtattcctcagctggttgttggaggttgattgaaaaaccctttgtaagccttgaaatgctaaatagtctacataggaaaggcttctactattgtttctacttttttttaatggtttgtaatctcagcagggattgtgttatctaaaaatctgcttgatgaggtctgagatactggcttttagaggtcagacaggaatgactgcaagataacttgactttctccttcccctctgctgctaaggggtaaggtgggagtggttctaggacttctgccatagaactagatatgtgatggataggaaatgaaaaaatgtgccactactgcacaatgtcaagagattaattggcatttaatgaaatatctgtgccatattattttatagtgtgcaacatttaaaacaatacacatgtaaaaaataaaaaataaaacaatatgcatgtatgcatacatacacacacacacttttagctctgtcttgagctgtcatctcctggggcaggcttaatgacaggtgcaattctggcctaattcaacctcttgaaattgaaaagggttagcaccactcagtggctgctaaatcctagagggcaaaacagcctcctgtgtctcatcccttcatgactgtctcatgggagctcgatttctgtctctttccacctgctaaccagattcgattttgatgctgtaccattggtagtaaaatatacttctttctggtaaaaggagacctgagaaagtagaaatggcattatttaaaggaatttatacataccatataagttggctggatggaccagccaacaagctcaacactttgtattcattgtttcttttaatactcatttcaagctcctggattcagtatcattatctccatatcacaaagaatgagggactctgaaaaactcaagaactttcaaggtcactcacagaatacatgcctgagctgggattctaactcaaccccttaagcccgatatcctgtactttttctgctatatcaggggtcagcaaatgatagccaatgggccaaatcttacatgctgcctggttttgtgaatgtttcatggaacacagccatgcccatttttttatgcactgcctgttgctgcttttgctttacaacagtcaagatgagtgcttgaaacagaggccacatggcctgcaaagctacaacattgagtggccctgtatgagaaacacttgctgaacccaataacaatacgtgagagatgtattgttattgacaataacgaaacatgagagatgtagctcaaatcatttaactcagtgtgtctacatctttttcctgtatcttcaaaatccaacaggataggtctatagatatactgtcttaagcccagcttcttgtatacatttattttgttccaagataacgtgcagaaacccgaattccagataggtctcttataatgagtcatgtttaagagggttctattattccactttgcatttctagaacatacttctttcagaataattactttctaaacctgttcacttagcaggcagatggaaatccaacatcctttggcagagaagagagaggaattttccactcgggcaaagtgaagcactggtcagctcgtggctgaaattttttatgtcatcccctggttctacagaagactgtaaggacagaggaatgaggcatttcgccttgggatcttcagactcagatttctgagtcaggtttgaggttcctgctgtcctgtgggcagtgaggcccagggattacaccaaaggagcaggaacccaatgtcacaggtcccctaactcctgcctagttgcccaggccacataggcacaggcaggggagctggctgatctcatttgtttgttttccgtgtccgttctcaggcagtgataggcatgctatcatctcaattcttaaataaaaccaagttgtatcgttgaagagcagataaagcaaagacagaagcattttaaaaggaattttgtggcttccaaagtacaagtatagagtatttctgagttaatgaagaaataattacaaaatatttttgaaaaagtgacattttattcatagtaattcatgtaattccaactgaagtaattgatactttgtaatagtaaggacctattcgagtgaatgtttaagatactaattatatatcaattttaaattatttaatatcaaaaaggcttgaaagcagcatattttgtgtcattatgtgaattcttgctttgccatttttaaaactatttgttttctcataccccctcctctttattttttatgatgtcaaagactgtgtcagtcaagtctgtctctatgtcatttgagtttatgtttatgtgttagtgcatttttacaagttaactatccagaaacatgcacactctgggcagaataaaaaatgtctaagttaagtgaaaaccactttaaagcatggcagccaaaatagctgtagaaaagtttatgctctattatgtacaattttaatagacatgatatcttgtttcccagaatacaacagattgactatcagtcattttgtaaaaaatgaaagcaaaactaacaatcacaagagctaagatttgctggccctttgcactgtcccaggcactagtctaagtcttttgcaagtgtttcatttttacagcaacacaatacatttcctactgttgttatccatcttaaggaggaaactttgtacagaaggtttaagtagctaatcaagttttcacagctgataagggatagagccagagtccacaagcagtctagattcttaatgccaatgctgtattgtctctccagaaaagaccactctcacctttccccttgttcttgataatacagttaaattattcatattcatagcataaattttctgtatcatatttaagaatacagttaaatattggtgcatattagaaagatttcacttaaatatgactacatgaaagtagatttgtcttttctaaaaaataaacaagcatttgttttctaaaaaatttactggcgtgcaccatttcatttcctaataattcagaataaatgaggtgtcaccgtggtccacttcaacagtagatgggcttatattcaggcaggaagcatgtcacctatacaacacagatgtgggtgattaatgaaaactaaatcatggggatgagatctttaagaagaagaaaaccaagttgtcttccagaagtgttttcagaaccccctgttttgaggttgtggatagacatgacggttttacaatgccaaaacagtctgttctaaagagaaaaagttcaatcaaccatttcacctgcattatgccgaagagctagtctttacagtcatggggctttaaaactattttgatagcctgtttgggctgcctctaaatatatcctccaaataaaaacctcagaaaatgtatcagagaaatgtacataattaatatttggcttaatatattgtcaactttgattttacatgtcccatccaacttgttaagccttctttgtggccattagtgtttactagagaataatatcatatttaattttctaattatgtgcgaaccttggagtcaggattagttgatatttttacaccttcaaatttataaacctagtatgaagtcccatctagactaacaaatgttttataatagaaatttaaatagtactccagttttgtttatgcatttgctgatggtctttcttgctatgaactttagaaactttaaatgtccatttactcacaatacacacacagcctcaatgacctaataagcagatttgcagagccataaccttgctggcttatgtcagctcgaagtaaaaggggaggtggtagtggtgaatctgtttttattactcagtgtttaatcataatgaatcagaggcttttatgagaaaccttctacatcccatgaaagatttgctgatcaaagatgtagagatttctgttttattagaaaaaattgtttagcacctcattgtggatacagaagacattgtttgttgaaaagtttaagtctttttacgctacattggatgtcacactgttctgagtttagtggtatcaggtcatcagattctgtaagatgtgattctaaaaattcagtcctagtcctaccgagtccattagagaaggtctgcagtatataaaactgtgacttaaaaaatgctcaatcttccatgcacataactgcctgatgactctcaagctcaggtgtgaccttcatagacaggctgttgtaaagtctagtaattccttcaacacaaggtaacttagtatttaaaccttgaccacacatcacttcagaattactaaaggaacttaaatatatgtcagagctcctcttcggaatataggacaatggagcttatgcagatagcattactttaattttaattgtacccatctgggttcttcgaaatggcaagtatttcgtttatgtgcctttctcatcttgggtcaactcagttccatgcactttaaaattattttaggaaagagccacatcttttttttttccttctttctctttctttctttctttctttctttctttctttctttctttctttctttctttctttctctttctttcttttttgtgcatgcatgcgtgcatgcatgtgtgtgtgtgtgtgtgtgtgtgtgtgtgtgtgtgtgtctcactctgctcgcccaggctggagtgcactggtacaatcttggctcactgcagccccgacttcacaagctcaggtgatcttcccacctcaccttagcctcccaagtagctggaattacaggcacatgtcactacactcagctattttttttttttttttttttttttgtatttttagtagagatgggattttgccacattgcccaggctggtcttgaactcctgggctgaagtgatcctcctgcttcaaaagtgctaggattacaggtgtgagccaccatatttggccaagaaccacatcccagtgctgtagaaaactccaaaaatttattttgcaattcaaaatataaaagtttgttagtagacatttagtttgttagatatttaaatctactagacaatctattatgtattctgctcagaaatggttaagacctactgatctagaagacggatctctctgagccataatttctgctcaaggcttgctaggggagatccttctaacttggctttatacacaagaagctagctcacaaaaatgtcggtattctagtagctatgcgtttcattgaccagacctgagatttggcctctccatcacttcctctgcaggtgatgtagacatcatttctgctgacatctatgttgatgcagttctagagtcatctgtgtccctattatcctgaaaatgaaaattgatagcaaaggcagataatgtccatttagttctgggtgtaaatgtcttccttgctcttccattgtgcaagcactttatgatttgagggagtaatcaggttatattccttctgttggccagaagtgcctgttgaagaaagacttggctctgttgtctggaagctaactatgtagactgatccacagaggactccatattcatcttcttgatactgagggcttcatctgtgagttgtaagcctgtaaatcctctgtttcagtggtttcaaagttccaagagcaggaggaaaatccagactgcctctgctgctgtgcagagcaattagacagtttgagtgcctcaactgttcctatacaggccagtggagtcagagccttaaaaagaccctcttctcccagtgctttctcaagtaagtacagcaacctcaatgtcttatagtatcactacagcacaatacatgagtagttttacatttgaagtaggattaaattaaaagtaatacattcacatggtaaactcaaaagtatatggccaggtgcagtggctcatacctgtaatcccagcacttagcgagactgaggcgggtggatcatttgaggtcaggagttcgagaccagcctgactaacatagtgacaaaccctgtctctactaaaaaccctgcagagacggccaaccccatctctactaaaactacaaaaattagctgggcatggtggcacgtgcctgtaatcccaggtagttgagaggctgaggcaggagaatcacttcagcctgggaggcagaagttgcagtgagccaagatggcaccactgtactccagtctgggtgacagagtgaaatcctgtctcaaaaataataacaataaatgtatatatagatataaattatatattaattctatattttatatataatatatactataatttatatacttataaattatataatatacaaatatatatttatataaattatatacctataaattatatatataattatatataggtgaatatatacagatgaatagttatatatgtagatgaatagatatatagatggataattatatatagatgaaaatatattcacatgttatatgaatatataagtatatatttatatataaattgtagatacataaattatgtgtaaaattcacatgaaaaactctctccacctcattttaccctttattccttctctttaaatctgttgaccaaaacaaatcactgttaacatttgttatttaggggtccagaaatgttttgtgtataaccataagcatgcatatatatacatatcaacagctacatttagatggtccacttactacagccccagaatggaaatttcttcctcaaagcaaacattagaggcatcttttgggaaaaaaaaaaaaatctatatttatctcattctgttcttcatttaattagcataatccctgttggatattttcctcaccaaataaggaacctgtaattaagtgttatattacatgtgcttatttctcttcctggaagtccattttttaaaaatatttttaattgatatagcatagttggtacatatctttggggtacatgtgatattttgatacatgtatacaacatgtaatggtcaaatcaaggtgactgggatatgcatcacctcaagcatttatcttatctttttttttttttgagatggagtcttgctctgttgcccaggctggagtgcagtggcgtgatctcagctcactgcaagctccaccttccaggttcatgccattctcctgcctcagcctcccaagcagctgggactacaggctcctgccaccacgcctggctacttttttatatttttagtagagatggggtttcaccatgttagcccagatggtctcgatctcctgacctcgtgatccgcccgcctcagccttctaaagtgctgggattacgggcatgagccaccgtgcccggccaagcatttatcttttctttgtgtcagcaacattataattcttttcttctagctaattagaaatatgtaataagttattgttaactataatttccccactataatatcaaatactgtaagttattccttatatctaactctatttttgtacccattaaccaactgttatttacccctgctcttctccttcccagcatctgataaccatgatttcacgctctatggagatccttgctttgatgataaattcattaaggacaagaaccctgcagggtgttcaatatgcttcccaggtgccaaatagtctcaatacatattaacagaaagtcagtgtcaactcacctgcacctcacacagtaaattgatttaggcatctcagattcctaaactctctaggttaacacctcatatagtaatgaaagtataatcagttcacatgattgaaatcctctctagtttaatgtacttgttgcttttccatggactttgaaaacatgaaggtctgtagccgtgttgttgcttttccatggacttggaaaacatgaagttgtgtagccgtgtgtctccagacttttaacagcccagaaatggtttcaatgttctgcattaaataaatcgagaagggttagacaaaacagtgtctgaaagatttcatgctgtgagggtgatgagggtgatgggtgacattaatgaatctgaaatggtcgtgactacaaacttgtttttaaaatgtcactttctctaagagaacaaaaacttgaaactcaatgttcatgaatacaagaaggccttttcaaagaaaggccacgggcactctcactaatacacacttggcatttgggtatatccctaagctgtggactgtgtttacatatattactctttcttctcatcactctttaaccaaattgttgagtgtccaagatgccacatggtcaatggattattaccctgtggattcaaatctgttaccaattactctaggggtttattgagtggtcctgcacacccactttcctttgtttttctaattatcgctgcacagctaatcctagctcaaaaaatcaattcctctctcatatctacttacatatcctctttaagccccttctgtgtttttttgttttgttttgttttgtttttgttttatctcacttccatctatttcctggttatttcaggaaaagttcttttcacaccactttttagtggattccatcctgtctctcttcttgtgaccataaaataaaatttgtcataaacaaatgtaagagtctggatgtttctacaaacatttaagtggcaggaagaagctaaagccatatttttcagtcaaaatgttagcagagattttcctgcactgtgcatgatttattttctttctttatatttttagataccttataaattgtctaaaatctcaatgaacaacatttatggtcaaataacataaagaaaaatcctttatagccacttacttactcaattgtatagtgttttgacattctaactacactatcagtatggttttctgttataacgtagtataggtatagattttagccacatagtaggtgaaataggctatgtgttaatctagactaagacacagccattatctataacatatattttatgagaatttgcattccaaggtaaaaacaactgtttgaaaagttaccttttaaacaaatccagttcatatggtgcattactttcattttctgaaggtgattcatatggaagtattgagaagagaaacatcatagtttaaaaaaggccaatcagactttgaggacaagatccaaacattatgcaactttatatcttagcagagtgcacttagtaggtgttcaataactctttgttggataaatgactttatgagtaaatgaagaaaacctcagagctattggcttcctgtgccttgaattacacttttgagtgggactgccttctgcaagccagttgaaaaatagctattggctcacagagttcacctttattttgaggactctgtcaagacaccttagtgcatgttcctagttatgtgaaagatatgctgccaatcagaatcccaatggtctccttgtatgtttcatctttaaatggggctgcgctgttagggacaggatatatcttggcagactacatggatatgaaaatttcaaatcttcccatagtcctctatctttaaggaaaatcatggcacttgtttttgaatttttttaatccatcttccagattccaaaactaggaattccaaatgttgtttggacagactgaaaagagaacaaccaataggagaagtggtacactatgagtagtcaaggtaccatacacatgggaagtgtgaaggagacttacttagtatttacttatgtctctttgccaatatttgggagtttcacagagcatttctagataatgagggatggaagtgaagagtaggacaaggtattcaaagatctaagaagaatgagaaatcctcgatttcccatatgacaggatgacttggttacacgagtaaattgctttttgtatgtgaaacaggcagcaattggaggtagcaaaggaatacacaggtaagccctggagtccaattcccaaaattagtggtgttttctgattccctaactgactctatggtaggctcctggtcaaaagatccatcagggctgctgggcccatgctgacattccatatagccatcttctttctgattctctgtcttccagtgatgatccagctctttgcagcagcaggattgtggctggccagaagcacacttgatttcaaaatggatgtgacgggcaggtcacctccttttctgcagaagtgtacttgcatcaacaaatctttttcctctcaggttttgaggaaatgggatcaaacattccaacacagagaaataggaggcgtgggcagcagctctcctggatctctctctttccttgaggagatcaacttgtaaaagattacaaaatgtaccctaagtggtcctagagcaccctcctatcttctttcccaagcttgtcatgtggttgcagtggacatggaaagtaaacactgctataaacagagaataataaattgtaagaaagcaccagaatatccttcttgcttgaactttgaatcattagatccaaacattccccctctctcttctcaaagttccaaagtgttaaagagttttgttctccggtatcaggagttggccacaaatgctttctctataagttcataattcctgttgggaaacttggaaaagagctctccccttctcatccaaagaagtgatgacttctctttgttagtttacaactaacaaagtcccatttctggtttgaaagtcagatggaccttggcttatatttatttaacaaagacgtggaatttctctaacagactgaaagtttattagaataacatctagcattaggcctggcaaataggaggtcctcgttaagagatctgatcagatttgacttctaatcccagatataaggtgtttattctttttgagccactatttcctcatctataaaataagaaatattcataactattccataatatgtattcttatatcctgtataataaaataactaatataggaatataataaataactaggaattataaataatataagattgtaataaatatccaaaatcaagggcctccttgaatttgttatatattgatttgttgattttttgagggcagtaatcaccacgtctgtccagatcagcgcggtgtccacgccccactcagcactgtgccttgtccatagcagatgctcagtcaatatttatctaatcagtgctgtttgtattcaaagagaatgtttaacttcttactctttccattcccacctcccctttttgatctcatgtccactatcggtgtactgaggtctcctgggctctgtttgcaggaatctaaaagtagtttttttactttggtactgggacatgtaactccactttttagagaaaatatttcatgctaattaaaacatctcagggctggtctccctgcacttctcactttcacacctacatactcataccccttttctctttttccttactttgtaatgctattagagttgacagaatacttgctgcttccccagaaagtcttagccaggagttcatgaaaccctgtcaggccttgtgaaatgtacagatgtgtttcaaatgatccataaaccctgatattgtataaaatgtgtgtgccattttatggaaagaggatgatatgttttcttaaccaaaatctttcggggtacttcggtccataaaaggctaagatccactccactaatgagcaagatctagtcatttagaaaatcctgcactctctcctttgttactgcctcaatttccttaaaaagctcttataagataataaagaagccctctttacttcctacagttccactccacagcaataccagcttaagtgtgtgccttccagcgtccatcccatctctccgtctgaggggtccccactcctagtccacccaggccaggaaacccataactcatatgtaccagaaaacctcctttttaaatttcctcatgcttcctggcaccctgacctgacaatggactagtacctcatatccacttctaccatgacttctgagaaagtggtattttttaccacagtgaacttggtatatgcagtgtgtgtcaggggcactggccttactaaagtagaggcccattctggagaatagtaagaaataaggagcaatacattgatgaaatagaagggacattaagtgatggtcacagaccactcttaggactgccattaacttcagatgttaaagaagtgcttcagctctctgtgctttgtcttcttcttgacaagtgaggatgttaggattatctgccatgtcatccagcttcaatctctataattgtataaatctggttggcagtggactcgttagtgcaaagtcctaaagccttaaagatccgaagttttctcactgggcaagcaatttgcgggattacgacagtgaacttggtgtatgcagtgtgtgtcagggacactggccttactgaagtagaggcccattttggagaatagtaagtagtaaagagaaatacactgatgagacagaagggacattaactgatggtcacagaccactcttaggactgccattaacttcagatgttaaagaagtgcttcagctctttgcactttgtcttcttcttgaccagtgagaatgttagacgggattatctaccatgtcttccagcttcaatctctataattgtataaatctggttggcaatggactctttagtgcaaagtcctaaagccttcaagacccaaacttttctcactgggcaagcaatttgcgggaaattaaacaagtccaaaatattgaacaaatgaagaaaggggccattttaacagacaggaatacttcatactgtaaagatggccaggtgtagtggttcacacctgtactcccagcactttgggaagttgaggcaggaggattgcttgaggctaggagtttgagaccagcctgagcaatacagggagacctcatctttgctagaactttaacaattagctgggcatggtggcatgcacctgtagtcccagctatgccagaagagaagggaggattgcttgagcacaggagtttgcaactgcagtgagctatgatcttgcaactgtgctccatcttgggtgacagaatgggaccttgtctcaattttttaaaatatatatatacatatatatatatatagagagagagagagactatatatatgtgtgtgtgtatatatatatatacagagagagagagacagagagagagtaaagatctcatttcctccacaaatgttaaaaacattattctgattttaaaaaaagaatgaatttttaaaatttacaaatttctgaaatggacaaaaatatcctaggccttcttcctcaaaaaataataaataagaataataagaaattgcactggtatctgaaaaagcaacttaaagctataaaaattaaaatagcatgttatgccatgaaagagacaaatgagatagattcaagtttcaaaataacaattgttattattatgatacaattatattaattttgtacctataatttaaataaaataataataaataagaaaaatcactgaataaaggtaataatttaaataatttaaaatcttaaaataatgattatatgtataataaaactgtaaatttacaattatagagctataaacaattttatagttgtaatattttgtaactaatgaaacattatattttaatgattttattattgttgtaattaatataaagaagataaagaaaaatgggcaaggtttgaataagcacactttgtcgaagatatatggatagccaaaaagcatataaaatatgaccaaaagcctctggtgtttagagaaatgcaaattaaagctaaaatgagattcttctaaatacctatcagaatgtctgagattaaaatgactgactgtagcaactagtggcaggaatgtggaggaactgaagttctcatacactgctggcagaaatgtacgatgacacaacccttttgaaaaacattttggcagcttcttaacaatttaaatgtacatatcccatgtaagccagccagtccactcctgggtatttactcaagagaaatgaaagcctatgtccatacaaagacttgtatgtaaatatttataacagctttatctgtaacagctaaaagttggaaaccacccaaatgtctatcagcaggtgagcggataaacaaattgcggcatatacagtgtagatagtggaatactactcagtaataaaaaggaatgaacaattgacacatgctacaacatggatgatgcaaaataattacactaagtgatagatgctagacgaaaaagagtacatactggctaggtgtagtggctcatgcctgtaatcccagtactttgggaggctgaggtgggcagatcacctgaggtcaggagttcgagaccccccaggcccacatggcaaaaccccgtctctactaaaaatacaaaaattagccaggcgtggtgatgagtgcctgtaatcccagctactagggaggctgaggcaggagaatcgctagaacccgggaggcagaggttgcagtgagccgagatcgtgccactgcactccagtctgggagacagagtgagactccatctcaaaaaacaacaacaacaaaaagtgtacatactgcatgatacaaaattctaagaaaagaaaactaatctatataaaaatttttctctgttattctctactgagaggggatgaggaggattaccaaggggcaaggaggaccttttggaggtgatagatgtgtttattactgggattgtgttgatggcttaccaggtatctatgtaagtcacaactcatcatatggtatactgtaaatatgtgcaggctgggcgtggtggctcatgcctgtaataccagcactctggaaggccgaggtgggagaattaaggccaggagtttgagacatagcaagatcttgtctctagtaaataaataaataaataaataaataaataaataaataaatgcacttttttgtatattgagttatatctcaatgaagctgctttttttaaaaaaaaaaaaaacatataacataaaagagattaacagaagagattcaaaagtctagaacaccaaatattaaaggtagcttttcaaatcagtgagaaaataatgatattacagaaaatggcaaatcatctagaattaaatttctacttcatactatcagcaatataaattgcagactaatctaaattaacaatttaaaagataaaagaaactatagaaaaatacacaattatgtatctgttcttgaatggaaaaagattttccaagcgtaaatacaaagaaaaatttatatagtaaaacaatgattgatttaatttgataatttttttagaaagtttacatcaaaacaaattacaaaattgaaaggcaaatagcagtctggttgtggtggctcacttgtgtaatcctagcactttgggtggccgagatgggcagattgcctgagctcaggagttcaaaaccagcctgggcaacgtgatgaaaccccatctctactaaaatacaaaaaattagccgggcgtggtggtgtgcacctgtagtcccaactactcgggaggctgaggtgggagactcccttgaacctgggaggtggaggttgcaccgatctgagattgcatcagtgcactccagcctgggtgacagagcaagactcccgtctcaaaaaaacaaaatggcaaatagcaaaggggataatatttgccacaaatataaaagaaaaggatatatccttgctatataaaaaggtcctatgaaacagggacttagttggatatttctatttttaaaaaggcaaatcatataaacaagtgttttacccacccatcccccctcaaataaagaaaaaagacagggatggagaaagaagggggaaaaaaaaaactgagtaaaaaaattctttgcaaaagagtaaaaaagagatttgtttcctcaccttgatgttgtctttataagttgttttattttaatcttttgtttttccatattttcagagttcctacaatggacttgtagtacggtacctgggtgatcacaaacataatctagggagtagaaaagaagttcaatgactcagcatagtgttaatggtcttccagatgaaggaggggacatgaacatgtgtctgtcccaataaaggttgagacaaggtttgttgtgcacgtgcgcgtgtgtgtgtgcgtgtgtataacagtgaggagactgtaattagcaggaaaaattggggttttgaaagtagaccacagtcttgtcattgtaccatgactcaccaggaggacagaggacaagtaccctactcctgtgtaaatccagactgccaagtagagcactgagatttgatgagtacttaagaaatgcttgcttgattaattggtaaaagatattaaaggggaagattttatatcacattcaaacatatgaagagaaatgttaaaaatgtttaaagttccatttccagtctcactttccaattcttggttcaaaatacaaggggtaattagacatcgactgtgtagtcaacattatgatcaggctatataaaatcatgaaacatcatcctaaactttaaagaactttgagtttagctgggaaaatatgctcacaggaaataattatgtaggaaaagaaggcatcaaaagggcttaaagcaaccaatcacacagagtttccttgttgggaccccccccccacccgccgggccccaccccgttgatatcctaaatgttctcttgacatcttggatttaccatagagcctagtactgtctgtaaggtcctgggcctgttctaattagtgctgagtatctgttgatctgctacgtgcaaatgggaagataaaactaaatgttagattagggtcaatctttaaaactctttcctagattgtgatggtattcagtggtggttgaccatcatggaattgggagatatttgtgaatgtggctgcaggctgcatgtcctttgtgtctctgactcaagacacacccattgatctcatttgtcttcatttcatcattgggcagaatgcgttctaaaatgaagagactaaaaccttcacagaagcacactctttcaacatctaaggaaaaattgttgatgagaaaactgtgagaacattaggaggtctttaaattgcaaggggaaaggtctgttggtgaaaacagctgaaatcctatggattaaatcaacttgtaaataatgtattcttagagtctgcagtgatctcataggcatgtttaaatgctgtttcttatgactacagtttaaagtcatggtatggactttcagtttcatgaggctggcctgggggaaaagagcatgaggttgaggttgatggtgttaactagagcaactgagcccccatacagaccttctgaacttgctcattaacgaagccacaggatggaaattgtatagtgtccttgaccagagcattagttacaagttgtgagaagagaagaaataagtaagaaagaaaataaatgacttataaaaatcctcagaagatatagtccccaactgttagcacaaagaaaggatgtaaaatcatggaggacagcagtggagaagataacgttagcagacaataaaaggccaaagttttagaacagtagtaagtgtttaagaatatacataatatatcttcctccatttgctttttgtcttcaccataaatagacatgagttaacgtatgtttaaagatttatttcccttttattgagctcacccaacaaaagtttttttcatcatgtcctgcttttacaaaccaagatctaatttgacatgattacgtaattgtgtggccatttgtgcccttccttctcctcctcctttctctaaagtagaaagcctctctttcctagagcctatgtaaaatgtgttaattcgcttaatagcaataataattttcttatgacaatttatctattcactaaagtgttattaaggacctattagttggaagcctctgtgccagctgttgggaatagaaaaatttataagacactgtctttggagctttcaatctagtgggggattcaaacaattaaagagatacttttaaaagacagtgtaataagtactctggaagatgtggcagactgccagttgccttccccagcataacattttcccaatattcattaggaaaagaaccctttaattgtacccaattaaaataccgaatctcccagcctcttctgcagcagatgtggctgtgtgactaagttctgtccaataagatataagtatacatgtttggtgagatttccaggaaggatgctcaagtggagatgactaagtcagaagaaagttccttttagctttcctgcattcctagaattctgatgcaaaagctggagctacagcagcaatcctggactatgaggtaaccttgggagtactagggaattgggatgctagtaactttctagaagcaccaactcagccccagaatgcctcctgctgacttcttttacgtgggagagtaagcatttgtgcatttaagccactatagttggatatttgaccattgcagacaaaaataagatcaaccgatagaatgccatttatgaaaaaaaaaaaaaaaaaaaaaaaccatgggagtggttctcctctctgttatgatagggagaggtcagagatgctgtccctgaagaagtgacattcacactgagacttaagggagaaatgagtgagcaaggtataggaaagtatttaaggaatatcatctgaagctctgaattagaagctatctacaagatactaaaagaagatcagcatgacagaagtacaggaattaagaagaacatagtaggtgacaaggctgaaaaatctcatagattctccattttgcagagacttatagatcatcttcaagatagtaatagctgcagagcagaaggctagagcagagaaagaactttgagagataccaatatagacatggtttctaaagtcttaggagacaataagattacccaggaagagtatttaaagtcaggagagggccaaagacagaaccttgagatccaacacttaaagatcaagaagaagagagtttcctatcttctgtttcttaaaaaataaataaataaataaagcatatcagcataattcagagtcacaaattctaagaaatcatggggcagagggcaggggtgaggtagggtttgttttgttttgttttgttttgtttgtagataaccaaaggaagaaacgattgatgcaagatttcagggagggtgaatagccctccttgtagctttgccctgctagagagatggtgggtggacaattactataatatttacaaacaggataagtctacgtcagcccctaacattctcagtttcgttatttgtaaaatggcgtaatgatacttatcttttagagttgtttgaagagtacataagagacggaaaaggatttttaattagataaggaaagcataatcacctatctttgattcattcacccttttaaactgattaaagcttagaaaataatcacatatgcagattgatcttagtttgtccacctcttgacaatcagttagtagtatatatgtatttttttatttttaagaatttttatatccccatgcattgactaatcttgccccatcatagataagactagaacaaaatattgctttgagaagtccttgagttccaaagatttaccatgaagctaatgaaacctgcattgcagagtccttcactagtatggccttttccaatgtcttgaaaggagtcctagtcacatgttcacatgcttacacatttatgtaaaatatgcaggataagataattaaactacaattatctaagatggcagtctttttttcactctgattttctgtccaaaatattcctcttgtggaagtaggtttggaatggccctgaacattttcggaatctgaactgagagaaagttgagtgaaagatacattgatttaaggcatagtgagatgtctagtaaagttattgtaaggtattccagtgttgaaaaggcttccagaaatatgccaaaaccgactgtgctgactcacatgatgtcatgccagaaagatgaagggccagagattgtatgatgacctgagtttgtccttgtgcaacaagcaccaatggcatatgagtgttgatgggacaagttttgaaatgtatggagccaaaagctagcctgtggaaagttctaccaggcattcgacatgtggtaaggtaaccaggagactaagttccgtggatgtctagtcaaatggaaattttcttctctcaagaataaacatgataatttcgtgtatgcaattctaaattcaccaaattgtgttttctttttcaatggcaatttcaggaaattaaatgatcagaatccccatgtttccaggggccaaacctgtaatagtcccacagacagtgagtgtgtctataacaactaatataggcagaaaaattcaaagacgttttctgaaatttgccaatacctgtaaacatttttaggacattgtcaaaataagctgtgaagctgaaagaagtttatttaagtattaataataaaaatttaataagctatgctaaataccaattctctttctattatctctatagaaaagattttacaaaatcattctcagatgtagaagcaatttttaaaaattcagccaaaaaatagtagggtgaaaagtattataatgatagcaggtagttaattaatagcatgttctttttctgaattttatgatgcttgtggctttgacaactttaaacattttataattgtggaatttcttttgtcgttttacagaaatattcagttttgtacctcataatttgtatttataattttgtattcttcttcataaaaagggccattgaattgtgtttaactcatgcctcaccaaacctgaaccagcattttcctctgttgaatttctattgcctgcctacagcaaggcccacgtcttcctgtaacagttgcccccagttcccttaactatcaccagggagtcagcagttaatgacatgctcaaccttcctccaattacagatggttaggagagaaaacaaagccataaggccattaaactcatgaggttttgactggtggttcggaggtagagctggccctggctatatctgccgtgtacacaagaaccaaaaataccacacttcatttcagaagatccagatttgatcccacctctgccactggtgtatgatcttcagaaatgaacttggctgtccgaacttcaatccccttattcatacgatagacctattgtgatggccggcaagctgaggtatagaaacacatattatatagtaaggggttcttcaaatgtaatatctgttctcaattcctcttctctatcattaccaaggagccaatgatgcacagctacccatgtaccttcattgtagagacacaccctgaacaagcagacaacatggcgccacatcagagtattatattagaatgtgtgtttggcatttctttagcagaggggccaagtgtaggaagggagcgggtagaaaaggaggaccacaggtgacaagagtctcccctgaccttaagcttgcagttcccactgaaccaaacagaagccctgtatgcatctggaagtccttgcttagtgggctgtgcaatgtgtgttttaggggtctcaagccttcatcccatgtagccatggacaacatgttccaggaaaacattacttcctcacttcattacattccaagtgacatttctgcatcccttcttgacgaatgttgtccaaaattggttgtccctctctttgatccagctctgaccacagagatcagttttacatacttgggtacttccccttggtgattcaagaggaggcactttccttaaatagccttggaaaccttgagacagctgctgcatccatctatgttcattgctcaaacttcctgtatggtttgccaccaggcttaggttcaaatccaaaatcaaaatcttaacatggccacccaggcgcatgtggcctcagtaatacacagtttttgagcttcatctcaagcttctcttccccttactttgctctccatgcctgcttccagctcttctgcttcacccagtccttccccatccctcatgtcacacaggttagcttctgtgcccaagtagggtcctgcttcctttcacaaagctgactcccatgagctctccagagatgatctcaagtgtcacttttgtggggataactaccccagtgacaccctcctccagatttggttagcttctcccattccagcctagtttagatggaatcatattaagttgctggcattaatttattatgacctacaaaaccatcaatagtgtacagttctcacaactcccttgtacattgcagccctcatcaaaattgttatgaagtaattgatttgaataatgattaatatctgactccctgatggtttataatctttgtggaagtagacaacatatctatcttgtctactgctatttagcacatactaaataccacctagtaaatatttgtttaatgttacttatttaactgcagagatatactttttacattttctacatttaagatgcacacggaatatgcgatgttgtggagaaaagagctatttgccaaatggttacttgttactttatttttctaaggctttgggcataaaatgccattatggaattactattttattacaatggtatctgtagtactttggccctaatgttcttttttggttatgatgctgcactatgcctgtggaatacattctggatgcatgatgagactactgagacaatcacaatcttgtaagtttccttttcttctaagataaatctcaagcagagattctcttctcaggaagagtagaacttttcacaatctcgagccaagtaaacactctcaaattgcaatgcaaaagattttgcaaaatacttgaaaaaatgcaatttataaagcagaagttgtacagatgccatggaagatctaatgaaaaatcagaaaagattgcagcacagatttaactcttctcaagacagcaaaagcaccccacatgtgacagatactcatgagaacattgggagcctgaagccccgttttccagacaaggaaggaattacgggtctctgatcacagcagaggggccctcattagacccatcaaggattgcacgtgccctgtgcaaggccacatgcgcatggggtgtgcaattaactctgcccatgctgctgaagtttcagtccattagtctgagtgaatcttggtcatttgtatccctcttggtgcctcataaacatatgcctcatagtctgcatcttcaaactttttccatactgtaaaactgtcttcgcaaaatctcatcacaagctgaaaagtgatccctggtgataaacaactgagatggttattcacctccatgactagcctttcagggcctcactttctatatccatcaaatgggaagaacaatagatgcctcatcctcctcactatgttgctgtgagcatctgttgaagtagtggctattcgagtgcattgaaatgcatcagtcagtacacagatacaagggcttctgataactcatacctgaagaatttttgtcaaccctgaagggatttgcttcttggtatacgggtattaaaatactagtataatttctctaacgggagtatgatgtcactagttccagagtcttttcatagatggatgggttttatgataaataactcaccctcagtgttaacttggctttccaactagccaaacaggcctttgtggaacaaggttagcaaatagcatttgggcaaacgatcaaaagggtctccctctcttctatcactctctttatctctcttggtacctctctctgactttctctccctcctttaaaaagttatctctgttttttttaattttttttacattaaaaacaacaaatgggcccttcagaatagtcgaaaactttagaatgcaaagatatcaaaaaataagaaataacctagatcagaaaacagataaatgattgccaggggttgggattgggaggagttatttacaaggtgaatgaagaaattatgaggggttgtggaacttttctatattttgatcttgaaaattatataactatatacttgtgttaatcttgtagaagtgaacactaaaaagggtgaattttattataaacaattttttaagagaacaaaaaatgtactataatcccaccagccaataacacactattaacactttggcgtacttctgactagtcttttttttttttttttttttttttgctggtgtttcaaaatgtcattatgatcatataatacacaaatatacatatatgtgtgcatatagatatctacagatgactaagatagatgattgatagatgatagatcagtgaatagataaccaaactcaaaacaaaatagttaattcatgcaacttgcacaaaaggtacaagaaatatactatgaaaagtctccctctcccctttttccttgggcacctagctagttttgttttagtttttacctagctctcctgagacagtgtgcatatataagacaaaatatacatatacctcttttgtaatactaagacaccaaattcatacttctgcatcctgccttttttctttacttaacaatacatcttgaagatggttcaaattacacatatatagataatttttcatgactgatttttaatagctgcatagtatttctatattttaatgcactgtaatttatgatattgtattgacaaccacccgggttgtttttaatatttcatttttacaaataataatgtgataaacatccttgtacttgtgagatttcttttcctatatgggttatttatctttagtagagcttcttagaattggaattgtgaagtctaagtccacattttaagttttgctagataaagctacattgccccctttaaagttgtgccaatttttactccaactactgatatatcaaagtgtctgttcttgtatcattatcaaaattttaatatttaattatctgatgagtgaaaaatgacatctgatagtcctgtcagttagtattgcttttaatgtgactaatttttagcttttattcatgtttaaatgaataaaatgtactccctttactactttttttttttttttttttgagacagggtctcaccctgttgcccaggctagagtgcagtggcgtgatcatggcccactgctgccttgacctccagggctcaagcaatctgcccacatctgcctcctgcctgtgttgctcagactggtcttgaactcctgagctcatgcagtctacctgccttagcttcgtaaagtgctggaattacaggcgagagccaacttgcccagccctgtatttcctttactttgaactgcatttgtgtatccttggttcatgttctatttgatagccatttcttcttaattagagggatttcttttttttagattagaaaaactagcccttttggctatgataagtggtttatatttccttttgtgtgctacttgccttttgtctttatttggcttttttttggacttgcattatttatttaagatttacgtagttggatttctttctcctttcacatatggcctctctcacttcaatattatgtagaaaaaaacctctgaaataatgaattcctatacttttatgggttctttttttattttgatatttgacccatctggaatttattttggtataagaatgaggtagattttcaacaatttattccactaaatcataaattagtacaccttttttccataaatggctaaatagtaaatattttagacttcatggatgatacagtcttggggcagctactcaactctggccttgggcgaaaaagcagccacagacagcacaaaaaccaatgggcataactgtgatccggtaaagctggtgtagacacacaggcagcaggaggatttgaccctcagattgtagtttgctcacccttggtgcagaagattacttaattattctaacaaaattgatttagtaaataattttccccattgatatgtcttggttcctttataatacacaacattattttttataggtaggtcttgtacaaaactctccatttgattttattgttctgtctttctattcataggctgggtatgacactaatttggttactatagctttatgtatatttttaacattggatgaggtcagttgctcctcaaaactcttatttttcagaattttgtgcaggaatatctgagtatttctaattagattagaatgtcagaatacattcatggacatatgagtttggggttttttaaaattttttttagatatccttcaccttgaacatttattatttctttgtgttgggaacaatccaaatctctcctagatgttttgaaatatacaatgtattgttaactgtagtcaccctactgtgctattgaatactagagcttgttccttctgtctaactgtatgattatactcattaaccaacttctcttcatctgccccccacctccacccatctcagcctctagtaactaccattttactctctacctccatgacattaacttttttagctcccatatatgagtgagaacatgcaatattttgtctttctgtgcctggcttatttcacttaacataatgacatccagttccattcatgttgatgcatataacagatttcattctttttatggctgaatagtaatccattgtatgtatatacacatataacgtctgtatatataatgtgtatataaaatgtatatccataatatatgtatatatacacatatatgtaatatatattgtgtgtgtgtgtgtgtgtgtgtgtatatatatatatatatatatatatatatatatatatctcacttttttttttgagacagagtcttgctgtgttgcccaggctggagtgcagtggtgcaatctcagctaactgcaacctccacctctcggttcaagggattctcatgcctcagtctcccaaaaagctgggactacagtcatgtgccaccatatccggctaatttttgcattttttagtagagacagggttttgccatgttggtcaggctggtcttgaactcctgacctcaggtgatctgcctgccttggcctcccaaagtgctgggattacaggtgtgagccaccgcatctggcctcacattttctttatccattcatccattgatggacatttaggttgcttccatatcttggctgttgtgaatagtgctgcagtaaacatgggagtacaggtatcattttgatatactgaattcctttcctttgggtaaatatgtcatggtgggtttgctacatgatatgatagttctacttttagttttttgagaaacctccgaactattttctacagtggttgtactaatttacattaccaccagcaatgtataagagttcctttttcctttttccacatcctcactgacatttattactttctgtctttttgataatatccatccttactgagggaaagagggtatctcactgtggtttcaatttgcatttccctgatgattcgtggtgttgaacttttttttttttcagatacctgctagccaattgtatgtattcttttaagacatatctgttcattcctttgccctctttttagtgcttttacatatttggcttttgtttttttgttttcgttttcattttgctgttatgttgttcctggatatacaaggaactcaaactatagtcctttgtcagatgaatagtttgtaaagattttctcccattcctcagattgtctcttcactatgttgattgtttcctttgatgtgctgttagtttttagtttaatatggtcccatttgtctagttttgttttttgttgcttttgaggtcttagccacaagatcttcgcccagaccaacatcctgaagtgttttccctcttttcttctgtagctttatagtttcaggtcctaaatttaagtcttcaatccattttggtttaatttttgtaggtggtgagagattggggtctagcttcattcttctacatatggatgtccagttttctcagcaccatttattgaagagaccatcctttcctcaatgtatgttttcagtgcctttgtcaaaaatcaatcagctgtaaatacatgcatttatttctaggttctctattctgttccattggtctatacgtctgtttaaacaccaataccatgctgttttagttagtatagctttgtagtatattttgaagacaggtactgttatgcctccagttttgttttttgctcagtattactatgagctatttttaaaaaatacttccaaagaaaaaagtgcaaaagtttatattagcttactatagttttaataggttaaaattagtagcttctgagtaatgaagagagactgagcttaatttctcctgctttgaaagtacttctagggtctgggtgtggtggctcatgcctgtaatcccattgttttggaaggtcaagacaggaagattgcttgagccccagagttcaagaccagcctgggcaagatagcaagaccctgtctctaaatttttttttttaattaggcaagaatagtggtgtgtacctgtagtcccagctacttgggaagcttgagcccatgagtttgaggcaggagcacgctatgatcatgccattgcactctaatttaagcaacagagtaagtcctcatctttaaaaacaaacaaacaaaacaaagcaaaacaaaagaaagtacttctatttatttcttcacctgctaatttagcttgttcaagtgtagaagctggaggatgtttccctgcaatgacagagtagccaattttgtatctcctgattttttccttctctcattcttctttgctcaacagacactaaattgaggtttgtgtccttgtaaatagtagatttcatttaccctctgccacctttgtcaaaaaataattttaatttaaaaaatgatgtaaacttattttagcaaaattgaagactatagaaagctatgaaagtgaaaatttaaatcaccgtaacactgcactcagagataaccactgttaggacttttatttctttctttctcttctctatacacctgtaacatgcatgtacacctactgcatgcatatgtgtatgatacatgtgcaaacagtgcatgctaacattttctaccctgcttttccatgtgttatttttatcctgtgttccactattttggaaaccgtcagggttgacagagggaaattgatcaagccctttgtcttcattgatgtcaagagtttcagtcaacttggaggccgtggcctcctccttacaggcttcttcagcctttggtttgagtttgggttttttacttttcatttttggaggagccacgttctctctcctttcctattactggagagccgcttcctctcttcactcattcattgtgcagtgtgggggagtcaggacccagatgggaaagaaagcatcttgccacactcaaatctcatcttttttgccatgtttgccccatggcatttctctcagcatcttcttgtgctttttccaaaacatataaaggacaattctactctggaaagtcactgggatactgttctctgagaacaggtattgagaagaagatggtttcctcttggaacttggccaactggctcacagcgaacgtggtgtggactcttaccagctctctctagtatgctaagggcccccaaccagggaccctgaaggcatctcaagagagcagtgtccaggtctgcccttgttggaaggaggatgatgtgaggagatcacctttattaaagctgcaggttgtctgccagattttcaaatttcaatgtaactttttatttaaccaatgctgattaatagtagtggcattgttgaaatccattccccttcatttcattttctaatgaaatttcggatttctacacagacatggttttctggcataaaaagcttgcatttgcaacctgtcatattgggactgtgcagaacttttccatgttttaaaactcaggagaaagaagtaaagatggtaagagtgcacttgagcagaaacaaagggctgtgatcccaaaacaggggacaaatgagctgcaaaggagagacaccaagagcggagagcaagaggcaaagtgatatgaaagactccaaagtgctggttcagagaaaagaaaaaaaagggacataggtcaggaaaggggagaaggactgacatgaactggcaaatggcaacagatataaaaagccagctttctctggggagtggaaatgtttctaagcatttttgttcatgttagtatgatttgttttttcctaagtaagcttgaaaatcatagagtgaataggagaaaccaaagattagggaaaatatttttagaacaagctcagggaagtcatataggtttaaaatatatagtctatgcaaataatggcacacatttcagaatggaaacaaaaataagtggcagataatgtgtccaagtaatattggtagcaaatggactgttacgagagcaaatgatattttgcagagctgagagtgtgacctgtcttcaattatttgaatccctatcctacaaaagcattgaaaaaggaagatctggagccaatgactgtgtattacatatattttcattcagtacaagcagacatcatcagtgtgctatatactactttcattattattattatcttaattaaagctgtcttacgagccaggcgcagtggctcacgcctctaatcccaacactttgggagaccgaagcaggtggatcacttgaggtcaggagtttgagaccagcctggccaacatggtgaaaccctgtcgctactgaaaatacaaaaattagccaggcatggtggcaggtgcctgtaatcccagctacttgggaggctgagacaggagaattgcttgagactgggaagtggatgttgcagtgagccaagatctcactgctgcactccagccaggatgacagagtgagactctgtctcaaaaaaaaaaaaaaaaaaaaaaaaaagacaacaacaacgacaaaactgtctcatgatgaaatgggatgctttcactagccgtggttgctcatgcctgcaatcctagcactttaggaggctgaggcaggtgaatcacctgaggttaggagttcaaggccagcctggccaacatggtgaaaccctgtctctactgaaaatacaaaatttagccgggtgtgctggtgcatgcctgtaatcccagctactcaggaggctgagacaggagaattgcttgaacccgggaggcagaatttgcagcgagccgagattgtgccactgcactccagcctggacaacagagcagaacactgtctcaaaacaaaacagaacaaaaaaagaaaagggatgctttgtggaacagggagattacttgcactggaattgttcaagccaagttctatcaacatttgacacagaaacacatgaccatcgtaaggtctttcccagctcagcattctgtgactgcgtggtctttgtactgagttttacatgatatggatttcttaccttagaaggatcagtttttaaaagatgggctgaatgaatcaaatcagagaacactatttgcctacccaatatctagtctccacagctagctggggacactttatagccacgttaaaaaaacaacagcaaaaccccactgcatttctcaacttctgtagcagatggaggtggtcaagtgactaagttttagccaaagagatattagtgagaattgggagaaactttgagattccttaagaagggagacagaggatgctaacatggaacttgtcctttgccttcccattctcctttctgccatctggatcaggatatctggccatgctgaaatcatgagacaacatgaaggataaaatcctcaaactaagaatagaaatcagaacattaggacctggtctgagttcattgtggagcttccccagcccgctcaggctgcccccagtcttcccatttttagaaaaattaaaactatggtttgttaaagcttctattctgatggtctctgttacttgtagctgaacgcaatgaattgtgagatacgatttaccacaatttttttctttctttctttcttttttcttcttcttcattttttttttttttttaaaagggttgtgccatgtcacccaggctggagtgcaattgtgcgatcatgactgactgtggtgtcaacctcccaggctcaagcaatcctcccacctcagtctcctaagtagctgtgactataggcatgtgccaccatgccaggctaatttttgtattttttgtagagatggggtcttgctgtgttgcacaggctggtctcaaactcctggcctcaaacaaatcctctctcctcagcctcccaaagtgctgggattacgggtgtgacccagtgtgcccagcgctgtttactgaaatttttttttttatgattctgactatagctttaaacccaggctctgccatctccatgctgtttaacaagttctctgcccttcgtctgcctcaccagatgtattatgtataaaaaaaagtcacaacctagattgcagaatttcatgtaaatcgcttacaaaacaacacagatagaaggcagcaattggtgagtttgatctttggtgcccaaatacagctgtgctatttggtgtatacaaatgtcaccaaattcctgcacaaatttgcgggcgggataggggaagaaggaagggatgatgaaggcaatggacacaacagtctaaaaagttttaaaaaattgaatgtaggtaaaatagagctcagaattcctccaccatcatctgcatttgaatctggggagaagtcagccctcccaactttcacttcctactagaatagcaagacacactctgcctccagacagtgtggattatctgccacccgaactgaagtttcaatcactcaaatcctggtgtcatttacattgtttctactgggaaaggtcaggtgtctgcaggggctataagcaaagaaaaacccatcccctggaaccaccagtgtaaaggagagggaaggcgagtgacagcatgtgtcgatgctggatcattttcaggggtaacagaccactacatcctgaggctttttagcaaataggaagctgaaggacaaacatctgaaggagaaattaatctccgtgagtaggtgacaagctgcgataagcccttggggtgtgtgtcagtgtagcacagatgttagtgtgagaactattacttgattcaagggaaaggggagaagggcagggaggggggaaatgacaatgaaaaacaaaacagtgaaaaccacaatcatcttcaccaggcagctgatttttttaaaaaggcatatatccatcaaaggaacaaaacattaaaatacacccatatggcaaagacctggtgtaactggaattttcacctcctgattttgacagtgtaaatttgttcagcccttttgaagagcaatttggcaatgtgatttcagagccatagaaatatgcacatccatctttcaaatgtcccagctcttataaatgtatctttaaaaagactcaaaaataatttttttaatttatatgcctgaggtgtttatttcagcatctctacaacgagaaaaatgaaaaccgaaggtttgacatttgagacaatattaagtaaatcaatacatgctaatttaatgggatggtattaagtaaatctaagaccagcctggccaacatggtgaaaccctatctctactaaaaatacaaaaaattagccaggagtggtggcaggcacctgtaatcccagctactggggaggatgaagcaggagaatcgcttgatcctgggaggttgaggttgcagtgagccaagattgcaccactgcactccagcctgggtgacagagcgagatcctgtctcaaaaaaattaaataaatcaatatatggtaatctaatgggatgctatgcagcactaaaagtatattttaaaaaaaacttgagaaatgcttctaagatgaataatacacaattaagtcaattacctgacttcaaatattattataactgcatgtggacaagaagacaaaaccttcaaggaaaaaaagttttgatattatgagattatgggtaacattgtattcccagccttgaatttctgttattgttactataatatgtgtacaatttttttttagtgaagtaaaacaaacaagtaaaagaaaggttgaaacttcacaatgtagagatcaaccagcctgaacctctcattttacgggtgacaagttgaatacaaaacttcggtggaattgaacgggcttatttcagtggaaatagtgagaaatactcattttcccaagtgcctattagaggtgctgtcattttccaggagccaatagaaaaacacataaaagcagtgcattggtgtgatctgggctgtttctctgaaatcactcagctcgctttcaactgctgcgttccacaacacaatgtggttctacattaaccacattacatcataaagagatcattaaatgactccttatggaaagggagggaagaaatgatgtttagagaacctggtagtatcggaggcatcatcctccttctctgctgcctatctgtgtcgcactcactcttgaggttatgcaaagaaaatgttgacaatttaggtgccagctgttgtttgacgaatagcaaataaatgactgtgaagtcctttggaaaacagagcaaaaccaaattagtgattcccctcttctgcctcccaacatcttcacctccagggccttctttacactgactatatttcctctgatttcattgtcccaatgagacagtaatcctactgagagaacagatagggttcttggagactagaaattatgtttattgaatggttaaggcattgtttttttatcataagctataatttaaagttactaagaaaacaggccaggtctctgtaatgtagggaagcagagatcagattatcttctgggggatagtggaggagggttgtaaccaccccaagtccttgagtgaggatggaacctagggctcaacagcagaaccctaagaacggatatttttgcctaggcctaagaatgtcatcagcattttatttatttgtttgtttgtttattgagacaaggtctgcctctgtcacccaggctggagtgcagtggcgaagtcttggatcactgcaacctccacttccctggctcaagtgatcctcccacctcagcctcctgagtagctgggactacaggcacacaccaccacacctggatatagttttttttttagagatgaggccttctacattgcccagtttggtctcaaattcctgagatcaagcaatccccccaccttggctcctcaaagtgctgggattacaggtgcgagccaccgtgcccagcctcatcagcatttttagacagctacccctctgtggtactctgtggtgagaaataagtttaagagataagtatgcagttatgaggaaaggtgatagaaccacaccatttttatgaataatatactaaaatatattcttaaaaaacttgtcagttgtatatttgataatagcatatttttacttagtccttattaaagatctcgggaaattcaaatctgtttcatctttgatcaggagagaagatgttgcccatccttagcccagagttagaaaggagaaatcatgtgattggccaaggtggtgatgagagtctcttcagaagggaagacttccagttgcaaggtcaggtgacccaatcaactgcctttgaacatctggaaaaatcttctaaaactcttccttctcaagaagtcctgcaactggagctactaatgaaagctctttccagtagcccttacagctaattttctgttcacatatttgtcttctgctgtaaagagctgtgcctcatagtgtattaagggctggcttttcctttcattgtaagggactttccaccacaaacacaaggccaccatggccagcaatgcacaaaacagcagagtatggtcggcccttaaagacaaggtttgacttactcctctcttctcttttttacagacatgtttctctactataaacttcactcttagctttattttcaagaataaaatatttctgttttcaaattggcatcttacgattcagcagactaacccaagaaataattttatggaataatcatatttcaatatcttatttcttttcaaaggaacatttaaaagcttataaaactaggtataacaatgaagctgtaaaagaaagtaagaaaacacaatcaaagttaaaatgaaccaagctaaaaggtaaatataattattggtgttaggctccatatttgcctacaggcttcctaatattcagagcaaaatggaaaacaaactgttatcctagctcaggtcacagatcgctctggccattcccttttatctgccctgtgtgctttcttgggctcttcttctgttaacaggactctttttttctttggggaggttcttctccaccctctgcctagggctgtcaatcaatgtgccccatcttctacccttctgcataggacccccattcccttgacatggtgattttccagaggatgggtacctaggtacctggccaataagagttcgagatcaataagagtcttcccagaggttaatacatatgctttggaatggagtttattgcccactaaagatgctaagctggaaaaatataaattggggctatccattggctaaattccctgccctgaggagcaggcctgtctccagtgggaggaagaaaactgaacagaggagaattgcaaatggagagagagcaagccctgtgtactgagttctggcttctgtccctgaggccctgaaacctggctgctgcagcttttgattctgaccatgatccaagagtccttccaagcagtgagagcaagtaaattccattctttgattagcaagtctgagtagaactctgccacttaaaacaaaaaaagtccaaattaatacatctttcattattggaaaggaatcagaatatcagtttaacaaggagcccattttattttctaaaattaattttgaaagaattttctcacatgggacttaatagcgcatattgactgatgtaatggacaatgccctcaaccacatttttacagtaaatgcagaagcgaatttcatctgatggtttctagtataaaccttgaataaaagccaagggcataacattaaagcaaaattgagttaaagccattttggaagaattagcccagtgcacatagagtgttcaacatttgagtggctcaattcacccaagaaagcttcaagaagttgaaggacactttttaactttgacagctttcttcatgtgttcctttgtttccccatttacccaaacttctgataaaggttgaataacaagtattttgagattctaattttcaaccagagctaacattttccactactaagtgagaaagggatctaaatgcttcagagactgggggaaattagaggagagcaaagttatgctacttgtatctaaatataagaccacttgtctctgcacagaattgacccctgtgggacctttggggatacctgcaagatatgcaggctgtttttttctatcaataaaccttggattttcaacaacacaaaaacacatcatcaattagatccccagagtcatgaaccaaaacagttttcacatgaaatttattcaaagtaaggatttgtagttacctgttgtgatatgggaaaaccacacagcagcttggcttccagtgtgctttccagagtgaattagttttaaagtgtttattttctttattccctcctccccaatttcacccagtatctgaaccaatgtatccatcaaagtagtgtaatcagagagtctgcctagaaatgtattttagttaatcatggctaataccaagcccttctttctcccagaaatcaggatgatgtccctcttggaattacttttgatttgtgactggttttgatcatgattacacttccagtacctggcgtaatacctagaacaaactcccagtaaatatttgccaaactaatgatagaatcagatttatattttgaaatgagcactctgaatatattctagaaattgtattggatgaacacaaaagtagagtgggaatgcagatgaaaggctctgtgcccacccagaggagggccgcttgtggcttaattcaggcagcaataatgggaactgagagaattgagctggtttgagagatatttaggaggtcagttggtgttatgaaaagataagggagaaagaaggaacaaggccagctagacatgttgtggggcccagtgggaaatgaaaatgctgagtctctcattaaaaaatcattaggaatttcaagagggtaatagtagagcaccaaactgtgcattgtacaggacttttactcataaagccagctctaagaataaaacatcctatattcattatgcccggggcgcttccatttactcactgagtgcctaccatgacagccactgtggtaggtacttaattctacctaaaagcaataatacaggattaggatagaagcccaaatgaagaagaaaccaaacatagctccaatttatagcacctaagagcattttcacctgtaaggaattttttctatttttacaggaaagatcaagggatttgccctgattcttggagtacttaagtgcaaattttgaagcatttcaattgttgaaaacatatcttttttttatatactttaagttttagggtacatgtgcacaacgtgcaggttagttacatatttatacatgtgccatgttggtgtgcttcacccagtaactcgtcatttaatattaggtatatctccaaatgctatccctcccccgtcccccaaccccacaacaggccccagagtgtgttgttccccttcctgtatccatgtgttctcattgttcaattcccacctatgagtgagaaaatgcggtgtttggctttttgtccttgtgatagtttgctgagaatgatggtttccagtttcatccatgtccctacaaaggacatgaactcatcattttttttggctgcatagtattccatggtgtatatgtgccacattttcttaatccggtctatcattgttggacatttgggttggttccaagtctttgctattgtgaatagtgccgcaataaacatatctttttttaaaacttagcatatatctatttgccatctcctgggtcaaaaagccaatggaaagctcaatgaaatctccaaatattcttaggttcaccttgacagatttttttctgaagagcaaaagagactataaaaaaacacttatcaaacatgagagattatgccttaaaaccacttaactcttatttaagatactactctgaaatatgtagatctgaaaacagggaagattaaaactcattttgctaatgagggcttagcccttgaggactccctgggtaaaattgtattatgggcattatctgggtccacactctgccctcaataacaagagaataaaactctcctctggtcataggtggagaattagcagcaccttgacattttgaaagaactagtctatcaaaatatataacagggttgtgacaaaagaatgaatggaaaaatcctctggtaggggtaattgcatatgattgatataacaaattatgattcagcatttactgagctcctacaggatgccatccattgtgtcagatccttctgcatgtgcactgagttaaattctcactgtaagattgacatagaccttatcactgaagatattaacaaatcctatcagttgagggaaattcaggttatgagaggtaaagtggtttatccagggttgtgtagctggttattggcagagccagaacttgaagctcgatcaactccacctataggtcaatactgtcctaagatttctggatacaagtttctgtattttcaaggacttcgttcatgggatttccccgtatcatgaatacctctctcttctgaatcatccctaatgcttgtagacatgttccaatatccctcaccttcaaaaacaaaaagaagatgaaacaaaaccttcttccttactgcactgctgttctcatttgctctgctccctttcacagacctacttcttaaaaaggcatttgtcatcaccatctccactttctcacccaaatttatttattacctttttgcttctatctccacattgccaaattcagtcacttttctgttcttattttattatgtctctggcagtatccaacaaagttggccattctctcctgcttgaaatactttttttaataatatattttgtcatctataacaccatatatcctcggtcttcctcttacaatccttttcggttttcctcttaccatctcctcgtagattcttcttctggaatacttttgccagttcttctgtctttgcttaacgaataaatgtagagtgtttctggaaatctttttctatatgctctttttaggtgacccctccagttgcttggccacctgtgtgagccatgtatctatgactctcaagcatagtctctcccctggacttcagacttgaccacccaacacccaaccaccaccttgaaatccccacttggatgtccagaagatttctcaaacttcacactaataaaacagagtcctagatttctctcctccaatcctggtccacctcccctgtgcttctacatctcagtaaacattaccactctccacttaagaaccttaagacagaaatctgaattattcctttttacttcctcatcaccatactaactcaatcagtatgccctattgcctctacctgtgaaacatctaagtccgttcactttttaaaacattttttaagttttttgttaatgcataataaatgtccatagttttggggtacatgtgataatttaagacattcatctaatttgtaaagataaagtcagtgtacttgggatatccatcaccttttaaaagtatttgtctttttataagctagaaacattcaaattattcttttccagctatgttgaaatgtacaatagattattgtaaactatagtcaccctactgatccatgtaacgctagatcttatttcttctatcaaactgtatatttgtacccgttagtcaacttctcttcatggtcacttttatacatatccatttctttcacccaagttaaagttactatcctatcctgcccgggctacacatggtctcctaacttcaacctcattggtctctttcgatttcttaaatataccaagcagattctttccagcttggtgcctccaaggtaactgtttcctctacctggaacactcttcccttgatccttgcatgatttgctttgtcttgtcattccatgaaaataacttttactctgaaaagccttagccaagcccctaaagtagccccacagtcacatccactctcctgagcacttgttaccatctgattatgtttgttggcttgttcgtttgctgactgtttggaatataagcttcacgagggcagctgtgtaccctgttcaatgggacatcctcaacacggaggcagggcctggtacagcacagtcctcaataaatacttgataacaaaataaataatttatgttgcattttggaataataattatattcttagttacacattagctgtatctagaagactgataatactgggggaccaaattaccttttaaaattatatttaagcctactaaacaacaacttctgagttaacaatattaagacaaataaagaatgacatggctcacaattataaatcagctatggttaaagatactcttaaatagtaaaaaataatcaagaaaatgttatggatttggcctctcaaattatgaccctgttgaactatacaaaatataaacaaagaacaatatctgaaacattattgaaatttactttataactgaaagttagtataagcagttaaaactgaaagtaaatatagacaaaataattgaacatatttgacaaaatatagacatctaaaagtgaaaagcattttaaaagtgagaaaactcctagagagtttgaactattatatggtattttcacctttagattatgaatagcatgaatgagatgataacaatggtaataacaataaattcactataagttcttagaatttagaagataccattctagaagctttccatgaattatctcattaactattactgcagtcttatgaagtgagtattatgatcatttctaatcttatgcatgacaattgagatttaaagagtataactttccaaggtgacaaatttagcaggtgtcagaatccagttctgtcagaagaaataagtagaaaataaaggtgggtttgttggcgactagataatcataataaacattgatataatcgtttataatttttcataaccgtagaaattatacaacctgtgtaaagccaaaatactttggtgatttctgggttcagaagataatgccttttgtagctatggagcttagatcttgtagctatatgtgtttgactgagggaagtggaaattctctaactgggatatcataccaggatgatgaattacctgtgcaaactctcactattgcaaggtcctatctacctggaaatataagattaaggtttgcaaatccacttgggtaagtgtgtctcaagattttaacctatttacttataataattttcgtatttgccacctaagttttatacacaagactaccaaggaatagacataagttgcaagtggtcacagcttgacctgaaaacctatatcagtaaaccagtggagctctccttagaacagtaaggaaaagaagtgtaagatatgacttcagctgatacagtcagcaaatacttcttggatctatctgtcccatacactggtccaggccctggaaattgagcagaggtcaaataacccacttccctcatgaaacttacattgatggaatgaactactttttatatatttaaaataaaaataatatgaaaacttgaggtaatgaatgctgggcacagtggctcacacctgtaatctcagcactttggaagactgaggcaggaggatcatttgaggccgggagtttgagatcagcctgggcaatgtagcaagatttcgtccctactaaaaaaaaaaaaaaaaattagatgggcatggtggcacatgcctgtagtcacagctactcaggaggctgaggtggaaggattccttgagcccaggattggaggctgcagtgagctatgatggcattactgcattccagccttggtgatagagcaagaccctgtctctaaaagacaacaacaaaaacttcaggtaaaagtaaacctttctttcctttcatgtcagagaccacatattgcaatgagagtgaaatcacatgaaacttataaataaaactgcccttctatcagaatgaaagaaaggacaggaacaggtcaacttggttattttctctctagacccgtcattgagggtagccaccagagggctacctagccatacctaggtcacatacctaagtaacctgatacaaaactttctcctacctcctcctttttcccacctgtgaacctaacaccctgaaatttagcatctagaagtatctaaatgaagacagacatataatttttgcccctgagctcccacccttttggactggaattggacatatctctggagccacaaatcagagtcacatagatgtgactgccagcttttgtgacttggactcagtatctttttactgcgccaccttacgtttcactcagacaccatctggtgatggattggtccgtcatgcggtatcagtctgcagaatcatcttcagtactttaaggacagtgcagactagaggaaagattccaggttagatgtcagctatttgccaattagatgacctgggtatgtaatgagaatgcatagccccacttcgtctggtaaattgggactgtaattcttactttgtcttagcccacaggatgatatgtatagaaagtgagttataaactgtaaatgaagctgggcacagtggctcacacttgtaatcccagcattttgggaggccaaggagggaggatcacttgagcccaggagtttaagatcagactaggcaacatagggagaacttgtctctagaataaaatagaaaaacatagccaggagtggtggtatgtacctatagtctcagcaacttgggaagctgagctgggaagatagcttgaggggaggagttcaaggctgcagtgagttgtgattgcaccactacactccagcccgggtgacagagcaagaccctgtctcaaaagacaataatattataaataaataaataaacaaactgtaaatggtacaaatataaaagagcaatactaacgacaaataataatacatataatgaatgcattgataatgacagtgaaagttagaagtgattcttttagcacagagataagagattagctcatggctcaggccaggcctcacagattatctgtctcctggtgggactaatgcaagatctgaagtttggtctgtaactttgtcattttggtttgttctatggaccaaactctggagtactgattaacatcattgtctagcagttgaaagctctctgataaccttggggagtgctagatagaatagatacaattttgccttttgattttcctttgcccaaacaagtggttcacatatgaagatgtcttttggaagggaaaaataaaaattacagattcccatgtaatagggaaactgagtcttaaaatccaacaccaccatcttatttctaagtcgtttttacattagggcttgttataaacctaggttattttgttttgcctacgtgtaaatcttgatggattcaaaaattccccaagtaacttagtgagatttcaaaaagatccttgattttagcagcgtttttataaaactgtcagttacagtagataacaatagcaattctattctcctccattttaaactggaatttactgattcaaatttttaagagaaaaagttcctgaacttgtccccttattctaggggaaaccattttggtgcctgtctatagctacttatggcctctctctcttgttttttgagacggagtctcgctctgtcacccaggctggagtgcggtggcaagatctctgctcactgcaagctccgcctcccaggtgcatgccattctcctgcctcagcctcccgagtagctgggactacaggcgcccgtcaccatgcccggctaatttttttttttctctatttttagtagagacagggtttcaccatgttagccaggatcgtctcggtctcctgactcgtgatccacccgccttggcctcccaaagtgctgggattacaggcgtgagccaccgcgcctggctggcctctcttttttgaatgaggtaaaaaagaagcttgagaggcaaaacaaccaacagcaaataaccctagtgtattcattcattctcacactgccataaagaaatcctggagactgggtaatttataaataaaagaggtttaaatggctcatggttctgcaggctgtataggaagtacagtggcgtctgcttggtttctggggaggcctagggaaatttacaatcatggcggaaggcaaaggaggagaaggcacgtcttacatggtaggaacagaagcaagaaagagagccaggaggtgctacacacttttacaagaatttactcaccgtcacaacagtaccaagggggatggtgttaaaccagtcaagagaaaccacccctatgatccatcacctcccaccaggccccatcttcaacactgggaattacaatagaacatgggatttcggtggggacacagatccaagccatatcacctagtaatcatcctcaccttcagttaaagcagcctgtgtgtttactgaagaaattagctacttgacaccaatcttttcagcaatactgctgtcagataagagaatcattgagtaaaatgccattaattgcaaataataaaacgtcattcattcaaatcacgtaatgagaagtttgaattctgtctccaaaaccaacccttacttttgtttatttatttttacctagtacccagggcatgattctgtctatgctgtcataggtctttagattttagttgccattagcaggcattttcattcaatttatttatttatttagagacagagtctcactctgttgctcaggctggaatgccgtggtgcagtcatggctcactgcagcctcaaactactggcctcaagcaatcctcctgcctcagcctcccaaatctgtggaactgcatgcatgtgccaccacatctggccctggaatatgattttataagaaagctgtctctctattaaagttttatgcaaagaggaaaactaaatcagtggacagagctaagagttagacgacccagactttcctccctccgttgcctctgtttctgtctttgcaaaataaggaaatttgactagcttatctttaaaacctctacttgctcattctatgatggtgccttgagatggagattcagtgagagattcttgtttcagtgcttttatatatttaacaaattttcaccgagtacctattacgtgtcaggacctgctctaggaaatgtggatacaacaatggacaaaacggacaaacctatgtcctcatgtagtttacattctaaggcctataaagtattgtctatttgaacacataaaatgtattctcccagtttgggcagaaacaggacttctgcaaggcctggagaagtaaggaagactgaagcaaatggaatccatggcactttccaattttgtactttctctttctgtctctccttactttcatttcttgacctactcctagacccatgcagataccaaattttacaaattttactaccagcaaatagttatctattatgcagttaaactgtgctatgtgtagggatgcagagcaaatcaagacatagcatatgccttcaagaagccaatgatgtccttgtgagaacaaaactcacatatgtaaaaaaaaattgctagttcaaaatgtcagaggctgagaaccaggaatatggcctgaacagttgtgtgctctatcaggagagattcactaaaagttagtagacttcaggaataattttcagtgcacataaagcttgaacttaagtaacataggtagttttcagattttaaaagcaattttcagtaaatacaagtagagatatggcctgcaaaataagagtaggatatagcaagacacatttcttattcttctgacaaggtagtacacagttcatcactttattgacaagatttattgatgtgactattgtgatgtcatcaacaatggctttgaagttcagaacatgagaaagagctaatggtagggactgacttgaaagcctttgcattctaagaatgatgattaggtttctaatgtattattaaataatgtccagcccacaaaaaagatgaagtctgcaaaggtatacacaataactctgtgccttgctatggtcctatctgatctcaaacaagaagctctttgggttgtgttgctggtggttggatgtgttctgagccatagctaggcttatgcacataacaaagtctgattcccaggaatctttttaggaaacacctcccagattaagtaatatttacctacttgtcctctttgaacagtgctcctactgattctttaccctaatgaagttcatgtcccaacccacacccttttcctaaaacaattaagcttttagtggtgacatgatgaaaaagaaaaaaaaaaaatagatgcaatggctgacttttggaaagttcccagcaaaaaaaaatcccggtggctttctgagtctcagcatgtttcttcttagttctgtgtacactgagataaaagtagagtgggagactgagtttaccacctgtgctaaagcagcagctgttagcattggtgacattcattgttacatggatatcaattgagctgggattaggaagccgcctgtctcctcaagcttgttacgattcagtcacttggaaaaaaacaaaaacagactttcggatgaggattctaatgcccaggtgacctgaaagccaggttcagcgtagtcaatgagcaacatgaaatgaaatttccaatcagaattctcattagccttattcagcactacccagatggatgttccttttgatgtctttgtcatagcagcctcacctatgcaaatattgccagtattaccccttatagtaagttgaagaacttttaagggttgtgaactttacataggtaagtgaatcaagtatacttgaagagcctctctgttgacataagtaattagattattggacaaagatctgatctagtaattttcttagtatgtatgtgtgccaaagccaagagaggatatgttattaattagcaagcaaaatttctaacgtaggggttttcccacatcttaagtaaaattctcgaaacctggaactatggctggctctctggaggtgtttcataaatgcttgctgaattaatgaatgtatccacaggcatcttttaagtggctacaatgacattaagaagaaataaggtcacagagtgtagttgccgcctcaggctctgggaaggatgggtctggaaacaaccccacagtagaccatacacattgtttttgagactttcagctcatccatttggttactgattacaagacggtttttttttttcgtctcaaaaaatgctttatttctcagaatcccatttcagcattattggtttttccctcaccaattctattttcagctttctgccttttctcataatgacctgtaggtgataaattagtaataataaaaatcaataaaaaatgataaagttttttttgggggggaaataggaatgagtttcatgttaagaaaagaaggaacgttccagatggaattttctgtaatgttaaatgtacccatatggcttctgggaaatttaggggcatccttttgtattagggtaacctaatgccacctgctttaaaaattcatattaggaaatagccacattttgaccttcttgaacgatgttcctttatcaatcaaaaatataaagggtgttttatttattagtcattgttgaaatccgtaatctctttctatcgccaaattgtcttaaaacgtctgtccagcacatcattgcaaccttgactgtcccttccactgtgtgttgaagagtcacaggtcccagggggagctgcgaagaaacgtaaaccaaataccatttcagtaactgttaagggacaattgtgacgattttgtaatgcttggcatgttttgcttataatcttgtcctacaaagaagcctatcagcagagatgagagatttttgctatgcaaagattagattaatattgatatttgcagaactgggttcaacctgtgggagacctagtcgcaggtcttgtagaatttatagcatattaagaagatatttaaatatttggcttcagtgtgatggcctcatttctacatacctttctaatatgtgccaactctctcttcttcatttcacttgtccgctgaaagatgagtcatcaagtctggttgaacctatctaatatctcttgaatcagtatgtctctgcatctgtattgccatcaccctagttctggccatcctcactgaccacctgactttctgcctaaatggtctcctactttctggtcttgtatactttcaaccctttctctgcaatcagagtgatattgcttccaatgttgtacagacaattcttacaaggtcctgcagcttttctttcagtctttctttctttttttttttttttttttgaaatggagtctcactctgtcacccaggttggagtgcagtggcgcgatctcagctcactgcaacctctgcctcccaggtttaaacgattttcgttcctcagccttccaataactggggttacaggtgcatgccaccatgcccagccaatttttgtatttttagtagaaagagggtttcaccatgttggccaaactggtctcaaactcctgacttcaagtgatctgtccaccttggcctcccaaagtgctgggattacaggcgtgagccactacacccagctctttcagtcttactgttcgtcatttttttccctcccctttctgcaccctcttcactctgctttcccattctctatgcctgggctacatcttaaaagacgccatgttctcctggggtctctggtgtccctgattctggaaatgctttcctgtctcttctctctaacccatttcacttagataagtcctatttatccttgagatttctcataggtggcagtctttttcccataagacttttcctgttctagacctggtggctcacacctgtgatcctagcactttgggaggcacagccagggcgaatgaacccaggtgtttgataccaacctgggcaacatagtgagactccatctctacaaaaaataaacaaccaggcgtggtgatgagcacctgtagtccaggcatggtggtgagcacctttagtcccagctactcaggagcctgaggtgggaggattgcttgagcctgggaggtcaagacttcagtgagccgtgatcatgccactgcattccagcctgggcaacagagcgagaccctgtcttaaaaaaaaaaaaaaaaagaagaagaagaagaaaagaaaaactttccctgatatatttaggttgagactagacaccctcttatctgctcccacaatgcccacgtcctccatcactgtactgaccatactctggtaattggctgtttatctgtccaatgccttccctagaccagaagctcctaaaggacagagcctgtattcccattcgtagtaccagcgttcagcacagtagctggacctgactaagcaccaagtaaatatttgttgaattaagaaaattaaaaaaaaagtgagaagtcaacagtctcttaatcaattgtaaagaaacactttactaggatgttctgacagctactccaaagtatcaaatattttaagtgaaattgtgatgtctggtgacattttttcaatattttagatttcttacacacaacttattttattttcatccactgaagctctcaagcatcttgttaaaataaaataaattagcttggtttctgtatgtgtgtgtgtgtccttttttggggggaggggggctggtggcaggacagggtctcactttgttgcccaggctggagtgcagtggcaggatcatggctcactgcagcctctacctcctgggctcaagtaatcctcccacctcagcctccctaatagctgggattacaggcatgcaccaccatgctcaggtagggttttttaaatttttcatagagacaggttcttgtcatgttgcccagtctggaatatatatatttttttgacttttattttaggttcagtgatacaagtgctggtttgttatatagataaactcatgtcacggggatctgttgtgcagattgttttgtcactcaggtactaagcccagtacccaatacttactttttcttttcctctctccaccctgaccctccacgcccagatagacaccagggtctgctgttcttgtccttgtgtccatgtgttctcatcatgtagctcccacttaaaagtgagaatatgtggtatttggttttccattcctgtgctagttcactgagaatgatggcctctaactccatccatgttcctagaaaggacatgatctcgttcttttttatggctgcatagtattccatgctgtatatgtaccatattttctttatccagtccaccactgatgggcatttaggttgattcctatatattttttaattgacaaaaataataacccacagaatcactaagtaggggaaagatcagctgctgatattttggatgtacttttctcgagtccaaaggataattcagtcaacttaaaatagttatttaaaaatgtgaacagaatttgtggatgttgagacagattcacagatccttaggaaatattaaaacttttgaaaaatggccacaggctctgaaggaaaagagcagttgggcacttaatgccacaagttactcttataaatcattatgctaatgatagaactgaggtggttcatttgggaaaaaaattgaaataacatttaggaaaagctgagaggctggcgatcaccattatgaagagagcagcctgcactatgattagatgccaccaataaggggaccatatataactgaaggatgactttaggagtcattgtaaacctgtcttctgacagcagcttgagacaggaattgcattcttcctctaaatccttttaatttagtaaagccctttattgaaacatttacaagcaaatgtaaacttttaaggattcttacatcccataaaagcagtaattttggcatatagctcatcaacatgaaatgagtaaaaacatgggaaggcagtactttttgaatgttgtatgccatttggcaaatctacatgttcctcccttttttcgcatctccatgttcctcctaaatgaaggagttgttgttgatgttggtttactttaatatgtccaattataccattatcatctatttatcaaaatagtgccatttaattgccttttgctttaagctgtattttatatgaaagattcctagtgttatttctgtcctttggaatattatccagcagagggaattttaggatctacttgataatacagatttgctaatttccacgttagtacttcagtgttgtttagttacacagtttcgggcctcatgatgtgtttgatgatttgggagtgataaaatgagtcttaagtaaaaatcttttaattaaaacaaacaaaggatcagtttttatgggaaaccagtcagtcagcaagtacatgtgttttaagtccagaaggatgctcaagtggaggggtagagagagagagcccttgggatccagggattgtagagtaactgctcccattatgccaggcctagcagggctgtcccactgtctctgccctcacactgaccacttcattactggttgtttttactgagcatcttttcagagatttctgagaacatggtaattttcccagaccatacacctgagagatcaggtactatgttgcctttaaaaacaacaacaacaacaacaaaaacctttatatttttcctctttttatggtgaaatatggcatactttattatttggagaaagacagaaaacatggtttttttctcccacaggccacaaaataccatcttcctcttacagggaatgagacttttgtataaagaggcacaatttcctgtcccactaggagaaaattattctcttgtctgagtctcaacagaagcttgtgttagttgctgttataaattaaactactactcaacccagcagtcccattactgggtatatatccaaaggaatataactgttctaccataaaaacacacgcatgcttatgttcattgcagcactgttcacaatctaaaagacatgaaatcaacctaaatgcccatcaacagtaaacaggataaagaaaatgtggtacatatataccatggaatactatgcagccataaaaagaacaaatttatgtcctttacaggaacatggatggagctggaggccattatccttagcaaactaatgcaggaacagaaaaccaaatactgcatgttctcacttacaaatgggagctaaatgacgagaatacatggacacatagaggcaaacaagagacactggggcctattgagggtggagggtgggaggagggagaggatcagaaaaaataactgttgggtactaggcttagtacctggatgatgaagtggtctgtacaacaaacccccatggcacaagtttacctatataacaaacctgcacatgtacccatgaacctaaaataaaagtttaaataaataaataaacttggtctccagtgttaaatatgatatgtcatcatcctcatttccttcatccagctattttatattcctcccatctgctctgtcctaatatttatattctgtaggccttatcgtgcatctcttattccttctaaatatgttttactctgcctggttcctccactcttttggctcttgttttcctacttcctttaatgtaacagtaacacagtgagcacttaatagcagtctagaataaactctgtgttcctgctttaatctatatctggtctttatctctcacctttatctttacctctgtcactgtgtggacttacactgaaaacagaactataccatgcccccatctccatgctgagtagctggtttataaatcaggagagacaatgctctttagatattcttaaatttgttataattctttcctgttatccagctcctcaacctcccttcccagctctgtctaccactttgtatcacttaagccacgttttatctacgtcttctctgtcactaacctttagtcccttgaaacaggcacaaccaaacaggactgacattttgcaagtcccttgagattttgcctaatccttcacagcaacctacaaagtcaatctggggctggtggaaattctcctctttcagccttttccttcttttggaatttgggggtgttttcacagagtgatttaccaagaaaacattctaaatcctcaaggatcacttatcccttacctcgtggttgtttgctcgagaccaagcacaactggacatttttgaacttacgtctttctccctaccctctttgttctccttctcccccttcataaaatctgacttcagtttggccttcaagtgagattgacttttagccccttccatttggcaaatccttcaacaaaaaaacagaagtgtcatttttacggggtgacaaagcattaagaagatcgctttttcagccttgctgtgcttcattataggtaagtcctcatgtggcaccttttacaagaggaagtattgtcatgctaacaaaatggtttcagatagtatgaaatcagtggtgagaagaatggctataaggaatgggctctacaattactgtcactctcagcaaaagagaacgcaaggaatgcatatttcatctcatggcgacctgaggatcgtcctcaattccatatgtaatactttctaaataatggtgacctttttcacgtccccttcctgtatatacaaagtactatgtggataatgcagcctgagtgagcttatgagctaatgcagggatttttattattaacaataatcatagtgaacaacagtttattcatgtaagatcaagcaactagtaagtggtagaaccaggactgggtcatagggtaggtacatgtgtaccacttttaaatattgccaaactactttgcaaagtattgaattattttacattcccaacagcagtgtctgggaattacaataatccttatcatgcaatgactggcgtattcattctttttaatttttgacattctaatctgtgtgtagtgccatctcattgtagtttgaatttgcatttcgctagtgactaatgatattgagcatcttttcatgagcttatttgcatatgtatgtcttctttgctaaagtgtctatgcaaatcttttgcccatttattaggttgtttgttttcttatattgagttataactttttttttttttacatattctgcaaacatttttaaccagatatgtagtttacaagtgtgttttcccagtctgtttcttacctttacattcccttaccagtatcttttgcaggaaagatgttaaatctgttgaagtgtagtttatcaagttttttctttggattgtgcttttggtcttgtagctaagaaaactttgcccaaacaagataacaaggattttctcctatttttttctaggcatgttatggttttaggttttacctttatgtctatgatccattttacattaatttttatatatggtgcaagttatggatcaaagtttagttacatgtggatatccaagcatcctaagcatcttttgcccaaaagataatcttttttatactgagttacctttgctgctttgttaaaaataaattgactatgtgtaagtctatttctggtatctctattctgttctattgatctatatatacttatccttaaaccagtaacacgctgtcatcatgactttagctttataataaatcttgaagtctggtaaattaagtcccccaatgtttttctttttagacattttttttggctactgcaggttctgtgtattttcagaggacttttaaaatcaacctgtcaatttctaataccaaaataaagttctttagaattttgattgggattctcacgaatgtgaagatcaacttggagaaagctaacaacttaatattgagtcttatctctcaacttattttggttctttaaaacttctttcaacaattgtttttcacatagagatcttgtatatattttgtcagagttcgcccaaatggtacatttatttatctatttatttagagatggagttttgttcttgttgcccaggctggaatgcaatagcacaatctcagctcactgcaacctccacctcccaggctgaagcgattctcctgcctcagcctcccaagtagctgggattacaggtgccagccaccacacccggttcattttgtatttttaatagcaatggggtttcactatgttggttaggctagtgttgaactcctgacctcaggtggtccacctccctcggcctcccaaagtactgggattacaggcatgagccactgtgcctggcccaaatagtacatatttttgatgctattattaatgacattgttttattaatttatatttcaagttgtttatttctattacagagctttctctactatgctgacatccatctgaggtctcttctcaacagaattgcctttaatgtccacatttctaccaagcttctcttcaaggaaatctatattttttctattactcaccttaaaattcttgtagcctctatccatttcccaattccgaagccatttctacatctttaggtgtttgttagaggagtaccccactttctcgcatcaaagtctgtatcagtcagtgtttgacagagaacagaaccaataggagatggataaataggtaggtaggcagattagtaggtagatagatagataggtagatagatacatagatagataatctatagatatctaatgcctggaaagctaatttttctatatattttctctattattttagttgtttcagatagaaggacaaattggatccctgttactctatcttgaccagagtgaaaatctgattaacttttaatcctcagtctcctcatttgtaaaatgaaaataataataaaatctatttcatgaggttattgggatgttagttttgttaatatgtataaaaacttggtgccttgtacataataaatactcaataaatgtatttaaattttgaacaacatatttgacatattgtgatttccaagtatctatactcttttatgtttgttaatgttatatatggaggcaatctgacttaacatcaaaaaaaaaaaaaagaccattcataagatgtagtcagtaccagtaaatgagagcacattttcctctaattgggtgtgtggatattggttttcaccctacttggagtttctgactatttgtcctagtgaccatcactatattcatttataatattattaaaatcaatggatgagtcattggttaccatgtgtattccggttctgaaacacaccctcctcttccccagccagcactcacctcagtgatacccagtctattgcaggttttttatgcattttctaaattacatgaaagcaagttgacattctttctttgtcttagtcttccataccattattttggcatgtttaaagtatcatccatctgattatgtttggaaataaaagcatgaatttgttaaagacatgtaccttccaaactgcacacttattgtgttttcactttcttatcattgtcccttcattagagaaaaaaatctattctgtgaagtatttggttttttatgcagtctgctctgctctaatatacacaaacacctgattctgcaatgagaattagttggtatgtgattgttgagcagggaaatagtactatttcacagaatttcctttagtttatatatggatttttcttggctgaagaagccagattactggagtaaaattataatctccagcaaaaataaaaaaagaaaagtccacagctcagcccctcctctaaagagttgtacagcgcagccttccacggctcatagcttacagcaggtctcccttccctgccaccaccctcacagcaaccccactggctgagcactctgtttttatttattgtctgagcactcatcagtgcagctctgtttaacatgttacctgtatttccacccaaattttttttttttttttttaagaccaggtctcactctgttacccaggctggagtgcaatggtgcaatcttggctcactgcaacccctgcctcccaggttcgagcgattttcctgcctcagcctcccgagtagctgggattacaagtgcccgccattatgcccatctgatctttgtatttttggtagagacagggttttgccatgttggtcaggctggtcttgaacccctgacctcagatggtccacccacctcagccttccaaagtgctgggattaattacaggtgtgagacactgcacccagcctctaatattttttagaacatccattgtggtagcctcctgccatgctgaacagttggcctgggtggtgcaagttatctcccaattattgggaggtatcaattatcatttttgtttggactttacaaagttttataggttctaagtgatatatcccttctgcagtttttctcataagttctgtttatacagtatgtgattttgcagaatatgagttttttgagattatatatattgcaatatcatagaaacctttttgtttgataatctttgcttaaaataacctcatttattttgtacgaatgtacaaaaataaaacaatgtagtacttattggctgtttttgtggactgaggtagagatgtcaagaagttcaagccaaaaaaactgaaaatagttaacagaaacaggcaaatctcatatatcttgccctgattattttttcattagagtccctcctattgaggaaggttcattagcatgtgatgaaacacattgagggggattaattaggaaatataaaagagtctcaaacttctgatataaggtaaaacacgttaattttatgtgtctttaaaaatgtaattagaaccttctgtttgtcttttctgagacacgtatttaaaatttccctcgactcaactgataatctgtgattttgattttcatcccaaagtgacttttaaaaaagttttggggttagggggatgtggtggctcacgcctgtaatcctaggactttgggaggccaaggcggggcagagggcggcagatcacctgaggtcaggagttcgaggccagcgtggccaatattacaaaaccccttctctactaaaaatacaaaaactagccaggtgtggtggcaagtgcctgtaatcccagctacttgggaggctgaggtaggagaatcacttgaaccccagggcaaaggtattagtcagcagagattgctccactgcactccagcctgtgcaacagagagagactttgtctcaaaagaaaagttttgggtgaaaagtagaaaaaaagtcataactttgtgtagagacttttccctcctgtaattctttttattatcaaatatcaggtattatagggtataagccagtgttcttttttatgatttccagaagtgttaaattttccatgtcttctgcatttgaaagtaataggtttggaaagagaaaagctgttcattcttcaagtacatgtaagtttaagtaccttgcagactttgttttgcaggaagcttccttgccttctccccatatcacctctctgcacctcttcacacccatgagggtctttatagcagtgcagtccataaattgttttgaggtaccaataccagtttcttggatattttcttacttaggaacataaatacttaggctgccattgcgttaataaggaaatgctggatagtcagaatcctacattaacccgagcctaaaatctgtagtatcgcttcaaatatctatgtagaaagcatagtttattaaactaaacatctcctgtaatcccagcactttgggaggccaatgtgggtgaatcacttgaggtcaggagtttgagaccagcctggccaacgtggcaaactctgtctctaccaaaaatacaaaaattagccaggtgtggtggtgcaaccctatagtctgagctacttgggaggctgatcacttaatttaaaacttaaaagacctaatatccagaatctataaggcacttaaacagattcacaagcaacaaacaaacccattacaaactgggcaaacgacacgaacagacacttttcaagagaagatatacacatggccaataagcatatggaaaattacccaatatcactgatcatcagagagatgcaaatcaaatccacaatgagataccatttcacgccagtcagaatggttattattaaaaggtcaaaaaataacagatgctgacagagtaaagggaacgctcatacactgctggtgggactgtaaatcagttcagccgttctggaaagcagcatggcgattcctcaaagaacttaaaatagaattatcatccaatccagcaatcccattactgggtatgtacacaaaggaatacaaattgttctatcatgaagacacctgtacacatatgttcatcatagatagcactgtccgcaatagcaaagatatggaatcagcctaaatgcccatcaacagtagattgaataaagaaaatgtggtacatatacaccatggaatactatgcagccataaaaatgaatgggatcatgtcctttgcaggaacatggatggagctggaggccattatcctaagcggactaacacaggaacagaagagtaaatactgcatattctcactcataagtgggaactaaacaatgagaacctatggatacatggaggggaacgacagacactggggcctacttgagggtggagggtgggaggagggagaagatcagaaaatatacctatagggtactatgcttattacctgggcgatgaaataacctgtacaccaaagccccatgacacgcagcttaccaatataacaaaccagcacatgtacccctgaacctaaaatacaagttaaaaaataaatacataaaaatttaaaaataaaaaataaaactgcaaacgtgccctgctttctggcagtaccccattccctgttccttagttttctctctggcacttatcatttatctattttattcattgtctgtctcccttcactagaggttcatgagggcaaggattttcatgttctgtccactgctatgtccctaacacttaaaaaaaggctttgcattctatagtcattcgatgaaataggctgaatttagctaaaagggagttcatgtcctttgaagaaacatggatggagctggaggccattatccttagcaaatgaacacaggaacagaaaacaaaataccacatgccctcacttatcagtgggagctaaacaaagaaaacacatggacacaaagagaagaacaacagacactggggtctgctgagggcagaaggtgggaggagggagaagatcagaaaaactacctatcaggtactatgcttcatacctgggttacaaaataatctgtacgtcaaatgcctgtgacacaagggtacctgtataacaaacctgcatatgtacccctgaacctaaaataaaagttgtttgtttggtttttttgtttgtttgtttgttttgagacagagtcttgttcttgttgcccaggctggagtgcagtggcgcgatcttggttcactgcaacctctgcctccttggttcaagcaattctccctgcctcagtcacccgagtacctgggacaacaggcgcctaccacaacgccaggctaatttttgtattttttagtacagatggggttttgccatgttggccaggcttgtctcaaactcctaacctgaggtgatctgcccacctcggcctcccgaagtgctgggattacagttgtgagccaccacgcctggcctaaaagtttttttaaaaagagaaaacactttccttaccctttgtagctcattgtctatctaacacaccctgtcactctcatcagccttgaacttcttacaaagccattcaataaaatgaaaggaaataggtgcagtgggccccctctgattcgtggctttgatttctttggtttcatttatccacagtctaaaaatattaaatggaaaatttaaaaaaaaaacaattcataagtgttaaattgcatgccattctgagtagcgtgatgaaatcttgccctgtcccactctgtcccatgcgggacatgaattcttcccctttgtccagcagttcctcactgtctatgcctccgacctgttagtcactcagtagccctctcagttattagatcgaccatggcagtatgggggtgcttgtgttgaagtcacccttattttacttcctaatggcctcaaagcacaggagtagcaatgctggagatttggagctgccaaagagaagccctaaagtgcttcctttgagtgaaaactcttaataaggaaagaaaaacattgaatgctgaagttgttagatcttctatctgttgaactgtgaagaagaaaaaagatatttgtgcatagtatataaagggtttcgtactacccacggtttcaggcatccactgggtgtcatggaatgtatcccctgaggataaggggggattactctatgtattttcgtatccttacatcacttacattatttttcctcagccttgttgaggaaaataaaaacacagaagccaagaaagaaatgagcaagcactggccgggcacagtggctcacacctgtaatcccagcactttgggaggccaagacgggtggatcacccaaggtcaggagttcaagaccagcctgggcaagatggtgaaacgccgtctctactaaaaatataaaaattagccaggcacagtggcaggtgcctgtaatcgcagctacttgggaagctgaggcagagaattgcttgaacctggaaggcagaaaagttgcagtgagccgagatcatgccactgcactccagcctgggcgacagagcgacactctgtctcaaaaaaaaaaaaaaaaaaaagaaagaaaaaagaaatgagcaagcactgaacacctactgtgtgcaaggcacttgatagccttcctgttatttcttcctcactacaatcccatgaagtagttcttatccccattttacaagatacaaaaattgactctcaaaaagcttaagaaatttgcttctagttgcacagtcttatagattttcacttttataagataaaagagcttattcaaatccaagtctgtttgaacctgacaaggaaagccttctctaaatagagtatctgaatccctccctgctcgaaagtctcctttatacgctcatgtttcaaaaatttcacattttttgagatatagatagtacccacccacatcacctctgtttttatggaaaatttacacttaagtggcaattattttaatcagatcgacatcctagagagtgagagttcattgaggaaagaaggaaggtacatttttggatcataatgaggagagatcttgatatttttgaaatttgttttgtcttcccatggtacaaagttttaaaagtacaaaaatatgaacagtaaattctcccttctctcccatccctgtctctagccacccactcctcttctgaggcaagagcagattctgttgccaccttcccaagcaggtagtgcctttaaaaaacaaaaaacaaatgttcacctactatatgcattaccatgcaccttacacttttcatttaataaatataccccagcaatggtgatagcagattttggaccagcagtggggataaagaaggtcctggtcacctaggtgcctaaagagaagcagatgaagagagaagaccctggagaaatgttttcctgttttgcacctgcaggtgcttgacatgcctctgaaaatgatctcagtgctgtgcagttccacagctgcagtggtacccacaatgccaaaacttgggatgcaaaggggcgggggtaatgacaaaaatcagggaaggaggaaccatagcaaccacctgatctgcacactcatgtattttatatacctctcttcaatgcctagtgtccttagacagtaagctccctgaagacacaggctatgcctactttattcatcatcgtgtcttcagtgcctagcaccctgcttggtatgcattcggttcatgaatatatgagggaacctgctgctgctgttcagcattcacacctccatttcaaccccatcagaacctttttcatgcttcctcttttgtagtgtctcagaaactcattctgttttcttcttcatctttttttttttttttttttaatggagtcttgctctgtggcctaggctggggtgcagtggcatgatctcagctcagtgcaacctccacctcctgagttcaagcaattctcctgcctcagcctccctagtaactggggctacaggcttgcaccaccacacccagctaatttttatacttttagtagagacagggtttcaccatggtggccaggcttgtcttgaactcctaatgtcaagtgatccacctgccttggccttccaaagtgctgggattacagatgtgagccactgtgcccagccttcatcttcatcttaaaacttcttccatgttcgctgtggctggggacatgatattcctctttccctcccagttgctcctaaggatgagcaaaaagctcttttcacgtcaggggttgtaccgccaatcactaaaaggaacagttgaaatatcaaacatggagaaattgcagtgattacaaaggaatgcaatggggcaccatacagatctgaatttgccagtttgccatatccaggctgtccctgttgcctctggtccaccttaagctaggtgcaaacccagttggaggaaagaaaggaagttatgtgttctctcttcaaggaagaaaccagataccagcctcaaactcttgttcttaggtcacttctttccttggtccatttcactcctcactctccattcaattaaaggacttgcagattaggttatttgcaagtatttctgtaatttattctcctactcccatttgaagccaccaagcctgtttaatattaaataagcaaatgcttcaagtactatggtgacttcttctgtgcctttgcaactaaagccttccaacagcagaggggagaaatttatatctgttatatacatagatgagtaatttgggaatataaaacaaatatccttcttagaaatatttaaacacagatgcttgattttgtctgatctttctctctcttttttttctctccaaacaactggttacccacacttgtacagtcatgtagagacaaaatgctcatttataattccagataccccatgtaattattgcctatgataatcaggtaatctttatgaaactattcctatacaattttcaaatctcagtttacaatcatgagtattttaccataatcttcataatgccctcttgaatatatttgcttaatatcattttgaatttagtgatatttaagttaacatattttatatgttttcatttcattagtaggcttttaaaaatttacttttttgtgagaatctgatttttgtgagactctgtgaacaaatatcctcactaattctttctaatggtataatgtgaatttgtcattgacaagtgttacaaaaaagacgcatagaaaataaaatattttaggtaatcctaagatagctcttccgcagccagggcaattgggctatgtgtctttgggttgattgttagctctgtcctaaatctctgaatttggagaaggaaaccctggatttgaattccagttcctcaacttactggctccatgttcattccttctttgtcaagccccctaacttccctaaacttcagtgccctcatcttaaatataatgacataatagtgtctctcataagattggtagaattacatgggataattcatcttgcatggtcaggggcacggtctcgggaaccagactgtgtgggtttgagctgctcagtcttggacaaaagattaaatatatctatgcctttgttttatcatctataaaatgggaataaccatagtaccttattcaaaggttgttgtgaagattaaaataaattaatcctgtaaaaatgcttaggtttctggcacatagtaagggcttagtaaaaactaggtatttttacctggtatgtgcaagcactgtatatatcctgatatactttctcatctataattctgtttctgtgcactagtttatatatttatttaatggaattatttttacagatttagtcagattttagaacacaaagcaagtggatacttagtagccataggggaatctgattttgatgtctcctacccaaagtttattcatatttaatattatatatacataagtcttattctttctcttcgtcctttttttttaaaggcaagatctgccttcatcttcggttttctttagtgcttagaagattgccttgctagtgataagtatttttgcttaataagtatatcttgactgtgaaatttgtcaccagttttgaaaggaactctggcagcaaatgaacaaacttaaatccttgtggccagggatcaaaggcaatctcaaaccgaattctataataaagagaagtttggagagagaaagggagtttagtgtaaactcaacttttgaaatccaaaggtatcaggctatcatgggaagagtgtgggattcagctttagccctggggtcacaaagtcatgggtatgctcttatataagtaacttaatcagatctctgtttcctcatctgtaatattaattcccttctcctatttcatagaaatgcttaaaatttttaacagaggtaatatatgggaaaatgctttgtaagctataaaattagtgtacaaatattagggtcactgatactctgtgacgcaattcaatgatttggtagaagactatatatatatgtgtgtgtgtatatatatattatatatatatatatatattatatatatatatatatatatatattatatatatatatggccaaccatatatctattagtagctctctctatatatgttttaaagccaggctggtcttaatcttgtctattgaattcattttgacaagaacagtgtaggatccattagtcctttacaatgaagaacatattaggtgagtcaatacttaattccaaaattttactttagaataagagggatgtctaacatcaattgattgaaggctggaggaaagagcgtggagagaaagaagtaacacactgctctgtgtttttgtgcctctgtctccagaataaaagtggacatgcccttcttcctccttacctctctctctctgtatccctttcagtacatatgtccaacactgccatacacagcctcgctgaaagtatcaggcaaagggagaaacagtgagcattcctacctccagccttgacaacaactatgaagtgtgttgctctaagctctgatcataagggaattagaagcactatgattttttaaaatcaaaatatgcctgtagctccaaaaaagaagaatttgactatagggtctcagctcactgctaggagaggtgtaactgattaaactctggtgcagaatgtatcaggatggaaggaatctgagaagtcaccaagttcaaatccttactttcagtccacagagtcatcctgctgcatttcctttttatgcctgcaaacaaaatgtttctggaactcatttattgtcagtgagtgctccctgggctctgaagcccagagatgttcctccataactcatcagaggcttgggtcatttctgagacaataagttactgctaggtcactgaacatacttggggtaggcagtggggaaggggattctgtgataagaaggtgatcatgtgttctctatttataggaaaatgaatcattctcagggtgatgagcatgtgtcattaaactgttttcctgatcatgaccttgcaccaagctgtttgccctctttgccctgttccctcaggctcagtggtcagggagggtgggccagctggccgagatgtgcagtccagtccagagttcaagaacagtttgaactgtgagactgagagccaagctgactaggtcagagtgagaagccattcctcagcatatgggagctgttagttagtgccctgaagctctctagttatttggggaaggaatgggagaaagcacttagatccctgctgggctcattacctttaattagcttgcttggtctggtggctactgcagagggggaaatctccaaaaactgcaaaaagattgtgcatgatggtgggggaagatactttaagaagggaagaagactctgttgagcttccacaaagaacaggttgttcatacctgaatgcacacagggaatgcacaaattttataaacaagaaggctgggtttgttttttttaagtttttctgtttttaaatttctgtttatttagcgggtacaagtgcagttttgttacatggatataactctggtctttcagtgtaaccatcactcaaatagtgtaccttgtacctattacgtaacttgtcattcctcaccctcctcccaccctcccatctttctgagtctccaatgtctattattccaccctctatgtccatgtgtactcattatttagttcttacttataagtaagaacatgcaatatttgactttctgtttctgagttatttcacttaagataatagccttcaggtccatccatgttgctgcaaaagacatgaattgattcttttgtatggctgagtagtattccatggtgtatatacgttacattttcttgattcaatcatccattgattgaatggtgtcctttgacttatcaaataaatggtgctaggaaaattggctagccatatgcagaacaatgaaactcgttcccctatctctcaccatatgcaaaaattcactcaagatgaattaaagatttaaatgtaatacctgacactataaaaatcctacaagaaaatttagaaaaaactcttctgggcattgcctagggaaggaattcattactaagaccccaaaagcaagcaaatgcaacaaaagcaaaaataggcaaatgggacttcattaaactaaaaggctttggcacagcaaaagatataatcaacaaagttaacactcaacatacaggatgggtgaaaatacttgcaaagtacacatccaatgaagggctgatatctagatatctagaacctatgaagctgtttttaagaacagaatgaggacatgagccaacacccaggattccagtggaaagtgaacagagcaggcacagttaatggaaaatgaacagagcaggtacagttaatggaaagtgaacagagcaggtacagttaacgtcatactttacctttttccatttgcacttcacgaagagatgagctttgatagttaacttctctctctttttctctctgttttcttcttgtgcaaactgggtgatgacattgactctcttcacaggaaagcactaagtgaggattaactaggtaatgagagcaaattggaagggtgatggagatgctccgcaaccttgctgatggatttctcccagcgagagaatctcttcaatgcatctttcatctgtgtcttacaggcagggtgtaccatcgttatctctgcattctgcttaagccatcccctccaaaccctgcctctaaggagctttggcctattccttgaaaggattcttcagttatcccaccaacaatcagaggcagcaggactcaatatccccctgtatggagaaaaactgagacaggagattgggctaagttgtcagtgattcacccccattcctgccctaaggaaaggatctttttctttccttttttttttttttttttttttgagacatggtctccttctgtcacctagactggagtgcagtggcatcatcatatctcactgcagcctctacctcccaggctcaggcagtcctcccaccttggcctcctgagtagctgggactacaggtacatgccaccatgcccagctaatttttgcattttttgtagagacagggtctcagcatgttccccaggctgggctcaagcgatctaccctgctcagcctcccaaagtgatgggattacaggtgtgagtcaccatggcaggccaaaagcatcttctcaaaaatctttcttccaaaatgtatattatacaaactttctggagaacaatttaggaaaataagtattcaaaattcttagaaaggtgcatgattcttgcccactgaattccactttcagcacatgaccattagtctttcatttcttcttctcttcttcacaccagagtgtattgccttcaacaaagaaactaaccacttttagacttgtaattaacctgtcccttcccctcatctgcccacctgactactgaaagtccccagagtctgcttcttagtgggacaccagccttctgcaaggcacttattctctggttatgaacctgtttaaggaaatctatatatttgcacagaaccatggaaatatagatgtgaacaggcttaagtgatcacaacccacattttttttttttttttgagatggagccttgctctgttgccaggctggagtgcagtggcgcaatctcggttcactgcaacctccacctcctgggttcaagcgattctcctgcctcagcctcccaagcagctaggactacaggcacgcaccaccatgcccagctaatttttgtgtttgtagtagagacagggtttcaccaagttgaccaggatggtctcgatctggtgacctcttgatctgcccacctcagccccccaaagtgctgagattactggcatgagccaccacgcccagccagcccacactttttatcagatgaggaactagagactctgagaagacaggtggcttatccaagagttcatacttattcaaggctacagaataaaccagaatctggggcctgtaactcccatatgggcccttctcgagttatggagacttaacggtgtgggacacaaaataggaagaagtagagtaaaactttataaagtaggaaaagaaataatgtttgtactatgtataatggcacttcaaaatccaccattaggagtgtctacagtttcctctgcataatttagaggctgaggccatgtacctcaattcagtccagttttctatccaagaggtgcaagctctaaaataaaggaaaggaatattctttatcagtcatcagcttaatctcaaaatattgtgtgctccataattgaccttcattagggcattatggacaggggcttactatatgctaagctatgtaaatacagatgctcctcagcttataatggggttgtctggataaatccattgtaagttgatccacacataaccctattaaaagtcaaagagcatactgaatgtgtattgcatttgcaccattctaaaatcaatgtgtcccttgtgtaaaatcagttgcatccgaaaagcctgaaacgtgtacatattctttgatctagccatcttattctaaaaatcaaaataaaatcaaaataaaatcaaaatataggtaagttgaactgtcataagttggggaccatgcgtactctgatagtcagtgttatgtatgaacttgaccaagccgcagggtcccagacatttgtccagccattaatcaggtgtgtctgtgggaatgtttctggatgagatgaacatttgaactggtagattgagaaaagcagattcgtctcccctatgtcagtggacctcatccaatcaagaccggaatagaacaaaaaggctgagtaagagggaactactcctgtctgactgctttgagctgggacatcaatcttctggccttcaagctcaaatgcaaatatcagctcttcttgagtcttgaggctactggttttcagactagaatttataccattggctctcctggttctcaggccttcagatttagactgaaactacactatcagcattcctgagtctccaaattgctgactgcagatcttatgactttccagtcattccattccttgtcataactctctttctctttctttctctctctctcctctctctctctctctctctctacatatatatatatatatatatatatatatacatatatatatatatatatatatgaacagatacatcctattggttctgtttctctggagaaccctgactaatatacagttatgtgtcacttaacaataggatatattccaaaaatgtgtcattaggcaatttcatgatttgtgaatatcatagaatattcttacacaaacctggatggtttgctgcacacctaacctgatgcacactgaggctttatgggatagcttgttgctcccagactagaaacctgtacagcatattactgtactgaatactggaggcaatttctaacacaatgacaagtatttgtgtctctaaacatagaaaaacacagtaaaaatatggtattataatcttatgggaccagttgtatatgtggtgtgtcagtaaccaaaatgtcattatgcagcatatgactgtatatatacatttacacttaatcctcacaaaaaccctctgaaataggtactattgttttgattatcaacctaactttaaaactgggaaattatacatagactggttaagttcctcgcccaaagctacacactgcatctggaaggagtctgaattcacccagataccgcgtgctccatctgtttgattcacattctcctaattgtgtcccaaaagcctgaaacatgtgcatattctttgatctagccatcttatcctaagaatttaccctaagtaataatcatggatgtattcaaatatatcgcaaaacatttataacagtaaaaatatctaaacaacttaaatgctaaacaataataggcgattggttaaatgttctatgatgtagttactcagtgaaatactaccttcattacaaaccatgccctcaaggactatttatttacttgggtaatcattcaagctatatagatgagagtaaaaggcctgttacaagcctgaggagagatggtaactaaatatactgtatgctcgatgagaccctgaaattacattttaccatgtttccttaggcttgtagcattccatttttacttctattctgaagcagaaaaaggagattagataaaaactaagaaaaccttaataaaggccgggcgcagtggctcacgcctgtaatctcagcgctgggattacacacatccctgtttttaaaagtgaaatctgccttctatagaacacattcccccacagaaatatactacagaaaacagacctaataaagtggagttttgttcaaatgcttccctcacaatgatgctttaatttgctgaggaacatatgattgatcctagttcacctgctgaacatgcataggcagtgtgcatctctagcacactgattaaaatgaatacccagaggctcaacatgatttcttattaatcagaacatacacaactttgtgaaagggaccttagagccattctctgccccagggtgaactgggacacaggtatagaaacctccaggactctgttggaagagtttttcttctaggttttttttttttttctgttataactgtcctttccaagattaaatgatgcctaggatatcacatcgttcagaagaggttgaaagagggagttatttataaatcctgaaggttctaggaggtttgggcttagaccactttggactcagagaaggctgtgaggtaaggcatgttctaatcttgttgatggaagtcctaatgtgtcttagaagatttctggtcatcactgtctttagggactcagagtcttcctctaagttagtttcaggaccctttgaagtattggcattgctggctcagtccactggctctttggccttcacctgtctgcattatggttatagctgagatgccaggaaaaacacaagatgagtctgttcagctcgaagctgactcaactggtttctaccacctcaattcaaactaggaatgagatatttttcttcctttgctttttagggcaattaatgttcccacatatctccctttttcttgccatttcttagcatcctaaacactaattttgcaaaataatgttgtaaatgctttgcatagtcactatcttatgttgcccttcctgttcacaagacagccgtccgtgtcagttgaagatttctatagatatgcatcatctctgatagataaaggcatgtttcagagactatcctggtgggagtattttacttttgaaaccaactaaatctggttttgctcctgtttgtggtactttatttctccctgtagcaggagagtagtgccaacgtgcctggaaaatcaagtttcaaacctctattgcattttaagccatgttttagaatcttagggtcaattaatattagagttcgacaaaatctctgctctcaaacaaaattatatacaaaagctcagtaagtaaaccaggtaaatgttaaggtgcttcggttgaatctaggtttaggagtccagagaatctaactcaaacctggcagctggaggatacccaagaaactccctgggcttagtagtgtacagtgcgaaaaacagcgatctcatccatgtccttcattttagggagatgatacctaaactttgtgggttttatttcaaagtcacatgttaattagtggcattgtgagggaagcatttgaacaaaactccactttattagatctattttctgtagtgtatttctgtgggggaatgtgttctatagaaggcaggtttcacttttaaaaacagggatgtgtataatcccagcactttgggaggccgaggcaggtggatcacctgaggtcaggagttcaagaacagcctggccaacatgatgaaaccccgtctctattaaaaatacaaaaattagccaggtgtggtggcacgtgcctgtagtcccagctacttgggaggctgaggcaggagaattgcttgaacccggaggtggaggtttcagagcaagactctgtctcaaaaaaaaaaaaaaagaaagaaagaaaaagaaaaaggatgtgaaaggaaagagtttgcaaaaaaaaaaaatgcggcaatcacaatacatttatgtctattcatattatttgaatttgtcattttcttcagtgattttttttccttgggttgttcttatttctacatcattatgtttattatatgaaggaagcagtcagcctcatgtttattctctggtagagaagaggaaaacagtaatttttgagcatgaatgcataagaccatacagtttatggaaatggctgtagcttctctaacctttcccctttcatacatacttgtttccatgtacacttcattccccctttttccccctttaactctctttgtatttgtatccctccttccctatgccctttttactcaattcattccctacatcacaacctgtggtttttgtatctgatcatagttttcaccctattgaaaatcatggctggccaagtacatgttaacaggaaaattctggacagtccctttgtacacaaaccttactgcttagtttcatctgtgcagattgctgtatactcagccctgcagcagagagaccacactgcagcctttagtaggaaaaggataggaatgacaatacactgcagacactttcgtgagtaagttgctaaagcgtcagtaaaacatcatggtgaggcctctgcaatcagcctgcttagatttaaatgacaattctgtcacttacaaatatataaccatttggatagttatgtttgcactttaagcctcatgttagttatctggaatagtatataatattacctacctttagtgtcatcataagaattaaatgatttttgtgatataaagtgttaagtgtggtgccagaccctggcaaagttggtaattgtccccttccttccttccccgctttcaccttccttcctccctccctccctcccttccttccttaattccttctgtccttccctcccttcctcctttcacctccttcccttccttccttctttccttctgtctctttcacatgccttctttctctcttcccttccttccttcccctcaccattctatgagggcataactgggagggttaatagaatggatatctaaagcagcgattctcgaatataggcttttaaccagcagaatcagcattacttgacccgaaaacttgttagaaatgcaaacacttaagtctcacccctaagctcctgattcagaaaatctagggttagggtttaactgtctgtgttttccttgtttttgtttgtttgtttgttttgtcgttgttgtttgttttttgtggttgttttgttttgtttttgagacagggtctggctgtgttgcccaggctagagttcagtggcacaatctcagctcactgcagcctcaacctcctgggctcaagcgatcctcctacaacagcctctgaagtcgttgggaccacaggtgcaccaccacgcttggctaatttttgtatttttggtagagacagggtttttccatgttgcccaggctggtcttgaactcctgagctcaagcaatcctcccaccttggcctcccaaagtgctgagatacaggcatgaagtcactgtgcttggcgttttaaccagcctgccagatgattctgaatttgaatatcctggtgagaggttttaaatcatgcaagtggctgtctgcctccagttaaggtaaaaagggaaaggcctcagcttacactgtggttgagccatatgacaggacatacaaacactattaatattactagagaagcaaccagcaccgttttgaatagctcagtctattgggggtgtgccttctactcaagatgtaaataaggataggaaaaatagcactagtatcaactgccatacaattatttagtcacccttgggtaactaaacagcataggtatgttgatcaaaatgcccttgagtaattgtcagtggaattttgaactctccccaattcaataagatactgctgcaggtattggtgaggtacagggagcatctaaatggactgtctttcattgtctttcttgagggttctaattctttggttttctggagaatattataggatagaatgtatatcagaagtgagacttgggagacctgtgtgacctcccaagcatgacaatattcacagatattcagatccatagaacacttcaggaaattgtctttatgttcaaagatctcatagaacatttagttggatacacttcccacacacatctctccatttgatatagagtcattatcttttcaaactttctttttggtcttttacagaagaacctgttaggatattctcaagatttgttctagtcacacgggggtggagggggagggggggtgtgttatagaagtagctctagatcatttagcttaagagttaaattttttgcaaaaatactttgtggtggatttctgatgccagtccgcataggacttttattattgtaatagtgttttgtctttcttttttaagattaggaaagtatattcaccataatatttgttgttaatcacttattttttatgcaccttttccaaagcaactatattgtccttatcttgaaaaatgaaaataatagcttccagataaatccttatgatagttttgctatcactagatagtggcagagggaaacagaggaaaaggagatctatgcattgtctttgaaagtcaagattattatactaaatgtttttgaagcattttgaaaatacagcgatatttacttataattctcaactatattacagttactggatctaaatgagaagtttgttcatctgtaaagtatttgaatgctaatggtattcttctagtctagtgcattcaattaaaatataacgtgtgttacatatgaagttaaaaatgtttagtaaccaaattaaaaaggtaaagagaaataagtgaagttaattttaataatatattatctttaacctcttttaataatatactctctttaactctttaatatatttaataatatattctcttttatatacatagaacattgtcatttcaacatgtaatcaatataaaaaatatcaattagatattttacattctttttttcacattaagtctttgaaatttagcacgtattttacacttacagtacatcttaatttggactagatgcatttcaggttcccaatagccatatgtgtctattggcgttcgtatcatatttatcatggcagttttaaatgtattaaaatgataagtctataaggtatcttcttaagtaaattctcccaagtataacagatatcagaggtaatatacacctacaaataattattgctaaagtaaaatttgtaaagctattgactgtcagtaaatatgtttaagaaacagtttttcgtattactctaagattgttcttaaaaccagcattgcagttcagtagacaagtgcagatatttgaaataagatgtttttatactacctatgtttaaatttcatgagcttcatccagcactggattttctggattctgagatatgctattcacatttcaacatttatgaaaacagaatacatcttacaattaatgtgttcatttaatgtaatcatacttcttgttttcctgaaactgagttggaaatcatcatggaaaataggttcttctcaacacaggaagagttctcagctattgtatagttgtgtttttgagaacatgcttcagcacttgagagatggatttcctagagtttttcttaaggatcaaaattaaaaggtggaaatatacaaacgctaaataatggaattaagcattggccttggataacagaaggtgaaggagataagagacaactttctgttccagctccactttaaccacaggggacataaatatatgggaccttgtagtatttaaccttgttaatatctccatactgttttgcagtaggcgttggaacagagcttcacatttttctggtggaggagccagtgatctctggatggtgaaaatattctctaaaacagactccacaactacaatgaccagtacaatgtgttttctatgccgctgtcctctgtcaaggggcatcacaagtggctggcctatattcatgtaaaggtagaactagaccccaatcaatgtgccctataaatacccaagtctttaaatacccttagataataaaggtaaaagatgcaagaaaaagaggactgggagagtgggccaagtttatagttctttcaaagtctatttgaattatttaaaaccattctttttttgttaatagattttaattctcatacatgtcacatgtttcttttgcagaattcaaaacatttttaaaaacacccatttcaataatattgcatgcaaggtaaacaagaggttagaataactagtacaacataacgcagcttgactagaatacctcgtcataacacaagtacatcttcttttacatttatgcaaagtgaaacattgtctgtctctctccatagtccagaaaaatctgtggggtaattgctcattgtcccttcacaccctgtttatattgcgcgtcttctattttaatagtcccaataaacagatggaaccacaaaaacacagccgggatggctcagttggtcaatggcatcagagaacttaaagtgcctgatgctgatgactcttccagaaggcaatcctcttatgagggtcagggtctagagagtccacgttgctgctcgtactctctgtgtttaattccagctaacatgacaaagtgcaagcgtatgacaaggactttcagtgtgaccatcagctggaagaagccaagtgcgtacagctcccggtggggtggcacatgctcctcttgtgacttaatggtggcttgtggctccacttcccttgggggttgtttttgttgttcttctctcaggaccacatttattttgatgttttaaaagagaaagaaaagttccaaaaacttcctttctcgtatttcctctttgagatccagcaaaatttctacaactggccttttccagatggcttgcccagaattgctgagagtttgaggcacctcaagctctgggctcaacatcgaaggttctttaaatgtgccttttatcctttagtttctgtcacttgatgatgggtgaccaccctcatctctctctctctctctctcttttttttttttcctactaaacatgagattactggaaatatttcatgattggatacatgctattggttaatccatttaaccaaactcccatcaatggatgtggagtgtttacaacatttttgctctcataacagtgcttgacaatgtagggatttgtcaggttttaatccaaatagggctttatgatacttgccattatactatcagatactttttcccactgatatggtttggctgtatgtctccacccaaatctcaccttgagttgtagtcctcataatccccatgtgtcaagggcgggaccaggttgaggtaattgaatcatgggagcagttttccctcatgctgttcctatgatagtgagtgagttctcaggagatctgatggttttataaggggcttcccccttcacttggcactcactctgtcctgccccttgtgaagagggtgcctgcttctcctttgccttctgccatgattgcaagtttcctaaggcctccccagcagtgtgaaactgtgagtcaattaaacctcttttctttataaattacccagtctcaggtatttcttcatagcagtgtgagaacagactaatacactcatcttttgaatacattatgtgaagtacaacaattttttccaaaccaaaccagacctggctaaatcctttactatagaccccaagattgagagagagggaaaaaggaattgatctgaatcaaatttgctgttatcaagaagtagggtagggaagggaccaatatgagatgtacgaaaattggctcccaaagtacagaaaaataaagatttgacttgcctactcctggcataccatttgtaggttctggccaacatctgcccttctctgagcctggagcttctctctttcaaatgggagataattgctgggcagctagagctcacaggcacgccgcatgatgagtgaggtcatgttaataaagccctgggaaagaaaagcaatgtgaaacagcagggctattaccgttccaagacgattttatacaagtgaagcttaagttcagtgtgatgattaacaagctattagagccaagttattgattcctctatctttagagtagctaatgcagtgtgcaccaataggccacagaccccaagctttccttcttcctgtgctcctgttctttgtaatgatgctttccttaggaaaatgaaaatcacttcgcatacacagtgcaacatctttaaggcaggtgccagcagagaggaaaaacacctaagctgattttgtgtgtttttattattttttctgataataaagattaatgcagatacatgaaaaaaacaaaacataaaaagtaggaacagaaagtcaaatactgcatcttctcacttataaataggagctaaataatgtgtacagacaggcataacagaacggaacaatagacactggagacttggaagggtgggtgagtgagcagggttgagggatgaaaaattaccttagaggtacagtgtacattatgtggatgatgatttcactaaaaccccagacctcatcactatgcaatatatccacataacagaactgcacttatacccataaacttatatttaagaaaagaaatagaaaaaagataatttttttaaagtagaaagagggaaaaaagtaaagcatcatcccaatttctttcaccctgaagcagctagttttgctaatatgatcatatacctatccacacatatgtatatgatcatattaaacatattagtttataacttgttctttgttccttttctaacatactcctcacaaaataatatcattgatagtttcccatttcaattaaaacagatatcaatataatttatcagcaaaatattttatggatgtgtgtacagttttggttaatccatttaaccaaaatcctcttgatgaacacagagtatttacaacatttttgctctcataacaatgctctgatgaacctcatgcattcatctttgagcttttgaccaattttccttctgtggtaaattcctgaaagtagaattgttgggacaaaagatttagagattttgtatctttaaacatattaccagtttgccaacccaaagggtcatatgagattactttctgcctacagtgtagtaaagtgccagcttctcccaacaaccttgccaacgttgggtattgtcaattttttggctctttgccaagctgataggagaatggaatgtctaatggtttttgaattacattctgactgtgctgcatcagactgtaactgaatgcagttgtgatgtatcaggggacctggtttaactcagcacactgtttgaatctgtgtaataactaactatgatataatcaggctttcttgcagttttgaaaaagaagccaaactttcacatggtttaaattactctctcatttacactctccatgtgtgagatcacctgggaagccctttggagatgcccccagtgacccagtacaagttgtcaactgcactccccatgaaagagagattgttctggtccaaaccctatgctctagaggagcatcttggaaacagcactgccctataattgatattgctccattgggtggcctgtggtattcaattcactggaaagtatcaatccctttgccttcagcaataatattttcacagttttgatgtgttttaaaggttattgtctccaggacaggtaattgaggaggcctcacacttcatcagaggccatttcatctttattacacagccacacacaaggcagcattttctcctttcactgatggattatttcaagatttataaggtctggtctacatgaaagcaaacacatgtttgggtacacagtcaaataattcaaagatatagggtcagcaggatcctaatattaaagtcaggacttccagcctgggcaacaaagtgaaatcttgtctctacaaaaaatacaaaaaattagccgggcatggtggctctcgccagtggtcccagctacccgagaagctaaggtgggaggattgcttgagccccaggaagtggaggctgcagtgagccatgttcatgccagtgcactccagtctgggccacaaagcaagaccttgtctcaaaaaatgataataataaataataaaagtcacaactttttcctcttctacctgtgccagagacccactacctaacccacatacacacagacacacacaaacacaccatacacttattcctttcttaaaatgtggctttcaaatatttgctttgcatgcagttttctctgaagatatgaccagtttcaagattatctactctaagttttctgactggttgtcagtcagtcagtttggaaccctgccataacatattttcctcaaattccttgcagatactggaataataatgaatgggaatgttattttgagccgatatttggaaagtccttatttggaattctacaagtttatgtctcctgcccagttcctaagccctctttctagataaccatccagaagataatcatccagcagctatccgggtacattcggctgacttggttagttgggtctaagcagtatatccatgagttctaactcgggtttctcaaactctttttcctttgggtttctcagactcttctctcaaactcaaactgccttctccagtccattgctaaagcttgtatgacctttgctttccctccatttcttgacttgtggcatccactagtcctacattgtaggactagtgtgagcaggtcactcagcctgaaagcactcaccctgggcctctagagctaagttgcctcaacacacttcactatggcttctcagagcacactcaccttgaatgtttagaaaaggtaatctttttggggttcaatgagatcaaaagcacggataccaattttgggatcaggaatcaggaaaatctgggaaatgaagaacgaaatgaggccttaccattttgatacaaagttcatattcaagtgagtcaggagatctggtttaagttccagatctgcctcttactagttttagaatcttgggcaattctaggctggacgtggtggctcacacccataatcccagcaatttgggaggccaaggcaggtgaatgcttgagcccagaagttcaagacatgccttggcaacataggaaggccccatttctacaaaaataaaaattagccaggcatggtggtgcattcctgtaatcccagcaatatggaaggtgggaagatcacttgagtccaagaggtcaaggctgcggtgagctatgatctgccactgcactccagcctgggtgagagtgagatcctctgttaaaacaaaacagaacaaaacaaacaacaaacaaacaaacaaaaaaacaaaaaaaattggagggaatttagttcatatatttgagtctttgtttcctcatctagaagatgtagtaaagataaatgaggtcatatatgattgtccctggcataatattttggtacttattgaaaagcagctattgttttaagtcctttgcatatacatttctatgatttactatatatcagtagcatttctccaacccatcttggctaggcaagcaccactgaatatgaaggaggccaaatagaatgatactatccaagctgcaaagaaacaaacaaaagaaaacatctaaatgcatgcctctttggaatggcatttgcatccgttgccaatatccatagaacaaatgccttcaggcaggagaagttgggataatgtcaatgtttttaatagctgtagtagagtcctatttagaaagcagtaattatctctccatattgattttttacatcccctcaataaatccagaagaaatgtgaagaccatctgtaagtgtgatttttaccaggatcagactctaatttgcaatggctatgtgtctgtttgatttagatcaggggttagcaaactgcagcccacaagccaaaactacctcccccatctatttttataaataaagttttattggaacacacccatcacacccatttctttatatctgtggctgctttcatgctaccatggttgttttatttaattgtaacagagatctaagagatctagagcccatattgcccacagagctgaaaacatatgtacatctaaccctttgcaggaaaaaacttgttaaatcatgattgagattatagtagtattatttctgattgactaggtagtaattggtcccagcatgtaaagtttctaatattaaagtcacacgatagaggagctagaggcttaagaaaagtatacatgaatttatttatttggaataggaagggaaacatccctggtatcatcatgatggcatatagaggcagggctgagagctagaatacagaatacgtcctttgctagaaacagtttctcgggctgggttagagtgggtagaaactatggatcatcctgccgcaggtccaagtaaacaggatttggcgctctacataatggctataaagaaacataaaggtgatttctccaagtgttatgctaggtgagaaatatttaataagtaagagcaatcagaattggtcccatattgagaaagtctgttttggagcccagactaaatagactgtgcagtgagaaatgaaaggtcaatttaggtaacttcatttagggcaaaatcatgacttaggaaatcatgactagataaatatccagtgaagagcagggagagaagattcatcaatggccgtaggttgctgtgaactacagaactgaaacatcaatgtatgaataaagtgctgtattgatggacagatgtgtgcatttttatgtatatgccataaaaaatctgaatcaatttctatttgaaatagagaaaagctagttcagatgttagaaacttttctgacgcaaaatattgtgtaattcataaacaattccttgtgttttagtttacagtatgtccagaatataggacttgcctactgtaatgtataaaacaaaagaacttcaggttgatttatttgttaagtagtagacattctcctaggatgtttatgtttgtgaagatgataaatggaagaatacatccacagaaaatgtagacacaggcccttctctcccagtctcaacaccacaccctacacacacacaatgccttccttctaaccttgtctatactgtctctgcaacacacaaagcatatgcccaggataagcttctctttcaaccacctatcaggctttcaacatgtggtttgaaaagatagtgacattgctatgctctgacatacaccgtaatgtcagtacagcagaagcaagtggaagattctacttttccgataaagatcagttgctgtttcctgtcttgaagacgaaagttgagcaaaagcaaaggtcatctgtgtttatattaacaatgtaagagttatactacattttcgcaacaacatcaggtcattatttatccacttgtcctttttttttttatcattcctttgaactgcctgcatttgcttatcgtgatatttctcagtctgtaaacagcccgagtagctgttctatttctctaaatagagtcttaggtcattttattatccagaattgtaagtcatcagaatgcacccatctgttgtccttccacatctgggctaactttaactctttaagcccatagaaaaagtagaaaagccattgtgatatgagtttgatacttttttcctaccatactgctttccagcatatggttttccctgaaaaatcacaaggaaatatttacaaatatcttatttttctttggacatggcattaaacgtggtagatcctccatctccacttggctctttctgattttctgttaccctaattatccttcctgcgatcacagctgctcagagcctcttcttaccaatttaaaaaacctctaaagatgtgacggctgcctttccagtggccaacaagcagatttccatagcagaggagctgcgactggggcagagagccaaagacagcttgtgccaacagccttgtcaatatgccaatcatcttgttacagtttattacatgcgtgacttgattttcttgcatgtgcgttttagaggtaacaacatattggtaaacctgttttcaatccttttgattaccttcaatttgatagctccttcagtaatgaagaaaaaaatgggctattgtgtttgaattacatttatcaaatgattctaagattgttctaacgtgtgcgacaggataagctctcttttagtcaccaattggagaaatatgctcagtgtcaaggaaatggagaaatgcctcattatttatgttgactaatgtataaatacaatatgaacaggggcggtttcaaccctgcaaacgttttcttccaagttgctctgtattttagctagactagactagattgttcagtggtcacaaactaccccaaaatcttaacagtttacaacaacggaagtttattttctaaatatataacatccactgagtgttggccagcgttgactgggggttgttctccacatcacgtccctaagggaccaacagtgttggaggagtctctcttctcatattgatgttcaccatggcaaaggcaatgatcacagtgaaccacatgctacattttaagcttctacctggacaccacacaagtcacttccactcccatttcggtggtaaagcaagtcaattcaagtctgacttcagcatctttgggaaatataattccaccccaggaggggaagcagatatgggtgaaatgtaataaaattcacctctccataaagtcctagtagcattgttttatttgagtgaattctttttttttttttcttccttacagatcctctttaaaacatcagcctggaaacagtatctgtagaaatcagttttgttagttctaaagcagggcttcattgttgggatgtgttgtctgccttcgttagcagatttcaatcatagccctaaatggaagacacattttagggctgttgctgctatagaactccaggtctttctgcttaacggtttcacacttacgtgtgaagggaggacacccttggccaaaagaaccaaggctgctcagttagctgctggttgtcctccagcaaattcctagaactaaatacctggtgctgaggtgtcacgactcagcaagtcctagaacctgtgcttatgacagcactctgataattcccggttattgcatcactccctgatggaaacccagcttttatttcagcaaaagtaatggattgttccagacccctgacctcccttgaagatgtctttttgttggatctggccctgtatattttccagttggttcaagacctagagaaatttctacagactctctcataccaggtaggtttttgtttgtttgtttgtttgttttgcttttgggataggacctagtcatattcagtccacattggaaagcataaattagtgtaacatacataagcttgttcattccactccatgtgttaggtttttgttagtgaacactgactgcaaaaataccaaggtatagccttatgcaagccaacatagtcacgttggacattagtgatctgagggtggaagtgaaatgaagtacggttttttttttccaagtcaactaaacgaacaggctgtatgttttacaatatgaattgggttgtgatatacaaagtgtttatccaaagttaccctcctctttgttttttagaatgacaagacccaaatgggagaattaggccagaagcaacaatgccctcaggcttagtgaaattgaccaaagtttgaaggtaagtgttttcagaccctggtttcctaggaccaagtcttggcctcatcaaacataatcacagtctccttttaccactttggcccaaacactatgaagccttttgcccactggctcagcttctcttgccatatactgattattaatgccagtaaaatacctaggcaccttggcagtaacttacgcaaatatgtatatttctaattacagggaaattgttagaacatgacttggattagagatacacagctaataattcaagaagaaataatgctttgttttcagtagaggaaaataaaagcttcatttgaataatttttcctcctttctctccctttttgttttgatacttacgcatgggcaataccgtaaactggcaataaaagaagttatcgcaaacagtgtggccatttctcctcagacactggacatcctacatctgttatatggtttaccatccatccacttccttgctatagctccaggtccacaattctttgtcatgtcattgctcttgacctataccatgactgataaccatgtacatttttaagaaaaaaatgtaaattaattaaaataatttaaaaacacatatccatatggtgtttgtgcatatattttgctttttctaatcttatctttgtagttcaaaaaggttaaacctgaatgtgatatgtgtgtgtatggaaactgaatgcactataggttcaaataggcaaggaagttgcttagtaacatcctgttcttgactgtgctatcataatttgcattttccaataaagtgtgtttccagccttaggacagtgctactattattgctggtggattttgtaatgtaagcttgactcattcagtgtcaagatcacctaaggccaaattcccattccacacgaattctctttcaagggatgtcctacccttcaagatgcccttaagaattctggattccttaaatatagaactatttatgcttactcataaaacagggaatgttataatatttctctgcttcactgtgtccaaggaagtagagaaatctggtaccatatttatgagcagcaataaaccatgtgttttgctttttcctaaaacaagcctggcaaactgtttaagaacacatgtgcagagcttgggcacagggtgagagtttggtggcacggagtgaggctagaggtgggcgtgtggagagtctgatatcctgatatcaaagcaattccattcagacttaggcctgagctgctcccagtcatccaagtcatttttactaatatctgacaacttgcaaatattgtgttacgttcaacactgaaaatgaggactgtgcatttccttttgtctaaatgatgattaaatggtgaagcagctacagaagtattgactaacgacagcatccatttactagaaaatatgtcatttgctactgcaaacatttatggtctgattatacctcatgttacactgcaatggtttgggttttttttttttttttgtatttttggtacatcagaaacacttttcccaatgtttgttagtttaagcattgttcaacatttatttattaagcattgactttataaaataggtaccaggaatatgaaaatgagtaagatatgttccctgacatccagtagctcatagtctagagatgtcaccataataataactagcatttattggacaccacctgtgtctcctgaagcctgttacctcatttaattttgacaaaaccttatgaagtgaatattatcacacaaacacacacatttagagaatgaatgtgaggctcagagaagttaaacacattgcccatgatcacagaaccagttagtggcagagttgggatttaagcccagatctttctgattctagagcgtatgttctatctatgaagctcttaccgattttattttatatcaagtgaactgtgtaatacataaagtcactcaggaaacagtactggatggggattatgatactaggcagtgcttactctagcaaataggtatcagagccctggcataggtcctcacttttgctaggattctgtcctactccacccttgctgataaacgggaagccacacgtcctggtccagcacttattctcaggcctcccagggacactcactctccatcacgtagtctcttccctaagtagtctgtgtttccctctgccttgcgggtaacttcatctgtgtgtaccaaacctgtcacccctcttagtagtcctcaaaagacaagacttcaagggagagttaatattctcagagttcatcagaaatacctgtttccaaggtcaagacccaccttagaaaggaggtcttcatataccctgtctgtgcttattttgtgttttcacaacacaaaatattttaacgatgatttaatttagttgtgtattgatagtctctgtcaatctctcagggttttttttttctgagggaaaaaattacattttgtaattttttaatttagaaacaacagcaataacaacttgagtcggtgacttctgaaccatttttgttctgattatcactgtaaacctaaatgtgtgaacactatcagtagggataatatttaccctatgggactgttaagcaatttaagatgagataagaaatgtcacagggaaaaggtgttactccacacatggtagtcgttattatttattgggttgaagtgttggcctcccaaagggcaatggtgatttaatagaatataagcaactaaatcccaggttaaagcagtgaattcctaattgtagaattttcctgttaaactatcaggtgggaaaggcctgtcaagatgtatatggaaggagtgagatccttgaaataattaatacacctggtataactcccatcattaggtaaacctgggctcatccctactagacagtaatagaaaattagaggataaaaggatagtcacaaaaataaatagaatatattgaaagctaactatgtactaaacagtgttctaggcatattttacatttattaattcatttaaacctctcaactccctataaagtagacattactaattatctcccttttacaaaaaaagaaatctgaacctaagagagtttaaaaaatttgcccaagaccacataatcagaaggaagattttgaatctgatttttcctcacagcaaagtccatgcattttccactttatcacaccggtttttgtttttgtttttgtattattatttttgagacagagtctcattctgtcacccaggctggagttcagtggctctcagctcactgcaacctccgcctcccaggttcaagcgattcttgtttctcaggctccagagtagctgggactacaggtgtgcacttgtattttttagtagagacagggtttccaccatgttgcccaggctggtctcgaactccttttactcaagcaatcctcctgcctcccaaagggctgggattacaggtgtgagccaccgcacccagccaatcacactgtatttaatatcacaacgaagtgcagtctgcccttctcaggatgatcttagatctatttttcagcaagtcgcattcgggtggagcaaaagcttttaaatggtggtcaattacacaatgattaaatttagtttaccattataggtcaaagggaagtgggaagagtttgatgactgtgtatttgtcatgtttctagttatagtgtacaactctgcctgtttatctgagtgagtgccaagaggtgaggtcagggcaggggctcttgcacatggcacatactatctgccccacagctattttgacttggacagtcattgtgctgggtggtaaaaattccagtgggctgggtaggacatactggggccctgtttcctctcatctgtgtttgagaactaggcagcattgcatcaaatggaaggaacaagtgatgagacatcaggaaaatatcagaatgaaagagaaatgcaaggctctaaaggaagttccaactcacttcgacaccctccagttagcaaagaggtgacagaatcccaaaagggcaggggagagattatggatagcaggctcctggaggaaaaactaggtatgtccagtagcagatctgtggaaactattagaaaccgagctaattgtggacttcttagcatgcctcaggaaatgggaaggaacttttcccttttgggcttgtattttttccaattttccttgttcgggaaataattaattctttaagcaatgtaacctcctgctgtgatttctcaattccacaaaagagaataattatagattaataatggaccaaaatagaaaaagctaaatgtgtgtagcagataagtaggaaatgttctgtcttgtaaagggtattgtttcggtgcccggcaacacagaaacaattctcatctatgcagctctaaatggatgttagaattcacccctctttcctactggtataaaattttcagtctcagtaggactaacgctttgacacatcctaaacctcaccaggagtaggaaatatttctcatagcataaatattttttcttccttgaactgaaaggtttgtggccttccccatgcatgataactgggcagttttcagaatatacctcacagtaaaacttagacttcacacctgtaatcccagtactttgggaggccttggtgggcggatcctgaggtcaggagatcaagactatcctggccaacatggtgaaaccccatctctactaaaaatacaaaaattagctgggcgtggtggcacgtgcctgtaatcccagctacttgggaggctaaggcaggagaatcacttgaaccagggagtcagagtttgcagtgagccaagatcacaccactgcaccccagcctggcgacagaatgagactccatctcaaaataaaataaaataaaataaaataaaataaaaaacttagacttcaagttttaactattgaaaaacttccatgaattgggtacagtactgagctaaacgttgtatatatgttatttattcaggaaatattttcaggtactatgctgagtgctaaaagcattgttctgccttttaatactaacaatgcctgtgaaaaatatgtaggattatccagactttataaatttaaaacattaggattcagaaaagtaatatgcacatgctcctatactttacatgtgacagactggaatcaaatggtttaggatgccccgaataactgaactcttaatgccccagaagcccagatcgggacccaccactgggagttacagccctctggagccagcttcagaggtgcacaggtttattctcttccctattcaccagtgaaagaagcccagagcctccattccaggcactctgtgcttcccaaagtaacaattacttaatttgacaagataatttaaagagattgccaaaataacttacaggagattgccagtataatcagccctcccatatctggggattctacatttccagattcaaccagttgaagagagaaaatatttgaaaaaaaaaatttaaaataatacaaataaaaacaatacaacatagtatttatatcatattgggtattgtaagtaatgtagagaccatgtaaagtatatggaaggatgtgcataggttatatgcaaatatgctattttatgtcagggagttgagcatctgcagattttgatatggaggcaggggtcctggaaccaacatcccatggatacctgagggacaaatgtaatcaccatgttttcccaggtggatttttaacagtggccttctggagacactatgcctatggtttagtctaattgttaaaaattgggataggtgaagaaagatggcagataggcacaatgggaggcagatatttccataaatgccttttaaatcagatcctttctagattcacttttggctctggatctggaagctatcatcatggcaaccccagagtcccattggtttgcctattggttaggtgggccaaggtgtccacatatcacaaaagagttctcaaaaaatttcttcccaataacgagggagatttatatttaagagcacctttagccaaactgaaggaagggaaagttcacaaatatggtaatagctcaagtcaatgaattagaggctttgtgtagggtaattgttgagacctccccagttgactgaccaaaacaattctttgttggctagcagagttagagaatagaattttgcataatccaagtatttcatataggtcccttctgctgttactggagcactagtgagctattgtatttgtggtcataatattagctgcataggtagttctataaatgtgtctggttaataatccacaaacgtcagtgttttacatttgtaagtaaagaagtctctgtccacagcaaaaacgttaccaggcaatattttttagcattaaaaatataaaataaaatcaagttacttcaaagttctaaagaactagaagtcaataaaattcataaatatttatttttcaataattctggatgtatcttaggatcctaatataggatgtacatcctaatatagttatgtttacctgtcatttattttaattgatatatgccagtacttctatagtaagattttattggtaaaatgttttttattcttcaaaatgcagattcctttcatagggtatattcatctaccattttccattctttgaaatctgaaataagtcctaaccttatacattcaccaggagtgtgtattaatcacttctcacactgctgataaagacatacctgagactgggtaatttataaagaaaaagaggtttaatgaactcacagttccacatggctgggaagacctcacaagcatggtggaaagtgacaggcacatcttacatggcagcaggcaagagagaatgagagcaaagcaaaagggaaaacaccttataaagccatcagatctagtgagacttattcactaccacgagtattgtgtgagggaaaccacccccatgattcaactgtcttccaccaggtccctcctacaacacatgggaattatgggagctacaattcaagatgagattcagatgggaacacagccaaaccatatcagagtgtatactttcattttattcctcaatcttcattccttaagttttcaacaaataatttgcttttgaaaggattaggagcttaagttggctttatagttatccagtaaccttttgatttctccaaccaatgatttgtaaaggaatcttcagattcagatttatcctttcctacttcatcttcaattgctaaattaagcatgagtcccatcactgagataacagtctttcttggacagagttatgccaggtctttttctatgtaaagcagtcatctattaggctgtcgttggtctgtcaagatgaaactgtgtgcattggatccatgtgaatgaacatagaacattatacaaatattgtatgtttctattctttgcttgaagcttctggttacttagatcttatagtgcttcatagtataaaaaatggttaaaatacttaaaagttttaaagataaagatgtcagtgtcacagtgcataactgggttttacatggtcaagtatacacacatacacacacacacacacacacacaatttaaaaaatctctgatgcactatgccatactcagcaccaatccccattacaactctcccaatgtttcctggccaggcaggtcaccaagatgtttgggactgtttatgcctttgcacctactcatcataatattgtgtggggatcaatgggagagatatttggcccatttttaagccatatcaggggatcttccacttcctaaactcacttagacttggaatttaagtctagactattttgtttttaaccttgctaacacctacctacctacctacctattcattgtccatagcctaggtagtcttgaaaaaccctccattcccgcagcttcccccaatgcctcctctgaactcagtgtcactcctgtgtgcctcctttagtgttttttttgtttgtttgtttttgtttgtttgtttgtttttgtcattgcactcaccaccttatattgtaaaagtctattactaaggaagtattcctccctcctttatgtgcagaattccttgacagaaaggataggtcatgtttacctctgtcttgcctccaatgcgcagcatgaagcctggctctatgatcagctctaaagaaatgcttgttgatgggcaaataaactcgagaatctcacaccagagccagaccggaagtttccttcatttcatgactggttttcacaaaaacaagcattagggagagtggaaggaagagcttgcaaaataccttactactgcattatgaatgtggagttgtaattttgaggttcttatccatgaagatggtccttaaaattcagaattttaattaccaacataacaccatcctttcttactagtatcattattttatactatgttttcagtaggacatatctgatggaaatacatttcttttgatattatttattataactggtgagctacattccacccaatagtaaatgcctctcagcaaaaagatagatacttttgatagttaatatattcagatattatgttgtttgtggaaaccataacttaataaattttaaaacagtgtcttctttaaaagtaattttttattaaactttgtattttgaggtaattgtagattcacatgcagctataagaaataatgcaaacaatactttttacccagtttcctccaatggtgacatcttgaaaactatcgcacaatagcacaactttgatattgacactgatacaatcaagatacagaacattttcatccaggcatcccctgtgcttagcccttttgtagctacgtctacttcctttgcccaccctcaccttaaaaccctggcaataattaacattttgtcatttcaagcatgttatataaatggaaccatagagtatataactttcaggtattggttttttccaatcagcataattctttggagattctttacttagcatacttctctggagatttatctaggtgcttgtgtactagtagttcattctttgttatcgctgcatagtatttcatgctagggatgttgagccatttacccattgaaagatacttgggttgtttctagtttggggagattataaataaagctgctataaatactcatacacagatttttgtgtaaacatacattttcatttctctgagataaatgcctaggaatgagtgtgatttctagatctgatagtaattgcatgtttagtgtttttaagaaaccaacaaaatattttccaaaattagatgtgccattttatattcctaccagcaatgtgacagcaattgtttttctgtatcttcaccagcatttggtggtgttactttttttattttagccattatgatcagtgcatagtgatagctcattttggttttactttgcatttctttagtggctaatgatgttgaacatcttttcataggcttatttgcatctgtatatcttctttagtgaaatgcttctctgttcctgttgcctattttctaattagattgttttttgactgttgagttttaagagttctgtatatattcttgatagcagtcctttgtcggatatgtgatttacaaatattttctcccagtccatagcttgtcttttttattctctttactgtttttttccacaaggcaagagcttttaattttgataaaaataactttttatacttaattggcaaccaaatacctaaatgtcttttgatagaaaaacttgtcctagataatgtaaaatcattttacatattcacagatccatctccactaatgtcatataagtttaaaaatcacaaagtaatttgaacagattcctaaattataaattagttaacagttattttttgctctaatctttagttgtacatttacttcaaataaacatttgttaaaaacgtactctgtactgaggaatgaggatacaaaactcataatttgtcatttctttgcttcagggacttacattttactggattacatctaaatttttatttggcagttttattccaggaagatcatgacagtcttgttttctaaatcttaactgccttttgatgaaaaagaaagataaggctttaatttctctagtgaaacctgaagaagtaaaataaaataacttgtatgtcccttcacaagccacagtcagaacactgtcacaatctcgacctttgctccccaaaccctattttgcaaaccagatgctatttctttggacattacaggctattttcaaaatacatcagaacttaacaaaacatcatattagctaaatagcactataagaaactgcttataatattaaaattatgtcttgagtttataattatataaaaattgaatctaccctagagcaaaaattataattaactactaaaaaatcgaataagtgatttttttttttttttttgaggcagggtctcactctatggcccaggctggagtacagtggtgtgatcatggcttactgcagccttgatcttctgggctcaagcaatcctcatcctcccacctcaacccctccagtagctgagaccacaggtgcaccccaccacacctggtatattagtttattttcacattgctgtaaagaactacctgagcatgtgtaatttattaggaaagcaggttaaattgattcagagttcctcctggctggggaggcctcaggaaacttacaatcatggcggaagacaaacaggatgcaaaacacctcttacaaggtggcaggagagagagagagtgagaggggaactgtcacacacttttaaaccatcagatctcgagataactcactgtcatgataatagcaagggggaagtctgcccccatcattcaatcatctcccaccaggcacctcccctgacatgtggggactacaattctagatgaggtttggttgtggacacagagtcaaaccatagcacccggctaattttcttttcttttctttttggtagatatggagtgtcactatgttttgtttccctagctggtcttgaactcctgggctcaagtgatctgcccacctcggcctcccaaaatgctgggattacaggtgtgagccagtacacccagccaagaagtgatttgtataatggcaggattatgaatgattatttctgtgtctttaatttgatcatatttttaaaacagtcattatttttggtcatcatgctatatactacagagagcagtttttaatttgtgaacgtgtaagtcaacttgatttagctgaacatagcagagtcatcaatcaaactgattgatgactaagggtccgcagggtaacacatcatcatagttgtttccatggtgatgaattatgatgtcacaaactcatcaagactgtgactcagtgaaccatctagacagaggatgaaatgcagtagttcaccaacatgtatgccatctttgtattatatggtattattaattaaaacgaagggctgagtatttctttcattgagattacatgaagatattacgtatattcagacttgcctgaacacggctatgctggttttaaattgaaggttttcacaaagcaaaaaattgagaaacagaatttgacatagaattgtgtatttattagaaaagatcttttcttctcatattctgaaaagcacactcattaattacagttaaattcaggcaaatttggcaaattttcgtcagtatacttattcttttgttagttaatagctttgcttttcagttttagatattggtattaaatatataaagagaaaagaccttagtgttctcatgctcagagattaagagaatagttataggtttgaaattaggcactttccctgatagtttttgttggtacatgttttaggttatgtttctatgaacaaccagatgcaaacgtcctggcattcatcctgcctgcttgctgtttgtaccatctccgtggtagcaaccatccaagctgctggaagcacagactgagctctatgagtcaattattttatatacctgggaacgtgctagccttcctgtcactctttgatgtcactatgtagacagtttgcagcctaggcaacatggtaagaccctgtctccaaaacttccaaaaattagccaccaggtgtggtggtgcatgcctgtagtcctagctactctgaaggttgaggcaaaaggaaccctcaaccccaggagtttgaggctgcagtgagctatgatcgcaccactgcactccagtctgggagacatagtgagatgctgtctttaaaataataataataattttaaaaattaaaaaatatctagacaatttctctgctttcaagactcttcaaagatctcaaagagaagctttactctggagtctcaacagaggccattcaaaaactcaacctggtttttcaacaataaattagaaatgtaatgctaacagtaggtgccaaggccgaacatcagggaaaagacattagtgaccttgagttctagactagattttaccagtttctgaccttcaactctggtactcgattttctcataaatgtgagaaaatatcttaaccgtatcacagaattgatgtgagaattcaaaataaagcatatttaaagctcctaggttagtgcttcatttatgaaggtcagtgcttcataaatgatagttatttttttccattcaaaatagagataaaaaagactttatctcactaatgtgtcatgcaaataaggattaatcctgttttctattcctgaagcatacagaatgtgatttctttctccatcatttccatctgactatcatctgggagaacacacagctgctccacatctggtgcaacacaggcagatgtagctgtccagagggagaagagtgtttgcttttctccacctaaacactgaccctcttctgcttagattcaaagactgtcttccttctgcaggtttacctgagcctggactcaaagaattaccttcattatgagctaaaggaagtcaggcccattcttcttctgcctggcccctctggctctttggcacttcccacatcctcctcatttggaaaggcttcatgactttctggttcacaaagcagctctgttgttgcttatttccactacagggaaaaagtgaaacacttcactcagggcgcagaacaatggaagtccctggaaggaaaggcttgcaagagaaaaccaagtggcttctgagatattcgaaagtccagttgttttccctttttaaaaattttcagatgctctttgatgccatttcataaagcctgtgattgggccaaaagtcttagttcaccatgtaccacaaatagtgtactctatatagcatatgcttaactaagaaaaaataaagatttagaaatagatgtattgaggacatgccattaaaagcagcttccattgaatcaactgtttttcagagtactgtcaagattaccttaaactagtctaatcaaggtaggtggtggattccaaacttgggaaaaagtgagtctttgtattctgtgaagtttaataactacccaaggaagaagtgttggatacaacaactatgagtatcttagaaagtatgtcttttttttttttctgagtcagggtcttgctctatcacccaggctggagtgcagtgatgtgattataactcattgcattgcaatcttgaccccctgggctcaagccatccttccatcttagcctcccaagtagctaggactacaagtggatgccaccatgcccagctaatttttttcttaatttcatttttgtagagataggatttcccaggctggtatcaaactctcaaacttcctggtctcaagcagttctcccaccttggcttcccaaagtgctggcattataggcatgagccaccacacccagcctgggtgtctgtctttatgctaaatgtccgagcctttccatttgtcttttgcctcttcataaacctctgctgagctttatcaggtcattcacatctttcattacaggcaagtggtaaacttagtaatatgcttcctctggtgacaatgggcaaaggactagaagcataagtaaagaaatagtagactgaaataagcggattttgacatgcaaaaagatgcagcaaggtgaacctggttaagaaatagactcagagagcttgaacatggaaggatgctaggacaagtggcagctaaggcagaaagacagccatggttccagatgtctggggaaacaatggaaggcagatattacaaagttttccattttgtaccagaagtgtccgtatgaacacaaactcctagtaagtgttcttaattgttctgtgggctgatgtgcatttttctcctacaataggaactagcaatctacatattatttaccaagccttcctagatagaagcatttatgattattttttgtttatataaatgtcttgcatttactagaaaatcatgcttttcgagaacgcatttctattatggagtttcttaaagagagaaaaaaaatgtatggctttagaaaaatcctagtgattttttgacagtatgaactgtattgtgtgttcttgtcttggatcaatatcatggcacaatgctttgatagtgtctgaagattaagatatacaatacaatttcctcccttcccttctttcctttttccttccttcctttttcctttctttcttttccttccttccttcctttctttttctttctctctctctttctcttccctccctccctccctctctctttcctctttctttctgtctgtctgtctgtctgtctttttcttgagatagggtctcactttgtcacccaggcagaagggcagtggccctatcatatttcactgccacctcaaattcctgggctcaagggatcctcccgcctcagcctctcaagcagctgggactacaggtgtgcccctccatgtgcggttaattgtagttttttgtttggggtggttttgtttgtttgtttgtttttgtagagactttgttgcctaggctggtctcaaactcctgggctcaagcagtcctcccactgcaacctcccaaaatgctgggattataggtgtgagccaccatgtccagcccaataccattttcttatgtttcccatatatgcataattttacttgcatgcaattctgaatggatgaaacatgttttaatcacctatttttctactttgtagaagagccaaggtaacatgaactaaatcattaaagcagttgacttgttagtggattgtgataggactcaggcatttcccaaagggggaacccatattttggtaatcccagacattttaattatatttttctatccattcctcaatgccacaatgaggaacagcattctttcctgggaagtctcacaattttgtcaaaagtagaagagttgcctttgacgaatacaaatccagcaataaagaagaacaggtctaacaaatgaggccaccttggaaaatgtcattttgcccctttgagccttgcccatcttacctttagaggaagagatgggactgaatcagttcaaagagcctcgatagctttaaatgtctgtgattgatttttctgcagagcaagatcaaacaaaacagtatttcctagctgctgcccttacatgtagtggtgattcacagagaatttggggaggaaagtagccattatgggatgttttgcaaaaggcaataccaagattgatcatcacctgagggcgatacactatagttgttcctctgtatccatgacagattagtcccaggaccccttgcagataccaaaatccacagatgctcatgtcctgcttataaaatggcatagtatttgtacacagccttgtatatcctcctgaatactttaaatcatctctagattacttataatacctagagttgtataaatgctatagaaagtattgttatactgtatttttaaatgtacattagttttattttttttccgaatacctttttatccatggttggttgaatccacggatgcagaacccatggatatggagagctgactgtaatagtcaaagacaagagtggctggtggtaagcacactatctgtccacaagtgaatttcccctaagaatcctgctggtacatttcttcatttcttgagattattgaaccacgtgatttgcctcactgcttatttcaccttctgggtgacatgggctgtgaatgtgcagttcaaggcctaaatattagccctgattcaaaatggacattaaccaaaaaaacaaacaacaatgatactggccaactgacttctctcacttctctcttctcttttctttaattcattccttacctatttagaatagctgaggctcatttttatcttcttatgacagccagaattgtcatctattaagattaagtaaggaaggcataattgatattcacaaaccaccccaggatttatcagaagtgagggtgtttcatatggattactaattgtctaaaatttggctctaagcacctgaagatcactaggcaggagagaagagtagggtttgttgtacatgagaagaggctgtggggtggggatgttcaccgagaagactgctttggtctttgatactagcatttttccttctatatggttaacaaggcacatattttcatttttatatccccagaataaaggcttgaaaggaaacaaaatctcaaataaatggactaatttgttaaattctggactaaacctcagtttattttaacagctttaacaacggtctctggagctcataacacatatagagcactattggtgtcacacaaaaccttgaaatcagaattgccacagaccgaatctgatctgaaatggcatttcattcaactgcagctttgtgtcacaagaacctgtctctgttttcctaacatgggtatgatgcatattcagaagcagccgagtgatttacttcttttttcattacgcttgtggatttgcatagattcagaaggggcatcttctgggaggtataagagtttatagaaagactaatttcttgactaggcacgatggctcatgcttgtaatctcagcactttgggaggccaaggtgggaagatcacttgagaccaggagtttgagaccagcctggccaatatggtgaaaccctgtctctacaaaaaatacaaaaattagctgggcgtggtggtacatgcctgtaatcccagctactcaggaagctaaggcacaataattgcttgaaccagagaagtggagattgcagtgagccaagattgtgcccctgcactccaacctgggcaacagagtgagactctgtctcaaaaacaaaaaaaaaaggaagattgatttcctgtagacagaaggagtgtttatattggcagcagcaatgcagatcaaaactttggggtcaccctcttgaatatcttatttgtatttcttcttgggttactaaagtcttgaggagaaaaatgaataaaaggcttaagaggattctcatttccatgcaaagcttctccacactcctgagagaagtttagggtcaggaaggaaggtcagacaatataaacctcagcactattcagtaaaatagccatggggaaaaatatggtaagtttgtcttaattcatacccaaggacatttagcgctcagaaaactaaaatactttttatttatttatttatttatttatttattttgagacagagtcttgcactattgtgcgggctggagtgcagtggcgcagtctcagctcactgcaacctccacttgaacctccaggttcaagtgattctccttgcctcagcctcccacgtagctgggattacaggcgcccaccaccacacccggctaattttttttttgtatttttagtagagacggggtttcactatgttggccaggctggtcttgaactcctgacctcgtgatccacctgcatcggcctcccaaagtgctgggattataggcataagccaccttgcttggccctaaaatacttttaataagattgtctcatccttctcttggttttccaatggaaatggtggtatagcaagtccatctgaaacacttctgcaaaataacaatgaagctaatcactgtgggaaacatttacatcatatgtatttgcatacagaggaaattgataatcttgagacatcagcatactagaatagcaagagacatgttttattctattatattctcttagtcagcaatgtttaattgttgcttaaaggaaactgaataaaacgtgggcgcagtggctcccacctctaatcccagcactttgggaagttgaggagagaggatcgcttcagcccaagagtttgagaccagcataggcaacatagtgagaccccatctctacaaaaaatattttttaaaattagtcgagcatggcggtggctccctgtagttccagctacatggagggctgaggtgggaggatcacttgaaccagggaggtcaaggctgcaccctggcctgggcaacaaagccaaaccctgtgtcaaaaaaaaaaaaaaaatacgtaaagcaacagtttttctataacggattgcatggtaaaaggaaggatgactttcttactataactccttatgataattttttccaaagtgttaatcttaggggttgaaatttttataggtaatcattaactttagtagaacattattttaaagtttaggtatttcatctgagtatattactctggctttcctaagctagcttagttatatatgttcacttcagtttgagtctccactaaattttaacatgaacaaaatattatatgcaacaccatagaagcaattgttaaatcattgttacttttaatatcacctaaatctaacctaagtaaatgtgtttatttttattaccaactgatgtagatatacccacatggacagaaaacagcataaaccaccaaaaggacttgaaaattccctcttcaagacttcttttgccaatgactaatgtttaatgctatttgctagagattctggtgccaggaggatttctaaccaggttattttatcaataggaataaaatatcgagggcttaaattagtgtaatctctcaagatcttgaatttgacgttttcataatttttacttaatcatagctcctggggattggaattactcttttagctggcccgagtctgggaggaggatccaaagtctttgagttgttttcttttatttctttttagcccctaaagcactggaaatggttggccctgaagtgctcctaaggtaaccgcaagatgaggcaaaacaggattgagatgaaaaccaagctcacccacatcctacgtcaattagctatttttttttctgtgtaaacaatgggagggaggtggattgtagcttttatggtagaggttcctcggcacctcctgacgcccccaggggtcccccctgccactgccctcagcccaaatataagctgacaacaaaatgtttcttcaaagtgctcattgtttactctattctggcttcttcttaaaggtcatcatcatgttgaattatcttgagaaaatcctctgaagtgtatgtgtgtgtgtgtgtttaggaaggatgtgaggaggattgggaggtgagtctctgaataacaagttgaaaaaagagtatggaggaaagcggtgtttaaaattgtccaaagccatcggccgggcatgatggctcacgcctctaatcccaacgatttgagaggctgaggtgggaaaattgcttgagcccaggagtttgagaccagtctgggcaacatggtgaaaccccatctctacaaaaaaagtacaacaattagctgggcatggtggtgcatgcctgcagtcccagatactcaggaggctgagatgggaggatcacttgagcctaggagtttagggctgcaatgagatgtgagtgcaccaccatactctagcctgggcaacagagcaagaccttgtctcaaataataataataatatataaataaacaaataaataaaattatcctaagtgaaatcagttgttgatagaactgaagtacatcaagcctagtgggactgtggttgtctctccagcctaaaaaaaaaaaagaacaaaaacaacaacaaaaaaacttaactccaaaattgctgttgctccatttatttcaggtgtaagacttctttgagatttaaaaacaatataatcatttacaatgtactttgttggacctaagcataggaaaattcattcattcattcattcattgagtacctgttatatgccaggcaatgcactaggcaccatcaaagatgaataagctatgtgctaaaattcacagtctaacagaagaaacatgaaagcagagtggaaatatactgtggcaatacatatttggatatactggtattaaaaagtaaggatgtttcagctaaatcttttttggtgtttattttttaaaaattcatctattaacttcctacacaccatgcatatattcagctaaatcttaaagtatgagaagaaacatgccattcatgaaagggaagagggagccagtgcatcagatacaacctatgcaatcgtgaagatttatggcagagcacaggatatttggggattggcaggcatttcaaaatggctggcacataaagttccgggatgggaacaggctggcaagagaagagatcatcggagccaaagtaactgaactgtgattgaattttagatatgataatatctataggaaacctggcaacccggtgggcaggtaaatatgatagagcgaagatagaatcttcaggccttcaggggactaagcaggaatagaataattttattgagcactttaagtggacattatgctagattattttacatatttcatctcctttaatttacaccacaaccctgtgagtgcaggttgataaagaattaaataaaatccaggtgaagtagcagcacctatagttccagctacttgggaggctgaggtgagaccattacttgaggccaagagttccaggctgtagttcacaatggttgtgtctgtgaatagccactgcactcctgcctgggtgacacagtgagacctcatttctaaaaaagaaaaaaaaaattgagacagggtctcgctctgccacccaggctggagtacagtcacgcaattacagcttactgcagccttaacccccaggctcaaacaatcctcccacctcagcctcccaaatagcttggactacaggtacatgtcaccacacctggctattttttgtattttttgtagagatggagtttcaccatgttgcccaggctggtcttgaactcctaggctcaaatgatcctcctgcttccaccttccaaagcgctgagattatagacgtgaaccactgcacctggtctagaaattatttaataataaaaaaatgaagacagaattcaatgaagagcatagaagagtctcttaaacctttgttttaagctatgagccaggaaagagatggtggcaagggtgagatggttgcagtgcttttttgttcacttatctcaggcctgtgtgttctgagttaaagacaagtcagttggcaagagaaggagagaggaagcttcccagaaccatttgaaggaaaatttggaaagtcttctctaagggagttgccctcaactaccttttaacacaaatggaggactgaaaaacaaaacaaaacaaaacaaacaggaaggaattgcagatatacagatctttggcctttcaaactatggtatctcttagtactattttatatattgataataattataatttttctcaaacttcccaaaagtggaacattgtgggaaataatatgggagtggacatttgaatttctgtttgactttgcagcagaaatctcttttctaactctctctttcaatctcaccatcagagccatctgattgcttgataacatgattctttttgcccagcccttgttatcctccctcctgccctagtcaccatgacataggctccactcatttctacctaggaacctggatgcactgctttgcactattgcctcctggcaaaacagggcaatgagaaaggaaatggaagcccaaattcagagccctccttcccagcacaagaatgaggagatgccctttttccccggggagggggattcttccctctctcttcagtaattgtctttatcactgtcatgttctagccagtctttattatccccgccacacaaatttcatgttcttctggcagtcaaatcaggaaattcaaggacacaactgctctggcttcgtaaagatggggatcaaattgtttgagttgctgatagcaactctttgcttcttgattctccatgcctcctcaagcttttttggctgaacttttagccttggaacagggtcactggaaaatacttcttaatatccttaatttctaattctaatatttgccttgtttcattttgtttatttggggaggatgaagttcaggtgttcacctatcaaactcacttccttcttttttttagacaaggtcttgctctgtcgcccaggctagagtgcagtggtatgatgttggctcactgcagcctccacctcccaggttcaagtgattctcccacctcagcctcccaagtagcagggatcacaggctcgtgctaccacgccccactacttttttgtattttttggtagagacggagtttcatcatgttggccaggctgatcttgaactcctgacctcaagtgatctgcctgcctcgacctcccaaagtgctgggattgcaggtgtgagccaccgtgcccagccctaacttccttctgatcaagtcattctcaaaaataaacatttaattgactgtcaactacaatgataataagacaatgtttgccttaaatgagctctaaatctagttgaagggataacacatggaatggactggtaataaaaagtgggctttgcttggtgctacagttgtgatgtgaactaaagagggagtgttttggactgactttgagttggggaggctttatggaggaggtgacatttgagttgggccttacgttgtattttatgaaataaaaaaagaggaaagacagtccaagatgagaagacagtataaataaagggacagaggcatggaagggaatttcttggccaaaggatagtaaaaagtacagaaccactaaagtctagagcacataggctagaggctagaataagtgagaaatagctaatcctaggaagataaattggggcttaattgtaaaaacctttgcatgctatactaagaagctttgagttcattctcttggcaactatgagccattacatgtttcaaaagatagatctgatggaaaaacagaagtatagagggtaatattctaatgtgtaaacttctactgtgagtccaaaagaatatggtatctatctctgaaccatgttcaatattttgcttagactgttcgaactatgtaagaataagaaatactaaagtgttttttctctgatataatatttaaataccttttagctatcaattccttctaatttccctttaataagacatttactacaaatagacatcattcccatagcaatcttttcttgagacaaagaggtcagtaggccaggttctgcatagaatataagctatttttccattttagaatgccactctccattgatgtctactctcgttaagtagaaaattccaagaagtactaacaaaattatgttaatttgtgtatgtactgacttccagacatttggaaccagattctgaacctgtaactcatttaaatcttgccgtgactttggtttcccaagttctaggtctttctctgaaaatttaaaatgcttctggaaagatattttccatgacacttttgccttaggaaaaaaatttttggtcaacattggaagaaaaaaaaactgagacaacatatatcttgctccttaacatattctgtatgaaattaaggtcttattgacaatctacgtatcagagcctcgtacacaggagctattgaaatgatgtgtcagttcagaaaatcatgttcattatttctgattctcatcataaacaagcagtaaatcaccgtataaggggtgtatgcattagggcctcccacataaacttcacctctgcgtgtgtaaacattttcttattatcgcaaataatcaacaggagaagagcaaatgcaagtttagcttttctccagaatgtttatcatggttactttaaactgtttataggaaagagtgaactataaatgtctttcaggaggtgggtaggaccatatggctcagaggcttttctgcagtaaaatgtttggttaaattttaggcaacagacagtccttccacagcaattatttgtgatttcgagcatcgttgttgatactcaactcctgaaacaaataacaccgacctaaaacatttataataactgaagaaaccaggttccttttaaccctgctaggatccagctgcccccttgcaacccatccccagtcagctgcagctcaggcaagcccagcctttccatccctgcacatcagactgtggtgcagagaaactccctgtgttcttcaaaacaaacattggatgtaatccacctcaatcttttccatggtgaggctttacaaattttagttttctctaagaagatagcctgtatattcaattgcctgggtaaaagtttaatttctgatgcgtaaagcatatcctgccttgaaaaatatctcaggaaaaataaaggccacaacagtttcatgtgtgcctatatcaggattgctgctgagtaagttgtgaaatgtttttggatttctgagccatttggatttcagaattgtggaggaattctggatctgtattttattgtgtattaccaattattttcctttctcttttatgtgacgggtagtattttgattatttaaaatcatctttgtagaaaaattattggcagctatgaatttcatttcaagatatttaagatgccttagaaacttttctaaaaacagtataataggattgagaaccactcatgtatggcctttactgtttcgaggtttttcttttttgacatgtattatttgatgaaaccctatgagattaggtctttacttccgaaagaagaaaaccaaattcaagggcaattaaaaacttgtcaaatgtctcaattttagtaagaaaaaaaaccgacattggcctagatcttaatctgtgcccagtcctcttcccatccctcttttttttttttttttttttttttttggtggctgctctcaaatttttgggctcaaatgaacctcctaccttggcctcccaacgtgctgagattacaggcatgagccaccgtgcctggccagctaaggttaatttagtattgaagaaatatttttgttatgaatttagtgtagccaagtgtgcagtgtttagaccatctacagtaatgcacattaatggcctaggccttcacattcactcaccactcactcactgactcacccagagcaatgtctagtcctgcaagctccattcatgggaaaggcctcacacatgtataacatttttttgtcttttattctgtatttttctatgtttagataagtttagatgtataaatacttatccttgtattacggttctctagtgctcagtacagtgacttgctgtacaggtttgtagcctaggaacgataggttataccatatagccaaggtgtgtagtaagctgtaccatcttggttcgtgtaaggacattcagtgatgaaattgcctactgacacatttctcagaaggtacccccatcgttaagcaaccattactgtattagaaagcagaaaaacaaattcagctccggacttagcctacccatatagcatcattggccagaagaaaatcactttgctttatgaatcccagttttctgcgggaatgaaatgaggtaccatacgtgatcctaccagcataacacctgccaaatagtgcacattcaatactaaaccatcctttttatgcctataaataaaggatttgtactatatcaagagcttctctatgtctgaagttacaatagagtaattccaaattatctttcatggaatcaaatccctgatgatcccttgattttctgagttctgtgaatttcatcacagcccaatttgacccattactgctaattcagtgtttttattagtaaattatatttccaagttgaatcaaaacaacagtatagcaggcacagcttaagacacaagataaataagttgttgcattcaccagtcaaaatatttttaaaaaatcaagaagcaatcactgaatagttttccttgatttagataccaattaggtttaatgaccaaatgagactgataatcagagctgaggaactcaatcaacaggattgcaacatgctttttttaaacctcttgaaagatcacatcactacagaataaggaaacctatttatttatttaatttgagacagtctctctctgtcacccaagctggagtgcagtggaatgatctcagctcactgcggcctccaccccagttcaagcaatttcatgctcagcctctgagtagctgggactacaggggcacaccaccacgcccagctaatttttttgtatttttagcagagacaggttttcaccatggtggccacgatggtctggaactcttgacttcaagtgatctacccacttggtctcctgagggaaatctatttatgactaatgctgttctttttactaattgtttcattggctgtcagcccttagaggaaaaactgttcaaacaaccttttattcatagacccatgttatttaattttagaattatttcccatgtatgcacaaccgaattttcattttcataacaagaaaacaaattctttaagtgagaaacagtacattttacacccttccttttcacaaaaatctcacagtattttctgacttatggtcttgataattagcactcctgtttgctcgtgttctctttctttcacaagcaatgtgatcttatttttaaaaaggacctgagacaagtagacaattgacccttgaacaacacagatttgaaaagttttggtccacctatacacggattttctcccacctctgccacccatgagagagcaagaccaagccctcctccataccctactccatctgaagatgaccagggtaaagacctttatggggattcacttccacttaattattagtaaatatcttttctcttccttatgattttctcaataagtttcctttatctagcttactttactgtaagaatacggtatagactacatataacacacaaactatgcattatcaactatttatgctgctggtaaggcttctagtcaacagtaggttattaatagctaaattctgggggagtcaaaaggtatatgcagattttcacgggtggttggacccccccagcatccatgttgttcaagggtcaactgtatatcctaattgttatttgacactggaagaaattagatctcctggccgggcgtagactcacgtctatcatcccagcactttgggaggccgaggagggtggatcacctgagatcatgagttcgagaccagcctggccaacatggtgaaaccccaactctactaaaaatacaaaaattagctgggcgtggtggtgggtgcctgtagtcccagctactcaagaggttgaggcaggagaatcacttgaaccctggaggcagagattgcagtgagatgagattgtgccattgcactccagcctaagtgacggagtgagactttctcaaaaaaataaataaataaataaataaattatatctcctcttagaagtttgtccctctcttcaactgaaatctatcacagttcgacctacatggtagttgcattgatctgtccatcctggtgccacatatagaacatctactttgtcagatactgttccacatacagtaagcagaacacatgatcccagtccacatgaaggatggtgtccagtcatgtatggcctgattcttttctgtaaagtgctttcacatttgtagttggttcctttcctagagcactcctgtttttgcattcttgtagaaagcaaattatttccaccctgtcactgatttttttctccaattcaaacaatacgaactagaaaagagaactcccttgtaatataaaaggaaatagaaatccctatgtattcaatgtttttaaagtttaatatgattcctcttagcaataaccagcaaaaagaaaatgtttctactttaatcttttcttttgaactgaagtgttcctctatgtcatttacatgacaattggcccaaatctctctgttaccaggacttggtattcaaagtaagaggcttcattaaatttcaagaggacttttttggggaaagtttttgtttgttttgttgtgttttatcataacaaaacaaggcatagtgaccaggaagatggagtttctagttagtgcatacatatacatgcttatggttacttaatgtgatagaagcaaattattcagatgcctcttctccacagaaggttttggtcttcagcacgtaaagcaacttttttttttttgtttttttgagatagagtctcactctgtcaccaggctggagtgcaatggtgcgatctcggctccctgcaaactctgcatccggaattcaagcgattctcctgtctcagcctcctaaatagctgggactacaggcacgcaccaccacgtccagctaatttttgtatttttagtagagacggggtttcactatgttggccaggatggtctcgatctcttgacttcgtgatcctcccgcctcggcctcccaaagtgttgggattacaggcatgagccactgtgcccggcctcatgtagagcactttaaaagtacattggatccatagtaatcacttaactatgaacttgtatatccatatcaaaacttcatgttgtacagcttaaatatagacaataagaataaaataaataaatgaaaatattttaatatgctgagccatgttctggccatttttctctggccttatgtagctttagcttttcattctcaaagcatggatcaaagagctataagaagaaattaaccagagactttatcctgattgtttcacatttccaaaggcaataaatcagtcatgggctgagagaagagaactgaagtctaccacaacaaatatatttctgccattttttcttttatttcctataggttttgctttatgaattttgacatgatattttcatcatgtgtagatatcatacctctttatgcttttattgcaggtgaagtcatttcctaacatcactgctccctctcccttctcccagcagttatctatgtgaaacaaataaatgttatttgtgaggttcagctaattcagataattagcattaccaagaggcttacaattattctggaatttgtgtttgcttatttgtttccccaaatacagctaaaggagaggagaggatcaccagatcttatagtaggcaaaactatgaattattagtaaatcttcctcctggctttctatctcactggctgctcattctcattgtccttcactctttctcctctgtttaacttccaaatgccaagcatccctgggagtattctcttcatttattacattcactcaaatggttttaaataccatacatatactgatgacacctaacactctagttctcgtctgtgtctccctgaactccagactcgtaggtccaactgacttctgcatatggctgtccagtcggcatctccaattgaacatcgtcagaacaaaacttcaggcttttccccaaccagctcttctggtcttgcccatctcaataaacaccactgctatctacccaattaattgagccggctatctggtagttattcccttctttgcctcactgtcttctgatccccatatcctataaactctaataccaagtatccctggaatcctttcagtttttcctatctttacttcttctccttagtctaagctattatactctcttgcatagtttagcggtagtttttaagccctttttttatttttattttacgtttgccttttctaacaaattctccttaaaacagccagaatgatctctttgatgtatgatttagccaagtgtggtggctcccactagtaatcccagctactccaggaggctgaggtgggaggattgctgggagttcaagaccagtctgggcaacatagtgagaccccatttctaattaaaaaaaaaaaaaaagaagaaggaaacatgaattagattttgttgctcccttgtttaaactctctattggctttttacttcatttagaataaaatgaaactccctgtcctggcccctatttgatcttatttcctgtcactttcccattgtctgttatacctcacaatcactggactgcagttattgctgttcctccgaactacaggccttagggcctttgcaattgctattttctatggctggaacactttctcctcagatctgcaaaagattggtatcttgtttagtcagatctcaaattaaataccacactctcatagaggccttctctcacctcaggctggtgttggtagcagtcattgaacttcacaacaccttatgttaatgttgtgcagaacacttaccactgcctgatattttactgataggtcttttgtctgtttcctgccactcctgcccctgaaatagaaagcaagctccatcagagaagaactttatctgtttgttcacggcagtaattccaggccttggaagagggtttggcacacagatgttacttaataaacataagagtgaatgaatgaaaattgttagaagacaccatctaaagtgagtcagacaatatgtccagcttcttgtgtgtgctaattaatgacactttgtggactatatatctgtatataactacttcatttcttacagagccttgatagatgaaagtaactagacatttaacttaaaaggtgctaggtcatcttcagttccaggctgtaagcattaagattgactgtacacgacctgttaaaaccattttctgggaaaggctcttaagtacctgtcagagtttacaatttgagagcaaacataaataaacccaaacgcctttcaactttgaacatttgatgcttgaaaatcacctctatttaaatttttgctagtcacatcttctcatcttttggtttcaggacctgattcatcagtttctatagatccatttataaactcagtcagcattttactttgccagcctatgagcacaagtaggcaactggaggcttggaaaaaacccagacaacaacaatttgtttttcactggttctgctttcaaacaacttccaagagcacaatacagcaaaaagtgagagttatctatttctcccttcttcatccgaatacaaaatacatcctattttactgctttttttttgtcttttgcctctactttaagacttatctaagaaataaagaaaagccaaccactcgttctatccacagaagaaaaacacacaccagcatagacaacacaaaagactgtgtctagatgttaagactatatatcctataggactataattttcatagatctaaaaagtgagaaacatatatatgtataaaattatgtgggatgcaagttactgagattttgaatatggggctctgtcatttaccctaaaatgttcagtggtcttttctattttttctctattctcagtaaaatagaactttctcaacaattctggctcctactcttccaatgggctcagcttgtctcatgatttaatagtactaaaaaccttttcttaaaaagaaaaaaaatcctttttaaaaaagtttaggtataaataagaaatttctatattatgaaagactggtttgcaaagaaactttaatatcttctggatctcatctcaatcacagtctatgaaggaaataaaataagtgccttctaaaacggcctattatactactatagctgttgtctataaggaaaaagtttgttagtgagttgtattcaatagaaaacctcaaagatggctgggcgcggtggctcatgcctgtaatcccagcactttgggaggccgaggtgagtggatcacttgaagccaggagttcgagaccagctttgccaacatggagaaaccccatctctactaaaaatacaaaattagctgggtgtggtggcgggcgcctgtaatcccagctatttgggaggtgggagaattgcttgaacctaggaggcggaggttgaaatgactctagatcatgccgttgcactccagcctgggcgacaaaagcgagactctgtctccaaaaaaaagaaaagaaatcctcagagaagatatcctagaactatttagttttcccttaatcgagtctgaaaacctcctgtgcccttccaccacttaataatctaaccaactattgtaaaattacctattcttctaaaccaccaaatagttcgaatagaatagccttagatatctaataactaaatgaaaccacagtttacctctctaggcttcagtttcttcttcataaaataagaagcttgaactcgaaaagttttagatgcgaagttcccaaaaatctagtagaggaagcaaaactctgtttggcaccctgtttccttgccctggacttttagcatttctttcttctggtgtaaagtcaaacaaaaaatagagatgaatctctaaatttacctttttattggggagataagagttgcaatacagggcatacacacagacctgatagtcttctgtatgtcagaagaacaaagagaaggttggaggttttacgaaaaggagaaatgtcttgtcctgaaagaaatttcactggcactagtaaagttgtggggagtggcaacctctgattggtgagtgacaacagtgcagtaggtaaaactaatcttagactcacagtggttgtcttagctgctattagataaaagtgatttcaggttacagcaggcagtttcagcagctaggtttgcagagaattacattcctagaacatgatattttaatatacatatccattgtgaaataaatactataggcaagcaatttaacatatttatcactttccatagttaacatttttgtaagagcacataaaatctacttattctgcagattttgaatatacaatacaatattatttactataatctttctgttgtacattagatctctagacacactgattctttttttttttttttttttttttttgagacggagtttcagtcttgtcactcaggctggagttcagtggcgcaatctcggctcactgcaacttctgcctcctgggttcagatgattctcctgcctcagcctgccgagtagctgggattacaggcatgcaccaccatgcccggctaacttttatattttgggtagagacagggtttcaccatgttggccaggctggtctcaaactcctggcctcaggtgatccgcctgccttggcctcccaaagttctgggattacaggagtgagccaccatgcctggcctagacatacagattctacatgattacaagtttgttccctctcatctactttccattttctcctctccctgcccctggtaaccaccattctactctctgtttctatgtatttgatttttttttttttttaagattctacatgtaagtaagatcgtgcagtagttttgtttctatgtctggcttatagttcacttagcaggttcattcatgttgttgcaaatgctagaatctcctttttaggttggataattattccattgtgtatctataccacaatttatttaccgcttcatctgttaatggattcttaggttgttttcatatcttggctattgtgaataatgctgcaatgaacgtcaaagtgcagatatgtccatgaggtgtttatttcatctcttttgggcatacccagaagagggattgctggatcatatggtagcagaatgttttatttggaagggaaacttttatactgttttccataatggctataacaatttgcattccctctgaaagtggacaagggttccctttattctacactctcaccaacacttgttatctcttgacttttttatacgagtcagtgtaactttaaatccacctggcctgatgctaaattatgaatgggaaaaattatattaatacttagaatcctgactgggtgcagtggcttatgcctggaaccatagcactttgggaggctgagatgggaggatcacttgagccaggagttcgagaccagccagggcaacatagtgagacctcatctctctaaaaaataaaatattagcctagtttggtggcacatgcctgtagtcccagctactcaggaggctgaggtgtaaggatcacttgagcccaggaggtcaaggctacggtaagccatgattgcactactgtactctagcctgggtaacaaagcaaagcaagaccatcttcacacacacacacgaaaaaaacttagaattctttttttttttttttttttttttttttttttttttttttgggggagggtctcattctgttgccaggctggagtgcagtggcgatcttggctcactgcaacctctgactcccaggttcaagtgattctcctgcctcagcctcccgagtagctgggattacaggtgcctgccaccatgaccagctaattttttttgtatttttagtagagacggagtttcaccgtgttggccaggatggtctcgatctcctgacctcgtgatcctcccgcctcagtcccccagagtgctgggattacaggcgtgagccatcacgcctggctaaacttagaattctttacattcaaataatgtctggtatttttttacattattttcatgtatattccctaatttaaacttatccccacccccccccaccccaccatgatgtcgtcaacacagaactgttttctagattaggaaactgaggatagggattttaagtatctcgctcctagatcaggaccgcatccaggttgcagaatcccaatccagcactcttccacatagtcacagcactaccccaactctaatctactgatgacacagaacaaaattaaagtccttgtccaaatcccagagttcatgaacacagagatgttaatgctcctgtagttcatactgcaaaaagaatgtgagagcttgtttcatttttcacttagaaaatgtatgagatgttctttctgaaggggttctgtcactaacaggttgcattacttgtacaaccattatatctgaatcttcccagaccgtggtttttttttgtttgtttgttttgttttttattaaatactgtcattaaaccagaactcatggatatctatgtcatttccagctataaaattctagaaacttggggattttacctttttgtttcttattttattttcttttttatcaaaagccttatcacaggtaaaatggtaatctaagcaagaataagctctgtcatgatttatgaagcatggaaattcagctgtggccaggcacagtggctcacatctgtaatcccggcactttgggaggccgaggtgggtggatcacttgaggccaggagttcgagaccagcctggcccacatggtgaaaacccgtctctactaaaaatacaaaaattagctgggtttggtggtgtgtgcctgtagtcccagctacccaggaggctgaagcaagagaatcgcttgaatctgggaggcggaggttgcagtctttagcatgggtgacagagtgagattctgtcttagaaacaacaacaacaacaacaaaaaccaacaacaagcacaaaccaataatagaaactttaaatgattctgagccttgagaggaatgtgattatgcaacctgggaaattcacctgcccatgaatagtatctctgtaattaataacaaagtcttacaggacagtccttgccatcaccatatcataaacgtatattgcttcttttagttcataggaacagggtctcctgctgtgtcatagctgtaggatttagcctaaatgctcagtgagtttgatgctcccttgagcaagcccgcttatttaagaaagtagtttttggatattcatggtttattgctgacagttaacgttctcaaaatagtgagagtcctaaagtcaaaggggaatttattaacaattttatttctgagaggatatgacaacaacaaagacattaataaaaaacaccagcgagctttctggcaatatgtattaaaattttcaaaaacacttatactctcgaatccagcagttattatttcgggaaattgctctaagaatattatctttttatacaaagcattttctgaagagaagtattcaggaaattttcatttatgaacagaaaaagtccaacattatggaaatagtgatataaaatacagcatatatagttctttggtattttacagtcatgtaatcatggagagaaatacttcagataaattaacataataaaccacaatacaaaaaagtatatttacaatagaaaaaaagtttaaaagtgtgttagcaatacaaataaacaaatacaagaaggatctatcacaacaatgctacagtgatgagccttcagataattttcattatttttcttgatacttctatatgttcaaaactttcattaatgagcctgtaataccagcactttgggaggccgagatgggctgatcgcttgagctcagtagttcaagaccaagctaggcaacatggcgagactccatctttacaaataatacatacatacataagtaactaagtaagtaaattagccaggcatagtggtatgttcctgtacttccagctacttggagggctaaggcaggaggattgcttgagcccaggaggtcaaggctgcagtgagccatgtttatacccctgcaatccagcttgagtgacagagtgagaccctatttcaaaaaacaaaatttcactgatgacaataaatattaccttgacatcaaaaaaaaaaaaaaaatccagtgcctggatgatcacccagtagcatctaaaagtgcatttgaatatatatccaggttctgatgccagcattgatgcttgttatgtgacaaaaagaaatcacctaactgctttgggcttccatttcttcaaagtaaaatgaagtggttaaacaggattactccccagatgtctccccaaactttacactggtgtaataattgtttgcaaggatcattgggtgattatgtctaaaagcctgcagttattagtcctcatatcaggaatgtgctatccccattcattttattgtagaacctggtttgctgtgggatagttgaaatttgaagaattcacttggtcagtgtgtttcacggccttgctactttttctgcttggatggactcacttctctatatgattttctctttaaatcagaagtatttgacctgaagcagtaactcctctattcatataatagtgatattctgatacatatgtgaatattataaaaataagtagaatgataatattattactaatattattgtggcagtaataatattatcattcacatgtgatcaatagtaaaagcacacacagcaacccctcaggatttcatcctcaggccattgactcccatcacctttactgatatttagcttagctttacaatcctcccctttgaaaaattcatattttaaccttgcctcccataaagacacacattttttcagatatagaatttgcaaggctgagacatatctttttagaatgaacccaatataaacacaaagcaacataggagaaaagtactagttacatgcccatggcaagaaaatatgcctgaaatggttctgtttattttgttgttgttgtttctgcttggaatttcagcagttatttggcaaagtgattagctagctgggaaggaagaaagctcgtctccatcagccttttgtcagagcccgccttttggtcccggagcccccatgaaagtgtgctgtagaccaggaccactgttgccctgaatgcatgagtatgcagcctttttatcgtaggcttgtcatctcctgagttctgcaatagatgccatgtgaaatccagtatatactcagtctaacacatagctgctgcataagaaaatttctttccatgcttaagcaatttctgcatagagcttaattcatagaaatcacttattcattcaaaaagcattcactgagttcctagtaggggccacatattacgctaaagtagatacaaggataaaccaaatgtagatctgtcctttaaagagtataacatgtagggaacaactacactctacatggcaatagaaagtcacaagtgggtgagaaccacaggagagaaacagtcagagggtgatgacagccagaactggtatgatgtgaaaggtcaatgacatcagaaacggcctcagggattttatagcctggctccttcaatttcagttcttggtataggccagcttttcaggactgttgattgtccctcttctttgtgtgaaattcctagtgcacagagcttctgcagtgcctcttaggtactttgaaaatcccaacgataaacatctggacccaacacagaagcctccaggaagctgtcttgttggcagtcacctacgagcaggcgataaacacaacacattaaatagtatgtaatgctccagggattgcagtcctctgcctcctaatctctctgtcctttcctcttttattgacttgtcaggagcatgacagttgtgcacaaccattagcacacaagaaatgactttcctgtgggggtgatggggactggggaacctactctttgagatagaaagttaccctgatgcagaataattacagtccagcttagcctccttataagcgattaatcttacttttcctcttagcttctgtctgtttgtaacctgaggttgaccgaagttagttcttttagttggttcttgagaaaaccctttcagtctgtatttccaggaataaatcttaactctaatttaaaaaacaaaagggccctataaatagttacttcaaaccctttaatttatagctgcattctcaatgtcttcatcctcccaaaatcactcacctctacatttttgccctaagtacctaggttagcacaacttttcacaacttctctttaacatttctctgaataacgtgaaccttccttatttccttaaaatataaacttatatatgttcttcctaggagattttcaacttttctgttctccacttattactctattcactctgttctctatctgagctgtcactaattagtatctacttaaataaatatttgagcaatttaacattacagttttttttttttttttcagcaagaagtgtgttcattatccattaaaagcctgggagagggactactaatgttacaccatcaatatctatttttagccacttcggttttggaagtgtctcttcttttggaagtgggagaccaagtggaggggaagaacatgaacaagggattgaagccattgagaaagtcatttattcattcgatagatatcttctgagcactgcgctaggacctaaggacagaataatgaaggcagagtttatccttccactagcacagcagtcaaaaccaataggaattaagattgtcagaagtgacaaaactgtacatagacctgttcacataactaacaagggaaacgatggaggtgatgtggaagtctgaacgtggtgcaggaataactcagccaacatccccctcctttgggaaatttagatagatgtaggtagattgagaagtgatataacagtcatgtggcatcattgagagagtcagttttctataatgacaaagacatggaaagagagatgtttagtacatgtacagcagaaggagttgattcacaacgcaatggaaacagaagtcaagaagacagtgaagtggatgaagcaaggagaaatcataaaaacaagcacactgggactgtcggacctcaggggagagtgacgtggatggtaaaccaagtttggggccagagaaaagtgaaagcttgtgctgttcttgttggtagtcatgggcaggctgtagcagggttattattaaaactctgatcccccaagtccaactgaaggggctccagtcactaccccatcatctcagtggtgagatgtagtcaaggcatctaacctctctgcctcagtttcctcatatgtaaaatagagacaatcattataaagtgtttagcagaatgccagatccacagtaaatatcagtaaaaggaaatttataaatttgtaaattgttagggaatggggtgagaccctcaagattctaatcttcaagggaaagaggatgctaaggaaagtcagaggaagcccgagaatcctaagagaggatgatacaagcaaattaattaaggaataagatcaaagaatattgggaaatgtttaatccacttggtgtgggaaaaggacttttttgtttgtttgtttttgagacggagtcttgctctgtcgcccaggctggactgcagtggtgcgttctcggctcactgcaagctccgtctccctggttcaagcgattctcctgcctcagcctcccgagtagctgggattacaggcgccagccacaacgcccacgcccagctaattttttttttttttttttttgtagtagagacggggtttcaccatgttggccagattggtcttgatctcctgacttcatgtgatccgcccgcctcggcctcccgaagtgctgggattacaggcgtgagccactgagcccggccgaaaaggactcttttttttttttttttacacagagtctcgctctgttgcccaggctggagtgcagtggcgccatctcggctcactgcaagctccgcctcccgggttcacgccattctcctgcctcagcctccagagtagctgggactacaggcgcccgccaccacacccggctaatttatttatttttttctttttttcttttttgtatttttaatagagacggggtttcaccgtgttagccaggatggtctccgtctcctgacctcatgatccgcctccctcagccttccaaagtactgggattacaggcgtgagccaccgcgcccgaccatgaaaaggactctttttaacctcttctccatgtctaatctgagtttcaacctttttattcttattctgttataagtacttctcccattcaagagcatataaaactagaattactttgggatgagtgtgagtgggggagagagaaggttgggagatcactagttgtgtttgctggtactgaatcctaccctaatacttccgaaatgaacctcattggataactcaactcttcattatgtttttgctaatcttttaggagcctttttgcaacccaccgtctccctaccctcgttgggtctttttttttttcttcttcagtcagggttttgctctgtaacccagtggggaaagtggcatgatgatggctcactgcagcctcaaattcctggactcaagctattttcccgccttaccttcctgagcagctgggactataggcgcatgccatcatgcgtggctaatttctaaaaaatatatatttttgtagagacatctctctatgttgcatttctggtcttgaactcctaggcgcaagcaatcctcccacctcagcctcccagagtgctggggattgcaggctgtttaatagaagttatcaacatatggagtcatttatgtctattgaaatatgaacagccaattcccttcacttgtcccatttctaattcagacactaattctgtttcagtttaacttggatcaatggacttatctttgcttctgttcagttatctgtttcaacaacaataagattctttatctatatggcatagtgggtgaaaggacacactaaccttacctactgctccttttatgtcagaaaatccattttctaatcactttttcttggacccaagtgagtctgttttttcccctacattttgtaatttgtcacatttacattttaggtgggttgttctaatcgacttttcttataaaagggtagtggttctagatcaatcgccatcaatcatgctaccaagcaatggtgaagtaccctttttaaaatattttatttagaagaatttcttatttcagatacaacagatgatacaagttgaatctagtagggtttagtaagagacaataaacatattaaacaaagccttacgtattttttaaggtgaaaaaaatcccccaagatagagtccgtgcttagaaactacccctgttaaatacttaatatataacatttgtaatgttcaaataccgaaagaaaaaaatgtacttgttcagagtctattcttgagtcaacctaccttctcagctctactgaccccaaacaaggtaaacaagctgatttaagttacaactaacttaaaaattatacatctaactcttttgtaaataactttagggctggtgctcaaaataattggaactagctatgaaaagaaagctagaaatgagaatgaggaaaattggtagtaagtgtctatagagaagtgtggaccatctgcaattcctatatttaaacagggagaagagggagatggggactcactctctccctcacaaccacatgactaaactggcccagccaatatctcatcaggtgtctccaccactttacaaagccactgggaatttatcaagggataaatacaaaactggtgtagggagaggggaatgggaagttacttccaaagactctgaccctgagttcttggcgtttattcttttttttgagacagtctcactctgtcgcccaggctagagtgcagtggcgcgatatcaactcactgcaacctctacccctgggttccagtgattctccagcctcagcctcctgattagctgggattacagacacccgccatgacaccctgctaatttttgtaattttagtagagacagggtttcaacatattggtcaggctggtctcgaactcctgacctcaggtgatccacccaccttggtctctcaaagtgctgggattacaggtgtgagccaccgtgcccggcccttggcctttattctttattttccctgatattaatccctaatgaaatgcatttagtacacattcatctttttaaaatgtgcagtttttgtcacagaagtagtgtaaaggacaccagaatggttggaagacgatttttgtggtcttctacaagtcctgttttggtgactctgagcaagtcttaaccttgcctacatttcctcacatttagggcaagtgtactcttcagggtcaactgcaatatctgtgggagtgctttgtgttttgtagcatgcatcttactagtgcttttgttgttgtttgcgttgtcgtgcgggttccccacctcccccataacactgtaaagaaatgctgagactaagtggtagggagtggcagccatctggtgaggatggaaagttaatatctttatttatgtaataaacctccctttagaattctgttactgtcaaatttctcctggaattctaatagtattttcgctatgtgttttgaccttttgctattgggaagacacaagtttatgaatgacaaatgggtaggggaatttaggctgcacagttaagtaggaagaatgaagtctttgctagagttagaatccagtttgaccttgaacaagttactcaatgactaagctccatttgcaaaatcgttttgttaaagggattagaggtaacatatctacatatgtacatgtgtacagtggtatggagaatggactggatgaatgcgtgctgttaccaatgtgataattactattctttttaaaaatagagtattttatgcatacacaatacttattcaattcaatttgccttagtgcacagtgatggaattttagaactggaattgacttcagaaataatctggtaaacgaaatcttttcgaggctcttcattttatggttgaggaaactaacatcctgagagctaaaagtcatcgttttcctttaaaatatctaaataatcccagatgttggatcagaactccaaagtcataatcagggcttttcctatttctatagtatttctaatactataacatgctattgctcagtcttttattctctaattccatcctggtttctagaccaaatatacctaattgtattctaacccacaagtacctcatcaatgagaagtctgacctatggtttatgatttccgcagacttaaatcaaccctgggcttctatccttatactagttttattttatgttttttgtttgtctttagagaaatgatcgtgttctgtcatccaggctggagtgcagggacataatcacagctcactgcagcctcaaactcctgggctccattgatcttcctgcttcaacctgctgagtagctaggactacaggcacgcaccatcaggcccaactacatttttaaatttttttctagagacgatgtctcgccatgtttcccaagctggtcttgaaccctggcctcaagcaatcctcccacctcagcttccctaagtaccaggattacaggcataagccactgagcccagccccacccttacatgttttctcttggcatcctgatccctggacacaaccccattgagatacccttccatttaatacttttcttagtcatttaccaaatgtgtttatagtaatatattcccatatatttgtggcagagtacagcactcatataaattttgatgaacacagacatgctgtcccatacttgtaggtaaaacaatcatgtgaaattaaaataaatattttgtttagatagatcttgactatcatacacttattctaacaatattgcccattcctcaaaacattctgggaactccttgaaataaaactgactatggtaagaagagtttttctgggagttgggaaactgattccattagaaggcagatggtgatagtctcacagcacactctctcccatgcggtctctattctacaggcatgcagatatttccaaaagcatcccttccctccagggtcctgaagaccctacctctggttctgccttggactgctctcagtgatattccctttttttttttttttttggacggagtctcactctgccgccaggctggagggcagtggcaccatcttggctcactgcaacctccgcctcccaggttcaagtgattctcctgcctcagcctcccaagtagctgggactacaggcacgtgccaccacgcctagctaatttttgtgtgtgtgtgtgttttttttagtagaggtggggtttcaccatgttggccgggatggtctcgaactattaaccttgtgatctgcccacctcggcctcccaaagtgctgggattacaggcgtgagccactgtgcccggccgatattcctgtttttatggttgcaattgtatgctatggcaccggtactatgtgggaagaatgatgctaggtactctactggtatggcctcatttgtcgatttgaggattattggtttatttatgcaaagcacataggatcataggattgctctctaggagaatggagtaattaataccatgaagactcatagacaatgcttcctcccctagaaactcattatttttcgaattttggcactgatctttcctgcctacttcctggcttttactaccttgtgaaaaagccccaagtgttagaagcagcttccccagcttactgccatcccttctaaggtccctggacaccactgcttgtctcctaccttagaaagtgcctacttggccaggcacgctggctcacgcctgtaatcctagaactttgggaggctgaggcaggaggatcacgaggtcaagagatcgagaccatcctggccaacatggtgaaaccccagctctactaaaaatacaaaaattagctgggtgtggtggggcatgcctgtagtctcagctacttgggaggctgaggtaggagattcacttgaagccgggaggtggaggttgcagtgacctgagatcacgccactgcactccagcctggtgacagagagagactctgtctcaaaaaaaaaaaaaaaaagtgcctactcataccctcctcctatttattctgatttctgtgcatgtattctttttgtttgtttgtttttcagagacaaggtcttgctctgtcacctaggctggagtgcagtggcacagtggcatgaccatagctcactacagcctcaaactactcctgggctcaaaatgatccccctgcctcacctaccaagtagctgagactacaggcaaatgccaccatgcctagcctgtgcctgttttcttaaggcagaaatgatctaaaagtgtggcagagggaaaagaagatgggacttagagcttaaataaatctagatgaaaatgttggttctatcactcacaggttctgtgatgttagggaagttaagttatttgcaataaaaattattaatattgtagaacatgtattgatcctatgtatcaggcttgaattaggtgctttaagtgggttgtctcaattaattcatcactctgattttcaattttctgttctaagaaatgagatcaaatatgcctatcttgccgaagagtagtaaaaattagacaggtagctgcctctggatcctgcagggtagagaaagtattacatatctgcatgtgtggatgtgaaggacacacagatacataaggtaaatgagaatttattataaaggtgtatttgacaaaaattggggaaaaaaggaaaattggagaagatatctttctgtgagattaaagacaaataggggaaaaaagggaccaatgacaagaattagagcaaggtatgtaaagaattccagagctggctctaagagatagagcagctggtcatatatgaaagggatgattcattcttcaggggctatccctcgtgatcctatttccttgcacaagctatcagttaatttattgattcacctcctttatgtgctcataggcatcaagaatacaatggatcacatacaattacagaaaagtttcatttcaggaggtcaaacaggaagtttctttctgacttatattgaagtactcatgatgacaatggagaaaaatgaacataatcttttatgggtggggaccatgtgatctcttttctttcaagctccagagggtttataagacatttccatgttcaatttgattccggaaattatatgttgggtagaacagactctttttggcaactcatgagaattgccaatgatcccagcatttgctactcttgatagtaattcccttcatttcctccatttttatacatgacctgcagtaaatattgacagttactttgctggaaagaataacacagagacagcttttcttaagctccaaactgaatttcgtggttaattgattggccagctggccctgccgtctcttgacctctacaagagccagcaagattgatggtttcagcagcctttcatggtgcactaaagcattcagatctatcttttgttatttgggaaacactaagttcttatgtagcacattatttacatggactcaagggctgacgagctgggaggcagcaaatgcccaaatggaagacaatgtatgtagatcaaagaagccgatgagacagagagttcataaaatgtgaatacaattccaggggagaattgatgattatggaagcagaaagccaattgagttaaatattcattccagcaacaagtctgatcgtctcactgggacctgtgcctttccgaagtttcctcagcttttcaaggtctacacaaggaaagaacaaagccatcaaggaggctctcattctggaaagccggctgcaagatggcatgaaccagaggtcagcggccaccactgagagttcatcgtattcgcctctgtaaagaataagcctcaagcagtggttctgcaggagcggttcagcatcatcaataccaatgagccctaatgaatgtgacaattcagaatgattgggccttttcctccaaaacgtttttctcctcaaaagtaaaacaggcttgaaactcatgtcttatatatgctgtttagattttcatatattaatgtcacgaatcagatgataggaaggtatattaacaagtgagacattgggatatggccccttgttcaagagcatcaaagcattaaatatgttgttttaaaaatacctttggcatagttttaccacctatttctcaattgccatcaaaattttaacttttaatgacttttggaagtaggttagatggggtggtgggagaggaatagaggatacagaaagataaaaactaaatccaaaaatagtattgaatgagaattactaataagaattattaattgagtgtcttctcataaaaatagtaatatctgttctttggtctctcacaatacatagtttaactccatatataatttaatgaatgcaatgtgtcactttggttataggtttgcatcttggaaacgatgttagtagaaacaagtcagtttccctctgttcctttttgcttagctttctgggctatcttcaccaatgccacagtccatctgtaacagaatgcattggagatttgaaaaatcacgacagataataaatctctatatacttctcatcctctggaacaattgagacattgaaattgcctgatctttttgagtgagtgttgccactttgacccaggcaaatgagaaataaaacaacaataccaaccagcagtttcaagtatccttctgctgcataataactcagcagtaggctttgctaatggtgtttatgagctgccaggctagaattggcccttaagcagggaggcatttgcccagtgggcttcttccatgtgggggggcctttttgcagcctgggggcccttttaggtgattctcagccggagcggtctcttcaggccaaagacttttgcaatgagctaactatgttcaattattgctttcagatccaccctacattcaaatgttttgggacaccaatgtaataccataaaaatgactgtgtaggacacgcctatgctaatgtcatgactggtttgttttacgtattatttatttatttgatactgttaataaaaagcaaacaagccaaaaagaaatactccccaacgtttaatagagatcattgtatcctaaaatcttatagcacattagagtgcaatgaagctcaatgtaacaagcatcaacaatcaactacgaaatgagtatggaaatagagtatatccaaggaagacagaagtgtagaccacatgatgacagcgggataaagacaaaggagaaggtaatcgagagccaagggttaaaccattcaaattgtcctttggcattaaaatgatccaagatgtttcatgagttcaggttaaaaaaggaaatcagtaaaccccaatatactttaagtttcatttgacgcccacaagctgaaactacctctttgtggtgtgtgtctttacatcagcaaagagtataattgaatttggttattatctccagtgctacctgtttggacctgctatttcaccttcctgaaaactgttgcattgagttctactggggaaaattcttaagataacatctgtttactaagaagggggtgtgcttacctgctctaaggtattgaaatacattgtaaatctatacctaattcatataaacataatttcaaggaaaaacaaaaacataagagacagaccctggcggagtgccaaagaatttgtcagggtcccagtccctgtaccttatgggagaattaaattcattaaactgggccagatgtggtggctcacactggtaatctcagcactttgggaggctgaggcaggtggatcacctgaggtcaggagcttgagaccagcctggccaacatggtgaaaccccatctctactaaaaataaaaaaaattagtcaagcttggtggtaggtgcctgtaatcccagctagtcaggaggctgaggcaggagagtcgcttgaacctgggaggcagaggttgcagtgagccgagatcgtaccactgcactctagcctgggcgacagaatgagactcagtctccaaaaaataaataaataaattcattaaactgaacaaattgagcccaatttatttgtcatagttcaaagaaaaggagagagtagagtaaaggggcttagtgcaaatgtctggtcagatactcaaaggtttagagcctcttaacccttatatttctttacataatttattctcattattttttgtttgttttttgagacagagccctgctctgtcatcagtctggagtacagtggcgcgatctcagctcactgcaatccctgcctcctgggttcaagtgattcccctgcctcagcctcccgagtagctgggactacaggcatgcatcaccatgcccagctaattttttctattttggcagggatagggtttcaccaggttggccaggatggtctcaatctcctgaccttgtgatgtacccaccttggcctcccaaagcgctgggattacaggtgtgagccaccacgcccagcccattcttgtttcttggtaaaggaaaatccaactatatatatcttctttaggatcacttaaagacccatacagatctgtcaaatagacatccaatattttggtaggctttgaaaggaggtgcaaaaggatgagaaggaatttagggagatcattatctgaatcattgaacaaatgctccttaagcacctggtgaagagaggctactgagaagcagagcacgtggtcccagcctacgaggtgacaaagtaaaatggcagaagcaatttgtaatgatctcacctatatgtggaatctaaaaaaaagtcagcctcatggaaacagtagaaaggtgattaccaggtctgggggctaggagagagatagggaaggggaaatgctgtcaaaggatccaaagtttcagttagacagaaaaaataaacttcagtgatctattgcacagcatggtgaccacagttaaaaataatgtatggtacatctccaaattgcttaaaaaaaaaaaaaaggtttcaaatgttgtcaccacagaaaaacaaaaacaaaaacaaaaaaaacaaaaaaaacgaggcaaggtgatggagatgttaattagcttgatttaaccttcctacaatgtatatgtgttagtccgtttttgcgttgctgtaaagaagtatctgaggctaggtaatttgtaaagaaaagtggcttattttggctcatggttctgtagactataaaggtagcgtggtgctagcatctgcttttggtgagggctcagaaagcttccaatcatggcagaaggcaaagggggagcccacatatcagatggtgagagggagcaagagttgagggggaggtgccacgctcttttaaacaaccagatctcatatgaactcagagcaagaactcactcattatcgtgagaacaacaccacgctattcacaagggatccacccccatgaccaaaacacctcccactgggccccacttccaacactgcgggttacatttcaacatgagatttaaaaccatgtcagtatacatacatacattaaaatatgcatcacattgtgccctatacacatataaattattgtttgtcaattaaagaaagaaataattttaaaataaataggccaggcgcagtggctgatgcctataatccaagcactttgggaggccaaggcaggcagattccttgagcccaggagttcaagagcagcctgggcaacatgatgaaatctcatctctaaaaaaatacaaaaattagctgggtatgtggggggtgcacaggtagtcccagctactcaagaggctgaggtggggggattgcttgagcctggcaggcggaggttgcagtgagattgcaccactgcacaccagcctgggtaacccattgagaacctgtcttaataaataaataaataaataaacaaacaaataaaggttgtgttagaacaaaaaagaaaaagagtgacaatgcaagccacatagttgaagttgacattaactagcatgtgccaacgagtgacaaaggaaacaagtgcaaagcaagaaaagttagccattatcatggtccatagataatactctcaaccccggctcttgagtgaagcagtattgtgcagtggttacatttatggacctaatggtcaaactgcatgagttcaaatcccagctttacagctaatggttgcattatcttgggcaagtcatttaacatctctgccttaattgattcacctctaatatagagctgataggagtctgaaatagctgctataaggactaaatacattaatatatagatagcattcataacagtgttttgtggactttccgaaggtgctgggccttccagttgccttaaagaatggattggattagggtggaggagatgaaaaaaggcatcacagtacatcaagtgaatggtgccagtgtaagtagaatacaggaataaggaaatgcccagcttgttggggggttagtatgaagacctctaactgggactgaaagttctagcaacagtaaaataccctggcctccaactactaagtaccctgaatactaagatgagtttatttttcattctatagacaatttccatctctttctttcaaaacaaacaaatgatgacgctgtatgagtaacagaagatgactgggaacagaaccgtgaacagaattaagcacctgcaatcaaataaaattcacagaaaacttaatttaccacattagtgatatgcataatcgttgttgtgctggtaaccagctcttcaggaaaaaaaaaagaaaattcctgatttgttaaaatactgtcactatggcccactgaaactatcaaaatgaggcatataacaggaaattgggaggagagttatacaatcagctcttgctagaaaatgatgatcattgacattacccttatggaaccaatccaaatttgggggttgttttctttctttctacttttgtgtgtgtgtgtgtgtgtgtgtgtgttctctggtatctgtaaataacatccatatcagtttctccatccattctttgcacatcactggtaatgcctgagatcaaatctgccatgcttttccgggcagatccaggctgggatctcagtatccctgcttccctgaagctgtccaacctcactcccttcattgctctgctgtgattaggaaggagccattccaaggactatggggtgctctgtgggataagcccagtccttcttccatacaggaggaacaggggacgggtgctgacaagaggaaatgcatggagcagagagagggaacaggcagatggactcaaggtccccagactctttcgagtgttgaatcagaaggactggagctgtgggggaagagggtgggaacagggtagtggaataacatgcagacagatgggctgaactgaaggtccagaggcactcccagccgtcaaccagcagttcttacaccaggttgatgttagggaacaaccccagctttaaaacttatttataccaaagtgccaaatgactcatttgagacaaggctttgatctctggggacagggcgttagacagcatgaggcttaggttgccaggtgtcttcccacagttcctgtcttgtgtatgttacacactcaattcatgtcaggatgacactacattggcatgatccaagggaacccataactgacatgaatatgtgtgtgtgtgttgattggggagatgggaaagagaacatttcttccagattttctagttcttatagttcataatcttaatcctcatctccacttctctgccacttctctggctaaatccaaagcacagcctggctagagaggacttctcttccttgggggttctagtctattctctgagttgtgacaaacatttccattccctgtaattacccacttgccttgtctctgaagaggcattcacagaataaaccaaaagaattgtagtgttaggaagatgtcaaatcatttgacctctactccatctccggcttttccttctccccccatgaaagttatgcatttagttgcctcttgttcattagtctggacttagagcaaagtgactacttcaacttcttgtgctcaacatatgccacagttgcttacatgtgataagtccatttgtcacttgataagcctttgctagaatttccttctctccatctccaaccttataatgatcttgaaggcaatgtcggaggctaggtaagtcttctttgtgttccccacttgagcataggtgagctgtcatgtcaatttccttacactactgagaagaggggatgtgggtgggcagggacccccagaaacaactttacccctttcacagtttccatcactgcctccaatgtccaccgacgttagaaagtttgggcagaagtggccaggtgcggtggctcacgcctgtaatcccagcactttggggggccgaggcgggcagatcacaagctcaggagatcgagaccatcctggctaacatggtgaaaacccgtctctactaaaaatacaaaaattagccaggcgtggtgtcaggcgcctgcagtcccagctactagggaggctgaggcagaagaatggcatgaacccaggaggcggagcttgcagtgagccaagatcgcaccactgcactccagcctgggcgacagagcaagactccgtatcaaaaaaaaaaaaaagaaagtttgggcaaaacctagagtttcagggaaagtcatttgaggtttggtttaggcaggaaatagaacaaaaccagtgtactaaggagaatacagtggaaataagagggaaaggaatgaagaaactggtaggctactaaaatgcccaggtacaaactactgaacatccacctttatgctgtcagtgggcagaaaaagaaatagacaatgacaagatacattttgaattagtgtgatttaaggactggctgatgtgcacaaaacatgagagaagggagtcaactttgacagagatttcaagagcagatcactgatgaaatgtgataacattcagaaaatagagaagttgacatgggctttgatgaaaacacaatgagttcagtttgaagcattttgaagtcaaggtgattttgtgaaatacaaacgatgctgtccagcaggcatagaatctatctggagtcatttgtacaatatacctatgccttttttttttctttctcctactgtagacttagataggaactcacttttgtcttttttctgctaggccaataaatacgttctcagcttagaaaaggggctttttggtttgcctatttctgtttctttttacagaagttaacacatttatttgtgacctattaaaatcatgaagtattaccactgggttttatgttttaatggaaacatttcatgtttagagaataatgatgcttaaaatttatatgaattaaaattttagcctgtaaaaagagcctggaaatatcttcataccatcatctatccttccacttaaatattaatcacaaagaagatcaggcgtagtgaacatacaccacgcaacctcccattcagagaattcttgtgcaaagaaggattccaaagggtttcagaaatactaaacttcttgaaattgaaattgaaattgaaatccttcttggcttctctacctgttacttcctctgcagtgctcagtatagtgtctgctctccctcctttctttttctttttttttgagacagattttcactcttgttgcctaggctggagtgtaatggcgcaatcttggctcaccgcaacctctgcctcttgggttcaagcgatactcctgcctcagcctcccaaggagctgggattatagtaccacgcccagctaattttgtcttttcagtagagatggggtttctccatgttggtcaggctggtctccaactcctgacctctggtgatcctccctcctcggcctcccaaagtgctgggattactggcgtgagccacacacccggtctgctctccctcctttcttcacttttctgcttcctctctcatattaataataagcttctatctttccttaattgtttacatatctgtctgtcctctttctccaccccacgaactcctcaaaggcagagtccctgtcttttttatttcatatccctaatggtagctgcaaagcagacactcaagaaggaaggaaggaagtaggtgggagaaaggaagaagaaaggaaaatgaaattaactactagtttgtttccctgtttcattgagaacacacgtattaaccaaacaagtaaacaattgtcagaatattgcattttaaactcctgagagaagttgctgcttctgtggcatttctatctaattaagtttccccttaaagttgtaatcttttctttcaaatctcataatacgtcttatttaggtgatcataccaattatatctttcccactcaaacccctaaagttatccttgaataaatgagccttgcaaattatatttccccaatttgcacttatttctttcttttttttcttttttctttgagacagagtttcactcttattgcccaggttggagtgcaatggagtgatctcagctcactgcaacctccgcctcctgggtttaagcaattctcctgcctcagcctcccaagtagctgggattacaggcgctccccccctccccatgcctggctaattttttatatttttagtagacagggttttgccgtgttggccaggctggtctcaaactcctgacctcaagggatctgcccacttcggcctcccaaagtgctgggattacagatgtgagccaccgcacccagcctcagaatttcttactgaataatccttttatagtttgttataactaacacaaaacagtagtgggagttcttattcagatagctaacaaattccaggcacctcctgtactataagtgtccctcatagcacaaaggggaaagctgccctttaagaatccataaatgcaatgaaactctacttacgccacccaggttgttaggacacaggaatattaatctggagaagcctttgataatagaatatagtcaaagttgacattgtgctagaatatttgaattttttattttccagaaattattttcactctttgctacatttactgtttgacctcaaaagaatgtaaaagcaagtttttaaatacaccattatttcctcaagaggctacagaattgctggatttttttttttttttggaatggagtcttgctctgccacccaggctggagtgcagtggcatgaccttggcacactgcaacctccacctcctgggttcaagcagttctcttacctcagcctcctgagtagctgagattacaggtgtgtgctcccatgcctggctaatttttgtatttttagtagaggtggggtttcgccatgttggccaggctggtctcaaattcctgacctcaagcaattcacttgccacagcctcccaaagtgctgggactacatgtgtgagccactgtgcccaacccagaattgctggaacttaatgccaactctcaattgtctttccttctgctagatctagttaatagcaggtgtctgatacatgttactgaagtgaatatgaaaaatccagagtaagcaaataaatcatatttttttaattaaaaacatataaagtacatttttgtcaaatgaacctaattggcaaagcaaaatctcatcttttaaatttctgagtttccactattgataaaaaaaaaaaaaataacgtaaaacagtgttggattttcaaactcaaaagaaagaaaaaaaccacaaaaaacaaaaaaagcagaagttgggtaaaaacgagttctgactaaaagctgcaatactgtctcaaatgtgcccatgaccccacctattgctcaatttctacaccatgagggtaaagggaaacgaaatgcaacttggattcacttgacttcttaagtcttacagagagagaaactgatcagaaaagatacatttttggaggttggtttttttttttaattcttgcttgtaaggcagggcttggtgactcctggtctcctccaatagcctaattttcctcccaaaagtaagcttttgattccactagggtgggcaagtatctttgtactctgccatttcagagataagagccaactgattttagaaatccaagagcaaatgaaatgtgcaacattttactcttggattgcttgagaccgcatctgtatgcctattccctggagtgcagactgtcttgtgagcatttggtgccactgaactctgaaaatcagggcatgcagcatctgctggggaacacaatctggtttctgtggatcagaagcatttctctacacgttagagtcttaaggatttttaaagagagcaggtctactcaggcaactcgttaccgtccctttcaaccggagtcagaactaagaatgctcagcagatggttgtggagtgaggtaaatttacatgcagccttcagtcattagtgacagatctattttaaagggacgaggttgtgcaacaagggtacaaaggcagctcatggttctaattgttgggctccattagaaggggtctttctggagactgtggtttcttagagcaccgcagtctacccctgaatgaaaggcatcctgctggctaattaacttgcagcactttcttctctattgtgccttgattttttgttttgtttggttttaatctcagaccttgtttctagtaggactgatggagtcttccattatttcgcctaaatattttatgaagaacagagtttccaatcactcactcactctgatttcattacttttagcatacttttcgttcttataatctgcaataaagaggaagactattaagattcaagcttgtttgagcaagtacactgccagagcaaaatcagaggaattcatggaagactgggaaggtgcaagtaatctttctcttagaattgtgatggtaacatatgaaataaaatgtgggagcaaatgaagccattgaaaagagaggccattatacttctgaccacttgggaaataccccccaaaatagctgaaaggtcccaagaggctgggcacagtggctcacatctgtaatcctagcactttgagaggccaaggcaggcagatcacttgagcccaggagtcagagaccagcttgggcaacatggcaaaaccccatctctacccaaacaaacaaacaaacaaacaaacaaactagccaggcatggtggcaactgcttgtagtctagctacagcttccatgaattgttcagtgatgctctcttaactccatgatctatggaacaggcaggcagaaatggagagacagtgggtggaggggaggagcctcagatggcacagaaatctgtagcatctagatcagagtgacacctcagagtttcgagtaacgacaggcacctggcccatggctgggattgttaccagtggtgaatctgtgcaggtctgcagcaacctcaattcttccctctttaggataaaaacttcattgaggggcataaagcagaagagactgaagcaagttttagagagggagtgaaagtttattaaaaagctttagagcaggaatgaaaagaaagtaaaatacacttggaagagggccaagcagacatcttggaggtcaagcacagggatttgaccttctgacttgggggtgtatatgctggcctatttccagcacttcacatcccttttcccttgattcttcctttaggatgggctgccgcatgtgtggtggcctgctagtgcttgggaagtgagcatgcgcagtgtgtttactggcgttgtacacatgctcacctgaggcgttcttcgggtgaatgcccccagaaagtcatgtaccagttaaactctgccatttggcctcttagtgcatatgtgtgagccccctgcccaactcctgggaccttatcgggaagctgataatcaccagtttcagatttttcctatttataaaaagactgcctttccctggagctggctgcaaccaattattttagagagacagttaccaaccacctgttcatcacttgatggtggcctgacattcctggttagggcggggggcactgtcctgctctgctcatgtctgcctacctactgtagcaggaccacaggcagacttttcttaaggagactcccagctttcttcctggtgaaggacccagagtttgtgagcccaggactgcagataatcaaaaatattaaattatggaagctaaatatttaaaataataactcataatggctctccaaatgtctgtaaaagcatttcacttaacaatagctggcaaatattatgtcagtggaaaatacagccaagttttggctcatccaaaatgttgtcatcaccgccactttaatatttaagagattaatgtttcaaggctcttccagaacattgtatttggagtctgattgaaagactcctcggtcctccctcattattctttatgtgtgactttggatgctctcaatacacttaaattgtatgtccctgtggggaatggttctcaaagtgtagtatctggagcagcagtatcagcttcacctgggaacttgttaaaaacataaattcttgcagctggatgtggtggcacatgcctataatcccaatgggagaccaaggtaggaggatatcttgagcttaggagtttgagactagcctgagcaacatagtgagaccccatctctataaaaaataaacaaaattagctggacacagtggtgtatgcctgtagttctagctacaggggagtctgaggtaggaggattgcttgaacccaggagttcaaggctgcagtgaactgatatcgcgccactgcactccagtctgagtgacagaacgagactctgtctcaaaaaaaaaaaaactgggggccacacaacagacatactgaatcagaagcctgggggtgtagctcagcttgtattttaacaaggcctccatgcaattctgatgtgccctccagttttagaattgatgctctgtgcaaatgaacaggtactggggcataatgatatgcaggactgttcttgagccaggctttgtattcatgaagtgggtgatagttgattggcattgtttcagtactcagtagctatgaagcattctattggtatcattggtattaaatatggagcagaagcataactcatctccctcatggccacatgaagaaagatcagtatgttagagctgaaggacacctaaagccccaaacaactgccagagaccaaaatcatttgtctcaagaaatgttaacaccctttttgtgttcaagttttattatttctttactaaaattgcccattcacccctttgttttatttttcacacctaaaaaagtagccaagtttgaaaaagaaagagtgcttgccaccctttctgtccttaaagtgaaggccttgtctatctcattctgatctctgcccatccatcaccattcagcactcctgttgtgacttcgccccatctccaatcttacattttattttcttggtacttttggtcatggctgtgttgatggtttcagaagaatacatagtatattaaggggtaacgtttacaaatgttcttgagagaactaatttttcccccttcatctcaaggtgtcactgcttaattattacggttcctaaataatctctatgatgtggttaactatccctaccttgcagaaatcctggaagatgagacggacctagcatgttgtgtgagcaacatctcttagagataatcaatttgatatcagcacaattattgtggctactattgaaatttctcttagtttcttagattagtactattggaactaatcgtaaataaccaatttacaagaaaatgagtctcattatattatagcacgaagaggatatattcaaggagatacacctttgaatctattatttcaatatgcttataaaaattactattttaataaatttcccagtcaatcctattgtgtagaaaaagatgcttcactgcttacatattttaagatgagactgggaacaagcagattaatttggttgtgagactgggagtttatgagcaaaatgttcttctgtgcaaacgaagtagaagcttcatttcccttcccttcagttaaccctatgttattggatacgtaccaggtactagagattctctccctgggtagtctggcttagaatggctccccaggctctagccatctgcatagctgctagaggaaaaagctgttttagttggctccaagaatgtctctgggaattataatgtattcatagaaatgagtgtggagtgcccacttgcacaatggaagatccacaataatacacctggatctgatagcaccttcctgaacttgggccacttccctctttgaggtttgtgaggccaaagggatatacacagaggctgcctttgtttgtgattacctgggaattagatggggtatcattcccccttatatccttttactatagcttgttcacttttgaaaaggtggaaaactagactaaattctgtattgaaaatgtcaagtcaaatatgctatataaccaagaaatatcagtatagaatatcatgtattctacacaaagctacattttcaatataatccccgtaattatttcactcatcaaagaaatgtatccagctgagacataaaaccttagtcaatacattaagaaaaaaagaaaaaaaaaaacatttttttcccagtcatggggaccagattgtgtctattattcatcagggcctagcacaatgttgagcacatgctcaaggtggccaataaatccttgtggaattgagttatatgggagtcaattattcggtcacagcactggattaggaggttgagttcttgatagatttactttcagctgacctgtgtgacatttggtatttggttttgcaactttgttttcagttttttccatgcaccaatactcctagaattttgcttttgcctcttttcttccctttcatcttttttttttttctgtagaaagcatacatccatatagaagacctctctcaatacattccagatctgagttgcagtgcagcacttagcttagcttgtgaaacactccaaagacttgattaatatcatcctatggagagatgtccttaagtaacttagaatggatcctttatttttccagtaaataaactctaaaatatgaggatttccaaggtgaaaagaaagagtacgaacccaagaaatattttaaatgaatcttgttttccgtccctgtgttctgagtaacatctgtattcacccctgcctttccattgattggaaacctttagtattctttgtactctcacagtcctagtttctcagaactgtctgtcccagtctaggcagttgtttcattaaacaaatgttattaaacaaataattttgagtgtgtgtctggtggggaggggaggctggggggttaaattcatgtatttttaggcaagagtattaacaagaattgtttgaaatatttctgaaaccatagtgtcataatgaaaataaaaataaggtggagactggattgtaattaacacagagcttttccatccaagacagagcttaaaggcctctgtttgttgggtcactttaaaaacaaaccctactgccagggatttccaatggcaactttaccgtgcttacccaaatggaggtaattaacaacccttctgtgtgttaaattaggtatccacagaattgggaagcttcagatatttattgtaaaccagagcctcttttcttgttaatctcctaagacagcagactagtgactcgcacccattagaacaaatgaactaagaaactgaatgacaggttctgaggcccctaagaagaaaaaacagagtctggattagagctgcttaacagaccactcactggggcatgctccctccccacgcccatttcctatcccagaaaataacaaacttcagatgacccgccaaaaacgactaccttttatatttgtcgttgaattatttcttctttgtttaaaattaaataatgcaagtgatttttttgctttagaaaggaggattacctcttcctagacatccagttgaaaaaccaactggtatagaagggaaatgcatctcaaacagatacaatgacattcttataattgcctcatttgaaatggcagcatttccccgtgctaattgtcatccttcagctaatttggtacattaaaggagattgttattaaaaacaaaattaaatccattgccagcatctttattctctaccagaagaaaaattttaaataaatgcaaatacgccagttttgctcttaatgttgcctgaagttgaaaggatgaactttgacttgaaagataatgagttccccctgttggaggatttgaggtttgggttggataatcccagatgatgttggaatagacagaatttaaggttccttctaaccctgaaattctatggttataaaatctatccttttcttgaaagaagaaatattaaaggtgttttcaaggaaatggtagcataatgaaaaaggaaacacaaaaatgatttttttttccttaataagcagtcacctcacttggtaatagtttttcttcttaattgcttgtttgtttgtaacaaatgcggtggtgtaatcaagtggcttttacaataataaaacacttctctcaattaaactgtactgcaaggaattcaaagatgaacagaagtgttccttcttttaagatgctgatttataagcatccctttaaaatttacttctctttctgatgataaaagtaatacatgtttattgtagaacatttggaaactaccagggactataaataacccatagttgccccaccagagaatattcttaatatttttggcatatttcttccatatatctattcatattcacattcatactaatttgtcatattctaatttaaccctctctttaatgtttataatgtgattatactactttttaacacatgaattgtctccaaataaaagccaaagtgatccatttgttaattttttttaatcctacccagctgaaatggacaaagaggagcccatctcactcgggggaggggatcaaagagttatcctttctcttgatcaattctgtagcaatcagccatgataagaagcccaaattaccaaattaacaaaaagaattttatttagtggccatatataaaagctaaatggacagttggagacagacaacaaaaactaatataaaactaaaaatgtgaaaattcagcatttaatgaaaatgagagcttagaaaaactagcatccagatttattcagactgaatttctgccctgggaaattaatgaatcatccttcagttcccttttgtgtctgtgcatccagcctcattgtccttggtagtaaattatgtacaccccctgtttccaaatcttcaaatacggtatgcgtcataaagtcacaaaatgtgtaatttgggtcctgtatacaaattctagccagggaatggcttgtagtcatgctaaatattctttacaagttgtgtaacaaagacaaagaaaactacaaaaaaatacagagaaacataaaaaatttcccattccttctgtgattctgatgtatttccctttgattctttgcttctacattgaaatagacttagtgggtaatactaataattacagttaacagtgaccaggtgatatggtttgactaggtccccacccaaaatctcatcttgaactgtagctcccataattcgcacgtcatgggagggatcccgtcggaggtaattgaatcatgggggaaggtctttcctgtactgttcttgtgatagtcaataagtctcacgagatctggtggttttataaaggggagttcccctgcacatgctgtcttgcctgccaccatgtaagacgtgactttgttcctcttttgccttccaccatgattgtgaggcttccccagccatgtggaactgtgagtccattaaacctctttctttataaattactcagtcttgggtatgtctttgttgttgttgttgttttgagacagagtttcactcttgttgcccaggctgaagtgcagtggtgtgatctcggctcactgaaacctctgcctcccaggttgaagggattctcctgcctcaccctcccgagcagctgggattacaggcgctcgccaccacgcccagctaatttttatatttttagtagagatggggtttcgccacgttggccaggctggtctcgaaccctgacttcaggtgatccacccgcttcagcctcccaaagtgttgggattacaggagtgagccactgtgcccagcctgtttggttttgtttttgttattgtttgtttgtttggagtatgtctttattagcagtgtgagaacaaactaatacatcagaagttctgattttcatatcagcacagagaaaagtgaccttcccagtccagtctatcgtattctcaaattactttctctaacttgtgaaataagatcttcttggtgaactttatcagacatttctgaacagaattaccactctgtggtggcctgggtaaatgtaatatatttataataatttgaaaagattcctccaggacttttacaaagacagatgatattaaactgaacaaatagtgctaggtaagaagtaaattgttcaattttttcacagaagccctgtagattttagcaaaaccccccagacacaatgtcaaatttctcagcaggtttcttggttttagctcttccccttaagcagtagttaacagaatattagatgttagtaaagttatttctttgttattctacctgggttgactaccagagaaaatccctgaacattttacaaattgctcaacagattttcatctaaaactagaaaagattggccagttatggtggctcacgcaggaacattgctttagcccaggagctgaaaaccagcctgggcaatagagtgggacccccatttctaaaaaataatatcttttaaaaaattaactgggcatggcggtgcgtgcctgtagtctcacctacttgggaaactaaggagggaggattgcttaagcccaggatgtcaagattgcggtgagctatgattgagccactgcactccagcctggaggacagagtaagaccctgtctcaaaataaaataaaataaaattagaaaggataggtgtgtttgggagggagactggttaaccagggtgcatgggattatgtagggcttgtctttcatttgagttcttctctgtctttttaaaatgactgattatatatattaggtcccaatggcttcattatcactattattttaattcataggttaaattttataaacatgaaaaataattgacaagcctagaatctcttttctgtctatattagaaattaaattatatttagtatttaagcaatacatgcatacatctcatgtaatccttactgtaattaaggatgaaattatgtaacataggaaaagcagatgtaagttctcattctccttttacacataaggaaattaattcagacttttagtaagttgcccagaatcacgcagctagtaagattcagaactaaaaatataatacctgtcttctaattcaaatgtttcacatccaagtgcccatatactaataatttttaactcttttgttggggttaaatgagataaaattgagtcttattgtatagaatttatcagaaatagcaaaatttcgcccaggcacggtggctcacgcctgtaatcccagaactttgggaggccgaggcaggtggatcatctgaggtcaggagttcgagaccagcctggccaacatggtgaaaacccgtctctgctaaaaatacaaaaattagctgggcatggtggcaggcacctgtaatcccagctacttgggaggctgaggcaggagaatcacttgaacctgggaggcgggggttgcagtgagccaagactgtgtcattgcactccagcctgggcgacagagagagattttgtatcaaaaaaaaaaaaaaaaaaggaaaatctctaaaatgatacctaaaatgataaacaatttaaatttagcataattatcattttttaacttacagattgacatatttctgcaagtgttttcagaggcattggggccacagaagtccaagtcaaggcaatttttggtactaaacagttgacttttctctggtccacatcaaagctgccactgtgcagagaactaacatgtgtacgtgactagtctagggctggaggaacatgcgaggggactgttggaaaggaaaaacttttgctcttcctctaggttcagtaaattagggactgtaaacaataataatgaaagattaataagaggcacacaattttattttattttattttatttacttatttttttgagacagagtttcactcttgttgcccaagctggggtgcaatggcacgatctcggctcaccacaacctccccttcccgggttcaagtgattctcctgtctcagcctaccaagtagctgggattacagacatgcatgaccatgcccggctaattttgtagttttagtagagactgggtttctccatgttggtcagcctagtctcgaactcctgacctcaggtcatccactcacctcggcctcccaaagtactgggattacaggtgtgagccactgtgcccggccccacaattttattaatatttatatgcaaaagagcttgtagaaaatcagtgaaaatcaaagaagtggttagactagggggtttataaacccttcttaaccaaggaaagagggtttgggcatcaatgagtggcgaattgtggagaagtgactagaaaatgtatgagagaaactaatggaaggtatattagttcattctcaagctgctataaggacatgcccaagactgggtaatttataaatgaaaaaggtttgactcacagttctgcagggcgtggaggcctcaggaaacttacaatcatggcagaaggagaagcaaacacatccttcttcacatggcggctgcaaggagaagtgctgagcaaaaaggggaaaagccccttataaaaccatcagatcctgtgagaactcactcactatcgtgagaactcacttactatcatgagaacagcatgagggtaacagcccccatcgttcaattacctccgaccaggtcccttccatgacacatggggattatggggactacaattcaagatgagatttgggtggggacacagccaaaccatatcagaaggtaaggcctattttagtaagttttgtttatgcaaactcatctcagtgttgactccctatctttataacatgggtcacttttttcttcctgatggtgtgggggagagggcacctatctcaaagagaaattttgctctgcttttagatgtacaagggaaagacagagaactgttcctgcatccattgattatcaattgccttcagctcaaaataatccttatgccaaagtagcatattttggggtggcatatttcaacctccttcatctctacccagctggaactgtccagggagttgcatacctcaaaagctgagttggtggctataaagacaagatttgggttagttcctgagaggtaagagacctgcaaagggaaagaacatagatcagaacgagaataaataagcagaaaagagcaaatctcagcacattcccactgatctcactaaaccaggctcctagtactggaaataggtcagtcaacttcaacaattgtatctcatttcaggaagcagcatgcaggtgggagtggggcacccctctgaagtttggcctttatgctatgtgaataatcacacacttaaagagaggcatttctatgaaaacaaaagaaaaacaaagattaacagttggagcagactctaaagccagtttttgagtccagaaggcagttagttggcaagatttctaaatgttggattcaaggctgggtgcggtagctgacatctataatcccaacattttgggaggctcaagtgggagaattgctcgaggccaggagttcaagataaacccgggcaacacagtgtgactccatctctaataaagtcatccaaatgtagttgtatgcacctgtggtaccaactactcaggaggctgaggtggacggattgcttgagcccaggaggtctaggctgcagtgagccatgatcacaccactgccctccagcctgggcgacagagtgagatcctgtcttaaaaataaataaataaataaataaatgttggatgaagtgtctttagatggtggattgaggataacaggggcagtctcagtcacgtgcatttcccggagtttgaaggaacatgttctggtgagcttcctgagtggtccaaactacggtagtgataattcctttgaagttaggttcagttgtccaacttcagcttccagggctccaagaaaagggcaattgtggttctcagtgatgccaagtcacaagggtgagagaagactggaaacattaattacaagatggcaggattcagtttataaaggggggaaatatctcaatgataatgaacattcacaagggtgggttatagttttccattaaaacataaaatttctttctacaatcacccccaatgtgatcaaaaacaatcaaagtatgtctgcttgtgtctggcaactgagtctagtctcattaaacttggccagattatttacataataagtgcagcaagaatagtaatttagcacgtaggcttttttgtgtttgctcttctggaacttttaataaggactctcagaatagacttttaaaagctcttgagagtagtaagccaagccaagaactagccattagactttatctgtaatacctatagattggggtgaatttcccttttcttgaggactctaaaacattctgagtttcccgggcctgccagaaagttaccttccttacccacctgtaaggctaggaacgctataaaccagatacgagtcttacttttccaagggagctttgtaagcgttggtgccatatagtcaaccttagttccttaaaactattgggttatatgtgattccacacacattattttcaaacatgacactgcagtcaaagccttagtaggacagccaatgtttccaattgtgttctgttccaaggagaatagattcttatggaacttaggcaaataactatattgccatgaaaattgaaatactcaataagcatttctgaattttggagagatcaggtaggggcaaaagataaatatttcatttttgtttatgaagacataatctattaaattattgtgaattacaggtagcttttagaaagggtttcctgacatccagaagatagaacattaaataaccagcaaggtttcaatcaaaaaggccataaaaattataattgttttttatcagttcattcagtcccatgtaattaattcttgttttgcttgatcttagattagtggatttatgaatccatcagcttctccattagttctggaaatccttactgtgtccagtgttataatcttgaagttatttaagcaatgtcagcagaagcctgtactccagagtacctgccaaggttttgttcatgaatctctaatatgctctttctttgctgaagatgaggcatgctggcctacagctgactgcgtgagccttcagaaaagcatcggcataaaacaataattatctgtgaatgacaatgacttaaaatggccatacctaaagatctgatgaaagttcattataagtcaattgataaagaaatttggttgtttctctgacatacaggattttaagataataatgtgataccaagacatctcatgaacagcaagggcattgacagatttctaggaattttatatgatttctgaaaaatcaaaatcattatatccatacaaatataacccaggaatggttaaatatcttctctttatttgacagtgcttcccatgcaatttagcatattaaataagctcatctctctttttacaaactgagagaacaaatcctttgagagttttccaggggccctctgggaaattccagagtcaattcaaggtcaagaagacttcatttggaatttgatttagggaagttgtgaaaaacgtgaaaaggtttgaacaattgattaaatgggatcacagatcactataaaacaatacttagttatctatttaaccaaagtgacaataaaagattttcaagataaatatggaagataacataatcataaaaaattttaactctttcaatcttaagaaaacttggttttctgaaataatcaaagacataataagtgcaacataaagcacagaatatttattttctaggtgtatcactcaagaggtaaagaaaacatttcataatctcttaccaagaatagactactcggtatagtggctgaggcctgtaattccagtcctttaggaggctaaggtgggaggattgcttgaggccaggagttcaagaccagcctaggcaatatagtgagaccctgtctctctaagaacaaaaaatagattaataaaccaagaaaacttgctcattttaaaagtagttttgcatcaatacactactgtattagtccattcttgcattgctgtaaagaaatacctgagattgggtaatttacaaagaaaagaggttgactcacagctctgtaggctatacaagaagcatagcagcttctgcttcttgggaggcatcgggaagcctccaatcatggcagaaggtgaaggtggagtaggcgtcttacatggcaggagcaggagcaacagagggtaaggggtcaggtgccacacaattttaaatgaccagatcttacgagaactcggtcactatcatgagtacagtaccaagagggatggtgctaaaacgttcttgagaaatctgcccccatgattacaatcacctcccaccagagcccacctccaacactggggattacatttcaacatgtgatttggtggggacacacatttaacccatatcaactactaagctcattctttaaaaccttataaatacacccattcagtcctagccagcgtggccacacaatgtaagattctctctctcttctgttctctctctctctctttcactgacctttacaactttctatatcaactcacatttttgtcctttattttcgtctttcttatttaaatgacctctaaactactctaggataaaagtcactgtcatttttctttaacaaaaacacatctcactctccttgtactctttgcctgcagagttttgtttcttcatcctattattactagtagttcatttacacatatttattagatttcttaacccttagtaacattaactttcagtgaaaatgaagaaataaacaatcataaactgtcagttacatacatgcattctgtgctacattagcacaggtataaatacattctctcataatttctagaggcatgtttcctaacagtacaacttctcagtgtggcaaaagagcaggtttattaacagatccaaatacctttagtctctgccaaattaagaagtcaaaagtagccgggcgcagtggctcacgcctgtaatcccagcacttcgggaggctgagatgggcggatcatgaggtcaggagatggagaccatcctggctaacacaatgaaaccccatctctactaaaaatacaaaaaaaattagctgggcatggtggcgggcgcctgtagtcccagctactcaggaggctgaggcagaagaatggcgtgaaccagggaggcggagcttgcagtaagccgagatggtgccactgcactccagcctgggctacagagcgagactctgtctcagaaaaaaaaaaaaaaaaaaaaaaaaaaaaggaaataaacttaaatagataaactttagtaattagtattttggtattttattttctttgaaattatctacctatttcatgaatatccgtcatttaacttagtataactttaagatttcaagtaaccaaaaagatgtcggaaactatttttaagtcactgtactataaaacagttattgttgaaataaagtttgtcagagtaatgactcaatctgaataaaatgccatctataagtttaatagccttaaacctcagtagttataatgttagtttgactagtaagtccaagtagaataaaatgtatatttcatgttgacaacttgaagacgtaactctctttaattaaagaaataatattaaactggtagtagcggtgaatccatacgggtatgcagcatccttacatcttgcctccttagaagaaagagttcagctgacggacatacgcagagtgagagaccgaggcaagttttagagcaggaatgaaaggaagtaaagtggaagatggccaagcaggcgacttgagagatcaggtgcaccgtttgaccttctgacttggggttttatacgctggcatgcttctggggtcttgcattccttctcgcctgattctttccttggggtgggctgtccacatgctcagtggcttgccagcacttcaaagggtccgcatgcacagtgtgtttactggacgtgtacgcatgcccacttgaggtattttttcccttagcaaatccagtgttcctagaggaaggtcatccgccattttgccttttagtgccatgcttgagcccacttacccaactcctgcgatcttagccggaagctgctgatcagcagtttcaggctcttcctatctgttgggagcctgcctttccctggtgccagctgcaaccaattattattttagagagacagttaaggactgcctgtccatcacctgatggtcgtctgacattcctggttgtggggaaagggaaccctctcctgccctgctcatgtctgactagctacctgctgtaacaaaactagttttatttaccaaagattatcttatatcagataaacttgaaaacatgttggttatatttaaccattaaataatatatttggttatatttctgagtgttttagcaatacttataagcgtttttttaagccaacttagaatagaactcatttattaatttggtaataccatcatgaagtgaggaaatgtcacataggtacaacgtacatacatatatacacacataaacatataaagatttatttattttaaaatttaatttatttaaagacagaaacagatagagattattttaagattttagccacaggtcaggtataaatatagaaacacaaaactcacaaatttatatgagctggcatttttgtctttttaaaaaaatctgaattgtatttctggcagatggaacaagaggttacctgctcaatgagggttaaggctttttatcaatattgttggtggagacttaaaaaatttttttcttgacataataatttaatgtagacagtagcattagtctcaggttattgttttagtcaacagaaattaaagccaggtgacttttgggctggaaatcaaagttattaatatttccttaggtgtttacatatcaaagagatggccctcaggtccttgagaagacagttttgggtggtagaatattttacagctgaaggaggaagagaaaggatgtaaactttcaagtagtccctttaaaagggagttttcgggcatttttgtctgttacagggttgctgcgtatcattgttgttattatcaattgttattttctgggacaaacagtaaattcttctggtagcactaagctttatcaagcaggcattttaaaagtggggttggggggatgatttttgatgggtgtgaattttaagttcttgtctaaatctaatttatgcttgttaattttgttaagggagctatccagtctaaccatgatacacttgtttccttctttcaacttgatcctcccataggtagcaatacgatgtttatttagggtgagagctctctaaatatccttttaaacataaaagctttttcaaatcccagttccatcatctggtctttgacaatttaggatctccaaaggtatacgtgctccaaaatgtgacacaaaaccagtaagacttttatgactcaaaaccaatcatccattttatggtttaaccggggaccaagagttgtccccagagagggtgcagaagactctgccctcatgatggaaagtcattcccaaaaatagccaaagagaaagcgagctgagaccctcatggtcacaggcagcaaaaatggtgtttgtgaaaatggtatctccagcgttacacaaaagtgaggcacctgcaatcacagacttgtggacctgtgacacttgggaggcaatacggagatgggactttttcagcactaataagacaatgaggaaggacaacaagtgccttgtatgagctgagacactttatttagacaaattccccagattgctgacatagccaggtgggaaattttgctagtgttttttagggtccttgactgacagcgagcacctccagactcaggcccaaccacctgtgcttcccagtgggcaaaaacacagacagaggtgaggcgtggtggctcaagcctataatcccagcactttgggaggctgaggcaggaggatcacttgaggccaggagttggagaccatactgggcaagatagcaagaccctgtctctaaaaaaaatttaaaaattacctggacatggtggtgtacatctgtagtctcagctacatgaaggctgaggcaggatgattgtttgaccctgggagtttgaagttacagtagctatggtcgcaacactgcgctccagcctgggcaagaccttgtctctttaaaaaagaaagaaagaaaaaacaaaacaaaacaaacagagcatgctgttactagatctaagtcaagttctcgggacagaagggaggacttcatcgaatttcttttttattggggacccacaacaacatttgcccaaagggtctgtagtctgctgagaactttaaagtcaccagtctgtgaggctggctcaaacaacaggcttatacacctgtgccaatattctattctatgattttcctccttatgacaaacaacacaaaagacagagacaaagagaaaacaatggctgtctccaggaggaaaaggattaatcacaaaagtcctcaagccaaaaatcacaaaagtcgcaatacccaaagaattatttcttacaaatgttttctcctgccaatctaaatttggagaggaaaagacaaggaaatgctcatactgcactccctcaaccaggctctctgcagaaatcttggggggtatgtggggggatctttttgactgggcatggtggctcacacctgtaatcccagcactttgggaggctgatgcgggaggatcacttgagtccagaagttcgaggctgcaatgagctgtgattgcaccaccgcactctagcctgggcaacagagtgagaccctgcctctaaaaaaaataagataaaaaaagcagtttttcaagggtgtacaatctcctacagcattctatctattctttgattaattaccctcaacccatttagccattaatttattgaacaatgtattagacatccacttcgttccaaagactctactttagggttgaaaaaaacctaggggtgaacctggcatggtttttgccctcaaaattcttaccctatgatgggagagagggaagatatgttcatgattaagctctaagtcagaatggtgaaaaaaatcctttatagaagtacaaagatggagcatgcctcttactaaatagttgtaagagcgagcaagagttactaaagcacttcaggttaaggggaggcagagggtaaggcaggttagtgatagggtacttgtaaaatctccaaagcatgaaaaattttctaatgttttgaagtagcagaatataaagtttgtaggagacaatgtccaaagaagagactgaaatggtagtttgaagccagtctgtgaatccattgaatggaacacttcacagtttagttgcctcttcttgattacagagacttacagaggcatttcaactggaaagtgtttgatctgctttgttcatttgaggaaacaactttgctggctgtgaaaaatgataaacagcatgagggagaatttgctggcaaaaaacaaaacaacaacaaaaaaactaagtttataatgcaacagtcccattaaagagtaacatgaggtgcccttatatacttttagtggcaatgtataacatttggaagtaacttggtagtacttattaatcctttgcaaatctttgcccaaatgagtgacagggtctcactctgttgcccaggctggagtgcagtggcatgaccttggcttactgcaacctccacctcccaggttcaagcaattctcatgcctcagcctcccaagtagctgggattacaggcatgtaattacatgcctggctaatttttgtatttttagtagagatggggtttcaccatgttggccaggcttgtctcaaactcctgacctcaagtgatccacccaccttggtctcccaaagtgttgggattacaggcatgagccaccgtacccagactacaaaaatgtatttatggggatgttcaatgcagtagcagctcatatgtccattcatagaagatgggttaaactctgacgtagctaaaccagctaacacttttcaaccattaacaaagaatggtagagtggaatgtggtggcacatgcctatagtcctaactactcaggaagctgaggtaggaggactccttaagcccaggagtttgaggtcaacctgggcaatatacaatatagtgaggccctgtagagatctataatatgttctgctgtaaacataagtccacaatataagggccatttttttttttttgagacagagtttcacactgtcgcccgggctggagtgtagtggtgcgatcgctgctcactgcaacctccacctcccaggttcaagcaattctcctgcctcagcctcccgagtagctgggattacaggtacctgccaccatacccagctagtttttttttttttgtatttttagtagagacagggtttcactatgttggccaggctggtcttgaatgcctgacctcgtgatccacctgcctcagcctcccaaagttctgggattacaggcgtgagccaccgcgcctggcctaagggctattttttaagttgcaaaacaaaaacaaagttttaacagttgtcattctgatatgtagaattattaggaaacctacactatttattttttatacttgtatatactttgtggttttgttgttgttttggttttttgtttgtttgtttgtgtgagacagagtctcactccgtcactcaggctggagtgcagtggggcaatcttgggtcactgcaacctctacctcccaggttcaagcaattctcaggcctcagcttcctgagtagctggactataggcacacaccaccatgcccaaataatttttatattcttagtagagatggagtctcaccatgttggcaacgctagtctcgaactcctgacctcaaacgatttacccacttcagcctcccaaagtgctgggatcacaggtatgagccaccgtgcctggcctatacttgtgtatactttgaattgtttcttttttcttttcctattttattttattttattttatattttattttattttattttttgcgacagggtctggctctgtcacccaggctggagtacagtggtgcaatcatgactcactgcagcctcaagctcctgtgctcaggtgatcagcctcctaggtagctgggactacaggtgaccaccatcacacccagctaatttttgtattttttcatagagatgaggtttcaccatgttgcccaggctggtctcaaattcccaggctcaaatgaacctcccacctgggcctcccaaagtgctgggattacaggtgtgagtcaccacatccggcctgaattgtttctattattcacatataactttgtaatcttaaaaaaaatacttaagactttaaaacaaagatgattagagcctggattaagctagtgtcggcagcctgaggagggaaggttttggatgccattgccaaagtagattgaagaggaattggaatttgagggatgcaggtgattaaaggagagggggaagagtcaaaggtgacactcacatttctagcttggtaaattggttgtttgtttattccattaatagaaatagagaaaagagacagcagaggagggcttcattgaggaggatgactttgttagtttcattttggatttaagtctgagggtcctgaaaaggcagctatatgtttggcttgaacctctccactttccaccttctcagtaattcattaatattttggatgtcctagcctgttgatgtgtgtgtactggaggtggtggtggtgggagctaatatgtttagaagttaacatttcatctgtctttatccttttactctcctttcattcagaccctacaattattgctacagggaagaaatgtggccttgcctgtgaaaatctagtttttggaattttttttgcttgttttccccctaaaatttagctccaaaagagagaagattcttaactagtggaaaaaatgtcttggtcagaaacaggagaaagaacatagctatcctagacaaaaataataataataataataataataataatcataaaagcaagggagggagggagaaagggaaagaaagagagacagaaagaaaaaagaaagaaaagacaggaaaggaaagaaaggagggctaggcatattgcctcgtgtctataatcccagcactttgagaggctgaggcagaaggactgcttgagcacaggaggtcaaggctgcagtgagccatgtttgtgctgctgcactctagcataggtaacatagggagaccctgtttcaaaaaaataaaaaataaaaaaaggaggaaaggaagaaaattccagtagaataaagaaaaaaggaaaaagaacaatatttacaagtacctgcagagagaaggtgagaagatgaagacctgttttctacttttttgggcagcactgctaaagaaataaaaaagtacccagaagtcgcaggactctaataaaatggaacatcacctctattcctgcctgttctttggaggagtagaaggtgaggaaatggggaagtgcaggatgagtgattctggagaagacatggctgtgctcatgttgggctgatgatgtcactgataactaaaacaaagggctcagccaggcacccagaagcctcagggccaccgcaccctaaggaccatgcaggctgagacaggactcttttcagtaatccggaagatggctccaccctctctagtccaggccataccctgggccatacccttagcagtgctacccaaaaaagtaaaaaacaggtcttcgtcttctcaacttctctctccaggttcttataaacattgttctttttccttttttctgtattctgttggaatcttcctttctttctttctttccttttttttttttttttctgaagcagggtctccctatttttttccatgccataccctgaaaaaaatctctggggagaggatcccaaagagacaaaggctaattttctcaccatgcttatagattaggggctttgagaaaatgagggtatgtttttaaagtattttaatagtggactgatctattttacctcctggaccagatgaaatgggaactgttccaattcatggagcaaccagacatacatgttcaaacaattatgaaaaacatacaacagatatttatcaacaaatacatcagtaaacaaacttacatgaccctgcttggccatcactgtttcttttcaacacacacacacacatttacaaatacatatatatgtgtgtgtgtgtgtctgtctgtcgatatatatgtgtatatatatatatatatatatatatatatataaataaaataaataggtaagagctgcttatagccctgaatccccacagaaaaccccgtctgtctttagtttcatgaaagcattgtactttttctcattatttttcagaccatcacagacacttctgatcagtgttccacttaagcttagccccaaatacacagaggaattttatactgaaagttaaagaagcgacagtagttagattatctcatgcctcctagattggctggctttgagcactttttcaaagtgtgtaccaactagggtttgtccaccaagttgcaatggcttgtatttgagtcagccatacgtgctcatggataaaaacaataagaactctttattaatataaatatactctgtgaaggcaaagatgtgctttaaaggaaatttctgagcatgtgagaagtagatgagttacatgaggttaggagcatgcagctgtgaccctaaatggggagaatacagccccagggagctgtgatgcacggccactgggaagctaatgaaatgggcagagccaggaccagtggggtagaattaaggcagaagcttccctcttgtgctggacattgtgctggtctctttcctgcccagcacatgccaggtaggaggctataatgtgatcatgggtcattccatgccacaggaatggattggcctgagctggccttcttcataatccaggaataaggagaagaaagaggtaggacagaagatggtcctttatgggggatgagggggatggaggggggaagcttctagaggaattggaattttcacagaaagacatttctgcttagatactaatacagacgtacatatttggacaatatacatgtagaataaaaattatttgaattacttcaacaattatgcctacttttcaaaaggctttgacatcagctatataatttagccatttggcaatattaatcataacttactaaactaaatttgacattgggataacagaatggtaaaatgcaaactgaaatcatagctttatgatcacatgaatttccttcaacagctgttcactgttattactacttatacctttgttagcattccaagaggatctgataatcatagctagcattgattgagcaattattatataccagacattcttctaagtgccattatctcatttaccctacataacaaccttatatggtaagtatcttttcctagtgccttttattgatgacatgaatgaggcacagaaaaaataggtaacttgttcaagtccacacagctagttagtggaagagcaggaattgaatccaggcagggtggtttcaatacttcagtcttagacataataccatattgccttcctggtacaatggatgctttacgtaggaggtgttatagggagaaattcccacattttcctttttatacttgtatattgtttgaatttgtttataataaggatacatctcttttgtaacttgaaaaccacaaagaagaaatagaacaataaccccattcctttaaaaatagcattgcagtagctatttcaggtagtgagatatcaaactggttttaacttttttgtttatttgttttagttttaagaatatccaaacaaagacggatacatgtgaaaacttgggacagtaaaattgtgacctttctataaagacaaagaggtaggaatcaagccaaagtgagattaggataatgtcaggtcttagtactctattctgcataatagtttattttaggtaattctctatattggttggcttgctgaagctggtgtgtgtgtgtgtgtgtgtgtatgcgtgtgtgcgtgtgtgtgtgtgtgtgtgtataaaaaatctttttagtcgttcttttttatttgtgcttctcaacatgcttaagcaagtgatatctttccatataaggggcaaaagaatttggggctgtgaggcaggctgacaaagaggaaatatatcctgtctaagcaagcaagaaaaagggaaaggagtgaaaattcttgcaacatttagctcttccgaaaaaaaaaaaaaagtggtcatgatttctcctatagtagttgatttgtcactttacacaaaaggcctagaaacatatccattatagatatgcctccttggggctcagcctctatctgtcaagtaggggtaatgggtcaatggaattgattatgtgatctataaactttgttccagctttaccatattgtgaattttgaggtttggtcaatgaatatgcaaatccaaccagaagtatcattggatacaaaagtatccgtatcatttttgagaataaaatttccaacagcatttttatatatatcagtgaagatctgtgtcacaaaacaaaactttatgaaataggaaataatctggctgatctttgacagtacaaaatttgacattccaagtcaaattttatgtttaggtagaatagggaagtattggttttgcagttttaccatatcaacacatataatatttctgcatagaaaaacggaccatctaaatgggaaaggggagagccaactagtgggtaaaatgctgtaacagtattttaatgctcaaggcccaattatgacttgaagatgttgttgtactgattagcaatactaactgaaaatttttctaacaggttcataacctaagtattttccagctatatactgttggtctcagggattggcaaagctgaatcagaacacttctttgccaagacttgtctgcaaattcttaacctttttttgtttgccaagaacaaagaaaaattgttgtaaacttagctgctgctgtaacatatgagcagtcttttccgaaaatgcaaattagacaaacaagaatcattacatcatttgcagaaatgcagttacatttggtttctgctattgtgtgtgtatatatatatatgtatatatattactttcatatcttacttgataccttttgtagtgctttaccattttcaaagcacttgcatatgtgtcgtattatttgatcttttctgagatccaaagtttttaacatgcttcatgcttgaaaactttgatacttcaatttatatgatgcatgtaacatacaacaaatgttttgattatggttgtatggaaaattcttattatatccccaaatataggttacacattttggcaaagtaagcagttattgatttttattgccacatgaactggattttcaaatattaccaaatgcatgtgtttttgtttttgtttttaatacaaaaacatcatctaatggatagtgatttatgccagtatgtaggaaataagcaagtattttgggtcaggtggattactgctgaagctttgattaggcttgaaaatttgatacactggaaagctaactgttaccctatagattactaacaaactcattgcttcaaataaaactgttattgattgttcagattaaaaaaataatgtcgacttttgttttagattcagggggtacatgtgtaggtttgttacacaaatatattgcataatgctgaggtttggggtatgaatggtcccatcacccaggtaatgcaagcaacatgattttattcttttttatgactgtgtagtattccatggtgtatacatatcacattttctttatccaatccactgtttatgggcacataggttgagtccatgtctgctattgtgaatagtgctgcaatgaacacgtaagtgtgtgtgtctttttggtagaatgatttattttcctttggatatatacttagtaatggaattgctgtgttgaatagtagttttaagttctttgagaaatttccaaactgcttttcacagtggctgaactaatttagattcccctcaacagtgtataagcattcccttttctccacagcctcgccagcatctattattttttgacttcttttctgactggtgtgaggtggtatctctttgtggttttgaattgcatttctttgatgattagtgatgttgagaatttttttcatacgtttggtagctgcttgtatgtcttcttttgagaagaagtgtctgttcatgtcctttgcccagtttttttgttttgttttgttttgagacagggtctcgctctgtttcccagaccagagtgcagtggtgtgatcagctcactgcagcctcaaattcctggctgaagcaatcctttcacctcagcccccaaatagctggaactacatatgtgtgccaacacacccagctcattaaaaaaaattgtagaaacaaggacacagtatgttgcctgggctggtctcaaacttctgagctcaatgatcctcccaccttagcctccagaagtgttgggattacaggcataagccactatgctcaggcctttgctcactttttaatggggttatttgttttttgtttattgatttaagttctttatagaatcttgatattagacctttgcccactgcttagtttgcaaatattttctcccattctgtaggttgtctgtgtactctgtcaattgtttcttttcctgtgcagaagctcttcagtgtaattaggtcccacttgtcaattttgtttttgttgcaattgcttttgaggacttagccataaattatttgccaaggccaatgtacagaatggtatttcctgggttttcttctaggattttaaaagactgggatcatatgtttaaatatttaattcatcttaatttttgtatatggtgaaaggcagcagtccaatttttcttctgcatatggctagctaattatcccaataccatttattgaataaggagtcatttccccattgcttatttttgtcgactttgtcaaagatccgatggctgtaggtgtgcagctttatttctgggttctttattctgttccattggtctatgtgtctgtttttgtatcattaccatgctgtttttgtatcattaccatgctgtttttgttactgtagccttatagtatagtttgaagttcagtgatatgatgcctctggctttgttctttttgcttaggattgctttagttattcaggctcccttttggatccatatgaattttagaatagcttttctaattctgtgaaaaatgatgttggtagtttggtaagaacagcattgagtctatagattgctttgggaaatacggccattttaatgatattaattcttccaatccatgaacatggaatgtttttccatttgcttgtgtcatctgtttgtttctttcagcaatgttttatagttctctttgtaggtatcttccatctccttgcttagatttattcctaggaattttaacttttgtgtggctattataaatggcattgcattcttgatttggctctcagcttgctgactgttcagattattgttttataaaagccacaaaaatgttccattagctaaaagtcacgtttcttagttaatagaagtcatagtacataagaaggtaagagtgtcaaattattactagttgtgaatgaattattactagttgtgaaagaatagcaattcatggttttgtttggtcagcaactactgcaccctagtgatgatgaattctctagcagattggaaagatacttagggagggaaaaaagatgactttattaaggatctctggaaataggaaaatatttaagaaattctataagtaaaaatgagtaattttatgtcagaataaaataaaatttggctgaatttatagttctccatctgcctgcttgcacctatttggggcttattttacctttgtggttaccctgagaagcatggtatggctggagcctaagtgagttctttgttttccaaccacattgtcctcttttctttttataaaatacatcaaattccttgcaggtttgtctgtctggagtacttacccaccttctttacttagtaaagtactacttcttttttaggtgtccatttaagttcaaatccttgaagaacttttattttgtaataaagattagattcatatctcctgttaaacactcttatagtattcaggatataccttctaagtggtacatgtggggcggccagcagaagaagattttgtattaggtatcacatttgagaggaaggaggccccgtggaaaaagcttcatcaaaagaaaacaaaagaggtgtttatatgtttctcaaaaggcatgtatctatgtgttggtgaaaactgccttaataagtattacatgtctaatgtgtgtatactaacatgcagctctacgaaatatacaaaaaagttaagcatatagcctatgcttttgaaagcttgagatatatttggggaagtaactatgaagggatgtcccatgtagcctcatatggagcataaaataatgaaatgctatttattatatgtcatgtatgggactggcctgtatggggtcatttgagtgctaagacaagatttctttaatttgcagtactttcccacaatattcatatgagttaatacattatacttaggaaattgcccctaagataattaaattaaaaatatattaccatattaacatgtaaacacaaattggtttaaatgttctctagcaaagatcaaatctaggacagagaaacaggagaagaaaacaggaaaatggggctcagagcaggggaatgctgtgttgtttaaaagccctggatgtcaagatctaaggaaaagataaaaaaaatagaaccaccaccaaatataaatatttatttccatatctcacaattttttcctaggccattgctggtgacagactttccagtccttttcagaacttactcatcacatccttttcatgcttgttattttgatcctgaacatccttgcaattcaaagagcatacagaggcagagtgaaattagcataatgtcacctattgctatgatgctcgttacctctacctccagaacatgccaaggaggcttccaggagccccagaaacacagaacagcaaatcttcaaaagcccagtgcccagagcagatagagaagaaaattctattttgaaatccataaagaatctcataattccttgcaatatctagtcccaattgtgtgggtgacaaactgacctatggcagaattaggaatgtgaataggaatgaggcttggagttccccattcctgctgccctaactcccactggaatgtaatttgtacaaagagtgacgacatgtgaagatgtaaaaaagaggactagagatgtcctcctgagctgcacaaggaagaaagctttttatgaccatccaattctgcaaaggacctagtttcccagtgcttattaccataaggatgcagaaagaaaaaagttcacagacataagatttcatgtgaaaaccaagaaaaaaaggttactgtattttttaaaggaatagcatttgatttggtgtaatggcaggataaagaaatgagaaataacagtggggaaaaaagttgactacaaagatgtgaataagatcagatggcatagtaattttattcgtaattaaaaatctggttcagttaatggagagatttaatttcaggagcattaactagtagactactggatacaatgtacatgtttaaataaatcataaataagtttctcctaagagctactttaatgttgtagcattctaactaatgagtagtatgacaaaattacgttgttattataatagcaatgtatcagtttttctgttgatgaaatttcttagggttagaatttttttttaccagatatgaaatagacttacacttaaatactgttgaaagttgccatataatgtggctattatcttggagttaattaaagttaatttagttttgagcattattaagctctttaagaaaactggaagacatcaaattcttataaaggaaagcaggacctatttgttaaaacaaaaagaaatagctctgtattcaagagtagttttctcaatggatactttgcccgtaaacattaaaactcactaacacttaaaataaatagatttgaatggatggctcttaccacaagttaaaggttgttatttcattaagctaaatgtagtacgtataactgatttttttttttgagggaggaggcattaccttggagaaggaaatggcttcagataacatctatgaaaataataataataataataatgagattatacgcaagatttgaaacattttcagagttggatagaaatttacacaaaccagatttcccctgggagatcctaagataaactaacaataatgtcacacacatatcctgttattttatttactaaattctaaattaaatttctgctctggtgctatgaaggtcacccagcgtactcttttagataatacaggagattccaggattgaaccaaaaccaagctaagcagaatattttccttccgagagatttgaaatttgtgataaacacgtttgattttttgtgtgacattatttggtaaaagtaactttttcagaagctcccccaaatctctatacccttctttgtgccaccgtgttttcttgtgtattggaggtggataagcaaactgcaattgggatagattttcacctaaatttctcacattttcataagtgttctgttcctcttatttactgcttgcaatccacatgtgtatactgcacacacactcacacacatatacacacacataccctcatattctaaagaataaaaacacaggcactgtaattgcatatgtgtatacttagggggttaaagcctggcttcaccactcagtgctggtgtgaacttggagagcttacttagctcaggtccttttgttttcttctgttgtttgtttttgagacagggtctcactctgttgcccaggctagagtgcagtggctcagatttcagctcactgcagcctccaaattccgggcttaagtaatactcccacttctgcctgtagctggtaccacaggcacgtgccaccttgtccagctactttttttttttttttggtagaaacagggtcttgccatgttgcccaggctggtctcgaactcctgggctcaagggatccacccgcctcggcttctcaaagagctgggattacaggcatgagccactgcatccagcctagcccaggttctttacctgtacaatggggataagagtactgatatcacagggtggttgtgaaattaaaatgagatatgtagagatatgtaaagctcttactaaagtgccagcaatataggaaagaacaacaaatgacatttactctttttatgttgtctaaagtcatatgagtatatagtgaagttttcagcataggctctgtgtgagaatacagtagtccccccttctttacagttttgcttttggcagtttcagttatctgcaatcaactgcagtctgaaaatattagataaaaaatcccagaaataaacaatttctaagttttaacttgtgcactattctgagtagagtgaaatctcgcccatcctgttctgtccctctggggacatgaatcctctctttgtccaggggatctatgctgtctacactccccaccctttagtcacttagtaaccatcttgatgatcagattaactgtcacaatgtagcagtgcctgtgtttaagcaacccttcatgtaatcatagccccaaagtacaagagtagtgacatcaacatgttattattattattgttcttttttattattaagtattgttgctaatctcttactgtgactaatttataaactaaacttgatcataggtatgcacgtataggtaaaaaatagtatatatagggtttggtactatccatggtttctggcatccactggggatcttggaacatattccttgtggataacggggaccactgtagaggcaaatggatatagaatatcctttaggtttatttttttgtctgtctttccctaaagcaataaatataaagaaaatctaaatagttggttttgacaacacataggtgtattatattctgcctttttagtgctcagtattccaatatttcattttgtagatgtgaaaattaaggtaatcaagggtggaaatgcttattggagatcatggaactggctcgtgatgcaacagtcatggagtgctggtttaaccgagttgaatacaacacgaatgcccccatgaaaagcaatgaatacagaagtgctcaaaagagtttacctaagaaaataaataggaagaataaaactcaaagacagagaaggtatattaatattcattatcactgaagagaagtaaacttaattttttaatattataagttaatgacctcaagcaaagtcagatattgaaaggtgatcgtttcaaagattgaaactgagtgaaaatatttcaggaaaagagagttttagctattcttaaagaaagagaaaaaagcagattcaaggatagctttttgaagaagatacagcttgaaatggcttcttttactccctcagttaaaagtggtaatggatgtgcctaactaaaattcccacaggaaaaacttctttagttcacctctctcttcctgctttttttagttgatttcctatgtaaatatgagagctcttaataaaaatatgacagaaagttggaaagagttttcctgaaataaataccagatgagtatagtggttacttgaattatgtgcagaaaagaagatgatactctacaagctcggcttttcggcgacaaatctgaagtccatctccattgtgagtatttcttgtgtggcttggacttcctccattccagagaaagaatcagtcctttgggaatccatgaagtgtgtcctactgtgccaggcctcagccactaacacaggtccctagagagccacgctgtcttgctccatgacctccaatgagaaccccttcttactgccctttcattgattaaaacgagacatttgctgggacctcattgtgggctaagcacattgcagtcagtttccacataatgttgctcattggatcattattttaatttttctctctttacctcccccacagctgtctttccttatctgcaatgttgcatgcacaatatttactttcagcaaatgatgtaaatcacccttgaatgaaaagactgaaggtgcctcacctttcttcttcctgtcctattactgtgttctcatggccttggattttctctggataaccacgtatcctagttcatgcttttgtgtcataaggaaaagttggcactcccttttgaaaagctaaacttcccttcctgctattcatcctgacatttctgccctttattaggaacttgattcaacaattttctcttctcttatatcttcaatttctccctttcttgtttctttcctttaggcttaaaaatgtctttaacatccttaggtctttcctattgttaaaaacaagcaaactcagaatccttttctcaaacttaatactttgttgagttggcacccaatttgcctttttttttttttttgagacagggtctggctttgtcacctaggctggactgcagtggtgccatcatagctcactgcagcctcaaactcctgggctcaggtgatcctcccacctagcctgagtagctaggactataggtgcccaccaccacatctggctaatttttgaatttttcatagatatggagtttcaatatgttgtccaggctggtcttgatctcctgtgctaaaacgatcctccaccctcagcctcccaaagaagtgctaggattacaggcatgagtccacgcccagcccttaatttgtctatttttattgttaagtttctcaaagaaatgctcaatgcctgggtcaaggacctctacagatcttgagtctccttaggacatccctttccaactactcatctatttgatgccagattttctacatgtacttcaaccaaaacaacatattgcaacagattgaatgcagaagcagatatgagaatctgctgccttctatgaagcaagacattaaagagatttgcaaaaatgtaaaccagtgctctcttcttttcaaaattatttttattagggaaaatatatttttcataaaaactaggttatttatattactatttaatggagttagcgttgctatttttaaaagagtttatttaaaaagtcttaacttctttagtggtaatttctagtacggtaaacactggtagatttaacccacagaatcagaagctctttgggggtcctcagtaattttaatagtgaaaaggagttttaaaataaaagtagttgacactttatgaggctgaggcaggtggattgcttgaggtcaggagttcaagaccagcctgaccaacatggtgaaaccccgcctctactaaaaacacaaaaattagttgggcatggtggcacgtgcctgtaatcccagctacttgagaggctgaggcaggagaatcacttgaacctaggaggcagaagtgagcgagatcatgccactgcactccagcctgggagacagagtgaggctctgtctctgaataactaactaactaactaactaaataaataaataaaaataggagttgcaaacagtaggtctatatccgtgattgcttttcctcaccactgttgcctcctttttttaaatctctgaccaaagaactggctccacttggtgtcctgtatcagatttcttgggccggccatggtggctcattcctgtaattccagcactttgagaggctgaggcaggaggattgtttgagctcaggagttcaagaccagcccgggcaacatggcgaaactctgtttctataaaaaacacaaaaattagctcagtgtggtggcatgtgcctgtagtcccagatacttgagaggctgaggtgggaggattgcttgagcctagagggtggaggttgcagtatgccagaccttctagatacaagcaagcctcttaccttagcttcctgagtggctgtgatttccctagtcttttatcctccctagttgctaagcaatgtttaacagtgcctacctctcatttcttcttgatattctttccttctacggcaacaaattcccctgatttcttcccaaccttcctgactacccatctttttctctcttggttcctttttcctgggagctgtattttcctcttagctgactcagtatgcttttccttaaagattttttttttctattgcccttccaaaattttttctagatccaaagcctttctcacagtgtcaagaaaaaaacattccagttgccagatgaacagcctgtttcagtatcatgggtctaaaaccagacaccggtttttcctccagcaattcttctggttaacttgatgcctctgtctatcatggaaaccgaatttcctaagtcatgcggatttaaaatgctagaaaatttcttactcctgtcaccactacatctaatgaatcagatgttctgtttgttcttgtgtcatcccagtccactccctgacaaagcatatctgcaagcttatcatcataaacctaggctatttcaatgctcacgtattaaccgctcatcacatgaatagaatttcatttgcctgatttaccctacacagcccttcaaatttatcaacgaaatcactggttttcaacttttatttttaagtaggaaaagcttttccgttaagtttttgcaaacaaatataatgcaatccaatatttgccctccagagctatgccgatttaccgctgaaaccttgagcaaagaaatactcaaagcttcttctaggttgtgtatgtatcacaacagaggaaggaaattatgagatgggcacttgggagactgttttcttggttgccctctccttgtgaaaggtagggctacaagcccccatttgagccaaagctaaggagtccggtgcccatgaaaaagacgcaagcaatgctgtcctccttgatggaggctgcagaggccagaaccacacctgctcagcctggccctgaggctgcccctgtggcactgctgaaagtcagtcttttgtcacaaggaaggcagtttttctagacaagattattctcatcttaagcatgaggtaggggtgtgtgtgtgtgtgtgtgtgtgtgtgtgtgtgtgtgtagtgtctaagtctacttgcctgctttctgggaactggtaagagataggaagatagaagtcatcatcattccaaatgtaggctttcacttaatttctctattttcagtctgagaccacacatttacacgtctctcagcctgcatccccaagctcaaaatatttctgctttaatctcttcagagactaaacctcctgtcccccactacatggagaaggcttggttacctgttattcaaggtgttgcctggatctgtgtatatactttaattcattccctctgttttcagcaccaacacccgccccctttcctcctagcttccttggtacttggtgcctccaatttttgaggctttctataattacttagcacaaatcaactttcttgttgattttcttctttataggagcatagatttcagcatttgtgactttgacaagtcagttgttacaaattcatcagctgcccatctgataaaattttaatgtcttttctactctatctcttctagcttttcttttcttgtgtgtcgatacccattttatttctttacttaccctcattttagtggcatttcaaaaggcgtactagttacctattgctatataacaaattaccataaacttagttgcttaaaacaatgcacatttattctcttagagtttctgtgggccaaggtactgggtgtagctcagcttggccccctactttagagtctctcacaaggctgcagtgaggtgctggccaagactgggatctcatgggaaggctcaaaaggaaaagcatctgcttgtatgctcctggagttacaggcaggttttagttcctgatgagctgatgaactgacagtcttgttctttagtgactctgggccagaggtcaccctcatcccttgccacatggctctctctctatagcagtttgtttaatcaaagctagcaatggtgagaatctgccaacaaaatagaagtcactattttgtgtgacataatcacagaaatgacatctcatcatgtttgccacattctattggctaaaagcaagtcaccaggcccgcccatactcaaagtgaggagattatacaaggcgtaaataccaagaggcagattagaggctattttagtctgttgatataggaggccaaggtgataaacacatgggtccaagtctctctctaaaactggagtcccctctctctcacttccatcaagcttacagtccacttctcctgtcaaggtcaagtagtgacctccatcttgcacaatccagtgaactatcccaagtgatcatcatactcaaacaaacaaccagtagcaactgacatattctcttcctgaggcattttatttctttggatttggggatccctcacctccttgtcttttcccttcatctcttgtctctgactcacaggctcctttgttcattctcatttttcttccttttggagggctaaatgctagaggtctacagggctccatttgtagcccttcactcttctgtaattgtacctaagaaatctagtctcatgacttcatagtccatgtatatattgatgactcttacatttatatctccagctccaacctttcccctatgccccagatagtacccaattggcatctgtacttggactcaaagacattgcaaacttaatttctcaaagaattaaaaatagaactaccattcgatccagcaatcccactacttggcatctactcaaaggaaaagaaatcattatatcaaaaagatacccccacttatatgtttattgcagcactactcacaaagggcaaaaacatggaatcaacctaagtgtccatcaatggattggataaagaaaacgtaatatatatacatacacatacaacacacacagacacacaccgtggaatactactaagccataaaaaataaaatcatgtcttttgcagcaacatggatggaactggaggccattatcttaagtgagataacccagaaacagaaagtcaaatattacatgttctctacttataagtgggagctaaatatgtgtaccatggatatagaaattggaataatagacattggagactcataaagttgggagggtgggaagggttcaagggatgagaaattacttaatgggtcaatatacactaaaagctcagatttcatcgctattcagtatatcagtataacaacaaaactgcacttgtaccttctaaatctatacaaataaaagctaaaaaatgaaaacaaattagacatctcaaatgacaacttaatgcagaactcttgatttcctcatccttccctgacctttacctaaaaacacactctgcccaaactgatgcccatttcaataaatgtcactaccttccacccagttgcttaggtggaaatccaggcattttctttgttcctcttctttttttcacaccccacatacacttctcactcagcatatcctgacagcgccaccttcagaatatgtccattatccaaccgcttctccccagttctcctgcaatcacccaggcgtggtcatggttgtctcttgcctccccttgactggtacatgtgccgttcccctttgcatcaagcttacatctgctccaggatgtttatatttgcagttctctccacctgtaattcttatccttctgatttgcatgtaactcactcctttttatcatccaggtctctccttaaataccacctctttggaaagccttccttgatcactctgtgtaaaatagccaagcctccgttattcactatcttcttttgctcttttatttttcatatatgactacgtgaaagtactgtctgttgttatatgtctagttacttgttatgtgagtataagcttaatcaaggtgatgctttattgcacttagcgctgtttccctgcaatccagtacaaagcccagtatgcaagttataggcatgtggtaagtgttggatatgtgcaccagttgttggacaggattgaacttgcgaggtcagctttctcaggtgacctcaaaggcaagcatctagtttattgagtagtacaacaataggtatgttgcatgtacatatatgtataacagaagtttatttttaagcctgaattagtgatagcaactctgttcatgagtgattatgtggttctttttcatctttactctttctcagagaaattcttctcttcttcccacattgtttgactgcttagagtagataatagaggagtggtaagatgtctgagtatataatgtaagggggtttggttcttgtcatatatagaatacatataggtcctattataaacaacatatggttcttctcatatatagaatacatacaggtcctattaaaaacaacatattgtagctttaattcaacacacgactggttcttgtataaagtttcactgagatctttattgtggagaattgcatgactattccagtcctggactcaatttgaataaaaacataggaaccaaattcctccactaaataactgattgatacttaaatttgacaacgatagctttatagaatagtccagaacatatacagtcgtacctcacttaacaatgtggctacgttctgagaaatgtgtcattaggcaattcccgtcattgtgtgaacatcatagggtatatttacacaaacctagatggtatagttcactacacacctaggctatgtggtacagcctattgctccttgactgcaaatccatacagcctgctactatactgaacactgtaggcaattgtaacacaaaggtatttatgcatctaaacatatctaaacatagaaaaggtacagaaaaatgcagtatagaaaataaaatatggtacacctatgtagagcacttctcacgaatggagcttgcaggactggaagttgctctgggtgtcagtgagtgagtggtaagtgaccgtgaaggcccaggacattactgtatacggctatagactttataaacattcttcacataggctgcactaaatatgtattaacaatttttctttcttccaaaattaacctaattactatatcttttcactttataaacttgtattttttaaaccttttgacttttgttatacttactttaaaacacagacacattgtacagctgtgcaaaaatattctttcttcatattcttattctataagctttttctgttttaaagttattattaattattattattttactttttaaacatttttgttaaaagcacacattaaacacacacacacattatcctaggcctacacaggatcaggataatcaatatcactgtcctccacctccacatcatgtcccattggaaaaagtccagggacagtaacacacacggagctgtcactttctgtgataacaatactttcttctggatacctcctgaaggaactgcctgaggctgttttacagttaactttttttcagataagtagaaggagtgcacttaaaagaacaataaaaaggatagtaaatacatagaccagtaacatagtcatttagtgtcattatcaagtattatgtactgtgcataattgcacggactagccctttataccactggcaggacagtaggtttgtttacaccagcaacaccacaaacacgagtaatgtgttgtgctacaatgtcactaggtgataggaattttttagctccattataatccttttttttttcttttttttgaggcggagtctcactctgtcgcccaggctggagtgcagtggtgctatctcggctcactgcaaggtccgcctcccgggttcatgccattctcctgcctcagcctcccgagtagctgggactacaggtgcccgccaccacgcccggctaattttttgtattatttgtagagacggggtttcaccgtgttagccaggatggtctcgatctcctgaccttgtgatccgcccgcctcggcctcccaaagtgctgggattacaggcgtgagccaccgcgcccagccagctccattataatcttatgggaccactgtcatatatgtggtccacggtttagagtatggaaatgactctatttccatacagtacttccaataataaattaagttgtttgatttctagattgaaaatggctttgataatcttgtaattggatttatatgcctttgagtctctcaagtagaactgatttacctttccattcctttctctttcctctctggtcacatccctattccacatttgttttttttgtaaccagatacacaaataatactttgtattaagtggttatagtgaaagctgggcattctgttctagtgaataatgattcttatattccaaggacaaactacctattaataataattgggtattcggggcttaaaagttgtatttgaaagatgcagccaggtgtggtggctcacgcctgtaatcctagcactttgtaaggctgaggcaggcagataatctgaggtcaggagttcaagaccagcctgaccaacatggtgacacctcatctctattaaaaaagaaaatacaaaaattagccagacatggtgggaagcacctgtaattccagctacttgggaggctaaggcaggagaattgcttgaacctgggaggcagaggttgcagtgagcagagactataccactgcactccagcatgggtggcagaatgagactccatcagaaagaaagaaaggaaagaaagaaagagagacagagagagaaggagagaaggagagaaaagagagaaaagaaagaaagagatgttatccatgatttagtggaaatgagaaaacctagaaaataccatgcaattctaatgaaaattctagaaaactagaaaaaaggaaagagaaggaaattgagaagaccctgtaatctgttgaaatgctgagttttcctaattaaggaaagtaaaattctagtcacttaaaatgcctccaagaaagtcactgtttttgtccatttatatctttctgctttctttttcattttttccctaaaaattaattaaatattaattacttttagaggaaagattactctgataaaatggtcaagaaaagcaaagtttcttactttctgtgccaaagattttcagccaaagtaataaaagaaaaatcttaaaaagggaaactatgcaattcgaatggaagatccattttaaaaagttattgtggcagtataaaatgatactgtgtgctcaaatacctaaaaacttttgcaacttacgaaatggtatttttagtattacttagggtgttgtatgggtgtcttatgtaacttgttaaggtaaagaattttgctattctcaacttcagtttatgcatctataaaatgagaaagcgcaaaataatacttctacctcatagggttatcgtgaaagttaaatgacagagggataaatgaaatatttagtatagtgcctaccacaaaagccaaagctaaataagtgatagccaagaacaaacacagaaaacttcctaaataaaaatatgactagaataactgcaatgtatggaccaacataagcatgtttaagagtgaacacaggtgctattagtaattacacctggaccaaaagtataacccaggatgctccctgacatactagaatttatggtttctctatctataatctattaacatagcaggcagtaaaccttctcttttgtggagaccacacatgcaccagacaagcagagcctggattcaatagtgtgccagtaactcacccagattttcaagaagtaatatttactgggattatggattaatcagagcttgtgtttaccaaagtaaagttcaccaatgattcttcaaatatgttcacaagctaacttggcttatatccatttacttataaatcagaagattccccaagattttactgtctgcctgattaaagctagtatgtgctataagtgttttcaaaatacttttttccaaaactgtccttgcagttaaggtgctgttaattcaaagtacctatgacttcctatcagaaatgaaaatgacacttaatgagaacaaaacatgttttcacttgaaatgcaattaaaccaaattagagaaacagtgtttttctaactaagataaaaacagctgtgtttatgaagctgctctaatggtattagaatttctcttatggaaacttttgctttatttaagatatatgatttttattttaattgacattttagacaatgatactttcattacaattttttcagtcaagtatttctttagggaatctttcctataattcatagtgagctaatttgatcatgtattaatagagatttcatggagatttgtttttaaaggtttttatgtgaaacctttaaaaggcctcccaacaaaaactttacttcatgactagatatgatttaatcatgattatgtcaaaattgtaatttttaaaatgccttaagaaaaataatttctgcatacatttgtgtaatttttctaaaatgcaaaatttgtaacaatttctaaggtgtagaaaaaacatttacttaagttgctggtttttttaatattcatgtgtatgttttgggattttgtagatataacctatgccttagattactacatgttgatgtgacttgctgatgtttcaccaaaaaaaaaagaatgcttccatttctacacttaacatttttttctttatctttcataattacggtccataacacttggagtaacaacatgttttcctgtgtatatataatataaatggttatatacaaacaatagaagaaatacgcaatttcccaaaatgataacatttgaagacgtcattaccaacaacaacatcactagaaacattactgctgttaagagcttgatctagaaaatataagcttaaactgctctgtttggaaacagcatgtaatcgggatatttaactagaaattcaagtacaataaaatggatttaattagttatgtagctataaaataccttaaatttttttaggctatgtctgcatgggcaactacttaaatgtttttagattaatttattttagtcaatttaattttaataattacctcaactatatgttattttcttcctttaaataatcacagaacacgctgttttaggatcaggtagaagctgagacaatctcttttgaacaaattttatttttattccaaaattaattgtcctaaaaatagtacatttagccatgaaaaagagaaaacaagtaaacctatcaaaatgggacactgttaattaactaaacatagaaaatagattcattcattatccaccaaaaatttcaatgtacctgccaggtaaaagcaccatattcagtaccatgaaagtgataacgattccaataacagaacatcttccctcaaagaacttatcacatgtttatgtataagtttaaatgcattgaatgtcaaaaatgcagatagcgctttgatcaaggacattttagcaatgtattcagacaggatctttattttctagggttttcattataaggcagaaaggttagactaaagagtaatgttaaaaatacaaattatttttgtattctagacatttctataagaaatgtatggaaatagaactgtaattttggcagtttttgtcacagtgtcagtgagcaaatagatgtcatactcatgagtacagaaagaggacattctctttaacagccacatacttcttacccagaaacccttggagaagatttataaacccacatactcagaatatggtaatgaggaaatgctgtctgccctgggaaggggaagaggatctaaaacatttaggacaggtaattccacaaccatgccttaagataaatccatgccttgaaaagtaaaaagaacagcaaaaacagctagttagtcaaaggtcaagatagcaaaccctagctggtaaacttgtctgaatctttactgtattcctcaagctataaactatgtttatagactccttcaaacaggattaaattttggaggcattttcttaaaaaaatagtaaatccccactgtaaaattagttataggctttggacaggattcttgccaatggggctcagaggcttaagttttattaatttcacagtaactccaccttagttcacagatattttcaaaacatggaaagtgtgattgaagtcaggtaagtctaatcaaatatgagttctggtgccacagaacggtgatgttgaaatacttggcttttattggctatttatggcttttattggcatattaatgtcttttactgatgatctcaagttctgtctatagaaacactgatgtctgattgtaacagtttaatcaatgtataaaccaatctggatggttcagatctcaattccaacgtttcctttagaattcaggctcaatttatctaaattgggctcattatattattattaattttactttggctgtgggctgagttaaagcacactatgtttttgagcattctaagattgttccaggatttaaaaatttaagattactttggtttcttggaattatttaatacacactgcaattttccctgaaaaacacatgtaagctaaaatggctctatggaaatgttttatgttttaatgaggttgggaaacagagataaattcacctggtcataatcatatggtaaatattgatgaaaggaacctttttctaaactgcatagctataattctattccagctgattttgtagatttaaaatattttaccctgtttttgtgtctcttaaggagtttctgtttgggttatttgtacagatcaacagataaaaacttatgtcctagaacaaaaacagcacacttaaacacatcttttctttcaggccaaaaagtttgctgtttcaggaccatggacctccttaggaacatgtacatatttccctaatgaatccttaggctgtgatatgttttcgagttaaattgttattactgatagaaaagttctttatgtctgccataaatgtgcattaaagtttatatagcattcaccttcatgattggtgttttatcttactgattattttggcagagaacaaataccaaaagtctccccatgagaaataaaaacaaaccacgaccctctaaaaatagaaaaaaagccacaactcttcaggtcctccttggacccatggacaaggctcataaacctccttggtgtccattccatgttctgtgaatctggctgatggtcaaagaaagggctagagacaggatgatctacaaatagaggagattgaatttccaaatgaggtttgatcatctgctctttgtgaattttttccaattgcttccccatgtgccttggtttagcctttcaaaaaattagaattttatacccctaggatgtaaaataccatgtcagcgcactttttgtgcctggaatgcaccttggagatagccttgcccattgaccagctcttcatttttcagagggagaagaaagtgaggtctgggaaagtaaaatgcctgcccaaatccacagagctaagaagtagcagagcagagatcattaccacacattccaaactttcttcctatttatcatttttctccttgagccccttcttgtctgagacactacatcaattaaaattattttataactgcaacatcgtacaattgccatgtaacacattgcccaatgcaattcaatcttagcatctggaaacaatactcatttattaactcacactttgtaggtcagaagtctgagcacagcatagcaaagtcctgttcttagggtctcaccaggctgaaatcaaggtgttgaccgggccgtctcctaatctggagtgtggagtcctcttccaagtccattcaggttgttggcaggattaattcgttgtagctgtaggactgaagtctcttttcttgctagctgtcagccaggggcagctccaagctctcagacgctgccctcaggtcttagatgtgtggccctctcactatacgacagctacttcttcaaagccaataggagaatatttctcttcaggaaaggttcactccctttttaaggactctgctgatgaggtcagacccactcaagacaatctccctcttgattagctcaaagccaaccgactaacaactagtcaagagtggtatcccatcatagtcgtaattctcacttgtgctcaaaggggaggggatcatacagcatgtgtgtaccaggggacaggagtcttgggagtcatcttagaattctgtttgttgggccgagcgcggtggctcatgcctgtaatcccagcactttgggaggccgaggcaggtggatcacgagatcagaagatcgagaccatcctggctaacacggtgaaaccccttctctactaaaaaaatacaaaaaattagccgggtgtggtggtgggtgcctgtagtcccagctactcgggaggctgaggcagaagaatggtgtgaacccgggaggcggagcttgcagtgagcggagatgcgccactgccctccagcctgggcgatggagcaagactccgtctcaaaaaaaaaaaaaaaaaaaaaaaaaaattctgtttgtcggccaggtgcagtggctcacgcctgtaatcccaccattttgggagaccagcctggccaacatggtgaaatcccatctctactaaaaatacaaaaattggccgggtgtagtggcgcatgccagctactcgggaggctgaggcaggaaaattgcttgaacctgggaggtggaggttgcagtgatcccagatcgcgccactgcattccatcctcagtggcacagtgagactccatctcaaaaaaaaaaaaaaaaaaaaaaaaagaattctgtttgtcacgttggtctgattctactcattcaagtactagatttccttttgcctcctcttaccttctgctgccccccaactgagttggttcattgtcttccatcctacagaaatccagaaagggatgataagagaaggtaaattcagactagggtgacgaaaactccaaatccatgaacatatggcatttttattgggttcatgtattctttgcagctgtaagggcattggccagggataattcagaattaccttttcactaattactgaatagtaaaatttacctattctttgggcatgaagcttcttttaatacggctggcctggattcagagatgtctggggacacctgtgctgggttggcaggagcagcagcagctggaagtcaggggagagtggcaactaaagacctgccattttcttagtgcctatgcaggctgagactttactttcatgagctcatttaatcttcacaatggtgactgatacagtcaatattataatcctcattttacagatgaggaaatagcagagatgcagcagagtcagagttcaaagctcggtcagatacaccagtgctttttcaaggacaggcttctccttctcaggttttggttactcttgttttcttttttcttttttgagacagagtctcgctctgttgcccaggctggagtgcaggggcgagatctcagttcactgcaacctccgcctcctgggttcaagtgattctcctccctcagcctccggagtagctgggataacaagcacgcgccaccatgaccacctaatttttgtatttttagtagagacagggtttcatcatgttggtcaggctgggctggaactcctgacctcaagtgatccacctgcctcggcctcctaaaatgctgggattacaggtgtgagccactgcgctcagctgagacagtgaccctctgagggtctcagcatatttaggcagagattgggggatggcggagggagctactgagtgacaggcaccctctgagagggagcctatctcaagcaatcaaaaaatatcaactatatgtagggactctttctcccttcaagagttacaattaaacttttcagaaatcaagatcaaggctatagatgataaaaattttattcctaaaggaatttatagacaagaaattgattgaaccttataataccccatgatggttcatgagaaacacgtgttcatatgattataccatgtttttaaatatggggaaataaagcacagagtaggtgaatgtgaatttagggacatcaaaatgtaatgacaaaaatcagctaggcttgttcttgaatccctcaaactgtaacttttggctgaacaaatgaattaagatatagctaatacagctgcagagcttggaaaagttacagttgctttgttaaagtatattgagttggagtaaaaagttctatttggaaagatttcaaaacccttcaatggcagcccaatcattccgaagctgaattaaatgtaaattgtgaattatctgcatacgtttatagtctattcattttaatatacatacggtggttgtgtactttaagaagataaaaagatgattcctgaggcatcattactgcatggcagagagacaaacttgaaaacaagtaattataataatgcaagtgttaaactgaagatacagagaaggaatacacatattccacagtcactggttccctttgggaacatcaggaaaaaacagaagaggaaagttttgagttgggtctggaagaatggaactttagcaggcagaaaaggagaagaaaattccaagtggtaagaaaaacacagttaaaatcatagaggcaagaaaatataagaggctagaaaaccatagttcagtgtggccagggtgcccacaatgcaccaggagaagatagaaaagagattgtttatgcagcaatgagattggaaaggacctggctgccctctaaggagaagtttctattttatagcagcaggaatctaatagagacgttacacgaaggaatgacaagataatcgctctattttagaagattaactctggtagcaggagctgggatggctgggggtgtgaactgaaactgacgctgcataagaagagaatttacaagcccagtcaaagaatgaggaagaggacccaggtcagggaagaagcaagacaggcgatgagaataaaggctgcttcagaggtgaacactgtagaattgggggcaccaggtggctggaggcaggtgagaagaaaaggaagatgtaaagagaaaaatgaaggatgatgcctagtttctgatcctgagctctgtctggctttttttgcggggaagagatggagattaatgaattgtctttgggcatgtttagtttcaggtacttggaaatacaggcttgcagtttagaaaacaacttacagctgtagataaacatttacgaattatcaacatttgaggtagtggcaagtaaatgatgtttttatagaattatcatgtagttaagaagaaaacagttttaaatattggaccatgggccagcatttaagagaaagttaaggaaaaaaaaaagatttaagaaaaagacacacagaaagtcatgccactgagattttactatgagtcccaggcaaaggttttaagatgagtgtatcaatgtcccctaggcataaaaaggattaaaaagagaagagttcagatgacaatttggaaggcactggtaaactttgagcagtttaattagattggtggagagttggagacgagacagagtccttgaactgataaacaaaaaaaatctgagagtatttggtagtgaaagtaaaggaagggtcaaaagaaaggttttgttgttgttgttgttgttgttatggtttcttcgatagaaaggggaaagataatggttaattggggtaacccagcagtagagattggcagggcaggtaaaccggcaggataaaggaaggagagtatggattagattttaataaaagtttcttagggaagaggggaagaaggaaaaaaaatgagttgagaaaatatatattaaattctttacattgtgcttctgagacagagctatatttagcacccataataaatatatctgataagaatcctagtatgttgctgactctcagcactctgcttattattatgaaaataaaaatgacttccatgtcattctgtcagactatcttttggaaaaaacaacgacaacaaaaataaaaatgtcattcaatccgaaagcaagagaaaagacaccttagtaaaagtaactttcttcttccacctacaaaaccagaacttgaagacacaaatctcaggtgtactgaaataatttttttgtgcctggatataactgctttatgggatcacagagacttcagtacacactctgggacaaacagattattcacaaatgatgatccaaacatattctaggcattcaattgaataaggcccaggatcacccccagaatttttctctgggcgccaaagaatcctacatgctgaataagaccctaggcaagaccagagctccctgcaccatttgaattaggtagtttccatcttgcacctatgggaaagagttggagccaacccaatctttatgattaggcaggaaaaacaacattttccataagaatgtaatcttctgcatggttggtcaccagttatttgttggacatccatttggtttctgccaagttagctaattgttctgctaaatcatctttaaaagatgacttgccttcttgagttgttaatacttgtgaaattcttttcccaaatgaatgagaattgaaagacatagattcttttaacacacacatacacaaaattcccaaacatatagtgtgttgaaagttagtctgttgcaaagaaacttgagttctaggcccggatccaggggtggagatgactgtaacattccaccaagaacttcactcttggctttcacctcgaaactaaaaatccctagttaagtcagatatatgaagtattgcactctaacatgaggaggaactgaagaaaagggaggatgttttcataaagatttagtgaggaagttagaaggaattatgtgtgaaagaaggaaaaagagtaattgtggtattattacaatacatgcctgggccaggtacagaatatgatgggtccgtgtttcactccatacagccctgttatcatgatgacattatgaagtaatttcctatatactataatctgttttggaaatgctttctaccaggtgtctcttatggaacatacaggaaaaaaaaaaaaagagttgacctattaaattactctcgctgttcaaatatttgaagtactaattcatcactcatgacattcaatttatattttaacatcattataaatttaacagggttgaatctttcaaaataacaaagaaagtgccttttgaaaggaaagaagataggaacgttgaagaggttcttgtgggatcactcttaaaagccatcaaagcatctgaatctctctcttggctgtataataaatattcacagaaaatgaccgccaagtatgtatggagaaatgccttggcatttgctgtatgaatatggatgatgggaatatagtaaaatattagagagattaaatcgaaactcaaagatagttctaaggtgtttactgggtgtcacttgatgaaatgactctatggggatttatcactaatctgtgaagtgaaaaataatcttaatgacgagaggaagcttacctacattatgcctaggacaagaagtttttaattcccctctaacaatgcagtgtttgcaggttttcatccattatcactttgttagagtatctttgctaaaacccaactattttataggctcctctgacacctcacaagaatccaagggaggaaatgaagccaatgaatgtaatctacaggtgaaatttgcagagcaaattcaggaaaaaaaagtaattatgcttcttcgcattttatcattttataacctcaccttttagagaaggtattgagagattatactgattagtccagatttttattttacatatttgttcatggaaaggcttattttaacagaagttatatcaaggtgtcatgcccagtaccatcatcatcatcatcaaaaatttgactgaataaacctaagtacacacacacttctgtatgtatagtcttacatatgaaagtaatatttattcattcaccaaaaagtgtaaagagaggttaaaacaggatgggatgaaacagtgtacaaaggtaaggaaaagcttttccaagcaactgaatttcccttgaagcctgaatgttaagtggaattaggcaaagtgtggtggttgtgggaaaattcaggcagaggatatagctagtgcaaaggctctaaggctgcaaaggatgcaagctatgcaggcatggtgcaaggaggcctttgtgcaggaagcaaagggagataaggctggggtgacccacagcctccttcttcaagggcactggatagactcctgggaagcaaaaagtgactggattaaatttgcatttcaaaaagactcttctgactacagtatgtggcaagataattgggtgaagcaatagtccaggtggaaagctttattacagtcaaaacaaaaaaggatgaagacttggattggggtggtacttagtgaagaggcataaaagaagactgaagtcaaaatgacaggacttggggatgggtgggccacagaaagaaggtgtcaaaatgattgtcacagtaggtaattagtcattgattgatagaaaatggtaatcactgaactaggctttttatcttcattctgttctatttaggttcattctatccaaagtatttagtgcttaccagatgcaaagtacagttaggaattctaatggatagaaatataaaataaatggatacaaggttatataatctctgccttttataggcttatattcaaatacagacaatgctttccatttccagtaaagggaatgagaaattatatacccagatacatatatattgacacacaaataaacagatgtatacacatgtatgtctacatatgtatatatgtatgtacacatatgcatatataagtatatatatatttgcatcatatacacatctaaattaagggtgcattgccaggggactgaggaggataaataatgcagaggtcagaaaaaataactgaaaagttgtgtgggatggtattcttcttataagaaattcaaatgttttcaaaaatgattgtcttatatatctgccttattacagaagaaatgtatgacgttggccctgtttatcagggccagaagaagaaattcagcaatagtatttagcagtattaacaattttaatccatgatatcagtcatgacactacaatcctgacagtaatcttattaatagtaatgataaataatagtaatcattagtatgtagtaatttttaaaagtcacacaagcagaaaaacataaacatagatttgattttaatgttgtttgaacattgccttttagcatttttctttgaattctaagctcataattttatcataaaactgtctttacagcagacaatgactaattagtaattctattaaatatttgccaaatggagggtaccacttctagttttgccagagtgtcttgctggtcagaagtgctttgcctaataaactcaacatgcatgttgatgctaagagtctaactgaacacacaggacaatcgcaaatctgtgaattattaagcctcctttcacctcaatttcctccctcataggatggtctttgcttatctcagttttgtgtgtattccttttgattgcttgttaatgtctcctatttatagtgatattatgtaacagtattatttaatctccaaaatagtatacaattgtcaagtaccattgctgtaattatggtgcagatgttggaatatgcttggaatcactaaaagtgaatttaccataagctaaggaagcttactcttcagggactctgacttgcaagagcctatttaatttcttattacctaaatttgtaagtttaattttgcagtatttttcttttaaaagatcccccaaattttatgagcttcatttccagaaaactcatctggccttgtttttcatattgtattgtcatatttaatttgtttttatgcctttctcacaatattttaggttcatgagatcagagacagtattttatttgtttctctactgcctagcttattatttatttatttatttatttatttatttatttatttatttattgttatgagacagggtctcactgtcacccaggctggagtgcagtggcacatttatggcttactgcagcctcaacctcccagggctcaggtgatcctcccacctcaacctcccagtagctgggactacaggggagcaccactacacctggctaatttttgtatcttttttttttttttttttttttttgtagagacaggatttcctcatgttgcccaggctggtcttgaactcctgggctcaagcaatccactcatctcagcctctgaaagtgtaagaattacaggcatgagccaccatgcccggcctgtctatcacttagttcagtaaatgcttggtgaatgaatgaatcatatacatttagtggttgttttgaagttgactctgctgagtgagattttctttgcattcatgcatcttcattaatgtcaactttgttgcagtttttaaaaaagtaatctttgtttacattatcttaagttacttgatttaaaaaagttaaaagtgactatttgcagaattctaaagtcccattactgtcaacatgcataatattttgccaaaaatgcaatttgtcttgttagtcttctttaatttttccatgttttaaaacttttcttggagtatttcccaaatgggatttactgagaggatatattcagccagctttgtagattctaagagtccttctaaaagttaagtctagccaaggaaaaatgtagtggcacacgattgcgtttctcttacgctgtcatttaatgtgagatctaaattttgcatttctttaatgcccaaggtgtttattttttaaaatctgtactctttttatcaggagttatgttgacaatttacctgggagctgatataccctatataatacatgatctaagacctgaacaatacacaaattaataaaattaaaccattaagatatgtcatcatttctaaattatacaattgggttttttttttaaagcaaaaatattcttcctcttttctccatcccttgttctggtcagttccaaggttttttacaaatgcaaaagaaattcatttgctactcctgaccacagagatgaataatttaaggacaatatcaaattcttgataaatctcataaatgttttaactgtccaagaaatggacatttatttggttaatcttttagctggccataaataatgtaataaaaccccttaaaattaacattaaataacataaagacctaacgatttttagaaaaaaacctttttggactgagccttgaatttcctgagaattcagctacaagtgataactaaaatgtaactcgagaatctggatatggttccagaaaggattgttgtcatgcaattgccatttcatcatctttccttaaagtcccttcaatatttatcattgcaatttttgtcctgtcttttcccctccatcacatcaaaccaaggaaaaacaattattaaatgctcatttatactcacctccctcccttcatattcattcattcctcagccctaaaattcctgtaggaatcctgcttttacgttttatcttaaagccaccatagtatctgtaatctcttttgtagtcatgtatgcttaattttggaagactgtcaactacctcttcaggttcattcaaatgaaaatgtatcacaaaatcgtaggctcttcccctatctcactgaaaaattactctaaaaatgaccagtaagctgttttgttgaagcaaaacatccagaccctaaacaaaagtagcagaattacaacatttccatagaaatggattttgagcttcttttttttaattggggaaaatcttattttttaaaaaagaatcccagaatacatctttgctttcagtccttcaattctaacataatgccatgttagagaatatgtggtagtgtatactaagcccttatgctgtctcacatccttgggacaaaatatctgttttgaaaggacttctctgaattttgctatttcctgcttactgagcagtggccccctcctgggaaaacagagttatttcagccagtgttcagactccatcttgcatacgtctctgtggaatattaatagtgctactgagatatattcatcatcttttctctgcttttgctgtctttatagcccagtgaaatttatatttggtgtttgtaggaaggctatcagaagctacttggacatcaaacttttaaactataaataatgatggcaagactgctaggatatctttccacagttaaacccattcaacagagtttcgttcttatgacagtgcaaattaaactagaataaaattagtgtgattttaggacagttttaaagtgaacatatttccctccctcccttcccatctacatatcaaggagacactccagactgcacttttatttaaattgcggccatcagaaaataccgtgagaaggtagtgtgtaggtaatggttcagttagcattgaccccagaaaatggaaaaccaagagcaagtcacttttaaagtgaagcaatagattttgaatatggattgttccaactcaccacttcccgaccacaacacaagagtatttcactgtaaattaagagtctaagttaaccacagctgtggtataactctgagaatgttttctctacatgtagacaattctggatccttccgtggtgcccgttaccctggtctttaacttttgtcctttgcaggggaggggtcaatgccttcttatttccttgctctttagaattctccaccagagggaggacaagggaaggagtaggtttcacgcgcagttctgagtaaagtttgaatctgagaaaccccacattcacgaattaaggatctccagttctgtgtctttattctacccctccctgcctgcttttccactcggcagaactgagtgactttcagcggctgcagtaattttaattattctgagtcgtgctccgaactatgttttttatcagttcctctgaaaattaagttgtagtaagagacgtagtttaagggcacccccttagaagaggccaggttattttttaaggaaaagctgaagatttctaacaggcacttactaaacacacacacacacacacacacacacacacacacacgcacacggcgcagacccagcaggagagcgcaacctagcatctttaaggttcgcttagcccttcctgtgcacctggaaggaagccttatcttaaactcccttccacctagagtttattttcgcctgcgtgcgacagggcttttgtacttaagtgagttaaggaatgaaccccgaactcttctgggaaagccaccaacgttccccccgcacccctcccagggttcctgaccacggagactctgcttggggcacaggtgtgggagtcgcaaacttttctctgcgccgtccttttccgcgtggaatgggacggagcagccctcccaggcgctgcctggctgcggaggggagcgggcagcgagagcctcgggtctccgcctgggttcccgggtctccggggcgctggcctcggtctccgcgcagcgtccagcgacccctgtcgggggttcccggcagccgcgccgccaccccccgcccggccagcgcgggaggaaaaggggctgcgcccgggagcgccgagcccaggctcctcccggtggcgtgtccgcgcctcggggtgggggtgtggtggggaagagggagggggcgaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccaggtgggtgcgcagcgcggcccgggccccacgatcctcctcctgctcctcctactcctcctcctcctcggatgccgtggcctctccctccccctctccctcgcccgtcctcttcgccctgcgctctgagcgcccgttgagtcgcgcggtgcttcccctcctgggggccgccgctcacctgggcgccgagtcctaccgggcgcctacgcccagagctcagggcaagggacagcagtcccggccgcaccctcccagagtcccgggagcgcttcgctccctggcacggcccctccccagcgccttagcggctgagcccagcccgggagtgggacctgggctataggagtcgaggctgcgtgcgcgcgtgccccgcgccataagcgctttgcacgggggccgtgtgccctctagcgggaaacgctggaatgggccgcctggagggagagccggtcccctcggtgtgcctggcagcgcagaagtgggtggtcgagcaagaggccgcgtgggaagttagcttcggcgttttggggcacagggcaagcgatgtagagtgcgcgccggttcatcttgattcagtcctgtgctacggagactcaagagcagcggcagggattcctaaaggtcagcgaagcagatgaaatctagtccagtgtcaggaatcagctctgccccaaacaagttctacaaacttttggcttaacagttctatttttcaagacctctgtgataaatatggataatttactttcccaagagatgtaagaaaacaaccgtttatctgaatttttgaacccaattgtttgctggttatctatataataaaatggcaattgaagctttctagaaacaaatcttgtatttcatcatcagaacacgagcatgaacaaaagctttaccttagatgtccctaggaagcgctgatgctttggacattaccttggacaaaagaggcatgtcgaataaatacttgtttatgagtgattggtaggtagctgataaaagaggggaggaaggagatgggggagaatttattttttgcctctgcaattcccaattattaattgatccagatgccttaagtcgcttcgagcgtacccccaacacacatttcatgaagcacttctgcagaattaattcactagtacttgataatactgtggctacagtaatactgtagaagtatttgtcccttgctggaagaaaacaaaccacatttgcttggtcttcttactggtatcactgatagcatttcagaacctgggttattggcagagaccttcagcagagttttgagcaaaacagaaattgaacagagagtaattgtttcaccactggccattcttgtgcttgcttctttaataagatcctgctgatcatattcacttcaattactgatcattgcccctcatgagggtgtattgaattttcccttatttttaccctatattttggggagagaccatagcactttattcaacaagataggaaattggggagctggattagttacctccctgcgtgactttgtctactgtcctttctaaggtcatcatagtacattacggagatttcagacctagctcaaatcgttgtaaagagttattttgggggctcttatcactgtttgtggttgtgttctcctgtctccctgctcattggcttcagaagaagtttctgtggtcctctgtagatggtctaatgaattaagaaggggccagcggtctgaagtagcatcctgttcaggtaataggtgtgcattttgtcaagggctcccagcagcagtaccgtaacacagcaacttgacaagttcagtgggggaggggcaggcatttctgtgccctccagatctcatctactaggtaggcagctgtcttgtgattagctacgctctcttgacacagagcaccagagcttccttggtggctctcatctgctttccagtggtacagcagtgattccctgtaaaccagctaagtcagtatctttaagtgacatttgcttaactgtcttccctgaaaaattggggtgaatttggctgtaggttagtttttagtatatttgtctctgttttccaccagattataatcttttttggggagggactttttacccccttcgaagcatcttgtgctttttaaaccagataagaatatgtattctttatttgattcagaaagaatggtcaacaacttgaaaccagctttatatagaagcacatggcattaaatacaatgcttcagaatcagtgtttctttccttctttgtcattttccttataatggtaagtgccagtgtagttttccttgtcttaggagaattcatacctgatgactataatggtttgtgagaaaaacccacactctaggtttcaggcattcccaaaggaacgacctatagatgccataactctagtattcacacttgccgtgccagcccaaattaggacttaggaggacaagtttctcttgtattgctcccatcttagtgcctgtcagttccaagtttcactcctttcttaaaacagccactgcaactgtctgtccttgatgatatgtatgcaatagccaagcctctcttcagctgttttaacattgcctcatgacagtcaggggagagataatggggtgggatctcagccactcagccccgctgtgtgctatattgtacgcataggcataaacacatctgttggagggaaattttcagggggaaaaggcttctttaactttcatatggcatgagtgactgatatgcgatacatacatggctatttcagagcatctgcacttttatacaattaactaaatgttgaattgcacactattggggctgcagatgttcaacacaattatctattccataataatagctctaataggtcccaagcccttggagtcattgattccttttctttgctcaaaataagcaagctaagaatagtcttgggtgctgtatcactgatccacgtaccaagagccctgtaacagcctgggtctccttggtgctggacctcccatatccagcctcttcatactgattcagctcaacagactttttctcttgaagcctgaattacaaaaccagagcttttttttttttttttttttgacggagtctcgctctgtcgccaggctggagtgcagtgggtgcaatctcggctcactgcaacctctgcctcctgggttcaagtgattcccctgcctcagacttttgagtagctgggactacaggtgtgcgccaccatgcccagctaatttttgtatttttagtagagacagggtttcaccatgttggccaggatggtgtcgatctcttgacctcgcaatccacatgcctcggcctcccaaagtgctgggattacgggcatgagccacggcgcttggccgctttttttttttttttttttaatttttggccaattggtatttgactctaagcttcctttgtgattctctgtcgatatgttgttcttactctgcacctctgcacggaattctgtcttttttctttttcctcttaaataacctgggaaaaattcactatcatgcctagccagattctagaactatcctgtctcccttcactcctggtaggaggggcatttgtgagtctgggtgatggaaacattgagaaacctagtatcccaaataggtagaagcaggctgtgtgtttccccaatgacatcacccacctgtttccctcactaagtggctctgcaggctgaagtgcttgtaaacattcttgcgtataaagtaccctgaccctaacggggcagcctgtgtttacagaacaagaggaatgtccagtgatctgtttcaacctggttacttgtaaccacctagcctatgtaattattaaaaacattaaagattattcacagaatgaaataggacttattttgcagaattaaaatagcaggaagagcggaagaaagttgtatattcagacatgaatacttctcatacccatgaaatggtcagataacactaatgaaaaagaggagaaaaaatatatatagagaaccaaaaaatattagacaaacatgaacactgaatacctactacatgccaggcactgtgctggacacttttatgtttattaatgagggacctgctatttattgaattcttaccatgttccaggcagtaaaacagatgtatattgtgtattttgtcatccgtcctttcgaaaataagaaaattccttgctattaggcagcaagatgccagatggcctagtccttagctcttcagccagattgcctgggtttaaatcctaattaggctgttccttaaatatgtagtcatgggaaagttacttaatctttctgtgcctaaatttcctttttctgcaatatggggataataatactattattattatcatgagggtttcatgaagcttaaaggaaataatccatgaaaagcactctgaacatcaaccaacatgtaataagtgcccagtaatattagctgtctttataaaactacttaagaaatgaattatctgtgtctttgcaaagatatttgatataatttccaaaatttaccttttatggtaaaaaatatccaaagctgacctcagattacagtggttataaatattaatatgtactacctgtaaaactagagaaaagtggataagagtgtcaaattccataactgcatatatacattatgaaaacagtactgaactcaatctaaatattgaaagtagagtgaggtgcaacataattttatctctggcagaaaaatgttgaggtttcaagctatgagaagattttgaaacatgactcttttttctggcaacacttaagagttgatgcttaaacctcactttattgtatagaatacataatcttctcttttgggactcgtataaattgcagcaattgaaaaacaaaagtgtgcaccaacctgcccctcactatctttttatcaagcataacagtatattgccagcaatgttcatagaattgagtgcaggtgtttctaaatataaacaaaataaggaatatattaaattcacatttctagttttttatttcctcctcagccttcctagaatggctataggtagtgtttaaagttctggaagtgtgatagattcttaccaaatcaatgttctgttagcattctccaagtaacaagttaaattggatttgaacagtactgatagtttatcatgttctgttaggatagatgaaaacaaaccaaatgccagtattttgggtgagtcactttatttgctcaaagacgcaaatgaatgaacttctggtagtttagttaaccctggagctccccctcttgacaaatagaaaaaacaaaaaaataaatcagatagtattagcttgaaaacggatttcttttacccagataaaaaatatgccactaaggtacatacaatgaagttttcttgaaggaactaatgatattttggatttctcctaattttgtgcatgtctgcacttgtgtgtgtccttgtgtatgttttaatgggttaaaaaaaaaagcgagctaccaaaataccaatagatgtcagtgtttgtcgctttagaaaaagtgaggtgttagaaaaaaagaagaaatggacagctttatttatttttggttttactaaacataaagctggctacttttcaacaattgactaataattcactgtatataaccctgtttacaaaagtacattttattaaggaaaatattccatgttctcatctttcttctaaatttttttaaaaaagcctctgcagtaaattcccaaaagaattcagaatgtaggcagaaaatatgttaattttttaaaattaggaaacaaaattatttgagaatgtcgttaacacattagatttcttttgcatttttaaactagaaattagatatgcactttcttatgttgccctgattatgactgataaagtgcatttttcagtccaagtcaagtgagatctgtggagttctgcctctacataagagcagagatgatcagaattctcttcattcttcctatgccccatgtcacctttttctggcctccagagggtgctccaggagcatcacactgctattccccaaagactgcttttttcttctctctctctctctttttttttttaagttactgcagtattctgggcaatctactggaagaacagagtcccgattccatacatgttagctgcctcaactggagtttgttttccagctggaccacatagccctaattcattaagtattctaaattagaatattttaaaacattattctgatgatgttgatgcagtggttagcttgcaaggggacatctgtcagattaattccctctaggaatttcccccaagagaatcaagcatctttaaataccttccaatcacgccttacaacagctccctcccactgaagtgcacatggtacccacaaagagatttagtgctatttaagagtttcactctggcattggaaaactataggtgaaagcatcaaagttggacaacagatctttactaacacatttgttttcatctcttcctatctctctgtttcctcaacccaggggcaacaaatgtttaggagccccactttgattgagtgcacatttttgaacacaggtttgagtgactaattcttgtggatcatgggctgattttatttatgtactttttttgagacggagtctcactgtgtcacccaggctggagtgcagtggtgccatctcgactcactgcaagctccgcctcccgggttcacgccattctcctgcctcagcctcccgagtagctgggactacaggcgcccaccaccacgcccggctgattttttgtatttctagtagagacggggtttcaccgtgttagccaggatggtctccatctcctgacctcgtgatccgcccgccttggcctcccaaagtgctgggattacaggcgtgagccaccgcgcccggcggggctgatattttaatatggtcacacaggccttgttatttatggtttacctgcttatgttaattccaccctgtacttgttatctttgacatgagttactctcaggatattactccccttccctttttaaagtgtaatattgttcccattgtttcttgctccaagaaatctgtcgttgatgggaatagtctttgactgccacagtgccccgaacctttcattccacagctttgatgggcagggagctgccttctctgggcagctgtggagttttactttcaatgatatgagagtcacagaatgttttattagattgaatcatatgaaattgtcagttttgtaggtcatacctggctgaatattgtccatgtcatacagtttaatatttggactttgaaaaagtaatttgactttacttattctttacatattctttaagtaataatgacaactttgaaaaagaattatgtacgtttttgataattaaataggattgaagtaatacataaaagaaatctgagctagggataattgaagcagtaacattttttacaaccaataaatcagctaaaatcatatccatattaaatgaatttagcataaaattagaatgacagagcaactagcattttcccttggtgagaaaagtagtaagtttccaccataaaatatgactcatttttatttgacctattagcagatagttgttattgcaccttatcttaaccaccattatttctacagagagattacagagcaatgagtaggaaatatggaagattgctgaataatcctggctttagttatggagtaatatgaaaaaaggaaaagaaaaccttttgttcactttcacagtactacatcaatgcaagctttttagtagttttaatgtatgaattttatcatcaggtgaaaatgcatctcattattagatggcctattttataaataaagttcaaatttcgatatagccagtttttaaaactgtatatgtttataactcatccctttgttgcatataatctcccaattttagagacttacattgcatttttaaaggatagcacagtctctttagcaatcccacagggaatctaaaaccagcctttacaaggagatgtcaaaattccaatttgcagtgatatttttgtcaaaacaagtaacgtgtgttattacgtatagtaagttaacacaatttttcatttgtgtatcaagtaggcattggtttttgttttttggtttttggttttttttgagactaagtcttgctctgtcacccaggctggagtgcagtggtgcgatctcagctcactgcaagctccccccactgggttcatgccattctcctgcctcagcctcccaagtagctgagactacaggcgcctgccaccacacccagctaatttttttcgtatttttagtagagacggtgtttcactgtgttagccaggatggtctcgatctcctgaccttgtgattaacccacctcggcctcccaaagtgctgggattacaggcatgagccactgcgcccagcaagtaggcattgtttttgtgtgtacgtatcaaatctgtttttatatcttttggtattttatctcttttctgccaacagggtgaaatggaagtacagtattgggattatgcacaacattttattgtttaaaattatagtattccttttccattctgttgtttcagttgtttaaaaataagtaacaaaagagaggggtctgtcttgaagcccatgagatggtagatctttagaaacagttataatagcagtcatattgaaactgattgtcatctatttctgggaaaaatattgaaggctggtatattgtccccagaaggattagatgaaatacagaaaatagattatgattataattttttttagtgaggtcaccttgctgtagagttggaaccttcccgggggattgctcatgcattatccattttgggaaagagtaatacttacaggcattatggaaatgagcgggtaggtttgtcaagaggaaaccaataatttgaatactgagttgaatggaaaatgaaatacatgattttccatatattaaattgaatagaaatgggagacttatgtcttgagggtttttcttttctttttttgaaacatgttgatgatattgtgtgttcccaagtgccctcaacctgacaggaaggagaaatgtcaatagaaatagttacttattatattttgatatttagaaaggaacagtggagttttaaatgttgtgcatatcatttatgccccatccaaaaggatagcgatccacttaaaagaaggcagaaaagacaaggaccgctatcgttctccaggaatcaacagaagctaagggagagcgtagagtatagtccctgtggcctctacggagtcatcgccttctcagactgaatccacacaaggccgccttgactgaaagagcctctacattggactgtgcatggcgtggggaaatgtgattacttgcaatatgctactgattacagaataaatattatgcattcggttttcactaaacttaaaaagcccagtgaaaaccccacttctgcatgtggtgaatgtggttatgctgtgtcaggtgaagacatgtttcagtgccttcgtttactttccattaagatatgctgatttccttctcccttatgaaatagaaaaggaaggacataaccatcctgctgctctgccctgagtgcaccagtataggaataaaactctgtaaacagagggtggtggcaaccatctaacagggacctgcatttggacctgtgtgtttgggagagccgcaaagtggctgtgcctctgatatcacaggactctatgaaagaggcaaccaaagaagacctgaggctcttcttgtcattttagatatgtgatttcataaagttactcttgaccttaatgcagatggccatttgggatttgtgtctgtgcatttcatccacagctggatggcatagttgctgagtaatcctgttgctctggagcaatgtaagttacagctgtggccaggcacgtggctcatgcctgtaatcccaacactttgggaagccaaagtgggagatctcttgaactcagggattcaagaccagcctgggcaacacaggagtcctcatctctactaaaaatccaaaaagttagccgggcaaggtggcatgtgcctgtggtccagctgttaaggagggtgagatgggaggatcacttgagcccaggaggttgaggctgtggtgggcaattatgatacaccactgcactccagtttaggtgacagtgtaagacttgtctcagcgaaaaaaaaaaaaaaaaaaaaagttaacaaccatatcaaaagaacaatttattcaccccccaaattgtcttggaattctcacattaatttacagagagaaataaccctttggaaaattcacaatgttttgctagtattagtatgtcatctcactctaaaatgtaaaaaaaaaaaaaaaaaatcactactcagaccttataagaatctggtttttgattatgaatacagcaattcttttttgaaaactcccttgacaaattaagccaatggtggacattctaataattgtcatattttatggtacatttgtaactaaaagcctcttctttgggtaatgactgatagtttcatggaagaagtcattctttttctggtcactctagaaaataagaaatgggaaatgattgtatgtgatatacatatgcatggttctaagtaccaaatttgcagattgcctgaaaatgttcttatgtactttttatggatacaggctttcttttcaattagattcaaaaagtatcaatacattattatactttaaattgactagagctaccttttaaatggtcagataggttttctttttaaagaattacttttgtgattactagccacctgaaatggtgtttcaaggccatgcatggtgcctcatacttgtattcccagcactttgaggggctgaggtgggagcatcgcttgagctcgagttcaagaccagcctgggcaacatggcaaaaatctgtctctacaaaaaaatacaaaaaaaaaaaagaaagaaaaagaaaaaccattagccaggcatggtgggatgcacctgtagtcccatctacttgggaggctgaggcagaaggatcacttgagctctcagaggttgcagtgagctggaatcgtgacaccacactccaggctgggtgacagagtgagaccctgtgtcaaaataaaataaaataagatataaatgaaatagtattttcaagacttggtataaatgcatagctgttaagctgtaaggacatcaataaatgttcataaataggtaactttctacattctatcaccttattttctataatacagaaaatatactttaaattattttatttatctgagtccttttattctttttgcttttttttttgtttgcaagaccaaagtcagagcaatttcaattctattttgagcattttattttggcactcatgtattttaattaaaaaaaataaataaaccattgtcctcagccagaagaattttctgctgagtggtcataaatgcagagtttagcatttcacatctctagaatgtaaaagccacaaagtcatatctgtcttttatgttgtcatatcaccaggtgccatcatggtgctgagaacatagtctttgtttttaagaatttattcagtaactgactgaatgaggaagtatggctagtttgcttaagacattgagttgtaggagttgatgggtagcagtttagttattatgctactgtcagttaataagaaagtatgagtgcaattcagcagtatcagtgatgcatggatttgttcctaaattgttatttttgtggttgaaatttgcactgtttattttgaagctctctgtgtaagtcataatcagtgcttaattattcagactaatgaattggaattagaggtttgctcagtccacaattcttgctaccattaaaatattttgttacatttgtttttgagtacatagaagcaactaagaaatggattaagatgctgcagttaatctttgtaaattactatggccattgcctggcacctaatgtttgctatgttaagagtttgttatatgaataaacgaccgctgttcctggtaggtaatgaaagtaatcttaaacaatattagtactgcctaaaaagtaaggtcttaaatataactacagtagtcctgagaaaaatcatagagtgttagaactgaaaaggttgtcttagaggtcatctgctcgaatctcatctttttagttgaggaaaaccacaaggtacaaacaacaagggcatcaatcctagcactagaacccagatctccagatttcagggtaaggattttaattattaccatgctatactttcagtctcaagatggcactatatatgaattcagcttcacttttatagtgctttgggtgttattatgcttccagataagagagatgtatttctgtgccattgaggaatagcttagagtacctatgattcataggaatttgaaggctgtaaatcaaccgaatctttatatctttttgttccttcttgcagtatcttgtacccaagtagcttcaataaattttgactgacaagatgaccataaaataagtagtcctaatgtcataacatggaaaaggagggtaatgggtgtgtgtgtgaatgtgaattagtatagtatagtaatgagctgcctcagcgctcttaaactttttttagcaccaatgcctttatgcaggaaactctgaaaacaagcaagagatctttgtgggctctctgtaaattatgtgcatgcaaaaaagcatcctcagtgcttgtcccttgacagctgctctgagaccactgagtcactcgcttgcatctgtgagccactgaccagtcactgattgcagtgacagtttatcactaacaacctgaattatctttgacccagagacccaggggtcaaaggcctcctagtccattattaaatttccagggcagtagttcagtttgcattaggggatttgtttatatttatttatttagggtttttggggggtggggggtggaggagcttgggggaatgagacctgcagttattttccccacattataagattatttagtcctttatttgtgggatttggcatcctaaaagaaaggaagactcaaagtattgtggttctggtctgggcctcacatgggtgtcctaaagatttctgggacccatttatgggaagaatgccactctacagattatagcagggaggagctttgccctcaggaagacacagatcctttgagggtggtagagactcctaaagtctgctgattcatacccagctggccccattaacaagagaattaaagagtggctagaaagggactgaagagttcactgggggcccatccaaaaagctgggggtacagacaactgctgattcccagccagtcatggattttattttgagacaggtctcgtttggtcgcccaggctggagtgcaatagtgtgatcatagctcactgtagcctgggactcctgggctctagtgatcctcccaccttaacctcccaagtagctgggactacaggcatataccaccatgctcggttattttttttttaattttgtagagatggggtcttgctatgctgcccaagctggtctagaacttctgggctcaaggagtccttccaccttggcctcccaaagtgctgggattataggcatgaaccactgtgcctggcttgccagtgatggattcaaagtcgcctctgggttgtaaccaggaagcatgcctgggccagactgagagggctgaaggatgacggcatggtttcagtgtgtgagtgtgcatgtatgtacgtgtgtgtgagaatgtgggtaagtgtgtgagcctgtaaaagtgtatcatgagtagctgtctcttgggaggagagggaatcaggaaccttggtcaaataacaccatgtactggcatggaaaggcactgttctgggcagcagtcaagaagacagaggaggactaactgtatatgatttgggcaatcatttaaagtatctgggatttatttccttgtctaataattagcaaggttgatgtagatgaggtataacaactttaggggtagaagaaagctatgattcaaagtcggcattttattagatcagtggtctctgatttggtgtgatgtgttcctggtatgttttcgcttagaacaaggttgtttaacccatggcccatgggcttcatgcatcctaggacagctttgaatgtggcccaacacaaatttgtaaactttcttaaaacattatgagcttttttgtgattattttttccagttcatcagctgtcattagtgttagtgtattttatatgtggcccaagataattcttcttccaatgtggcccagggaagccaaaatattggctcacttagagtctttagtagtgactatgtttttagaaagcctaaggtatttgaagaataatagtcacataaagtctaggcaaatagcaaatttgttttatgtaggaaacagcttatcttctatagaataacttttgatgggtgaaattgtagtgttaatttatcttagtgaacacctagaagatttgtttaggtatgtgaattgtttagtgaaaatgtagaagatggtaagtatatttgggaattactagtgcagaagccttttattaaattctcaatagaaactgggtactggttatgaattgtgatctctcagatacctttaacttagtcgtctctcatgagtatgtgatacaattgaagttgtgggatttaacctctgctgagcagcagaaagatatgaagcagtggaaaatacaggctaaacagagcctttcagaataatttttcctcagtggtttatgttcttcacattcagtttttattcttctccatccttaactttctatagctgatacttccattttggatataggctctgtttcatttccagaggtatctctttccctaaactcatcaagtactttttcaaccttgttgatcatcttaacagaagaatcgtaacattaagttgatttatgacaccatatctctgtagtaactctgaattgtcatcaagctattcattgaaaggatacctcttaaactttctattactaagatccccaaatgtatctattctcctctcgataaaatgagtattgtcttagacaagcagcagactgctttttaagtgaagtggattaagctgctgtgatcgtccctgtgaatgtgtatgataaatcattttgatggcctttttaaatcagagtcaccgagtcccacacagagaaacagagaatgctgtctgtcattattacaataataattaagcgttggctgataggatataaagtataaatcaaagatcttagaggaaatagatgaaagaaaagctttgtttctcaaaaacttaatctaaaagaagaaatattgagcaagcattgggtgcttcatgaatggcctaaaaatatatttaagtctatcacctggaggttcgttcatttattgccaggaaagaatcaatcccacttttttttctctttccctgtggctcaactccaggaaggtgttttaattgattggtgggaagattttaacacagacaaaacttataagctaagcatcattatttctagtacagtggcttcaccacattatagggtaataaagttaaaagctgccgattgtttcagaattattttcagaaatttacatcctctttattcctattaccttgagaaagagttcagagaatgggcttagtcagcatgcaattatggtattagataaagcatacagtttggtctaaaaccaagatgcagctagtctcatcagggtactttaatcaatcaagggttgttaagaaggtaggaatgtcagtctaacttcattcctttgaaggtgatcagcctttcttctctggaggctttgaagattttgtcctatggctgggcgtggtggctcacgcttataatcccagcactttgggaggctgaggcaggaggattacttgagctcaggagtttgaaaccagcctgggcaacatagaaaaacaccatcttcctctccccactaccaaaaaaaaaagttagccagttataatggtgcacatgtgtagtaccagctacttgggaggctgaggtgggaggattgctggagcccaggagtttgagggtacagtgaaccatgatcatatcactgcactgcagccagggtgacagagaaagacccagtctcaaaaaaaaattgttctccaacaaatcttttttgaagttatggcatttaaccctgcccaccattcccattcccctgtcagtttcactatcatgcattcctttttctttatcccactcaggaccattgggcttgtcaaacatataaattggctttcaggaaaattcttctccatatctcttaaaaatttcctgtatcccattctcttccctctttttggaattttctttttctataatttaaagatagagtcttgctgttttctaggctgctctcaaactcctgacctcaagcgatccttctactttggcctcccagtgttgggattataggtgtgaaccattatgcccggtctagaactttaactaaaagtacgttggaccttctttctctgaacactggttctttttacttccctcacgtttcccatcattttgtttcactctcccgctgtatctcttttgaagttatcttccccttcactcattgactcttcagctatgtgcggtctgctgccaaaaccatccatgaagtttttcatttcaaggactgttttcccccctaaacctagcagttttatttggtgccttttcaaaccttctatgttgtattttatattttcaaggtccctgtagatatttttcaggttgttatttatttcttttagcagagtaagcctagttgtttcataatttctgtgtggtaatttcagtttgtgttggttctcactctctatgccttggttccttctgtgcttgatggttggtctctgaccctgtgttggccattgctctgtaaaaattatctgtgtcattcctcaaggcatgggatagaagcacattcctgccgagaaggtaagtgttactgctgggtacttggaaacttaccgagttcgtggcttgaggttctgtggcctaccagcctgtgcacacctaggcatgtagaaacctgtcggtagactcagcttttccctctggctgaactcaggatcaagacaatgtgtctggccggacacggtggctcatgcctgtaatcccagcactttgggaggccaaggagacgggtggatcacctgaggtcaggagttcgtgaccagcctgaccaacatggcgaaaccccatctctactaaaaatacaaaaattagccgggcctggtggtgggtgccaataatcccagctacttgggaggctgaggcaagagaattgcttgaacctgggagggggaggttgcagtgagccgagatcacaccacttcactccagccacagaacatctcaaaaaaaaaaaaaaaaagacagcatgtctttagttctctggggctaaatgggtatgtttagatttggtgtagcttttttggggttctttactccttttggggtcccagcttaatgtgaagagggtctactctaagactccccacttcaggaagatcctggagcctctatccctttctccaggatgagcaaatgcacttgaagaaaaagtagttgctttgtccaggtattttgcgtctatctctaaggtttgagatttgccttagaatttgtccaaaaaatgatcttttttgtcaaattcttttaaggtgatgtttattatatttcattcagcacttttaattgtttccagccaggaggttcttgtgagaaacttaccttccaggaatggaagaggaatcattagtcattaaggagctaaaaatgttaggaaaatattaatgcttcagaaacaatttgttgatctgaagagtacctaagttagggattttcagaaagtagcattttgttttgttttgttttgttttgtttgagacatggtcttgctctgtggcccaggctgaaatgcagtggcgcgatctcagctcactacaacctccacaaacgattctgttgcctcagcctcctgagtagctgggattataagcaggcaccaccacacccggctaatttttgtatttttcgtagagacggggtttcaccatattggccaggctggtcttgaactcctggcctcaagtgcccacctcggcctcccaaagtgctgggattacaggcatgagccactgcacctggccagtagcattctttggatgaattgactctggttttgttagccttcagaatctaaggaagtttatatctggtcaattttgagaaagaagatctctaagaaatgcctcaagtggggaagggatggactttataaaccaaaatgtcaatgtgttaatcctaaatatctcaatgaaatggggcaaaatatggctaagaaaaatttgacaaggtgtaaatctcactgaatgcagttgctgtggttgctaccaagtttacaagagaagaaaccaggttttgccaatgcatcaaaaattagattaaaaaagaaatttctctggcctagtctgatgcttagccttcaagagtaaaatgatgtgttgttagatgacttgaccaaagtcccatagccaaggcagggagagtgttgcagcctggtggtccattatctgatgccactggatctatgtagatgagtttggaacttcactttctgccttgtctgggacgtaaaaactttgggtgcccctcacttcttttttatataaactgttgtgttttattgccctggcactcttaagttgctgtttcaccctagcagtgcctgcttcaagccatcaccaatgaaagtgcctttgaagtgtcttaaggcgtgtgcattgcctagacaaatagttggcagaagaggtcaacacaagcgtctttgctttggagtgtcaattgaagaaattgtttttccacttgaattggcagtgtgtgctcttactgctgttagagttctgggcagagaagtagatgtgataattatgaagggagaagggggaagaacagctgcagaatgcagggaagtgactggactccagtaatcatatttggcaggtcaagggtgagatttagcctgatgggatttggaccattccctgggctagaaagtagtgttaaaatcaactccaggtgtttccgttattcttaaggcctaagtattattaaagcagaaaataatatggttaggatatgaatgggaggggattggtcattcgctgcttgggaatcacttatttgcaatagagctcattctctcttgacagttgctcctacatgtctaaaatacaccataaatctcgaagtgctcgtttcaatattgaagtttcctccaagtgagctgttatcacttttgtcttcaagagaatgctaactcactgaatctctttgagctttttatgctttacactgtggattttggagtttgctttggtttttccactagttctttaagttaaatttaggtaaagaaatttaaaatcatcaggcttattcttaaaaactcaagtattatcaaatgatggatgatagagatatgctttgggaatatatccaagtacttcaaatgatagaagttagaacaccaggagacatttagtaagagattcttctgctgggtgaaatcaacatcaacatcacctggaaactcgtgggtagtgcaaatcccctggcctcaccccagagctcctggaatgaagctgtccgggatagggcccggcatcctgtgttttaataagctgtttgtgggattctaatgttcgccaaagttttaggatcatgcctgcagagaatcctgctcactatgaaagtttgcatgcctgagtaagtcaaaagagatctttgaaaatagtatctaggtttgagagacttgctgtgattgtataattttagcaaatgtgtcaaaacaaatttttacttgcaggcaatatcttgttagtacagagaaataaaacaaacaaacaaagattataaataagaacaaaagtaattcatccaagagccatgtgaaaatgaaaatccttgaaatggaaaaaaaaaaaaaagtttttcagactaccctgtggaagtagtaagttacattgaaaggccgaaatcagccaagatcattttttgttgttttgttttttgttttttgagacagcatctcgctctgtcactcaggctggagtgcagtggtacgattttgactcattgcaacctctgcctcccaaattcaagcaattctcctgcctcaggctcccaagtagctaagattacaggcgcacaccaccacacctggctaatttttgaattttttgcagagaggggttttgccatgttggccaggctggtcttgagctcttgacttcaactgatccgcccaccttggcctcccaaagtgctgggattacaggcatgagccaccgtgcctggccaggccaagatgattcttgaagtgtgtgtgctgtgcgtactgtgtgtgcatgtatacgtacatttctgatggttcactttagtgatactgtagttcagtttatctgggattgcctcagtagaaagctatactcttacttgtttaactttctgtctattttctcctttaaaaaagaaaagattatatagtagacttatacttggtatctgtctgaaaaaaattatatgaaaactgtctttattgccagggaagcacttgtactttcttttctcatttattcttttctgcactttaatattacagtttatttgcttctggctttctttcataatttatcagaaatacaggcttgtatagaaatcaccattttttaaataaaattttatttttattaaattattgtgagctcattgttttttaaaacaatcatacacaagtaaaacatttaccttgggggtgggcatcagttccttttcccatccgttttcatctctagttttctttcctaaaaacaagccctctcaacaattctagttaattctttttctgatagttatcttttttttttttttttttttgagatggagtcttgctctgtctcccaggctggagtgcagtggcgcgatcttggctcactgcaacctctgcctcctgggttcaaccagttctcctgcctcagcctcctgagtagctgggattacaggcacacaccatcacgcctggctaatttttgtatttttagtagagacgggatttttaccatgttggccaggctggtctcggactcctgacctcaggtgatccgcccaccttggcctcccaaagtgctgggattacaggcgtgagccactgctcctggcctctgatatttatctttatattttctatataacatgcatgttctgctgtttcttttttaaaaaccttttattttaggtcttataggaagcttgtgcattcatttattcaacacataattattaagtacctaatacattctgtacattgtgctaggttctggaaataaacagagaatagaacagacatgattcttatccatggagagcttatattctaaagatgctaggaagtacttttaaataaaactctgacttatatataaaaacttcagaaaagaaagggcctgcttttaaatattttttttggtgttgtccactacttgaacttcatcaagttcatcagaaaaaatttaaatggtatttctaaataagtggtttgctccactctatcattaagcttgttaagatgaataaaaatcagaatattttcaaatgtatgtaaatacatacattcagtgtatttcccagcttcagaaagtcctaatttctgaaagtccttgttatcaactcttgttttgaaaggaccctttctttaagataaagtgtcacatacattattttgtattgatacaaattattgatgattatggatattttaggtaatcaatactaagataattatgttaatatgaattatgattatagggtattggtaacagacaggagtgtaggtgaatgatatgaatttgcactgagtttgtcatgcccagaaagttaatctgagccaaatttctaaaaagtgccttccttattccatattatgtatgaaagaagagcatagtttatgtgtgaatatatgggcaacatgtatatagatgtccacatgaactgcgcctggttaggtcctagaaaagcctatggtgggaaaggtgggttaagaggattgaagttaggagtgaacttgttatagtcttcataaatatttttatagccagtaacataaaacaataaagacagtgctccaaattaaagatacagcaatgacatgacatctacatttgaaactagtaataatggatgccgggccctattactaatttctgcttagcattccttactcaccagaaatgttttaggatcttagttcctttgcagcttgggatgcttgtaaattcacttgttcttttataaataatgtgcatacaaggagattttcaacagcattttcttatcaaaggtctgggcctatagtcaaatagtcaatgccatcgtggttttacagcacccatgaggaggtgttgacgttcaggttttagcttcaggattttgacttgtgtcttcttcctgcttgggtcctgtctcttcccacctccccagctcagccttcatgtacgaattttagattcttttgccttcgtatcagccagcagaagctagttttttgttttgttttgtttttttcaaggcctaggtttccttttactcacatctttcttcaagctttatttgcaaacacctccattcctcttgccattacttttgcttcatgtctatttcaaaactctgtttcatctttttcttgttactaccaataggagtaaattgagtgacttgcaattaaggtacaacagaagcagaattttcaaagttactcaaaaggaataggtagaaaaattcccatggtaagacaactcagtaaataattacatacaggcagtgaccatatatgctcattttaagttacaaatatacacacatggccataaaaatagtcagagactgagctggaactcaatccgtaaactgattccaaaccccatgtaatttttatacacagtttattgctagctttttgtccttttatgttcacttttatgtcctatcttctctatattcctaagttgcccacattttaaaatctgcctgtcttctgactttttaccacaagtgtttttttctcatccacttttattattctcatttcctgttttcaaagaaacaattgcaacacattttagaaatgcttacgacataagtggcacactcctgaagtctttccaaaatctattttcctccatgtcttaatttttgaaatttatatacttagcttctttctgctaattcccacagaaaaactcagcacaattttataagcaatgtgaatgatcttagagccctcataggaataaattgcacagaatgttatcaatatatcataagtgaggtacaggattaattttctaagatatcatttaaaatttcttctattgttactatacacatttgatttattaagccaaaacttcattcctctaagaataataatcccgtcacagttctaatcctagcatagtgtcgtcttaactgcaatgtactatcctaactttcaattacatcttatttcagctttctttattatacagtagctaaaaatcattgatagttataaagaccataatgccataacctctcaaatttaaacaggatagaatattttatgttactaatacagcaacagaggcattttcctctgttgggtagatgcaattattcagattccaagtggttgagacattccataattatgtctctaattttacattctacaggcctcatttcctctgtctgataactgtcctcacccaagggtttctacaaagtcacagtttgggtgaatctgtcatctcattttttcaaagaaggaaatcatcatcaaataaaattatacacaccaaataaataaatatcaaataatatattaatctacaaatttgcgacatatttattttctgactttgaggttaatttcgccaccatttttcctaatctgtatatcctatccccacttgcaaacaatgttttgcctgaaccgagtaatggcaacatttatcgtaagtatatcttagcttcttctccttatctgaatggggttctagttcccttagcattctcagataacattctgaatattctactctgtatatccagtttgttcatagacctcaaaatgcagaccctgcatggattattcccattctgctgtctgtctttatgaaacctgccaatacttattgctagatgaaattctacagatgttccatgatgacttattgactcgataacagggatctgcaaacatttctgtagagacccaactctgcagttgtagcacaaaagtagccacagacaatttatgagcaaatgaatgcaagtgtgctccaataaaactttatttacaaaaacagatggtaggcaggatttggcttatgagccgtattttgctgacctctgctctataatattccttgaagagatactattatcccaatatcctgacataaaatatatatccttaccatttgctgtagcaatattcaatttttctttacctggcgttgcttatgttctccagccagttctgtcttttcattaggaatctgagttaggatttcttagaactatgtatttgggtaagtttatcaaaggcctttttatttttattttttattttattattattatactttaagttttagggtacatgtgcacaatgtgcaggtttgttacatatgtatacatgtgccgtgttggtgtgctgcacccattaactcgtcatttagcattaggtatatctcctaatgctatccctccccgctcctcccaccccacaacagtccccggtatgtgaaattccccttcctgtgcccatgtgttctcattgttcaattcccacctatgagtgagaacatgcagtgtttggttttttgtccttgcgatagtttgctgagaatgatgatttccagcttcatccatgtccctacaaaggacatgaactcatcattttttatggctgcatagtattccatggtgtgtatgtgccacattttcttaatccagtctatcattgttggacatttgggttggtgccaagtctttgctattgtgaatagtgctgcaataaacatacatgtgcgtgtgtctttatagcagcatgaccttttaaagatcttaggagcataatgctgtaacctctcaaatttaaacaggatagaagattttatacattactaatctggttgggtagatgcaattattcaaattccaagtgggtgagacattccgtaattatgtctctaattttacattctccaggcctcatttccctctctcatttcatcaggtcttcaaaaggcttttaataaacttacccaaatatataattctaagaaatctcaaattcagtgcttgatcagatcactgtgtggtatagtttgtatatttttccccacccaaatctcatgttgaattgtaatctccaatattgggggtggggtctggtaggaggtgactggatcatgggggtggatttctcatgaatggtttagcaccattccttggtgctgtcctcatgataatgactaagatctggtcattttaaagtgtgtggtctctctctctttctcttgcttgctcgctcctgctttcaccatgtgatgtcccccactactcctttgccttccgtcatgattgaaagctccctgaggcttcaccagaagcctggcagatgccagcatcaggcttcttgtaaagcctgtagaactgtgggccagttaaacctcttttcttgataaattacccagtctcagttattttttacagcaatgcaagaatggcctaacacaatgtgtaatctttgtttcatagagtttacactacagctttgccacctaactctcctatgttagtacatagaatttctgaaccttcaatcctgttcagaatgccagattgtgagagaatcagttatgcttcaaccttgaaagcatggagttctctgctttcagggaactccagatgactcaggaacagaagtaaaccctagacaaatctaaagccaaacatagaataaagctgaacagcagatcataaatcccattccttgctccctaggaatacctcttcttctaactccagcttcagatttttccccaggtttcacaattgacctttgtcttagtgtccatactggttggacatacccctctggcatagacattcatgataggcattgccattcttcatgatatgtcattcttggctacttcctctttttctaggatgcatgttttagctcacttcatgttcaattgccttgtggttggcctacttcttctttctcttctttcctacttttgtggttgctttatagttgactaattactagttcatcggctctgcttattgcctaatactataaaagttcccttcctggaagggttggggatgggaaagtgggggtgggtggtagtaaaattaactaaactttgtagtgggctggagatagggcatgagtaaaggaaaagttgtattttaggactgctcaactgcatggatatttatactttttaagacaagcaacattaacaaagtctggatcttaaagtagagatctacactggagataataatatccctgtgggcatttaatgctcatggttacctagaaaataagtataaagtaggaaattttgagagagtattcttgtaaagattaaatggtgacaccaatgtaaggcttgaatgttctaataagggtgaaacttggtctgggaatggcagttcttacaccttttataattcttaactgttattttttagatctggtcatttaaatctgaggacccagatatgctagtcttatagaaagcacaaatttaaaatgggttctttgtcttacatagctctaaagtttaggaaaaaagtatcttcaagcaaccttcataggaattctccaaaataaatgtgttcctgattaatatgtgttttattttttaaaatttatttttaattaatttttaaattgacaaaattgtatgtatttatggtatacaacgtgatgttttgaaatatgcatacactgtggaatggctaaagcaagctatttagcatacgtgtcatcatctcacataccatttgtttgtggtgaggacatttaaaatctactctcttagcaattttcaaataatgtaattattttaaatcagttgtttaaatattatgaaattactttcagcccttagagaatagtccatctcacatgacacataaaaatggaaggaggtgtctagctcaggagaaactttttggaatatttgattctctttccctcattttctcttctttttttgttttttaaaaaataatttttaaaccctgtattgactcctggctattattttgaatatgagtgctaacaatttgagccttgtagataactatcccaatgccaattgaaccataattttcatttgtctctttctacaagattctgaattttttcagaagtgaaattaagtctcaattccctataatttacccagggcaataaatcttaaacattttttcttaaaaaaacaaaacaaaacatttttactggaaagactttatggggtggacattaactctgtaaatgccatataacttttggagagggctgcccctggcacagtgtaatatttatgagaaagttgtgcccatactaaccacctgtatgagaatcgcctgcgatgcttttgtttaaaaggcagattcttttttccctatatttttctctttttaaaaaaataatttcgacttatattttatatttatatttatattattttaaaaaataatttcaacttatattttatattcaacctacgtatgcaagtttgtcatatgagtgatattgcgtggtgctgaggtttagggtacgaatgatcccatcacccagatactgagcatagtacccaatagttggtttttcaactcctgttccctccttccctccctgctctagtagtccccagtgtctgtttttgccatctttatgtctatgagtatttgatgtttagctcctacttataagtgagagcatggagtatttggttttctgttcctgcattaattcgcttaggataatggcctccagctgcatccctgttgctacacaggatgcagtttcattcctttttatggctacatgatattccacagtgtgtatatactacatttcctcaatgcagtccaccactgatgggcacctaggttgattccatgtaaaagagcatattgttaggcttttctctgaattactgaatcagagtctttcaatgggttccatgaatatttcatattcattttagtaaacttgctcaagtgacttatgtatacagttataggtttgggaacctctggcctggggaagttgtctgcaacaccactgacaggtccctgtcctgccacagacatttctgctgtaactccatgcttgcattttttgggaaaaacaaagcaagacaaaacaaaactcattttgcaaaatgacacacaaaataaagaggcttctggaaaaagtagggctaggtgaagagaattcaaaacttacgaaactataaactgaacaccaacaagaataacaatgaacctaataaaaaactagcatagttatggctctaacaacatttattctcaacaacttagttaaatcgttgtacccttaaaccttaacactttttttttttgtttttcgagaccttggttcttgaggacattttcttctagcagaaatcagtattaacttctttatccatctctctcttttttttaaactgttatgtaccatcattatagcacttcttacaaaaatgaggagctgtctttgtaacttcatctgtgccatcagcttttccagatagtttaacataaaaggaagatgaagtggttctggaagcaagaaaaccagccaccacttgcagtaaggaaggcaggtctatgggcctattagctcatggaggtttttgtttgcttgtttgtttgtttttgagatggagtctcacacagtcgcctggtctggagtgcagtggctccatctgagctcacggcaacctctccctcccaggttcaagcgattctctagcctcagcctcctgagtagctgggattacaggcacctgccaccacgcccggataattttttgtatttttagtagagacaagatttcagtatgttggccaggctggtctggaatgcctgacctcgtgatccacccgcctcagccttccaaagtgctgagatcacaggcatgagccaccgtgcccggccagatctttttaaataagatcttcatgtgttataatactaaggttgtctctttaatcacaaaaagccagtcctttattgcttcaaattgttcatgtgctgatatcatatgtctattgaggtctgacttactacattaacacacgctggcagaaccactgcagacattctctgtcctccttttttttttttgtcactaacatgataaaattcttaagggtttgaattctcagaggtactgtctgatggttaaatcacagaggtccactgcattgctgatagatttttttttcaccacagtgctgacaatacaattgttcaggaatggccttcatgaccataaggttggtttgacctaggttcttaattgtgatgtctctatagcttttaacttatttcaggatgatttcccccattgcaaatagataattgttcaatagatttgctgcagacttttggacctgatctatagttttcccttgggatatgtaagatatttgaggtacaccaaagtaatgcaagaaatatctttctttagagctagagtttagacaggaagtatgtcatagaactatggtgtgtccttcccaagtgagggatttcattagaccttgacttagaattgaatgtaatgttaatctgtaaaggcttgttgtgagggttttgcttaaatttttaggtttattaaatttttaggtttattaaaattcctaaatgatgatatttttatcagcaaagacaaaaatactgctacttaagtagtagtcactagaaaaataatttattttgttttgttaccttaactgtcagatttaagcacattcctaccaatatttgggtttgggctctgaaacccaaaacttttgaaagctttggaaaattttgtagaagttctttcttctgtcttttttttttttttttttttttggatactattgccactgggatgcaagcattcataaattatgtttaaatataaaaattaggtcggtaactctctgctcgtggattcctgaaacacaatgtacaaaaacccagaatagatcttcgtggctcactttagagcgtaacagcactgggaggtgatctgacttttcattttacacgcaagaaactgaggctggagagaaagaagggttgtctgggtcacaactgttgaggtcagcctctgggattgaacttcatttcctgaattcctcatggttttccacctccattcctcagcttctgtgatccctttggtatggggctgtttcttgaaccttgaataggagggtatggaggtgaagtgacatgtgagctaattcttttacctcactctggtttatctatttttatgtactaaggtcctgtgtattaattaatgagatgagttccacagttgctaatattagaaaatcaacacaattgatttctccttgggaactgtattagttttctattgctcctgtaacaaattaccacaaactttgaggcttaaagcaacatgagttcatgaatttattatcttagagttttaaatgttagaattctgtgaggagtgtcactgggctaaaattgaagtgttggcagggctgcaggaggctctaggagagaaatcattttcttgcctttttcggcttctagaggggcttcccttcctcttacttccaagccaacaacatgacatctctgagtattcctctttaactgcaccaagggaagataatctccttttaaagattcacaccgttagattgggtgaacctggataatatagtcagcccttcctatgcatgagttttgtagctgctgataaggaggtcatctgtaagcaacttgaacatctatggattttggtatctgcaggggatcctggagccaatcccccacagttagtgaggaatgaccatatagcataatttccccatgttagtatccttaatctcaaggtctcaatcatatctgtgaagtcccttttgctgtgtaaggtaacatattcacaggttctggggatcaggatttaggatctttgggagccattattctgcctgctacaggaatgaatttgtttccacttgtctcaactctaagtgggcagttatttaaaaactttgtattaatttagagagcttcataaaatgctaaaattttctgagaacctaagtgataatataagaagaatagctaccaacatttgttgagtgcttgcaatgtgacacacactgactgctatgtgctttaattgcaatatcttatctaatcattttagtagccctatgagataggttctatttcatttacattttagaaaatgtaaaatgaggcttagagaatttaaataatttgtccaaggtcaaacaactagcatatgggagactaagacttgaaattgggtttgtctgacccaggcttttaatcagcatattgcactgtttatatgtagctctgaagtggtaaaattgtaacatagtgtaatgcagtactgagaatataatatcttagtaatttttaataaataagtgttttagtaaggaaaataagttgttattaggaataaacactttctaaatgacatagtacccattgagcagtgttcaactgattaatattagttggttatatactgatttagtgatcagttctcaaagcctcaatttaaatagaaaaggagttatgtggaatttaagtggaaaggatatagctactttaacaattttttgtgctctcagattgtaaagaggaaggatttattttacaaataaattgcttgtgaaagaaatttaattggttaataaagtctctatctcttgccccctaaccagaatgtcaactccaggagaacaaggatcttggttttcatactcaattctatatgtccagtacttaaaacagtgagagcaatgtaactgatgcacaatgatatttgttgaatcaatgggtactgacaaattcctaagggaataaagccagttatctacatgaataaggcaggatctagatactagctgcatgccagaagaagaatatagagcgttctaatgtgtttggctaggaacagaccatatcatgggctaatatgatagagtaataaaggtagtgataaccctgataaattcaatatgtttttacataaatcctgtgcattaaactagtagctcacttgatatggagtgtttgaatcacagattgactttgctcattcgttcttccattcagtcaacattattgagcactgtgctagttattaggataaaagatgcattaaaagaataaagcccctaacttccaggagcctctgtctcctaagtgaaacaaacatgtgtaaagataaaataccttatattaaatggaataataatggttttatagaaacatggaagagggatacttaacttattattcaaaagagacacttattcgaaagacataaattgagtttagtcatcttgagttttagaagaaataatttttgatttatggagggattgcaaatataggacagagagttctcctataccctttattcagctcgtttaataatacatagctttgctatattgatcaaaactaagaaattaacattggtacaatactattagctaaactgcagaccttacttggattgaaccatcttacagccttttgtgctaaagggaaattgtgtatgaaagtgctttgtaaacagtaggctaaatagtggtagtctaagaagtgccatctggtgagcccagggtaggtcactgagggtgaaagttgcattctctgaagggagctttaaataatctaaccatgaactctattttattttattttattttattttgttttgttttatttatttttgagacagggtcttgctctgtcacccagactggagtgcagtggcatggtttcagttcactgaagcctaaacctcctgggctcaagtgctctgcccatctcagcctccggagtagctgggaccataggcacatgccaccacacctgggtaatttttgtattttttgtaaagatgatgttttaccatgttgcccaggctggtctcaaactcctgggctcaagtgatctgcctacctcagcctcccaaagggctgggattacaggcgtgagacacggcgcccagcctgagctctctatattttagtttcctttaataacatgatcagttccacccatgaatttaattaattccttatgagtttgctattaaaataaaatgagcggttattgatgcttattgtgtgtgtgacagtatcctattcaaagtatgggatacagttctttgattctctcactccatcctgtggaaggtaaacttaccttgcagatgaggatgaagttcacctaggtaatagatggacttggccaagccatgagactttaggtgggaaaactggaatcagaacctgagccaacctgacttcaaagcccaagttttctcctttgtgttgtctcctgagtcattttcctgtatagccccgctgaataagcattttccaaattatattttgtattgtgcaaaacttcacttccttttttattcaaagactatgtatttcatgcttcaaggttttctgagaactgcagtattctgcaaattctcaaaaaatgcttttgctctttctaagatttcatgactttaaagaacagttactttcttcctggccttcctggtgtcagtctgtatgattctataatgtttagtgtattcctttatattggctgccctttcctttgagcatttcggtaacttttcttgatagtttccagctactttttttttctttttgtctctcaagaatgaccaaaagtatatgtagtttttcagatatttgtcatgtaatttcgtgccatctagatttatataacctaacattttctggctttttcttagatatttatagatggtggtggttaaatcagagttaataatattaatttttaaaatatgcaaaatgcttttattgctctttttaattaggtttttacaactgtattgaaataggtgtggcaggtgctatttcccctcctttttctgctcaagatgattgagattcagagtaattttgtgactgcttcatcctgcagaccaaacaagtactttacctaagtttcctgtctccattctttttgatagggtctatcaagcttgtggcaaaagctcaagatgttatgtgtagagttcagtaatttaaattcatggacttataaactattaacaaagaatctaattaaccttctttctaagtaaaaacaaacaaaacaaaagatacttctagtagagtgccagtgtctttagggattcatggggaattaattaaattcatggttggtactgatcatgttattaaaggaaattaaaatctagagagctcatggttaaattgtttaaagctcccttcagataatgcaaatttcaccatcaatgccctaccctgggctcacccagaaggcatttcttagactaccactatttagcctactgtttacaaagtactttcatacatgatctcattgttcagcacgaaaaaagctgtacacaagttggtgcaatccaagtaaggtctccagtgtagctaatagtagggtaaggaaaacgatatgttgacatgctaagtgagcttcattttgacttctttcgtgtaacatgtttgagtctttgtgctgagaaaattgtattacattctgggagtcagtgggttgtgtcagaatgtgtgggaagcagctcactttcactttcaaaagattctttaaggaatttatgctttttgtaaaataggggagactatttggactctttcttattgggatttctttttgtgtgttttatgagaccaaagggcactgacttccatcatacggtttgactttggaggacagtacgggaaagtgcagcagccttgtagttatagtggccacagaatgtagtcacagaataatgtagcaccaggtttcttactgtcaacaatctgtttaatttgattttggttattttccacctcttcagcaaattcatgtcactgggaaccctaagataaggaatttgccttccctgatcttcctgtggggtagaagtaaaatgataagaattcaatcgttaggttgtccatggacctgcttaagagtgcaaggaggttttaaaggtccttagaaagtcaaatgtggaccctgctgaagaagggatgcagcgttgcttacttaaaactgtagtgaacagagaagagagaaatttaactttgatattgtaggcctcaacgagtaaagaaggctttcaatcctggcaggtactaaggttttagtatcattctctttaataagtcatctgtggacaaaaatgaaaaaatcagaaagccataattactaagaaaggagatctgactaaataacaaagaaacagattttagaagtcctgaaaggacacatttgtttcagaattagctctgctaaaatttttctttttcacagaaggaataagctttaaatggctatgtgaaaaatagattatagggaactaatgttcttagatcatgaatcagggactttgttcatttatatgcactgcttaaaagttttcacatagttatcattgtttaaaactaattataatcaattgctaactcatcttacctgggaatttatttagtttagaacatgtaagtaaatttctttaaataaaaaagagaattttagtggcatgaattaaatgtaattcaacttgagcaaagaagaaatggttataaagacaaatattaacatatcaaaatcatgttaatgtgctaactttacctaagcaataaacacatcagaacagaaaaaaacttgacaataagaaaataagtaaatatatttttaatttttagtaactagatgtttctcagtttttctgtttaacattttggaagtgaatatggctggtatgtataatgcataagaaaaaaatcctgttttatgacaatggaaaaaatcatatttataagcttatgtcatgtgaactttgctacacatcaattaggtaaaactgtactggatccattttaaccctgtgagttgattgctttcagtgaagcttgctggacatctttatgtccgagagtgagatgttcttataattaggggcagctgtggtgacagaatcaattaggcaggcctgctgaacacttaccttccagctgctggccgcggcgcagtgatttgctccagcattcattgtcacggtgtattgcctttacacctcgaaagaacaacattaatccattaagccacttttgttgctgtatcctcacgtgggggttatcacatcgcagtgaacacaggagtgagatacagcactgttcacccttgtggcatttggcatatgacagatagacagctgcatagttcaaaagaattattttaacaccaatcgcaagtattgccttgttttatttccccatcaattatccaagtagctcagaaaattcagcaattttgcatatctactgtatttctcagactgtcttttgcacgtggaataagtgcagaaataatgtcatgtggtgtatcccaggttttgtgaggaaaatatggaccctattgatagatcattaaataaaatctttagcacattgtctggtagttaagagccagggctctggagtcaaacttcctgggttcagatactgacttgatagtataccagccgtgtgactatagacaggttactttacctctctgtttctgtttcttcatctgtaagttggtgataatggcagtaatacatatctcctggagttatcataaaacttaaaaacgttaatgagcataaagctcttagaacaatgcctggcacatagtaggtactcaagtatcagctattattattcaaaggtgtttattgttgaaagtactatatatatatatatatatatatataatgtgtatatgtatacattacattctactatatatactatatataaatatactgtaaataaaaaggactttatttaacttcatctcataggctttggaaatacattatagttgttttaagatttttatctttagtccctaactgtgaagtacagggcaaggaactgtatagaaaagagagattgctaatttcaataaataactaatttcaattatcagggtgaaaaattatctcacctaataaacctgcattcattttcccttgtagaattttacagtattgtaaatttctcacagacaaatgtggagaggtgatttggtttacatagctcattataagaacaaaaaatttactgtagtggctatgaaatggagtgatctttcccagatttttaatctactgtccttctctccattttctgcctccacttcaaactttgtagaaaaactaggtatggtaaaaagtcctaggtttaagttttggttctgcaacttgttagacttacgacattaagttcccctatcagtttccatctcctcacctgtaaatggaaacaatcattaggtaccttacatgaaatacacaccagaactgttgcagatgaaaggagatttgaccaaatagtaattttgcggatatgtagtgacaacaaggcacattaacagttaagggagcaaaccagcatcttgtagaccatggtcaatcaatggagaagagcaactttgacttgagggcataggaggtatggtggctgacacttataatcccagcactttgggaggctagagcaagaggattccttgaagaggattgcttgaagtgtttgagaccagcctgggcaacatgaatctctgtatacaacaaaacaaaaagcccagcgtggtggtgtgtgcctgtgcctgtggtcccagctatgtgagaggctaaggcaggaggatcacttgagcttaagattctgaggctgcagtaagctgtgatcacataacaccactgcattctagcctgggtgacagagtgagactctgccgccaaaaaaaaaaaattaaagcagagaaggtaatgtgcttttcttgcaataatacaagaaccgtctgaccactctgggtagactctgaaattaggtgaaataaatgagctagcaaggaacatgaccagggtctcggctgaggcagggtccagtttgagagtcctccaacagtgatggccagataagagaaatacagaacatgaaaacttcaaagtaaagataatacgacttacttgacaattttccagttagatttacatgtcatttttgttagtgtctgatggcagagcggcataagagtcctagcccagtggcatgcagaacacaaacaatgtcacagggcctcacgattccaaataataaaaagtcatagagaagatagatggggcctctggaatcattttgtacctgggtttcttctttgtcagcatcttccagattcttcctcatcctttcagcagacacttgaagtcctactttgggttaggagagcctgagatcctgtatatcttccattcaataaattcagaaattttgatgtttaggtatagtatcaatccaaatggacacatacacagtcaggaaatagcctaaccctccaaatagagactgtgaccccctgctattaacttgctgacccttgtttgatttcgtagggataaattccttgaatggccctctgtttgtacatgtgggtttttttgttttgttttgttttgttttgttttgttttttgagacggactcttgccctgtcacccaggctggagtgcagtggtgtgcccactgcaatctctgcctccccagttcaaatgattctcgtgcctcggcctccctagtaactgggattacagatgtgtgccacaatgcttggctaatttttgtatttttagtagagatggcgtttcaccatgttggtcaggctggccttgaactcttgatctcaagtgatccatctgcctcggcctcccaaagagctgggattgcaggtatgagccaccagcgcccagccctctacatgttttttaagtgcagtcagttgagtatggttttcagatggagaatctgattaatcatcttcaatggccttagcataagcattctatttaactgagctgattgtggctcataccctcaaatcaaatatcttaaagaatcatactgtttcagtcatcgtgtagcagttaattgtgagaagtgaaacttggaggacatccgtatgtaaaatcccccaccaaaggaaaccaatatgtttgggaaatcaaaatgaagcactagtaagaagccaactctggctgtagtggcaccactgtgatgagtgttagcataaaatgctgaaatactgcccccaattttattcttttatgttgtataatgaaacgttctatgcatgttatgtgcttgcaaagaaattattcagtagttcatatacacatcgttggattacataaggagctggacatggaactgctagaatggaatttccagagtccagccatcttaaccctactttgaagcctattcccagtgtgtttgctggttggatttagtttgctgccagtggtaaagagagtcagcttgagaatatattataacaaaatactgaattttatggcaacttttatttcaaatgaaggtgccatcctccttcctcagtagtcagggacaaatagcagctccattccagctcacagggaaccctatttaacttgaatcaagaacattctgtctaagcctgattcagctagagcacagggcggggtgagcacaacatcaccacaggtggcaacaaataatgatcttgttgggcgattcgggatataacccaacatcacccactgcgtcagtagcagggcattaaaacctagctgcattccgaaataccattaccactagaatgtgctgccttttacacagctatatttacacatttgataagacaaactttcccttttatagccaaatttgtgagtgcagctcagaagagaagaccagatggaagagcacaaagtttatccactctgttgcaggactgtaatcaacttcgtgagatagtacaaggagagagaaatatgactgggggagttttggagactctccatagtaatttatctacttctaacatgactattaacaaaaggacatcctgcatagaggactgattaatggtattcgtgtggctttcattagctaacataattgtcagtcaccggttgtcactgtgggatctgcacatatgtgatggtgggctttttacacatttatgcagggaagacttagctgggatcatagctgaaagctcattgttacttgataacattttgcaggtttcctgtgtaatttgttcaatgtgttgaggctcttcagattagctgcacaaacgtggagagtaaagatatgagctagctttgcattgtcagatccttcagagaccagaaataacaacttacctagtgtcacatgccatcagcatatctctgcagcagacacatgctaaaatttgtttcctgttcttaacaatacagtacaatattcgatatagctgcacgaataatatttgaaaaataagggcacagtagatgatcaaaacaagaggattgcttagatgaatgaggttgtttttttggaaatttattttgcccttaccacaagtattttttcacccattaaattattagaataaatgaacatgttgcattgagtttttgtggtggtcagaatatgaaatataagtatttttggattacaaccacatttttcttccctaaattgtgtgacatagcaaataggaaaagcagaacacaaaagtagactttggaagtatactttgcatacctgcatgttttgagttagagtcagaggagtatatttgtgatcttttaagatatttgaaaacacttaaagcctgtaaagagaagtattcaaaagaagctcctgtgaaatgtgtggcattgctctgaaagcatttgcatgtctgttttaaaaggctgttctttgcactggactgtctgcctctgttgatgcatttctaaggatgtggatatgtttatattaatgtcaagcaagtttgaaatagatttaggcacagactgcttaaaacttgctctgttattaaattgtttcagggtgtggaactaccgcctctctagaaacacatagagagcaaaattatgaactgcggtagaccaaatacaattaaatcatgcttaagattctcggaacacctcctgcatttgaagcattaacttagccttgagcttgccttcaactaatttttaattaacagaccttttatgcttagataagactttcaagacaagtaaaaatttttttgcacttttaaaattcgagtacttacttaacaagaattgaccctaagtttaggaactaccattggccttataaagttattcctgggtattagaagatacttggtgaataggttttatttcagtgaaataaatgatattgtttcatgtgagtaaaccatatgcctgagaaacacgtgtacattgaaaatgaattctattaacagatagctatttatataatctctgacaaaaagaaaatttactctgttgaaaattgactcattatggatagatgaaaaaaagtcatacaaaccacatgggctcaaatattagtttgcacttttataagaatctgtgaaatattcagggctattccagtagtcctggaagacaaaaagtttgaaaaaatatccataaagacaaaaaaaggtttaaaatttttgccctgtgtccttgatacttgaatttgagctctgccctgagtgagcgagaacctttgtatggtccttgtctagaaggtaccactgacggcagaacatccataagtcaaggatgcaattgtgcagctctgttggtagtacacagatgtgtttcttcacttacgctatggaggattttgagttatcaacttaagagagctgttttctgaaaagctggatatcctcatgtcatagaagttaccccagaaggacgcagcagggacattattacacctggacttctagggatgcaaagttagagtagctgtgagcttttccacatctgatgattttggaactatgtgcaagagagagaaattcaggctggtcactagaggtatccttgaaccgcaaacatcgagaaatgttcatacatcagggtcagcttaagaggggatattttagctaagaaggaccttggatctgaaggtctctgcctcattgcattgtagatcatctcgtaaggcaaggaatgtaccactctgcatatggaccccaaaaggaaaggagaagtgttgacctgcccaatgagtgattggtttccttccatcaaaagaccatagtggggttggggccctgaagtcacgattgtgaggatgaaccatgagcatttcagtgcaataccgcttgcagaatttaaatgatttaaatgaatgtaatgttattattaattaaatttaacttataaattattaactcaaatatttacaagaatttctttcatgaatgcaaattaaccaagagtttaaaaatacttaatgacatgaacataaagaagaaacctccttgagagcggagggtgagaagaacgtgacgattgaaaaactgccagttgggtactatgcttattacttggacgatgaaatcatctgtgcagcaaacccctgcaacactcaatttacccatataaaaatctgcacatgtaccccctgcacctaatataaaagttaaaaagaaaaaaaagaaaaaagaacagactaatgcacacacgcacacacagacacacatacacacgtgcgtatttaatgaagcctaggtcttttatctaatggcagaaagatcagatgagaaaggcagaaaatcagagacagaccaaggctcccggtttttttttttttcctctgtatgtgttagcatgtatatgtgtaaatgtatttctgtttgctaaaccatctaaagtttagttgaagacatcatgacatttcacccctaaatgcttaagcagatattgtctaagaacaaggagattcctttgcgtaaccacaacgcagtgctcctgcttgagaaatttaactttgatacaatatttttattcagatttccccagtagtcccaataatatcctatacagctctttttcccttggagcaggatccaatcagtagctccacattagattgacttgccatgtctctttaatctcctttaatctagatcacatttacagtcttcttttgttattgatgacattgattttaaagcctacttcagttgttttatagaatatctctcattttgaatttgtcgtattgtttcctcatgtttgaaatcaaaacccctaatacagaaataaataaactaatgaagacagaaggtgaagaggaaggagagacgagctagagagagaaaagaaggaaagagaggggcaaactgattttatgataaaatgtttatcaaaggggaagaaaacaaagtctccatagatttatgctcagactatattgataagcaaatatatggagtggtaaggggggaaacatggtccttaaagagaaggtatctgaagtatagttgacactcagacaatgtaggcattaggggtgccaatcccctgtgtggccaaaaatttaagtataacttttgactccccccaaacctaactactaatagcagcctactgttgactggaagtcttatcgatcacacaaacagttgattaataaatatttttaacttatatgtattatatatggtattcttataatacagtaacataaagaaaatattacaaggaagagaaaatatatttattcatcaggtgaaagtggatcattataaaggtcttcatccttgtcatcttcatgttgagtaggctgaggaggaagaggaagaggcgggcattggtcttgctgtctcaggggcagcagagacagaagaaaattcatgtataaggcattttgcttagaggcaagggaataaaccttggaagttctggtgtgttcccaagttaaatgtaaaatccagaggggtgaagaattcaaactagttatttcagtttataataaattaatgaggcaatgtatttttttaatatgtgtaaaccagtttttggtgtcatgtagcaccggcagatttgtttctttaaaacccttcaccaggccattggctcacacctgtaatcccaacattctgggaggccaaggcaggcagattgtttgagcccaggatgtggagaccagcttgtctaacatggcgaaactctgtctctatgaaaaatacaacagttagccaggggtggtatcatgcacttctggttccagttactcaggaggctgaggtgggaggatcacttgagcccaataggtggaggttggagtgagccatgatcatgccactgcactccagcctgtgcaaccgagcaagatcctgtctaaataaataaataaataaatcccttcaccaggctcacaaaattaaaaatgatcttaaggagttaacagaaatatgtagacactatttcagataacatgagaatttagtctgttttaaaaaacctgcaaaacagagattcatgaaccacattttaaaaagacttctatgaaagctcttcagaaaaaaatattttcaaggtgtcaaaaaaaaaaaaaaaaaaaagaaccagacaaaatattcaggtatcaagggctaagaacagctaaaacatgttttctaatttgccagtggccagtgtgtcaactacattaaatggctgcttctccacctcatctcccagccaccaaataaataataaggggaatatgtagctgtaggggtactgctaagaaatcacagcattcaaatgatttttttctgaaatttattggaaacttcgtatgttcattcttgacatttttaggatttacttggcaagggcagaatcgtagaaaaacaaatagagttccctgagtaggaaaggtctccatttcctgttcatggttaggtgatcctgattactgtccttggagtcttgagccccttacccggtgaataattaggtacggaatcagggaggtatagactcatttgcctgggtttgttttctgggagtttctgtttaacattcctgaactggagcagaagtagattttgtagctggcttttctgagactcaggaaacagaattgtggaattctcaggttctgtgacatttgttgattattaaagtgaaattatgtgtgagaggaaaatttattcatctatgcttttaagaaatgtctatgataaacagaattagacatactatatagaattgcataacacaccaccacatgtccgtattacccagtttccacagttatcagcttcttggtaattgtttttcacctttatgcctatccatttcccaccaccatattattttgaagcaaatctcggatattgtaacattttatctgcaagtatttcggtacatatttttaagcagtcttgcttaaaataagaatggtatgtaggtgtttaatgtattctccaagctaatgcataatttaagtactcacagtctctgttgagactatttagatgcactaaatccaatcaaagagagaatttgttgtgagtagtggtcatctggaatggtccattcattgtgtatgggatagaaactctgtaggtccagtcaaagagtgatagcatcagagaatttctgtcttgaagaaaggagccattgttaagattgatgggttttctgtgttctttggtcccctctgatgacaggatagtgaaatgagccctagctccgagtacccacaaactttgtaaccatggataaagtcagccacttacttatctctgaaattaaacttcccgattttaaaaatggatgtgatgcttcctgcgcctattcacagtactgtgatacactgtgatttgggatgtgaacacgctttaaaaataatggcccggttacatattctcctttttattttttatttttttttaatttctttttgaaacagaatctcactctgtcacccaggctgaagtgcagtggtgggatcatggctcactgcagcattgacctcctgggctcaggtggtccttccccctcagcctcccaggtagccgggactacaggcacatgccaccatgccgagctaatttttgtattttcatagagatggagtttcaccatgttgcccaaactggactccaacttctgaggtcaagtgatcctcctgcctcagcctccgtaagttgggggattacaggcgtgaaccaccgtgcccagcctacatacgctcctttaacacaggcttttggttctttgaaattaccaacattcaggattcttaatggcatcagagaatataaagcttgaaactatctagaatttttttaaggaataattttctaatcttggttctctgcttctgagtatattttatttgggcattttatttttctccaagatgagatccattttcgctcatccattttgaaattgtttttctctctgttaataaaacctttggaatggtgccttgatcaggctaactccagattaaatgtttctctttgaaagattgcctggtgatcagagttgtttttcattctcttttcttcttttagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggtaagtataatgcataaaatagtagagactgcccccagcaataagataacatataaatgttatttagaccctaataagtgaatttactatcagaaacataatagataataagtgaaaagctgtttcattatataatgacaaaaaatcatgttatcacataggcaagaattcttgtggttcttacatcttattgatgaaggaaataaaggatggctggagaaagaactgtaggaagtaagaagagatggaagggaagaaggaagagagcattagtggtagatgctgtcatagtaatagatcctaaaattcaatttcttggccgggatggtggctcacaactgtaatcccagctctttgggaggccgaggagggcagatcacctgaagtcaggagttcgagaccagcctggccaacatggtgaaaccctgtctctactaaaaacacaaaaagtagctgggagtggtgggcgcctgtaatcccagctacttggaggctgagtcaggagaatcacttgaacccgggaggtggaggttgcagtaagccaagagcacgccaccgcactccagcctgggcaacagagcgagactccatctcaaaaaaaaaaaaaatgcaatttctttaaaataagacaaatgcatatgataatttagagtaccagtgccttacacagttaaaatcacaacttcattgtaaagctcagtgaatacttagatttatggaaagaattggaatgtaaccagttgaattcagactattttttaacaaggggttaatgatataattttatctaataagaatttttaactgacactgctgataaagcacatcatcattctagcagattttaaaattaggtaatcttaggtagcaagaattttacatgttcctaccctccccgaggaggtccatatttgacagggcttcatgtgattcctgtaacatcttggtggatgcattctgtatctactctaaaatgatactctgttatcatccctacactcttcattcttatttacttccttacttaagaatcatttcttctaatatcaaactacattttgaaatcagagaagagataagtggattagatttttgcttctaaagagtcctttaatcaacgtgacatgtataatagtggttccaaactcaaagatgatattttctgcactcacatctcacagggttccagtgaacccccaagtatggtaacagaagcaacagaacaatctcctatactttgattttataggacattaaccagaaagttgttacacattcatgagcaaagtgattacaatgagaattaaatttaatcttatcaaagattttgctctgatgactgtattttcttttctagtttctgtggttttattagctacatactttattaactacacgttgactctagttattgatcatgtcagatagatctatagctttggaagtataataaagtgtaaaagaaagggttgtatcactttctgcagcaggtggtacttcaaagatacaaaatataatactgtaaagagacatggcatttttatacctaatattactaattttttttacattattccaatatgtagcagttcagcagcacatggcaactatcttattttgcagattaggaaattgagggtcaaaaaagtgttctgctttgcctcaagtcatataactagtaagagactcagtgagagctgagtttatcattgttatacccattaaaaatgtaatatactgagaatgaaattaagtttcttcctgtagatcatagtggtaattaatggttcaagttagatttgaaataggtctgactctaagtctcatgtttaacagcatatgtgcatgaggggaggaggaaatacaatgaatgaattgaaaagataagtatgattcttacaaagaagtttaacaggacaaaaaaatactcctagattttggatggaatggattttggtgtttgcttttcatcagacaagttagtaaggaatgaagttatctctacatgcagggtaatgtctcatttatttctacgtggctgtcaaaggataccagtaatatttaagtgcccatgaaaggttttatgctaggactgtggagaaattaaagaggtatagggcattacaatctctgtgcccaggggcgggggtcataagattgtacagagattatctagttcagtcttatatgaaacatgggaaattttggaagttatgtattgaaacactgttagagcaggggaggaggaagggagggaggagaatttcatctagaagaaagcatctcacattgcagatattcaatctgatgctacctggagagaagcaaatgaagttcggtagataagatgagaaaatgaatttttttaaaaaagtgaactgactagaatgaataggctttagaaaaggtacatgtatacttaaagaggtaatttgttacctggcttcaatgacatataaaagtatcattagtattcagaaaagcattttcatattggcttcataggtccagacagctaagagcactgtctacatattaataaaatcccattataccagaaagggcaatagttagaaattacttcttttaaacaatagtcttgctggaaagaattaaatggggaaaaatgtattgaagtgatgcaaccataaatcactcgcagcaaagcagttaacatatttgatctaaaaataagacatactttgtatagagtggacagctacttgagaagcgatcatcttatcagtttttagaattgggtattttgtcatttctaaaattgtgtctttttataaagaagagcattgtcagcttttttaagattaaaggttccaactgaatctcaatttaattaacatttgcaaggtgttctattatttcaatttatccagtaaatataagtagaaggaatataattattgttatacccatttaaaacattaatatcctgaaaatgaaggaagctgagtttcttcctgtagatcatagtggtaatgaattgttaaacttagatttgaaataggtctgactctaagtcttgtgttttttcaacagacatttgtgattatgctacataaagttagaagtcagaacatagggctctggcatgcttaggataatgtctttaattaaaagattcttatttttcagatgcatttatatattactattaatgatttttaattactaagatattcagactattagtgttttgcagttgttagttggttacttgacttaaactttttcttaggctatgatcaaccaagcagaggtgaagtttagtttgaggtgtaagatttttctgggattctctttaattaaatactttgactctttcccaatccttagtcttggcttctttttcacacttcttataatcagattatgcatagcagccaacatatccttttaatctcttggtgtttagtggcacaatttcacagcaatatgcaatttctattattttgtaaaatcttacccttgttttgcccacggtcctactaaaaactacattcctacgtgttctttgtatgatttttgaattcccattgagcctttgtttatttggctaacccatgtgtggggccaatgaaaagaaatggaaactaccctcatgttatatgtctgcttatgtctttgttcttgttttctttgattggtggatgattttgatcaagaaaactggttaaaaagcttggcgtgtgacagattcatatgtaaggactggcagattgacctcatttaaatacctgttctatcttagctttattaaagactggcttcctattatttgtatgtttcacacacttttggacaccattaattttgcctcagctcttacatattttaattttgtttaaaattggctgtcattggttacattggacaaatattacaattatttcctctatttttactggttgctttttttgactttataatggaaaaagtttatgtgcatttcttttctcatattagctgagcaactctggcagatcacttgaactttatatataatgaaatctcaatgttcttatgtagaaaatgagaatcctcagtggcattccatatggtttatgtgaggcacttggtacagtgactggttctgttgcttaagaagcctctcttttagccaagcacagtggtgtgtacctgcagtccctgctactgaggatctcttgagcgcaggagttcaagaccagcctgggaaacatagcaagaccccgtctctatacttaaaaaaaaatcataatttcctctttcacttctttgtccttttcacgatgatcagttttacactatctgaagcagtgttggacacacacacacacacacacacacacacaaacactgtctatataattccttaggggtcagggaaccaaaactgtataaacagaagagttcttccctatatgtgtttaagttgccttagcctgtaactatggtagaataatcgagttaaaataaaactaaactaaataatagctaatggaaccttgaattcaccttgtaagtgagcacacagtaaaaaacacagtgtgctttctgatattaaaaaaatgaaaaggaaattaatattcagaactttttatcttcaaatcacttcacattaatttatttttacactgtactgttttttcttattctaaaagtaatgcatgcttattatgaaaatccaaatatttcaggaatatagaatgtaattactataataatagctaacacttattgggaagttactatattgaaaaaattattttaaacactttacacgaattaactcatttaatatttttagaaaataaaaatccattgaaacaccaaccttcctccagatccctagaaaactcatcaattaaagagcaaaaagttaaatttatgactataagggaatcaagtagtctttccaagctaatttccttcttatagacagagtatggtatcttacagaaaagaaaaaaagaagactgttgtatccatacttatcaaagccccaaatctttttgcaatatataattttcaaggaagatttggctcattctacactcttactacattctgtccttactctaggacacaaggctggatgaatcccatagttaaatgtatcattagaattcagagggatgtttatgctccttgaggtcagtggttttccaatgatgtctctgtagagtcctaaatttctattgaattgcaaaaaggattaccagtcactctgacctggaacactttctgtgtgatatttttgaatatgaggttctgatttaagctttcattttaaaacaggattttgttgtaaaaaatagttgaaaccactgatctaatttaatctttctctgcacagagatattcttgtaggaatgtgcttggcaggtggctatccagacttgaatctttccaaagagaaaacctaactctttcacaagacaccctatacatttttgaatgctcagaaaagtgcttctatgtaatatcattcaaaacatgtttcctttttcctgtaagacttagttttcctgtaagacttagcaatcccaaataatttccttttccatatgcatcctggaaatatatttaaatagctactcatatttcattcatagttgtctgccagtgggacctctgtttctttaacataatcctctctagtgataagatttctaggccctattcaattctgatcaccctcttctaaagtcctttaattatgtttttttatcatcaaatatcattccaaagtatatccaaagtataattcagcattctagatatgatctagccgatgaggaatgtattggggcttttatccaagttgattgatgctctgctttaatattaatttggctaaagagtacataaggttttttttgttattctttcttcttaaaaatagttttaaaaatgggttaataataagcatgtggctaattagaaatccttatttctgcatatattgtagtcaagggatatctcctcttgtatttatgtcaccagttttcgtacgtgaatgtacttgtgatgcttatctcgatcaaattgaatcttagtcttggcccattgatgttctgtcttaggattcccaagggtgttctccatagaaaagattccatggccacatgtcatggctgccttagaaattcacagtacagatttgcaaaaattcactgagatgcattgttgtaaagagacctatttaactttttttaatgcaacatttattttagcatagaaccattttttttaaatctctctttcttttaaagcctaacatttgattgcattactaggaatagtattccaggaaacagtgccaaggcctattaggagaagtttgattttaagacttatccctttaagattatgttaactgtaaatatgattaccatgttttcttatagttccatctagttcaatagttaaaatgttaattgcattgggtcaagaaaggggtctttacatacaaacacgattgttcctagatttgtataaataggaaagaaaggttgttcttgagggtgttgtaataatcttggagttgtaaattcttgggatgttgttgtaatcttatctcagaatttggggacttaagaaaagctacagttttcttactttagaaatttactccttctgtggcattgaaaatcaagatactatgccccaccctgatattgttcataatttatctattattgctagtggtttcatggttatacatgaaaattcttccagcaaaccatgctaaatgttgggctggaaaatcttacagtgcttatccatttttttcctcactatttttcaaaggtacctgtcatgaaggaaacttgtcatatatgatcaaagtagatatatagctgataatccatttaaaaaatcatacggtatttgaacgctccaaaattcagccccaaaattaatacagcctgcattgggtgatattctaatattgttttatttcgataattttaaaagttgtcatattttattgttaagacatatctatttgcaaagatacttgtcatcaaaaggcccattttggcttatagggatatacttcagggaagctttcctatgaataatgtctctggttgatgtgtgaatattctttaaatggcccttggtggtctccccattcctagatagataaggctgttaaattacatccactttttgtcaactttgttccgtggaccattattttcagaaaacattaacagatatgccttgtgaatgaaaaggattccatggtcaaaggagtttgagagaaaataaataatatatcccttttcggggagtcagagtacaacagcatattcaagatgctgagaaatcctgtgagattaaagataatgaaaagcctgtctttatttcacctaatattttccaaatttatttgaatgtggaacacattgctttgttacctcatgtttacctgttgacatcgagtcccgactagcgcagttaacttttctttttctttttctttgaccaagtctcactctgtcacccaggctggagtgcaatggtgtggtctcggctcactgcaacctctgcctcccggattcaaatgattctcccgccttagtctcctgagcagctgagactacaggctcatgccacacacctggctaatttttgtatttttagtagcgacagggtttcactattttggccaggcttgtcttgaactcctgacctcgtgatctgtcttcctcggcctcccaaagtgctgggattacaggcgtgagccactgctcccagccgtgaagttaacttttcaacccctatgttggtttgaccaccactgcccctggtctggaccacctctgatggtctttgccctctcattatggcatttttctttcctcccaaccagccttagaaatattaggttctgctgagtacttaagcaaacatccagatattttattcattcattcacacatttattcaataatgtctgaagagaaagcatagcctgatgtatgctccacgagactagcaagaagttgacattatagctacactctccaaagtatatgtcctaggtcaagagatgagacatactgaaggaactctcatgagaggcgtactcagggctgtcagaatttagacacgtgagagcagctccagctacatgaccaggaggggcttggtgaagcagttggcacctgacatggccctggaaggtcagctgagattttgatgcataggaatgcaggacccccattgtaggaagaaaaaatgacacagacaaaagcacagaggtggaagatcagggggtctacatgtggaactttgggtggttcaatcggatagactggaggatactagtaggaattatatttggaacaattgatttttctcagttaacattaatgtgtgacaagaagaccagaaaattcaccagaaaactagcaaagtataacgtgggagatttgcaaccagaaggattactgttgtttcttcctcctttgttttctcccttgtcgttatccccttaagagcccaataaatcacagttaccaggctagagcatagaaggattgctattattttttggagataggggtctcaccctgctgcccagactggagtgcagtgactcttcaccagcatgatcatggcacactacagccttgaattcttgggcccaagtgattctctcatgtcagcctcccaagtagctgggattccaggggcatgccaccacaccaggctttagaataattctttagaaagaattcagtaaactctgagccaatccctgctgttctgagttcttatatcttggagactgcttaaattataggttatgtgcaacagtaaaacacagacacagcaaatcacaatgctgcccatgttaaaaaaaaaaagtgaatgttgatgtaatattcagagttttataaaactatgtgataatgttgcccaaatatttattccagtattaagaacctttcatgtggtactatgctcccagcaatgagaatcttaaggaaagaaaaattcccttccttttggaattgataaatcctcttaattcaaaattaacattattcttgatgttactctactgagaagaagagtgcacagtatttttaaaatctattctaaccttcagtaagtgtccttaacagacttgtaggaaatgattttatacatttttctcttcctaaaccctagtggctgatggcatttggatatagaaaagtaagaaaatttaccaattgggtttaaaaatctaaagtataacacagttattggtgatggtaagggagtaaaaagaaaaactacagaagaattcctttaaactactgatttaggtgataaaattgagatgaaatccatggtacaacttaaatgtgatgcatcttacttttactctaggtaaaatcatgaggtcagatcaatgtaacggaagttgtattttaacatatgtataaggtggggagaggcagtttgagaactctgaaagcatagaaaagtatgtatttatatttgttggatttctgtgatatatactgacaccactttggtcctgatcttataggaagtcagaacttcgcattaacaaagcatcactggctgattctggagagtatatgtgcaaagtgatcagcaaattaggaaatgacagtgcctctgccaatatcaccatcgtggaatcaaacggtaagagatacctacggtattctgttcctcaatctgtaacaagagtaatcaaaacatgtggtaagactcataatagactggtgtgttaaatctcattgtgaacaaattaaaaacagagaaagaaaaccagatgtttcaaggatcttgtatgtctttcataaatttctgtactctatgagattatatagacctgaaatatacatatattttttacaaaaggattttaataaggccatgaatggcagagataggttgggttgctaaaatataggggctatactatttttttaagttggtcagtgagggcagtcaagtctttggctctctgaacaacagaatacagtcatatatatatacaggatatatatacacaatatgtatatatgcacacagaatatatgcatattatgtattatatatgcgttatatatgtatatatgtttacgtatatataacatatgtattatatatgtattatgtatgtattatatatgtattatatatattacatatataatatgcatacatatataatatgcatatattctgtgtgtgtgcagaatacagtcctgactcaattctggcaattttattcccattacatctggcattaggtagtagaaagttaaaccattaattttttttaggcctattaattttgaaattaggaccgtcttagaggcaataaatttcctactaggaagaggcttcatcttcagctttgttcagaatagtaccaggcaatacttgttaaacaaatgaatgacttagaggtaagaaatacaatccacctctgacaacttctgtgttattccaggaaattaaaagaaccaccccgatggctttgtgttttgtaatagcctgatactccatgatttgatggaatcatctataggagctgatgatgatgatgacctagcaatgcttctttaaaccttttagaataatcaaatgctattttaaaacctttagtgcttatttatttatttattgaattatggcacttaactattgcctttacaaaatttgtcatctgttatataaccaagcctaattgcatcttcttggtaggagatgagaaagattctgcatttcaaaggcaagcgctcttaaagtgataaggtaaaaatgccaggtcagcacaggcagagttaaagtaattttaagggttaattctatgggaggctgatgtagtttttgtcacttgattcttctgtaacatactaagaaagtgagaagggagataaaaatcagaaacagggctgggaaaattcaggttaatgcctcatcctctctggacttctcaaggatctgctccatcacagagtaatcaaagtttatcactttcattttaaatgtctccctccatagagagtaaaggagagcagggaaaaggagtttccattaccattaggagtcctgtttattacagtttaaaatgtaaaagccatttaaaatttatatgagtaaatatagcatcactttattttttaaccagggcaggttaagcaataatagtttgctagtattactttaccccacgtagaattctataggatgctacctgaaacacacattaaaaaattaattttaatgggctgttttttactttctactataaccattgtttgaagctcgttctccttagtttgtcactggcttggttcagtgtgtttcctcatagttaatggtattcaattgtgatttttgacacttggatttgattcgtgtagctataccacaaagtcccaggaaaataaaattaaagctagtgtcatagtctcactgagtgtctacagaagtatcatattgattattccatggtttctgatttacaggattaagcaatgaattatttactactatattattcctggcaaaaacccatagaattccttttttattaatttgggggtactgaaagtttgataatatggctttttacatttcttacataggaaaaacagctaattcattttttccacattaattcactgaagtcttggtctagtgatcaaatttgaatatgtagtgttgaccaattatagggtagagagatgaaactcgaggtgtttttgataatgagtcttttttacctggcaagaataaagagaagttcatggaatattttaagtaaatccttcttaaacaaccaacaaaaattctttcagaaataggttcctatggacttatgtaattaaagcctctgaagaatgagaatgaagagtctcaattgcaatgcaagttggccttctttttattctcttcttggaatgttaggaatagatcatccttatccaaccccttcattgtattaaaaaagaataaaagacagcatagaaaacagacttattcaggatcacagagatatttaacagcaaaaggagatatgaacccaggttttttttgttttttttttttttgtttttttttttttttgcttcattcctaccacagtgcagttccatctgtatctgaaatgttttttgtgtgtgttttcttttttgttttttgagacagggtttcactctgtcacccaggctagggtgcagaggtgtgatcttggctcactgcaacctctgactcctggactgaagggatcctcccacctcagccccctgagtagccaggtgcatgccattacgcctggctaattaaaaaaaaaaaattttgtttgagatggagtgttgctatgttgcccactctggaactcctaggttcaactatgttgcccactgtggaactcctgagttcaagaagtctacccaccttgaactcccaaagtgctgggattacaggtgtgagccgctgcgcccagccttactctgtatctgactatatgcttgcaaatgtttaagtgagattcttttgcttataaagaacagaagctgaaggaatggtatgaggcctaaggagtgagggattctatggcgaagaactagaacttcattataactcagcctcgaggagatggaattgtatgctgagcatctctgcgaatttaagcaatgcgagtttgtggcttttctctctggtgtttctacctttaatatgcttctgatagttttaacaaaagttacctaccttctcacctctcctactttcagactccgcctctttataattccaaactttgacctgtttcttgcccccacgtggccatattcttcatggcaatttcaggcattctttcagctttaacctctactgtatgattgtttccttggttccccagtgaaattccgcagaccaagaatcctattagcaaagttgattgttgcatattcattaaaagacctagagaacttacaaattatctgctgtctggtcatacgtccactgctgcctcaactagggagggtggagccggaaacatagctgcccggaagctcctctcttcaaagtctgggggtggagcatgcagctcacctgggcctgtggcttggcaggcaccatgattgacaaggccagtttcctgtacattagaggagataccctttttgctctgcaccttagagtcctagttatagtgcatccagaaggaaaatatgtaatcatcttgatcccttatcctcttccactgctatctaagaatttgctatattctgttcaatgcttggttgtcaaagaagcctcagttgggttctgagctctccggggcttagatgcactgcctttgtattgtctcattcctgtctccctaggaatcagggcagacgttgcacagaaacactttttctgagagaaaaagggcactttctactgggtttataaattgccgcaccactgaaccatgtcttcctaaatagatatttaccgttgacttgggctgatagagagtagaattctcaagaatttccttccctccctccttccttccttccttccttccttccttccttccttccttccttccttccttccttccttccttcctttccctccctccctccctctgtctgtctctctctctctttccttttttttttttttttttaaatggtgtttcgctgtgtcacctaggctggagtgcagtggcaggatctcggccactgcactggattcaagcaattctcctcctggattcaagcaattctcctgcctcagcctcttgagtagctgggattctagacaccccccaccacaccccagctaatttttgtatttcttgtagacaaggtttcgccatgttggccatgctggtctctaactcctgacctcaaatgatctgcccactttgggctcccaaagtgcttggattacaggtgtgaaccatcacacccggtcaagaatttattgtttcattgtggattctagaaaaaaaaaaagttgttaaaataagaacatgctgtcaaactattacattatgtagaactccccttgagattttaatttatattttctatgaactatcagtcactttattaatttcattttttcaccttttctatgtatttccaagaagctcatggctatagtttcgagaatttctatacaggtttccttgatgaatgatccttgtaggttgctgcaatctaattatcctaattttttcctatgcagaggattccttgtgattcacttaaattctcacacagttactttttgtatgttccaacatgtttagaacatattttgatacaagattctaagagagatggggaggttgggggagacattcgttggaagctgtttactttctccccagatgaccttgctgtttggcatgatgtttaatctcattaaggaagctatagtaattattaaaataaaattagatcataaaagtcttctgcaatgaaactcattgtttagatctatctggattagtgactaaatataaacgaaatgattaaaaaattaggaaattccccttgaaacagtatatgcttgggtgtaacagtggccatacttatactgttttcaagcacttagaaaataatacagtcaagcattttgccaacctacattttagaaatgtaggtgttttctgtcttttccaatgcctttcaacccctactttattcagaattagagaaagtaatttatcctgtagtagacatatatcaacctatgcaatctgctaattacttctgggacaatgtaaagcttacaaagaccagttgggttttcatataacaaaggatctcataggcagtaattatgtgataacttatgagtgaattcctttcatgaattcgtatatgacagcagaaaaggccacatacatcatgtttacacaccctacacactatatgttcatttgtatttgtggtttatttggctcagtctgtatataggaaaccttgacttagcaattaattcttagctaacaagctttgtgaaaactcctgggctttagagtagggaagagaataatagactttactggtttccaaattaattaagtaatgctttcttttaaaagattaatataggaaaatatacaactaatcaatcatatcttctcctaagttttcttttttaatcagaagaaaaattatttgaatgagattcaagttcccacaggagcaattgggcttgtagcaaaaaaatagctgtttcatttgagatgagcagaaaaatattatttttataaaatttaattaaattatcaattgcagcttttaaaaatagactcatactggtaataggcttcgccttaccccctttcccaaattgataatgatgttagaaatttcacaatattgggaaacaacctgcagttatgttgaaaagcatgtaaaatatgttttataatttgtataacagtctacatgtatattgtattatgtaggatgcccaggaaggcaaatacatgagaacaatatgaaagcaatagggtagatttgtcttttcaatgtatggtatccatcctgtctacactgtttattaatttcaaaatttctcagttgccttagagtaagcattcattatgaacaggaagaattcaggtacttaaagatgttccttaagttatctttataactgctaataaataaatatgtccacttttaaatcttttaaagaaatcacttgatcaaaatttttgtatgtacagcagtgacatataagtttggtaaaaaagtcacataagtgaatgttggaatacacacagacacattttatgtatgtttgtatatactgtatacaatgtgcatatgtgtattttgctacataattatatttagtgtattatgatcatgatgaaattgcaaacatgttacattcataataattagaaaaattcctttctagaagatatctttgagaccatgcaactttttcctgagaccagaccccgtttattaagaaagaattcaaacattacaaatatactaatgttcattatgtttacttgcctgttcagcataagttgctcagctgtgttcagtttctgataattctaaaacctcattaatttgcactaatgaaggggctgtcctttataaattaacaaatgtaatatgccaaattactatgggaaaatatgttgcttaaataaacatcataaagattgcaggatttaatgcttttttaaaagtctgtaagtgtaatataaaattactttcaatttacttttaacaaaaggctgttttccaaatctataaattctacccatagcacacataaaaatgcttgctgagtggttttaattaaaaagattaactttcttactagcaagattctttttacaatgaagactcctttggtgtagaagtataggttaacttttgagcttgtatttcctccagggttaattcagaaagtttgtatttgaaaccataatcattaaagatattttaaggtctccaagataaatacctgattttaggaagaggagttattttaagttgtctctgtgtagatgcctctttgtagtaacctcctgttctggtatttttaggtaacattcaattaaaaaatgaaacattatggttaaccttccctctaatctgaggtattttttgctggagatagaaaagttctgatttttttttcttcttggaaggtcacagtggacagctactttgtttgtcaaaaataaatttgaaaagagtcttgatatccgaattgggattgggacttctgcccagctctagttgagcaccttgggtttacgacttcatctggttgtaatgtcattgatgaatcctgaaggacaagagaaggaagcatctctcttagtgtaggtcctttgtttggaaacatggcccttctagatatttctagagaaggacacacactttgtatctctaatatagtttctttgagattacattttctcaaagaagaacaatttcattttctgcagcccaaatcaagaaagcttgttggtgctgcttcagaaacagatatcttcatattaccaattcggaatatcctctttctcgcctgatgcttgagaaaatcctgagaaaatgatgtaccctcacatactaattcctttcagtgagccccatttttagtggatgtaagagccaacgtaggcaactttgatgtattgaaaccaagcttactccttgcatagtttgccctcctaatctgtgattagagaggatcatccacacttaatttgcagcagaaagacacatttggtcttactaaaggtttattgctaatcacttgttcttaaacattgctgctgagtctcacatgactttgtttccctttcaattccacaaaatcttttgtccctagagaagcttcagagtttgaagaaatattggcgcttaaattgattctgcttacctgctagactagtccaatcttggaaaccctaaatggccatatctgtatttaaagatgattatattagtaataaagttttctactccattattaacagaatattaatttaaacataaaattatatatgacctgcttaggattctcggttagatctcataatttttgtacagtagatagtatcgcagtagattcagcttatcttttgtcctggttagaaaatgtgaactaccattaagtcatttggcaagacttatgacacagtgaaacttgaatgatatacatcattgcatctctacatctttccaggcttcataaaactgtacctttccaaaagtgttagattctgccaaactgaagcccttttcagaactgaatatggaattagacagtgtaactacccattccatcataaaggcagtaagaaaacaagttgaaagtttgaataagactgtcacaatcctcatgaaaatgatgtatccagaagtatacaggttggattcatccttcatttctttgggtgggagctgcatacttactgcctgggtagctaatgtctatcatatgataagcacctgtcttcattctcactggcaattttaaatagaattcaatgccagaacttgatgtttttcaccaatcctaattagaaacatggcttacttttatttttgaacaaaaatgtacttgttcaaagatctgtaacttaaaaattcttactacagcttggcaatccgatagctttgactttcttagttcccctatttcgacttttcttcctgagaagcctactgcctctttgacataaattcttcctcactgacccaagtggaggcagtgaatgcttcctaattattttagcacagctgattttatgctctttgcataagaaaggagaactatcaatttggactgtctttctgcatttctcactctctgtatggttaaagcctggacttttctcactcccttgcaatacttccttcctttacacttaacttttagttccaaggcaggctgtggtacctgctcccggcctcctgtttatatatcataatgtcctatcacctttttttttcagagatcatcactggtatgccagcctcaactgaaggagcatatgtgtcttcaggtaaggaaaataagcctggcaaattttactaaccagaatgacaaccataactgctggctgctccttctactaatcagaaccccttctgcatccagacctctcagctgctcttgttttctgcttcaatatttttctcaaccttgttctgtctttttggattttacttaagggaggatggttcttgctgtgtcttcaaacttaggcctgagaaacatacatgagtgaaagaaatctatatctaggtgcaacttaatgacattaagcaagtaaaggagatatatctgagttacaagctcagtttttatgtctttccaggtgattctcttagctgccttctactctttcacccctcagagtgtattcctgggtaatttgtcaacatctgatccgtgacctttgggtttctaataatcagttgtggatcgctaaacttaacaaaacaaaacagaacagaacagaacaaaacaaaacaaaaagacttacagcctttaaaaatgctgttgtctttgttttggttggtttctcacttgcctgtagtatttgctgatagcacttatagtctgagcagatattagcaacttagaacccaactctagcaatgcatatataaccataattcattgatttcttcacaagctatgaatttaatctatcctctatgtatttcattttttaaactttttcttattctttgtaatgctataattaatagagccttagaacatttaaaaattaatctttatttggaagaaaatttttgaagacccaagattggaaattcatctcagaggtacaatggtaatttggttttgcatggtgccttttcttttacaaaaattcttaaatttcatttgataatcacaataaacttgtgaaacaagacatcatttttcctcattttacagatgagaaaactgaagtattagaaatgttaagtcatatacctcaggaagtagaagagaaggtatttcaagttcgatattctttttattactccacatttaatattttagcttcattgagtttttcattatggctggtaccttgttgaaactatagaatgacctataatcaacatgtctttttccatcttacctccatcatttcctcttcccttcaaagccattttttaaaaccataaaagctaaacatctctgtatcctagactactttagctatatttaggacatattcatatgtcattactaagatataagtgtatgtgtgttgcggaatggtatgatcctggagtctaagaggttgttactcttctgaggaaaggaaggaaggaaaaaagaggaaaagagagagaaaaaaagaaaaaaaatcacatattctaaatttcttcacctttcatttacacgtttctgtaatatagggacttcgttatctgactccagtaaatgccattaggaaaaaaagagcttttacatttatatggaacttatcttgggaaattgactataactattatttcttaatatgtgacttgaatcttgataactttctggctgttgactttcaatccttctttgatactaagacttctttatttcttactaatgaaaacccatccgttccatgcttttttcggcatgagtcatatttttcattctctctgtacttaatgactgttttttcttcttttatctttgctacctgagaaaatcttgctactagatatccccaactattgtatgatttatttaattagcatggtttgtttgatcctaatgtaattattctattgctctagcagactttgcatggacttttcagcactttctggtccggatgtttatgcagatccaagttgcctggaaatactctcaatcttgtttgtttatttatttggcatgcatgaaaattggctttcactctcttggaatccaggggctattctctttggtttcatgttttctcaaaatcaagaccacatctgaaagaaggaattttctttctcacctgtggtgtgtatctcctcagagtagtctctcttggaagttcagataatgcttggtgtgtgggatattcttacagatggattgactccattttcatcccttttaaaagtctttgggtctagactatggtaatattcctttgtggtctttgagtattgcattctgacttataaatgcttcagcttctctgttgcacggtgttctactactcttttactaggcgatacccaagcctggcaaatttctaatttatgagtccaagcagcatgactcaataaagcctcattccacttttatgttttatagagtctcccattagaatatcagtatccacagaaggagcaaatacttcttcatgtaagtatacttaaatattctattcactggtttttaacccaaggcactatctgctttggaaggtcatgttcacgtctatcttctgcccctattaagggtcagagtattgagtttggcaataggtggtatttgctgtttggagtagaaatggcctcctaatatgcttaaggacaactagacatcctgtcctcccaatatacataagaatattaaaatacaccacaaatgtatcagttttagggtaatctggtggctttgaatattgaaaaataattgcacaagttctgaggcctaattcctggcaagcagtagagcacattgtgtgtcttttcagcttctctggatgccttcagcaactgcctgaggcatgatacccagctgtttggagcttccgttccaaaacttcttcattctcatataaagttagctgtgatggagtaagaaaactatatatagatgcccttaattcaaatttgatagcaagtaactgattatgaaaatgtttgaaagcaagcccctaggcaagatctcagattagttttcgtctatttaatgtgaaatgggctttgtgcttgtggacttctataactgttagattgattggggttttgtgctatgtcgggggaacttaaaatattagcaaggactagtataaagagtttttgatacttataaattgagaatatcatcgtattaaattttgatactcaacaggggagtttatcaaaccttgaaaattaaacttataactacagtctttctcttccttatgttagctccttatttaaagcatttctcaatttgataagctcttcaataaatagatgttcctagttattctatttcgatctggggagtgtgttgaaggaacaatttccttttgctatcagcagggtaggaaaactcatgaaaagaaagtctgtccttttggcaatttaagttgttttgtcaatctgtttaaataaatcctgtttgatgttacagcctttccctccaggttggtgatactagaactgtaactatatggtataaaattatcttttattgtgtgaagtatggtgttttggctatattttaactacataaagcgtcatttaactggattgatggcaatagcctggtgagatcaaacaggaaatgaaatgctagaaagggccaaattagtttcctatgtgttccaagggctctcatcatatcctccaaaatgataatttctgccggggaatttgtgctatttgttttttaattctacttataaaaagattagtataattatatggattttatgtagctagcatccaggaatcacattgagctttttttttttaagtgtttattctgcagaagcaaatactaggtttttcttttttggcattttgtctggaaataatttctctcctgtgtgattcattgaataaagttattgaaactcttgtaattggaacccttcatgctatcatcaatgggaccatagatactatccttaagcatatctgagcagtttgagaatgtaaaaaaatacttttggttttcccaagctttggggaactgaaataaatctctcagtttatgtttctattcattgcattatcactgagagagaaataattatgaaatctgactccattccctaattctcagtagaattagtttttgatatttggcaatggtttaaaactaagaaaggaagctttgtgtaccatgatattaaaatatttcaatgtgccattttcacacatcagtcacccggggtcatggtaagttctcagtaaatatggttgaattgattcatgaacacatttttttgtggaacttaattttattaggagaatataaacaatgaatataataaactagtaacacgatatattagaaggtgctacgtagtccaaaaatgagaaacagtagaggaggggaggggataaggagagttgaaacttgtgatttttattaggttgatcaaggtaagtctcattaaattgttgatatttggacaaaaagtggaaagaagtgaagggttaactttgcaaacatctagggaaactggctgggcatggtcgctcatgcctataatcctagcattttgggaggccaaggcgggaagattgcttgagcccaagagtttgaggccagtctgggtaacattagtcagacctcagctctacagaaaattgaaaacttagctggacttggtggcatgcacttgtagtcccaccttcttgggaggctgaggtgggaggatcacttgaactcaggaggttgaggctgcagtgagctgtgattgtgccactgcactccagcctgggtgacagagggagactctgtttcaagaaaaacaatcaaacaaacaaacaaaaaaacatctggggaaactgtatttaggcaaagaacaggctgtacaaaggcccttagacaaaagcatggctcatgtgccgtgtaggggaccataaggagccctgtggggttggagtagaaggaacaaagggatgaaatatagaagatgagggccacagaccctggggtctgagcatgtagtgccttgtaggccattgtcaggacattggtatttaatggaatcactctggctcctgtgtgaagaatggctcactgggaggaagggtagaatccaggatcccagttaggtggcttttgctgagagcatagtggcctggcccaggctggtagcagtagaggtggcaaaaaagtcagtctgtaatagtttgaaagtcaagccagcaagattccctaaccaattcattgtgaggtgttagagaaagagaaaagccataggtaaaaccaaggctgcttttgtttttggtttttaacttttggtgttccatttgattttcttctttggctttttcattatacttcttcatattaactattgttttacttgtttttttataattacaatatgcatgttttactaatcctagtgtgttttttaaaattttagattcagcgggtacattggcaggtttattacattttttaatctcatgaaaatatgctcttcagtttgaaaatataaaccagtcgtggcaggaaccaggtccagtcttagttacaataatgaaaatagcatgaagcacacagtccatttcaaggcagccacacgcaggacttgcattgcagggaacgactgtgaggtacaaatatctccatttagtaaaggctgaaggtgaaccttgaagagtcagcaataacaataagccaaactcaaaaatgccaaatatataaaaaagtcaaaggcctcagaaaagtttgcctggtcaaaaataatcagcttcaaagaatagatttcttttcactttattttagccagcaaggagatgctagtaaatccctgtatttgaaaagcgaactctgcttttctaatgtgattgtgcctgtaccggctacattctttgaactaatgacattggtgttttctaaagtaaatgttgaaaagcctctctgaagtagtatggattcagcaaacattttatgtattaaacagttctctgcgatttgggggtcagtgtaagacaggggaggctttcagagcaaacagatataggcagaggagatggatctgacttcacagcccccaaagttcccttttttcctctttaactcatgttggattagaagaaaaaaaaaaaaaaaaaaagagcaggcatggtggctcatgcctgtaatcctagcactttgagaggccaaagagggaggatagcttgacaccaggagttcgagactagtctgggcaacacattgagacctcatctctataaaaaaataaagaaattagccaggcttggtggcagccctgaagtctcagctacttgggaggctgaggtgggaggatcacctgagcccgggagtttgaggctgtcctaagttatggttgaaccactgcactccagcctgggcaacagagcgagaacttgtctctcttaaaataaaaacaaacaaaaaaagaaagaaagaaaaagaaaaaaacaaaaagaagaaaatagaagtcactcacctacccttctacctacttaatatattataagcatttttctcatgtttttaaatagtaatcagaaatatattttataggtcactgtaacaataaagaaatcattcttgactggaggtttttaagggattttttcatttacaaacacattatcggttttgccccctttctgtttatttttcctaccacttgtaaatattagtgaaatatcaaagttcttagtccttccctttgtaagacaatttttactactcaatttttggaaattggaaacttccattgttcattcactagtttagagttgttaattatatttttaagttctttatactaatctaataaagatcaaaattataattttctttattttcttttgttttttgtaaatgaggcatctgtgactaaaaacttataaataattgcctaaatgagttttctattacatgtaagtgacaagttttaggagaagaacttgaaccttacaaaacagtcaataggactatcttgctgctccttttatagaatcagcagaagtaaagtgattgtttggaacaagccttaatgacttcttctggagatgccagctgctggtagccccattttgcagacaattctgttgaataccataaaaaattgttataccaaccactttgctgaattaagcaccatccattccaatttaatacataaatgaggaaaacaaaacggaaaatctaacaaatagtaataggaaagaaaatcaagataaatcccgggaaaacagttgaagtggtaatatctgtttcaaatatgaataacagcaagcatttattgaaggcttactgtgtgccaggtgttgtgctagatgttttacatggatgatgactcatggttatcatgaaaacttattacactgtacgttgaaactgatacatgttgtccaaagtcacacagcagcatttaaccccagataatgcagtggactgctatgtcacataacgttttgctgcctcaaagaaaaagcccttactattgaaagaaatgggattctgtgagtggattgaaaggtagcctttggcaccaagtttattgggagtatatgtggtggattcaagtaaatgacttgtctggggccagttgtacccaagtgatcttcatgttacacgtcaaagcatggcaggtgaatgaaatgggaagagcacaaatgctgagtggactcatgctcttaagtctaaatactaatgctgaggacaatcgcggtggctcatgcttgtaatcctagcactttgggaggccatagtgggaggattgcttgagcaaattgatcatttgagcccaggagattgaggtttcagtaagtcatgatctcactactacactccagcctgggcaacagagaccctgtctcaaaaataataaaagaaataaattctggtgctgctaattaccgtataattttaaacaaattatgtgacttccctgagactcagtttcatctctcctctcctctcctcttcttttctgttctgttcttttcttttcttcttttgacagggtttctctctgtcacccaggctggagtgcagtagtgcactcatggctcactgcagccttgacctcctgggctcaagccatcttccttcctcagcctccctagtagctgggactacatgcgtgtgccaccacacctgagtaatgttttttagagacagggtttcgccatgttccccacactgctattgaactcctgggctcaagtgattcacccatctcagcctaccaaagcgttggaattgcaggcataagccaccatgcctggccccgagattcagtttctaggtctgaagaatgctatttattttaaacatatattgggaagtctaatgtgagaaaatgcatgtatatcatttagcacaactttgctttaagatggtcccttcatgtatggaagagagctagtgtgtggaaaagtgacatggctctaaaaagagaataaaagtcagagagtctctacatcttacttcaacaacgttggaaaatgcccttattgttggagaaggaaacgagtttatgattttagcctaagtgatgatgctgacagttctttgccaggaaatcactatgtcttttcaaaatattatatattctcagctaaggcttcattttacaggaactaatccaggaagtcttctatgaaatctctgaatgaaatgaacaattcagtttttaatttggcacctaaaaaagctagctgaaggaaaagaatgtctttgcagagacatttctgtcataatgagatagaatggtttcacttgggaatagcacactaatatgtattgattagattggaccagatctgggtggtccattggtggaatttagacccatggctcttacattctaccctcagttgtaactgacttacctgcttttatggtagaaaaaaacttctgggagcttagctaaatgattcttagctggaaaaatgccatttcaatttcagatgtttattggtcataacatgtgaacctctcctgccactgttggagagctacttttaattgaatgcaaattgtgttttcagatttctataaacatggcatttttcatgggttggtggctctgcccactgtggagaatgacaaacaaattatcatgcatcatatagcaataaaataataattcaaaaagaaaattgccctactcatattacctcatctttttggttggctggagagttacttacagatttttaggatactagagtgacttggtgcaagagttggggctcgtatattatagccattcataggtgcaagcaagttactgccttcacaatcagttcttttattctgtatatgaatatatcttctttttcttttttaaacaatactgcttgcgagtataatttatttcttcacttctgcctttgccctttctaaagtcattcactgtctatcattgcattccaccagtggaggagagaatctaaaaagttttgattaagctttgacctttcgtactggttgaaattaacgctttacagaattattcttttggaccataaaatatgtgtgtgcatgtgtgtgtatgtgtatgagatatagatatagatatagatatagatcattgatacttgcatcatactttacattttataaggcatattttcttattttgagtcatttatttatacaactcagtggcttagatttcatcccatggatgagggacttgacgttcagaaatctgtgacttgtcccaagtcaaagaacaaataggtagttctaaaaagaagagaaagtctactccttatctaaacagcacattttagggaagaatctgattggccctgattgcatcatgtctgaccctaaaatactgcatccagggagattaatgcctccagctgagtgggggctggggcacatatccactgctgtgtgtgttggggttagtgagggcagatgggctcagccccatgggaaccacatggtgtagaatcattacagagaggagagttctgtagcaaaagaagggaaaagtgagctagacaggaaaacaacaacacaatcattgacaactgataagcaaacaaccttagaaaaatcagaaaataggtattagtaacagaattttaaaggaaaattaaaaataggtgttgttgaaaattgtgtttcattgggcagacaaaactaagcaggatgagcaatctgaagaaaataataagctggaaaactgaatataattgcagtatcatttttttaaaagactcattagtacctatgagccattataattactcttaacagtgccctctttttaacccaggaaattctgcattttgaaagaaagtagaaaaacgtagacaaatgagttacagttttgaaattagaatgcatgggaagcattttgaaatctgtaaaatattctacctttgatgtcaaaagtcagagtacttgatatggatcctttaaaaaaaatccatgattgaggagattttgaaaaattcctagtttcttttaccagagtaattgtatgttgattagggtttgggtgttttttgttttcaatttggaaagaaaaagagcgtgcttagcccattccatataatattgtatagaaaactcaccaggtcttgttcaattgtgagataacactgattgaggttttatcagacttatagacatcaccatttaaacctaaacgaaataacaactccggtagttcatctgtgggcatcttccacttttctctgtcccactctgttataatgcacctcccatacaagctgtgaatacttaattcatttctttaataacttgctgtgtatacatagtttagctaatcatcaaaagtgttggaatgccacttttcattttatctcttagtctaccaaaggtcagcaaactctcaaaaaccaattaattgggtcactgtggcttatagcctagagctatgctcatctttattcaagtccataaccatctctgatttcaggtttggtgtttaggttgaatttatccatcaacgatgggctctttggtttgttctttgctgaggtattctagcactacctcttgagtgaataccaaactttaaagagctttttaagaaatgtcagaaggagagagcgagagagagaatgcctggctttgtgaaatgttgcagaaatttgtatttgtaattatcacaaatttaatcagtctttcctttaaatttttaaagcaattttggactattctcattatttcaatggtagggaaagtaacatatagatagggataggccaagtgacacttaaggtcaaatagcaagtgagtggtgaatgtaggtgaattaaaattggatggccctgtttttgctgtttgatccttagatcactgaaaactttccctctctttttttttttttcttttttcttttttttttttttcttgagacggagtctagctccgtcgtcaggctggagtgcagtggtgtgatctcggctcactgcaacctcggcctcccgggttcaagcgattcttttgcctcagcttcccaagtagctgggattacaggtgcgtgccaccacgcctggctaatttttgtattattagtagagatggggtttcaccatgttggccaggctggtcttgaactcctgacctcaagtgatctgcccaccttggcctcccaaagtgctgggattacaggtgttagccactgcgcttggccaaaactttccctctctttaatgaaaatgaatagataataaccaggtcctactatatttcagcatgaggctaggaaatgtgtatgcatatttcttgggaagtgggaggtgggaggtgtaatgattgggggagataaataggaaatagtccttgggctgaaggagttcgcagcaaagtaaaaagtttaattgtgattaattgtgcataatgacacgtaatcataatgggaagtaaaatatggcaagaggaagactttcaaattaagtttttttttttttttgtaatattccttaagatagaaaagccagccgggtgcggtggctcacacctgtaatcccagcactctgggaggcagaggcaggtggatcacaaggtcaggagatcgagaccatcctggctaacatggtgaaagcccatcgctactaaaaatacaaaaaattagctgggcatggtggcggttgcctgtagtcccagctactggggaggctgaggcaggagaatggcgtgaacctgggaggtggagtttgcagtgagccaaaatcgcgccactgccctccagcctgggcgacagagcaagactcatctcaaaaaagaaaaaaaaaaatagagaagccatttgtggttatgtaatttaaaagaaaattttggccaggtgtggtggctcatgcctgtaattccagcactttgggaggccaaggcgggcggatcacttgaagtcaggaatttgagaccagcctggccgacatggtgaaaccctgtctctactaaaaatacaaaaattagccaggcatggaggcacatgtctgtaatcccagccacttgggaggctgaggcaggagaattgcttgaacctgggagcggaggttgcagtgagctgagatcgcaccactgcactctggcctgggtgacagagcaacactctatctcaaaaaaataaaaataaaaaaggaaaagaaaatattattattattactatttttattattattattttactgttgtctgtctcctaaaatagcaaattgttgtttctacttcatatttataggtcattttactaagaaatcagaatcctgaaatttatctcattttaaaagatgatgacattctataatttaccgtcaagaataaaagattagtgatgattgaaggtgctggaaattaatttacactaaatagcattttgaaaatagtttggggaactttctgaaatataactagaaacttttagaaaaacatgactatagtatggtaagttgaatcattgttgatgagcagacacttatccttgatacagagatggatttgcaaaggctatgttacatatccgaggagatacttttgtttaggccatctggaaatgtgtgtatatgaaaaggttgcaattttatttttttaatagagaccaggtcttactatgttgcccagacaggtttcaaacttctgggctcaagtaatgctcccacctcagccccaaagtgctgggattatagacgtgagccaccatacccagcttgcaatttcctgaacttgttttattcattaagtaagactagttttgttttttaatttttattttttaaagacttgagttgatccaaagaagagagaagtggtaaattttaaaaaggatgcctagttataatcaaggaatccagtaaagtaaattaatctgttaaaattataaaacaaaaattttgcctgtatgatcattcctccctcaattttcttaaaattcatgtattaagagcagtgactaactgacaagaagcttctgtgccatttgataaagatttcaactacaaatgggaattaaggtatattaaaaaataaaattctgcatgacaaaatatttaaaatgttagtttttaatgttctacacaaatattgtcctacattttaacctagaaatctacgtattgaatcagcctataaaaatccatttctttcacaaataatgtagctttgagaacagatttttttcaataattctcagtctacaaagctatgaaaaggaagttgctgttgctgcattttttttaagctgtaaaatctaatatgccccagctctgatgaaatgtaccaggaggaacctgccttgtcaaacaggatatttttatgatgaaatgtgatacgaagaggcatagccttacatatatctgagagaaaattatttaagtggccataatagatttttcagaaattttgtacatttctcttatttgatccagatgcatttttttcctctgttgttctcataccagcttcttaatttcacctccctaatgttccacagcataaatacatctttgttcagagtttctccaagttatctgtgagaaaataaactatacaaagggtccctgggtatgttttaggatacatagattatgggggtgggagagttaccttgtgtgtgcaaatgagactgtatgtgaaacgaagataaggtttggagggaaatagatgattcaaagatacctaagaggtttattaagacctttaaaaatgattttacagtgcctgtaaagaggactgatatttaaactcattcagcttagtgaaaaaaatgaagaaaaatggaaagtaacatgcactacatgtgtacacacagaaacaagtataataaaactttctgccctttttttttttttttttgatatgaagtctcgctctgtcacccaggctggagtgcagtggcatgatctcggctcactgcaacctctgcctacccggttcaagcgattctcctgcctcagtctcctgagcagctgggattacaggtgtgcaccaccacacctggctaatattttgtatttttggtagacacagggttccaccatgttggccaggctggtctcaaactcctgacctcaagtgatccacccgccttggcctcccaaagggctggtattacaggcatgaaccaccacgcccagcccctgcttattttttaaggtttctagaacattggctgtgaacttttgggtaaatagtgcacataactcttctccttcctttttatttgaagtgcagacctgggtatattttattaaaataatggtctgaaattataaaaaatgttctttgtccaatcaaggagtaaaatcaaaccttgtattattttgtagttatactcagatgttagactatcttctagtccccagcagttcactctaggtggtcccatagctcttgcttgaaccacagtcttgccacttcttatccatagtgatgtgcacatcagttcccacaccagaatgtaaaatactagagggaagaattttggttgatttgtgtttctattcccataacttattactatgccagttcccagggagtatttattaaatggatgtcaatatcaacagtgagttaatgaatttttttgttggattatcattttttaagttgtacacatttacaatgaaaagaaaaccaccttcactttaaatcatgggcacagatatttaagtattttaaaatcaaagttttaaaaaactaacattggcttaaataatatttattagagaacttgtaacattttaagaagcattcacattctacctatgtatattttaaatttatttctgttttttacatctggaagatttttttcattttatcataaatacttgttttcatggtaatttataaaaatcagtttctcctttgataggattattacaaattatttcagaatctacttattaactggtcgctgttcctctctgtagtgctgaagaggcacttgcttgggaacaagagaagtgccgcaacagtgtcaataacatggatttttcatttattatctttaataataataatagatgacaataatatattttaataagcatctactatgtgtcagatgctttcttctgagaatggatattgttagtcccattatgtagatgtagagactgatactcaagacaattcaatatttgtcaagtagtggtagaagcaggatttaacctcagtctttctgactcttcatcctgtgttcttttcacccacagatggtagaggttgaaggctcagaagaacactttttgagctcagaaagctcttcttgtgacctctatgctactagtctaaagggcaaatgataattgcagctactttcagaaatggtcctttttccctaatgagatgaccaaatctgctttatgaacccagtttcctaagcaagatacagaaatagacacaccaatttagtatgataaaaggtgttaaaggtagaacaattttaggtaccaaattatatttatttgatacttggataatttaaaaataatgccacaaacttcatcccatctacctcccagtgcgcacacatttgggatgaagagataatgatgagaatgacattgtagataaaaggtatatgcattaaacatctgaaatgcttaggttattcaaagaaaagaataaacacaccatgtgatatgtagcctcagctacttcatgtttgaagttgatggtaacattcagatcagttttgagaagcagactgcaaccatagcttttagtttaagtttcagattgatatggaaggttatttgttttaacaatccctatgttaagttttcttttttctatgtttcaattgacttattttgtcagattttaggtttttttttttttttcaggcaagatggcattctcatccctgctgttgttaacatttaaagcatgcagcctcttgtgctgtggtgtaaattccaactgactgacgataattaaacagaaaatgaaacttgaatggcactatctcaaaatctacttaaagccacaacaggtatctgcctatagcaatatatcagttggaacacatgaagaataagaaattgtagcattttgtgtctgggtttatttttctttgaaatcaaagaagaaaaatactgatttttcctggatcactaaaacagtagtatggatttctaaacagggcagaccatacaaacacacaattaattatatctgaacttgaaatctcatactgtgcactttacctcttttataccagttgtaatttctcatttatgtacagatactgtagtaactttttttaaaaaaaagaatgtattattgtaattaaaaagcaaatactcaagaaagataagacacaaaggattaattgggattacaactcttctttctgtattgagtgcaaaagcttggtgatctcctgaattgtgcttcaacagtgacctcaaggctccttccaacccccaaggctctccttttttaacatttgttattacttagctattttatttggcagggatcccttctatctcatcttctaatgcactggcaatgatcctattgccaatagcttagagcctactgctgctggggtaagcgacacagccgaactttctagcctctgcatccttataaataatgcatctggtttcctgtaactacatgaactcttagactttagtaggcatttctttgttagtcagggtaaaagagttgggagatgaacagttgtggaaatagttataggcagttattatcactgattagaacctgagtccatgacatatgcattaatcactgggttaatgctaatggaatgcttatggtatttatagtagatataaataagatatagaaaaagaatatctttgctgaccaaactgcatgcttaattcaacatggaaagttctggtgaggttaatctaggacgctttgagactccgttgctcataattggacctgatttactactcatttaaaaaatctcttttaatttgcgcagaattcgctggctttttgggggtggacacacttgttcttaagaacaatagcaacaagatctttgtttaacataatatctaatgctccatgtaacttagtggtataacaaattattcaatttgtaatgaaaaaggtaaatgctgtgttaataagttaatagcaaagtaaataatgcatatttatacttttgacttcaaagtgtttataaacttatggcattaaaaagtaatgttttatttttgagcatcagagaaaatagtatttaaacaagagaaaccgatttttaaagtgaaaatcattttagcaacattttaaaataagccacgttaatataaaataagtgagttccatcgaagtatacactcttttcttcactagacgtgccttaattggacatgtcactggccaggcgtggtggctcacacctgtaatcccagcactttgggaggccaaggcgggcggatcacctgaggtcaggagttcgagaccagcctcaacatggagaaaccccgtctctactacaaatacaaaattagccgggcgtggtggtgcatgcctgtaatcccagctactcgggaggctgaggcaggagaattgcttgaacctgggaggcagaggttgcggtgagctgagatcacgccattgcactccagcctgggcaacaagagcaaaactccatctcaaaaaaaaaaaaaaaaaatggacatgtcacacagtgacaatgttcagtgttatgattctatcataaggataaaaaattcagattgatttagatgttgatgagaaacttgttgctctagagccttgtatattttcatcagaattaactgaaagaagggaaaattgtttctaatatgatacaggatgttcatcctgatcattttattattgatttctttagttaccatcagttcatctctgagcagctcattcatttagaaagatgatagcttgtaagtttaattctaaaactcattctcatccttgttagcatttgacatgccaatgattttgcagagctgggttgttatcaggactcatgtttagtcaaaatgtttaacacttatttctttgattcctgtagaatttccttattaattaacccagggtctataagcaacaaatttttaaatcagatatatatctatatgcatgtaattcatttttttctctttgatttttgactacttttttatgctgatattttagaatttctatgaaattaacacatttccttaacaattcaggaaatctgactaactgtactttaaaattgtgctttggtatcaccagtaaataagaaggcttcaattcatcaaaaagataataataaactgtattaatgctttcttttatttatttattttaatccatctaccaaaaacaatcaagacaacagctttaaaaaaatgcaatcattaaattactacgacagcctagtctgcttttgtggctgttttgttttgatggttaccgagaatggaaacagacagattatgtttttctgcttgtaattgtccagtacctccaaaggcctcttgcctgggcatgatcccttctggaattgaattctgcattcttcttctatcactaatcaaacaaaacactatcagaagaaaacatttccataactggatccggagtgaaggaaaatttcagatacttagacatgcatatacaataaacagtgtttcctgacaggctcattaaaaaagaatgactccactatgtgtcaactgcacaaatagaatccattataagactatggactcttacttctgaagtctgcctttgtgcccacctaagattaggaaaactaaatcttccactagaatttaaatatcacagaagcagaaacgattgcaatctctttccccagtgccttccttcctctttctctcagtcttgggtaggtcctggtacatatgaggcacttgcttaaaaaaataactgaaggaacgaatgaagttgcttaaggccgggagcagtagtctgtagatgagtcgactctcacctgtagtcccagtactttgggaggctgaggcaggaggatcgcttgaggccaggagttcgagactagcctgggcaacattgtgagatcccatctttacaaagaaattttaaaaattagccaggtgttgtgacatgtacctgtagtcccagccaattgggaggctgaaacagtaggatcacttgagcccaggagtttgaggctgagcaagatcttgtcttaaaaaaaaaaaaaaaaaaaggttgcataaagcagcagagacaggatcaacctagaatgtctgtggaaaaactttgaaaaagcatacattcttaaaaataaatgggaaatctgtggcagaggaaacagtaactactgacctgatcttcccttttcattttattttaatttctaatttgctgtaattgtatggtgctttcaaatactgattaaaactcttaaaaaaatgaaagagagaaatcacatttttctgctaaactgagtttgtggcatgccttcttccttcatcttgttgatgctcaaagaattatgcaacagagggccatcatactgtttagtatgttaaattattttgattcatgtacttactagcaacatcatttaaatggtttggtttcgtcatggccagacttaagacacatagcataattaagttgacaacctaatattccacattaaatcctggtgttggaaaaagctaaactgatcggagaaataaatctgtccaaagtagaaactgtaatatgtatgtgaacatgtatattctcatcatcactttttgttttcttcttttgttctctgttcctcctgttgagtcttgtgtaagtccaaataaaaattttattgtagagcccaacaacaaaaacaatgatctcttatgtaattgatgattttaaaaaatgctttgaaagtcttcttcccatactttgtatcagtataaagatattgtacagtggtacagaaaaaaatggcttttgaagttcagatggtttgaatctttgcttcaccacttactagctatgtaattgtgggttatctgtgcatctttttaaattctcactttttccatctgtaaaataagaacaatatcagttactttgcatactgattgtaaagattataaataagaactgatgtatatatattacttggcacaatgtctgacctgtttctgtttttcacagtcaggcttctcttccattttctaaggtgactcggaccttaccactctaaaaattcaaatcatgccttcactttctgcagattgcacttgttactttagaagaaaaggaaaactataagatggaaattattttaatgtcctcttaccaaatctacaaaccccagcacaatgcctgtcacagatacggtcatttagtaaacatcttttggatggataggtggatgggtagctaagtaaattaacatacagattaggtctttggaaatggtagctatttttattacaccctgtacagtgaccttaaaatttgaaatctactgcttttgaaaagcaggtcatcctgaggttttccattttgtacctgccagattgtgaaaagaagttcatttcaatgctgcacagcacatttcctgatcagttggctgaattacagtcatgccatttcattttgagttggacaattcaagcatttagccctgatttttttttttgacagtaagttagttatttttatactcattcaacacatttttcccccaccacaggttattgtaaaaccacctgtctctgggagcacagttaattctgtgcatgagatttctaaaaatgttttacattgtcattgcagttttttaaaaatgtagagatccctctgctattcttttgcattgccaaatgcttaggtaccttggaaaactgcttaattggttcttcttatctcactagattctttggccttaggttgtgaatgggtaacaatcatttaacttttgatgtgccctgaagtttccatccaaaacttttttctttgaatcttttttagggtgaaagagaagaatatgggggatctaggtgtacattgatactttttagatgcctttgatgtcagtcagtaaacagcagtagacatttggaagagcatgatagaagagacagggctaattccaggtatttaaccccaagttaaggagacttaacctgaggctgggttatttctctgatctctagggacagagtagtggcaaagccttaaggtggtaaaatttttgagaaacacttctaaagacttatgttttgttttagaatcctatctaaaagcatttcaaacaaattaagttaagccgttcctttcttactggatgtgttcgggcgcagggggtgggggcaaaaagaagcatatggttgaagctctgcactgcagtaatttgtaaaagaagtacttttcctgctaggttaaattgctctgcctgcctcttgctgtcagggacatgatttagttaaatacggatgcttttagaggggctttgtactgcatcatacatatttaatagtttataaaatatctgtgtgaatcactgggtggagaatccagcagcagagaagctcaaccttcacattggagcctctggccttagggtccactgaccagttgaccactggaaaaggtgtgttcagaatgggagcgtcctgaataacccaaggattctactgatttcaacagaataagcttagcatctaacctttcagattttttcagtaatgtgaactttacattttctcaagtcacattattcatagatgttctaattccccagggatcgaagtatagcattaaggaaaatcccttctcaataaaaaaatggtattgggtgaggggagggggacagaaaaagctcttagatgttctatagcaattaatggttgccatataaagatacctcattgtcattagataatggttaaaattatatgaatcttttacccttgatataattttgaaattcatcttaaaaatcaattccttaaaataaaagtagtaggggaaagaggtagtgatgggtggaggctgggggatgatgcagagaaggaaaaaaataagcaagtggaggttactaaatgtagcattggtggattattttgtttgtttggcataggtaatgagttttataataaaacttactatagtatatcaagataggctcctttcatatatgaacccagaaacaccatgaaaaattttttaaaaagttccagcattttattatgaaattttcaaacatagagaaaaggtgaattaatcattcagtaaacaaacttatgcccactaccaagattttacagttaatattttcctatatttgcttactgagtgtctacccatttatctatcaactttttatttttgatgaaatttcctgtatatatgagttcattttacccccaaatatcccagcatgcatagtatatatattttattacattgtttaagagaacatgtaggtcatggattatgctatcaaatagaatatatgtttctctcaaataagccaccatatttggaccgagggttttctagtcatcatatttcagagtataactcagacagtagcagccttcttgttcctgttccctaataattactccttcccctgtcccaggcttttaattctccaaattaaaagaggatgtaacctcggcttcctgattcccagatactgataatttttggtacagtttgtgtttgagctactgcagtaatgttcgggcgattcccattttggtgacagtcttctttcctgaggatacattgccttcctatcctctgtagtttctttattctatactttcctatgtaagcaataaagctaattgtaatgctcccacaattcaggtagcgtctaatctccagcctgttctcaggggaagttgttgggttctggagcacacattttgtgtgctcccttagtttgacaaaatgctgtttaataacagagtccaaatatgaatattagtctctgaatatctttcagaaagaggcccattaagtagagttgtgaccacaagtggtcgtgggagcattaaagagtaaactttcaagtagaaatggtccagggaaacagtcaaagtgaggtattggtacagacatcattcatggctctaggcgagagaaagtctaaactatctaatcaagtgtgtgtatctgagttggcagtatgcaactaaaagctttcctttgtagaaattaattaaaaagaaggagaaatagatgtgattcccagtcctgactttgaaattaatttctgtgtgactctaagcaggttttttgtttgtttgtttttacctcccaataactttttttcttcttgtataaaataaaattcatgtaatgggtgcagcaaactaacatggcacatgtatacctgtgtaacaaacctgcacgttgtgcacatgtaccctagaacttaaagtataataaaaaaattaaataaataaaattcatgggtaaggcctgttgcagctccaacattcagtcaataaaaaaaatttaaatctaattattattgagattacagttgacctttgcattaaacctaaattcttttactccaaataactactgaaatagaaagaaaagacacaagtctattttcttttttctcccagtgtcttagagatatggtctccttctgttgcctaggctggtctcggactcctggcctcaggcaatcctcctgcctcatcctccctagtagttgggatcacgggcaggagcgaccatgttggacagaaaagaaacaagtcattcttaaacaaatctgactctagcaacctattgtataatttatggtagaaacatttgagctggaggtcaaatcataagatatttttatcttataactttcaaattcatatcgttttaagtaataaaaattgtaacaattttctgtaaacagaaaaggtttccaccccttgagctgaaaagcagcaggaaaaggagattggcatttcattttaaatgggatacgtctgcttccatgagcatcataaaggttatgaccttacggtagtgttgcctgacaggtggctcactaagaatgccaaatcagttctggaaactgcatatacttttatttcttcttttttttttgttccctttggtgcaactttgtattttcattttgatcagcaacaaggagaaaaaaaatgtgtgtactctaaggaaaacgtatattgtaagacattttctctggctaaggtcttttcaggtttagaaatgtgaactggccaggcgtggtggctcatgcctataatcctagcactttgggaggccgaggtgggcggatcacctgaggtcaggagttggagaccagcctggccaacatggagaaacctcatctgtactaaaaatacaaaaattagccaggtgtggtggtgcatgcctgtaatcccagctacctaggaagccaagacaggagaatcactggaacctgggaggtggaggctgcagtgaggtgagatcgcgccactgcactccagcctaagcgacagagcaagattccatttcaaaataaataaataaatataaaagagaaaagaaatttgaaccatgtttaaaagtagaatacttcaggtaatccctttcctcaagctttctttattctgggaatgttgtgcaagtatattttatacatgggcttatgtgaagtttcagtctcttgaatagctggtactctcttatgagtaattcataactgccttcacatgtgtataatctcatgctcaactgtttctctctattttaagcaggagatttaaaaatcaaattaacacatatttctagagcatttgctataagtgatatgctgtgctatatactgactaactacatttctgggttgattgggggaccagtttatagaattggctgacaagcaactgaactttaaaacaaatagctagtgcttaagtataagtcaagttcaatcactcccatttttaaaactttgctgaatttatattaaaccgacattggttattcaaggtatttcttccttgtttttagctaaaacttctcttactgcattaaactacatccattatcattttcattaaataagattgcacattggatatgtacataaaagcaaaattatatcttgcatttttgttacatttgccagaagaatgaaaaacaaacaacagaaaatttctctgagctgtgctgctctatgccctgaacgtaactgtaatagtgaatattaatgagacacagcaaagatatttgctcaaggtagctaagccaatatgtattgctccagtaaatgttagaaatgaccattcatccacataacctcagattagtctgcataaagataatgtttcttttgttttttcttctttttgtcacacacacacacacacacacacacacacgcacgcacacacaccacacagtaatttaacattatttgcatttactcacactggtaaaacacacgtctcaaagatgtttcccatagtttattcatccctcttctatgtcgttttcatttggatgcatttgcttaacaatgtctgctgtgtgccaggcatgctctaggtactggggatatagcagtggacgcagacacaagtgcatggtcttatggagctgacattctggtattgagtttatcacgtttgataagaaaacacagataatacaggaagactgccatttgcccctcatccttggcacttatttccagtggagtccttcatcccaaagatctcagacccgcacacacacacacacacacacacacacacacacacacacacagaaactagtaaatggatatgtcattgagactctgaattcaaaaggcttctgagaacatgagcaaaggcttatctttctatcccattttatatactaaaatattatttttctgttcaactccatcctatttccctatttaaaatatacatatcggcaggcgtggtggctcacgactgtaataccagcactttgggaggctgtggtgggaggattgttgaggccaggagtttgaggctatggtgagttatgattgcaccattgcattctagcctgggtatgaaagtgagaccctgcctctacaaaataataataataatagttcaaaaataagttagccaggcatggtggcatgcacctgtagtctcagctacttgagaggctaaggtgggaggattgcttgagcccaggatatcaaggctgcagtgactaggattgcaccactgcactccagcctgggagagagagtgaaaccccgtctctaaatatatacatatatatatataaatatatttttatatatgtaaattaatatcaagttcagagttcatagttaataattgcctgagattcactgccatattgcctattgatactttctagaagaaagggtagccgacacataacaaagtctcatttttccttgagttgaaattcacacagcaaaattaaccatttgaaagtcaacaactcagttgcatttattgcactgttgtgcaaccaccccttccatctagttccaaaacctctccagtggaattttaaaagaaggacaacttgtaaaatgaccaataaactgtgtttgtagaaaattaatgattttacttatggagagtgagaaattaataggttctcccaaagtaaagcaaactcactgtaactatcgtatgcaattaaaatatctttccatatgaaattctcacatcctcatctttgagatcatttactgtatcttcagttacagaggatctaaactcataaagaacaaaatgtaccagagtaaattgctcatcgtgttacagaatgagaacacagagcacagtcaatatcaagtacttgatacagcatctcacaaagtaatgcttaaaattaagtcaaattgtctgctctgagaacattttcactgggtaagaataatcagtcttgactcacctttaaagtgggcagaaaagacatgcccaggaaggtaaaatgagtttcattcatctcacctattttgcatcataaataatgtacaagaacatcacacagcacatggatttggtttgctctcagagaacttttctatttagctggggagagaggaatgacaagaaaaaatagttaaatattagcatattccaaattttccctccactgataggatctgtggtagttgagtttcgctagatcaggctaaattaattcaaggcatactttggaacaatcagagaaaatttgataaggaagtatctgaataggccattaaaagacttgaaaaaatggagaggaggagtatagagggtattttagatagttggctatgaataaagcctgctgatttattagagaccccataatctgtgtaatgcaatcccaatccaaagtaaaaccaaacaaaatgtatgtattgaatggacagcccagctctaagtttgggacaatcaaatactgatagtctttgccttcaaataaattgcattcttcagccctgtatacacgatgtaattaaatgatgacacatgactgtgaacatgtaccccaataaatggtacagttaagaaatgctgggtctatgatttggaaaaatgggaagggcttcgtcaaggagctgagacctagctgagggcatgttttttggataggtggaagaagctgacagatccattggtgtactttatcctccagagaagctgcaagttttgaaagtcaacttcaggacatggagctttcttgtgaaaattatgatttcataattcctcagcaaataaataaataattgccatttgtatgtagggatctctccaaatgaaacgactgctgccatcatttttattttatgttagataccatgaagtaaattctactcttttgccagccgtaaaatttaggagcaagaataaactttttcagtgataatatttttagattttggagataatatttttagagttatattgccaagatacaggaaaaaagtcaaagagaaaataagtgagtaataaggtcaaaagcaaaatgtcatttatcattctctttcatctgttggagctaccgtacattcttctgatgataaagtaaataaaagtaaagcagaatgactagcttgaattcatagcctagcttgaattgatgtagctgaggaattctagtattttttatttgatgatattacaggatgtttttcttcattgaagccagcttagaaggaagctgaaatattatgaaagtggatcagaaatacaaatatattttactttattctgccaaatcccattctatattaccgtgtctcttcttgatccaggttggcatactagcatttacttccttatcctctgtggcagattaattgtggctgcaaattctttgccactttctccctcaagatttatttcttctgtccttgagtctgggctggcacggtgactgcttaaccaataggatgcagtggaaatagtttgttctgctttcaggcacagacttttaagagaactggcagcttgtgttttcttcttcttggggtgctttctctcacaacctggccaccatgctgtgggaagctcaagccacaaggagaggccacaggttggtgcaccatttcacagtgccggctggcatctagcagcagctgccggtcgtcatgtgggggagccatcttgaacgtttccacctagttgcacctcacctgcagcaccagctgacgtcaaatgaagcggaagaaccactcagctgaacccagtaaacctacagaataaaatggcggttgttgtaagctatttccaggtggtttgtttcacagcaatacataactgaaatcgcttcccaaggaaagtcctggaatgagaccatggaagagctcatttgatttaaatgataaatagacagtatttaaatggcctatgcttaattcttataatttctaaaaattattaggcaaaattgtagaagtcttattttggaaactagatccttttaagtttgtttacaaattatattaaggtaataattcctatttcattgttacatattctggttctcatagtctctccttgaagtggtatgtaatcaataatataatcaaatgcacccttttgatgaaataacaaaagcagtatttttcagcagaaataggatgaatcagaacgtactcaaatcttggccacatagctatgtgtccatggcaaaattacctaagctgcctgggccaatgaaataaaaaaaaaatttaagataaatatggactgtatgggattagtgaagatcagaaataatgtatattatgaacctagcagagtgcctgtcacctgggtggaactcaacaaaggtagcttttattattgtgagggagatggtgataaaaggttaggtagtaaaaaattgtgtagtttatttttctaagaggacatggaaatggggtgttcctgggctttactggggtggagcttaaagggttaaaatgatatatccttgcagtttttcctacaaacatgcatgttttatccaaaggaaattctgacctctaaccccattcacactttcctttcttactcttttattgctatagaggatttgatgaaggcagaaaggcaacttctgggtcctagtcccaagggtagaactaatggagaattcttttattcttcacctcccatccttctccatttccccatttacattctttttccaatttggcggaaaaaaagcaatgttataggaagctggctgtctgcagattagtcttagcaccaaggtggaatgacttttgggggaaaaacagacacatcccaaagtctggctcatgtagtccaagggaaagagtacttgtggcagtccataggattctctctctgatgtgttgtcctagtctttgtataaaatgttggttttctctgtaagtgttgggtattttcagtgtaacagctagagcaatgcccagtaacttttttttttttttctgctgaatatgtttgctcttaatggttgaggtaaggtgaataattgctcttggtgtaagttaaagaccacttttctaaactatgggttatcatgcttggtattttctcctatctgcctgacttgaggccacctgaaccccattttggtctttgaaatttagctgaccttggccttggatgaaatgctggtgtattgagtataatagttttggtttaggtcaaaattggggaattcagtgccgtatatttcaactgggtgctttttgaagaaatcataaattaccctagtttagcataaacacctgctgatattgtttctgaatatttacatgaatattgatcattgagatcttactatctttcaatttgaatgctttaaatgcttcaatagatgttttctacaccgtgaaattgtatgtcctttgctagaatctttgtaagagaggtctcactgctttgaagtcaaataaacctagaaaataagcataggaattatttttaaacaccatttactgtgcagattatagagagatgaactcaaggataactcatgttgctcataaacttgtcatagtcatggttacatttatgcaaattggcacaggcttttgttgttgttagttatagtactgcaaacacagtttaagatgttaagaccctttaaatcatgtataattatggactaatttcatcttgaaggaagaagtgataatattcttatctcctgccgtttaaagctgaaacatacctcaaagtagtggagattgtgccctacaaaatataatgtgcttaaagcggattttctcaggacttgaattctaaattttactgcttcagggactcatatgatggctatgtagtatagatttagagagagttttacagactcctattgacataagtgaacaaaatggttccttggaaaccgtttagatgtccaatcacagtaagtgtggattacaggttcagatgcatattgtgtgcagtgatgtgcagcacagtgcttggggaagcctgtggtctgtattaagaacagtgcatttcttctagtgttttaatgactgttgttttaaaagaaaaaaacagtcagcattgaaactactgaaaggtaaagctcctgaaacctaacccaaaaggcatgctctcatagaaaactcttcttagtactttcagtgcggtgatagctgaggacatgtggtatatattacagtgccagggaatccaaacctctgcagtgtggagtcaccatgaaaggctaatctaaaaatgaagtggtagctttgctcgcatcataactctgttacttactggtgcttcctattagcttgacattattagtcttctttgggtgagatagaataaatggaaattcaaaggggaccacagcaggggatatatgggctgccaacccctcccctagcactcccttcctccagcctgtactcagcatttctccctgggcatgacaaacaaagtcttacatagtcattgcaaaaagggctaaaggcagagctgtccatggttaggaaaaaaatgttcaaactgttggttgaaaatcaggtaataacagtcctcttagtgaacaaaacttattagagggctagggaaggaatgctatctctcagcagcaggcaggaagaaattgctgttgaaaagcttacctctctagggaggaatcagatagcagacttcaagcctcaggtccaacccataaggtcccacctacaccaccccccaccccatccccatcccagctttgttagattgctagcatcgatcgctggctttctctgacccaacagtgggtgaaggaaagagactgaaagctggcaaggtgggggtggaagaagactgggacagcttttgtagagaaagaaagaaaaaggaggaaaacgggtgggggccatggggactaggcttaactgatgcctgcctgcctctctttgatttgatggcctttattccttctaattggataaaataggaagtcactggcagtcctgtgtggctggggatactgattttactcagaccagcctgcagctctagagtgtgggtagagagcggggagtgggggttgggagagggggaggaaagagagagaggagagaggacgggcttggatgaagaagggaaagaaagagaaagagactgaagcagagaagagccgcagaggaagaaagtgaatgagcactcaagaaggacaaagaggagtagtcgggggtggggtggaggcagggcggggaagggagtgaccgcccctcctggctgcactcttgcctccggagccctctgatcctgtttgcagtgatgctccgagggcaggcacctgctgctctgtaatgattcagcccctttcagccgtcgtcgcgttaacacaacaggatgctgttgctattgtcactactgcctctcctgccgccgctgctgctgccgccgccgccaccgccgctggtcctccttctgcttttacttctcctgcatgacagttgttttcttcatctgagcagacaccagcttcagatgctcgaggtgagaaacatgcctttcagtttgggctactggtttacttaattaatcagccggcagctccgtcgatctattttcgtccctgtcctcttgacgagcccgggatggtttggagtagcatttaaaagaactagaaaagtggcccagaaacagcagcttaaagaattattacgatatactttgattttgtagttgctaggagcttttcttccccccttgcatctttctgaactcttcttgattttaataatggccttggacttggacgatttatcgatttccccctgtaagatgctgtatcatttggttgggggggcctctgcgtggtaatggaccgtgagagcggccaggccttcttctggaggtgagccgatggagatttattccccagacatgtctgaggtcgccgccgagaggtcctccagcccctccactcagctgagtgcagacccatctcttgatgggcttccggcagcagaagacatgccagagccccagactgaagatgggagaacccctggactcgtgggcctggccgtgccctgctgtgcgtgcctagaagctgagcgcctgagaggttgcctcaactcagagaaaatctgcattgtccccatcctggcttgcctggtcagcctctgcctctgcatcgccggcctcaagtgggtatttgtggacaagatctttgaatatgactctcctactcaccttgaccctggggggttaggccaggaccctattatttctctggacgcaactgctgcctcagctgtgtgggtgtcgtctgaggcatacacttcacctgtctctagggctcaatctgaaagtgaggttcaagttacagtgcaaggtgacaaggctgttgtctcctttgaaccatcagcggcaccgacaccgaagaatcgtatttttgccttttctttcttgccgtccactgcgccatccttcccttcacccacccggaaccctgaggtgagaacgcccaagtcagcaactcagccacaaacaacagaaactaatctccaaactgctcctaaactttgtaagtagagagagagagagagacgatgatgatgatgaataaaaggggtgggtttgaggtccccaaaggacatttccctttcttcttgcattttagttgcctggttttgtttaagcaaagcctatgtttgagatgcttgggatggcattgaagggccgagtaaaatgatcttgcaaactccggatctgaaccagtgttgtaacagcagctctctctagccacatggctcaatctggtaccgggaatgaaaaacttcagcatctgcaagtcatgcttgaatttaagttaaattcaatttatttctaacacattttaaaattaaaacatcacgccatctcttatgttttatagaaatgtgactttcatataccagtgagtattattttgtgtctttctcttccccatcatagatttcctgtcatctctctgttaccctctacctctcagcgaccccaagctgcctgttgtctctctctccttcccgttccctaaccacttctccctacttttgtatcttaattggttctttgagattacagcaagtcttaagacatttacggtgctagcctctcactagcttgagacgactgctgtcctgcccagatggcactttcagttagtgagcacttactagtggcagctttattttgtccaggacacagtaggattctgcatgaaggattttcccaaattagttttgtcttctataatcaaatgtttaaatagcttccttggcagttgttaaaaagtacaagatccattagtgaggtacatctttttttttttttttttttttgatgtatgtcatcttagtctggcagattgcagcggcccagtttaataacctgtgatgtgcagagagcccacgctcttaaaaacaatacattcctgtttgcattgcgtaattgcaatagctttagagtggaaagttgacaggaatgaaagcatgactgttctaaatatcaatatagaagggaggagttttctgtagccttttaaaaatgtttctagtttatttttgttgtctctatctcctatcactttttaccatgaggaatatttacttagtagaaaagtacaagatcagaaaatttggttcttaataacttgcatgaaagctcttagggttaaaagagagttgacaatttctctgacgaaatgcctcttgtttttcctctggacagtaatgaagaataaagaataccttttccagacatcatgttcagtgtgaagtagtgcagcatgctgtagaaacacagaaaaacttgatttgtgcttgtaactcccgatcatttcacgaacaccagattcagtggcaaagatttaaagaaaaaaaaagtcttgttttctaggtgcaattagggaaaacctccttcatgcagacgctgctttgtatctttatcaaatccctgaagcatcattaaaggtctgacagacatcactgcctttgctgcctcttcccacctggcaaagtgactgggaaataatacccagatgaaatgacaggctataaaaagcaagtacagatcctgcaaaaagaagcgaaattcaccaggaggacaaggttacttgatcattttaaacttgtctttaattgaaatctgcttgaacaggtttcattgtccagagaaagaaaaaaatgccctttgaaaaacacttcaactaaattctataattttgtcatctgaggaaatcaggaaaacaaagaaacatctaacacattttcctgatctaagaccatgtcagaaagtatgttgtgaagttttgataaattattttataaagtaaatttttctactaagtgttttagtagattacatattccttatcagtttttttttccccaagccagggcattgatattgtggcatctgcaataaatgggaaagatttactgctgcctaaaagcatcattgtggccagtttgaccagatgcacagctgcaacgttttgaagtgcatcggagataagcctagagaagcagtctgggaagtagttttctcctgaaaagttaggggtagacagttagttggttaagactttgaaacctataaggaaactctgttaattttttagactagttccttaaaaaaacatcaaatcttgtattgtaaaaattgtgagactactttttttgggggtggggagaggttgttgtggggagagtagtgtttgaaagggattggtccaggcagctttgtttttagagacttgtaagtggttgtttttgttgttgtttaaaaaggttgtaaccactaattaatggaaagcaaaaaaaaaaaaaaaaaaaaaaaaaagcttacaaagggattgtatttttcaactaagaaagtattgtttagtcacagaaagaactgggacgttccttttcccgtgcatgtttttgacataaactaagctgtcatggcttatatttgaaaatgacattatcatatgtgaaacatgctcttcagtggttttaggactttattctcccgtttccatttttttttctgtctcagcatattcagcacattatgcacagagctgtagccttcaaggtcatagactgttgaaggctaattgattcttctttatcctggagcctgagagagtagaagagagacaatcccagtaattgtgtctgcagcgttgctccccaaaccaatctacctactaatgttagagttttattttataaatactagaattactccctcactgactcttgtcaaattacaacattctttgtctttgttataataaaaggcaaaatatgacattttaaattgccttaaggtatagtggctatgtcgaattttctaaaatgggtatttctttcataaagtaatatttcatattttcatgatattaatctatgcattcatgtaggtcttaagaagtccaatgcagaattggaatgaaagtatataagtatatatttttattctaaagtatttctaaatatggttaatggtttcccactaccacaatgattatattgtcatgatactaattaagtttttacttctcaatgagtcacataatacttgcactattcatttgttttgtctgggctttaaaatttttcctaccctgactgttgggagattgcaaacttagattatcataaaaagagctgattaattaaattatagccaggaaacagtggtaccatcttgaaagaaaatgttttctggatatgagatcctccctgcttgacaacagattcttggatgcaagaatgtgttggtattttcatcttgggccaactttgttttgctttgtcctaagtcttattatgggattgtatgacaaaccattgttaccgcagtgacaataagaatcagtaaccatttgcaaaagatcaacatgatgagttggatataccataggatttctttccttctatttgaaagtgccgttcatttaaattctaatgcatccttcttctagttcttggtaactatgtttgtaggtatttcagaacagtgattttaaataacttctccccactttaatcatagccgattacagcctaaaatattaaaaactggaagagactgaaagatcttctattggaactgaataatttcataaatttaccaatgaagaaacccaggctcagaaatgcctattgaaattcttttattaaaatatactaaactctgaaaaatgtggcaaaatccaaagtattagaaaatgtctctgtctctgagaatttaaacacacacactctctctctctactgttttcttctatcatcgtatccttactgtagagagttggagctagagacgaatgtagcatcagactgagaattagggaagtactttaagtgggaccactgttcaggtgtgtgtttagtgcatatcactaaaattaaattttcttctcgccttcctgttttgctcttattaaattttcagtcgtggtggtcttttccctttttattagatcatccatactttgttcagcttgcttctgaaaacagcatgggttgcctagggtgagttcttccctcatatatagcagattgctctgtggctcacttcttttcttcataacccattttgttttctcctctctattcttttgtgatacccaactcagacttcttctcccctttccttcctaccttcccaattatgtattgactcttttttatttttgtaattatgtcattttggctttataggtcagtatttcattgcatcatatcaaaataatttcaactgtctttaatgaaactttattgcattttaatgctgaatggcactttcatatattacaaacatacaaaaaaaatctctagccaatgaccaatataccagtttcttaatgacataattaaatcaaatttttaccttcttcttgatcttttcctcttttttttctttagtgtgcttgattccagtttttctgtttttggacatcagcatttctgtactcccagaaaacgatgttccaaaccatacatctgtgttcttcctccttccctcttccttttaacaactcttcatagtatccttttaaagtatgaaggaagaggtattttatagattgaaaaaccaaagcataaaaagttatgacttgtttagatgcccctgagaaccaggaatataacttgtccacagagtccattgaacgttctactacagcataaactacattccgtctacttttatgctcatgtttctacttttattacttttgctctacatcaatgctttgtttttcttctattatttcctctttggtttttttttgtttgtttgtttgtttgtttgtttttcattcagtgaatgtacgctaagtgcctactctgtgccagactctgttctagaccggttatatgacagtggaaaacagtagagtgcctgccctcagggagcttatgttctagtggattttaagaatctaattgcataatgcaatttgagatatttcttgctttcttatacatataccctcttcattcagcatttcttcttctttactgtcatgttattcaccttttgacttccactcctgtcttttcttaatatgttttcttctccatctaccaaatactgaacacttgcccagcaatgtcctttaactgacagcaatcccacctctgctaccaacaggctgagtagccaggggtgattcaccatatggcactatctaatcaaaccattggagtagtgagaaaaatttgatctgtctggccctttaggagcaccctcttaagatgaaaaatatatacataattcttctagcatgtacataaagattctaagattattttcagattctagagagttggtagctgtaaatatttttgtttctatattttgctcatatttttatgtattgttttggcttgcataacatcaagagtattaaaatattcccaagggtttttcatttcactgtacggacaaagactagaatctgccattaagttgtttagttcttaaactgaataaagacatgagttcatatactattcacatgaagagtgattgactagcagtgagtgaagttaatcctcatcatctcaaagctgattgtaatctttactgcagtgaattttatcgtgtgtatgcgtgtgtgtgtgtgtgtgtgtgtagacattcaaagggtgtttctgaataatataactagtatcttataatcatagaattttatatgctgaacatttttagagattatttgtgtcacttcctaagtgagaaaaggcaggtctggaaaagtgaagtgacttgcccagtgtcactacaaccaatcagtagcagtgctgagactaaaactgaagtcatccttacctttgctacacttgcttttcttctcaaaactgtttttagcatttattcaagtagcatatgttacgttatcataatttaaaagatttggttttcccatttattatttaaatactaattagtaaaacttttatcaccctatagcagatgtcttctttagagaagagaattttggccaggtgcggtggcttacgcctgtaatcccagcattttgggaggccaaggtgggaggatcacctgaggtcaggagttccagaccagcctggccaacatggtgaaaccctgtgtctactaaaaatacaaaaattagccaggggtgggggttcatgcctataatcccagctactcgggaggctgaggaaggagaatcgcttcaacctgggaggcggaggttgcagtgagccgagatcgtgccactgcattccagccagggtgacagagtcagactctgcctcaaaaaaaaaataattttacctttataatattgatatgtataagacacccctccggaggctggacatctgtctcccaacaatataatatatgagaaaatgttttaatgatcaacgttatcccaactgaaatgcgttacatacttagaaagaaattagttccttagtgcttaaagtattcaagcagtgacactgttgagggagatttatgttcctagcagattattaactatatttacttctgaagtctcttacaactctggttctctcagtttattgtctcagggtgttagctttccagtgggtagacttgactttcaatcctacttgtccctcttcatggccttgagcaagttagaccatcatgttaaatctgtttcctcatttaaatgtgataataataataatatacatgtcttgaggctgttaggagattaaatgaggttttggaaaactccaagtcctaggcctgagacataaaaaatatgaaaccagcaccaattttgtccctcattctattttaactccctgcctcactttgttctttttctcctttgatcttgacagtggtttggtaacaatgcctggagaatacattttggggttttaggggaaccttatgaaaaactttgaaggaagtgaagagttgatgatacatcatgctaaagtaggaattatgctagaaactcgagatcaaataccagctctacctcttgcatgctgtgtgactttgaggaaatcacttcacttgagatttagttttacatccaaacaaatggggatgttaacatctaaaactctcaagagattgtgataaggacaaaagtggttactgtacctaaagaaaacagagcttaaaaatatattgaattccttctttgccctttctatcagggttcgtgtatgcatatattcacaagtgctaacatttctagaaataaattgtaggggttctttaccagtgaattaatttgttatgccttaaaatggtctgtaggactttactaatttcttgagcccagtgtcataaaaggagtattttttcccttatacaaattggttagaatacatagattattacctttgagttacatagattattactttttgagtaatgtccaaaaatcactgcatgaggggcttcattatagggaaagcgataaggagttacttttgagagaggaaaagactgcatggtatgtaaaattgtgtttgtcaagtaagtactgtttttggaaagattgggacaacggaaaacaatctatacagtttagatgtggtgcaggggaagaacttggctagaaataccatgaatcctaagattatgttcaccttactctttttattgttccaaactgggatttcctgatctcaaaagatgggaattaacgtctatgagttgttttcagcatttgacaaaaaccatggaaataatatacatcaaataattttatatgagccaaatcaaatgtagaaattctttgagtatactacatctatgtgtatctatgtgtgtatacatacatacatataattcatacatataatattctaaataaaggggaaaattatttgacaataaaatgagcagataaaaatatttttaaatttggacaaacaggttgtttattaataggtttgggaggggtggacaaaaaaacttctagccctatgcctaactgctagagtaaaagagaaaaaaaagtgttttaaaagtaaaaaataattggagcttaagtatatattggagattctgttgcaagtaacttaaaatgaaatcttactagctggattattggccagaatcctacaaaaagggaagaagccagtgctgttctagatatacacacttaagggattttggtatttttgttgtataccttatggtttttctaacagacagatataagtttgtaagagcttgccatttacaaaaatgtatagtagtgggcataatatatgtatttttatttattctttaaagtagaactagaaatatgtgagatcctttgttcatcttgattgttattcactcaagtataatacctttgctgcagaaattgaactctaaatcaatactggagcaatgaggcagccccttcgaagcataaaatatttgataacaatctagagtatgttttgcctgggtataagttttctgactgtacaatggaaataagctgatggacccaataaaacttggtgaaataaaatggaaagcttcctcaggtaaaatattttaaatttttcatcagaaacatgataggacaagacttgatttactgtgattttcagtgataggcacttagtgtttgagttgcatttcatgaggtggttgtctcccagccaaaggagaaattcatgaactctctttgaagccagagttagcacagaatttaatatgcatgtaattatcaaatgtaaaaatcttcataatttattttagtttaaaagttattaatttaaaattaaaccaaatgtacatatatgcatatgcatttggaagaaagatgagagcaacactgaagacaatgatagttgccattaggaagaaacttaattcataggcaagcagaagaccctatatcttccagttcctaactgtgttgcctgtattggtgtacaatgtaatataattttgtttcccccgtttaccttccttttccctccctttgtttctttcatacttgccattcacagttactcttctctttcctctattctttcataccccacctattccttcttctccagcgatctcagggcacatggctccacacttctctctcccaccctgctctgaagccagtgtcctaaagcatcagaggttatagagtagatggcccagacctgtggtttctcactggatggttagtgggagagagtgaatgagaccttaaccacagtcttgaccatgattagcctgatgactttcagtgttgcctcttcctttgctaagtaacaggaagtaattgttttatgaaatatgttggtgtcacagcaataaaagctccatacataaatggaatgatctaaggatagtagaattgaactcttgttagcatttgtttgtaatcccttggtagagcttcctgggtcataattgcttgctcttctgggagcaaaaggaatcagtaaccattgattgttacatgatgctaagtactgcctacaaagcaaatcttaagaatgattagtggcagagttcagggttactactctgatctctttttactataatctttaaagcaagctgaatttcacagtttttcccatcaagcaactcctatgattcttcaaaaggaagagaaaaaataatgtcatgtaatctataaaagcttcagttgacatcaaaaacaaacaaaaatatgtaaaataattacttcagtttttttaaatcttcctacttccacgataacagggagacatctaaattaacccctgaccagtaactttagtcttgcatgaatatgatccttataatcttaattgatctgaactatggaacctgtggtacacagtcaataacctacatagccgctgcctatttagtaaactatacatgtaatcagtgggatcaatacaaggattctcaaaatccttgcaaaattcattcttcaagattgctgagttttctgaatagctgatgatttgtcaccttgaaacttttttatctattttggattgaaatcttttaataacttacaatactagtgactactgtcattttaaatgggatttattgaatataggatcttcacaatgttgaatactgtgatgtctttaggacatagttgggttatgttataactttgttgacccctgttatttcgttaggacatactgagttgtattagggattctagctcttttactaaataacccagacctacgtatgttctgattgtattttgggttattacataatcaaaattagcattacagagctttaagccaccttagagacactttgaaccaaatctcttattttatcacagagagacaagcccaaagatgttaaccttcttgccagagaccacatagagccagaaaatgttgatattttcatctcttctaggctttcagctaccaggtcactttgcaaccagtgtatgttaattgaaacattttttctgcacttctgatgtatagttctggtctcctgcaggtttaaaaggcaaattttaatcaggttaaacatttgtattaaacatttatataaaggataaaatctctctgagtgagattctctccttgaggaaatgcatacattttggtgacatgttttggtgacatattttgcttatatgtcactcttgctctgttctggatcaacagagttcaaggatgagaggtgaatgacaaatgaagaggaagagtaactacttggttctgatggtccttggatttatagcgcagatttaggggagctgagtttaattcctagatgttttatttgttcacttgttcctcctttcataatatgtagaatggcagtaataaatcttttcttttcttttcttttttttttttttttgagacagagtcttgctctgttgcccaggctggagtacagtggcgtagccttggctcaccgcaacctccacctcctgggttaaaccattctcctgcctcattctcccgagtgctggggctacaggcatgcactatcatgcctggctaagtttttgttgttgtttttattagagacagggtttcaccatgttggccaggctggccttgaactcctgatctcaggtgatctgcccaccttggcctcccagtgtgctgggattatagccgtgacccaccgtggccagccagctataaatctttagaccttgatcatgcacctaattggaaattgttttttgaatgtatgagcactactaaattagtcagtgggcttcatgggatctgttttgaaatttattgtgaaaccttatgatttataaagcacaaattacttttattttcatttcttgaggacaccatagcaccaatatttacaaagcacgtatctcataaactctcttgtgatattgaagacacgcctgcagcagaaccccaaacttcctgtcttccctaactccagctgtctccccagtcttcatcccgatggaccatgttttagccaactagaactcgaccctgaatattattttttctcttccatgtttttgctcattctattttttctactataaatgtgctcttcaaacagtctctcctctcccaaattctacttaggcctcaagactcacctctccaaattagatgatgggacccctcttcttgaagacctcctccaaccccccataacctattgcttgtgctttatcacatttagatttgtgtgttcttatttggatgcttgcttattgctcatagtagactgaccatttcctaaggcccagagttatagctaactcatttttatgacctgtatagtaccaaacagtgtacaggttgagcatcccaaatatgaaaatttgaaatctgaaatgctccaaaaatccaaaactttttgagcatcaccatgatgttcaatggaaatgctcgttggaacattttagattttggattttcagtttggagatgctcagtggtaactataatgcaaacattccaaaatccaaaacacttctggccctaagccttttggataagggatactcaacctatattttatatgaagtaggtatctcattcgtatatttatggaataaaagttacactgagggtaacttgcttatgggagtggaagaggaagaaaataatctgaaaccgggtcttaaatcactgacattttaattttgaagaattcaatatagagtttagtcattacaaactttgttgagacatgcttttggacattttaacatataatttgcaaagtcggacgtgatttaaaaaattcacatcatggagtttaagagacttcaggcagcaaagaattttatttcatgatagtatggtgattaagagcacacactttggaaccagattgtctggctttaagtcccagccctgtctccggctgtgtgacagcatgcacactatgaactatctgtgccccgattttctcatctgtgaaatggtggcaataactatactttcctcaggggctttttgtgaggatcaaatgagttggtgttcataaagtgtttggaatagtctctggctcatagcgctatataagcatgagctgtcgttactaggcagttttaacaattaaagtgcatttccttagatttcaagtttgatagcttgtgattacaataacaggcttcaggaaagggccaggaattccaagggacctattgacacagctatggatgtgctactatttattttggtttggtttgttcatgtggtttttcctctgtgtgatttatgtgttaccatcatacctgcattgttctcaggatttaggagaacagaaaaggataatcatcaatctacctgtcagtcagaaatagagcgacatggatggtttgaataaaaatgctgccctctctggcaaaatgccatctgttgacattgacatggacaatcatatatgtgtatatctgaatttattgctgtaacttcttattctgtcataaaatggtggacaaattcacaaggagaaaagtaacttatcttagttgttgaagaactgttgcaaaggctttgaattctgcaatgctatcattttaccaagacagaaatctactcattatccagatgcactcaataaattaatgcgatgatgggtcctgtcattgataagataacagtgatttggaagtatctcagtgttattaaacaagatcacagaagagccattaacattttaaaaacagagagatcttgtagataacctaatcaaaatattttactttactcatggggaaactaagatccagaattgtgaaatgactgggtcttaaatacatgcagctagtaagaaacacgggctggtctaaaaaacaggaatgccacttcatttagggctttttttttttttcaatatcccatgctgcttcttataaattagataattctttaatggtggaagactttattttttctgttgttctatattctttattgagtgcctgctcaatagagaagagtttacctctaaaaggagaacaaacaaaagaataataaaccagaaatcatatactatcttagcaggcagtacatcatatggggaaaataagtgtgaggagatcagagtactggtggaggagcatagttattttaaatagattaaaaggtacaaacatacagtctgatagaagaaataacacctagtgtttgatagattagtagggtgaccatcgtttctaagagtctattgcatgtttcaaaacagttataagagaataatttgaatgtcctagcataaagaaaaaacaaatatttaagatgatgcatatcccagttatactgatttgatctttataaattatatggatgtattaaattatcacatgtacccccaaaagtgtgtacatctcttatgtatcaataagaaataaaatttcaaaaatacccttaagaaatacataaacagaatggtcaggaaaggcttctttgaaaaagtaacagctgatgaaaggcttgaatgaattaatggagttaaccatatggccatatggaagaatgttccagactctgggaaaaggccttactgcccaggcagaaggccagtgtagtcaacttaagccaatggcttaagtgtagcatgggaggcaggaggtattaaatgagatcagagaggtgatgaaggcctgatcagggaagcatgccattcattgtaagaatgatggcttttccaccgaaagagatgaggaattattgcagagttttgagtgaccatgggacttgatgccttaggttttaatgggatcactgcctgctgtgttgagaatagcttgtggagaaggatcccaagatcccggtggaaatagtcggaccactgaggagattgttgctgtaatccagatgtgtttgtaggagttgtaggagggaatgtaaagacattattggattattagattctgaatatattttgaagatagatttagaatgatgtaatgatgaattggatatgggatttgagtgagaggagtcaaggctgatttcagtctaagtagttgaaaggatacggttatcaccaactgagatggagatgatctaaagatcattttgctcagtctcccaatgcataggtgccaaataaatcaaggttcttatcaaaattagaactgtggacattaccttctcataaaaataaagcgagatatgcctgagagcctcctgtaaatcaatacggctttatgtgtgactagagatccttataaatacaaaagaaaagttgcagtgaaattgaggatgtctgcctagactactcggtaacactatccagaacccacaacacgtgatgatggaatgaagtcccagggggatgtagaataggcttccaacaaaccactttattcctattttatggtttctttttaattcatcttgttcagcattcaaacctggttcaagttgttcagtttatctaaagcatattgccccatccctctcagctcactttcagtcatcttttaaactttatttcagaagtctactcatcttagaaatgtgcactttatccctaaggtgagctaagtactttcctctctttcctctaggctttgacagtatccagtattttccacccgtttcccatgtactctgctgacatgcatgtattcctcaaggtcaagcatttcttttatccatgtacagatgcttcacatagcaccatgtatactataagctctaagactttgaagtacttgcatgtcccaggtagaggtttttctcctttctctattaagctgtcaattttctatatttatgatgaaaatacacagcaaaagtagtgtaaatgcttattttacttctcaaattactcgtcaagttgccaaggtgccaactattttttgttccacatattatatcttctctacttcactttctggaaagtaaaaagcagcaaaaaggaggttatcaagagaggagaagcaggaaaagttctagacagtctacttcatttttctcatattctagtactctagacagggtgaaggctcctgttgcagaagtgatggtcacatattcctgcaaataccaagtactcagttcagcccgtgcctgcagtctctttacatccctgtcctcctctgcttctcaaattttacctactatgcaaagtcttgatcaggttccactcttctttagagacatttcctatactctgtggtcatcattaaactttcctccttagtctctattccagcagctcgaatcatctttaatactcatgtgtgtatttaaacatccatcctaccacataggtgtttgattcagtcatgtgtgttttatattatgaattaggttttaagtctcatctttggttttatttacctcctcatacctagaaaaacagattaagcacttgttctctacaaggccctgggttcagagtagtagaattgagagagacagaaagagctagtttctgtcttccaggagcttggtttcatcaaagacataaaagccttgccattaactggagtataaggtagtatatgagatgtatgaagaaaaaatcctttagtttgaggtgaaaaaaaaaaaccaaaaaggaataaggctaagaaggaagagaatcagaggcatcttcatattgcatggatagttgaggtgggccttgagagtaacatatgattctgatgggtgtggttatttcaggtgggagtaaaggcccaagggaaacagacatgttaagtgcatggtgagtcggccagttgagtcagtatgaaggaatttgctgatagcgaacatttattaagcacgtattgtgtgttcagtgctttgcatgtattgtctaatcctcacacacacaaaaaaaacattgttcctttttggaaataaactgatggtgtagaaatgatgatgatgatgatgatgatgatgaagatggtgatgatagtgacaatctgaatggtgcagaaggaaatgggatgccatgcatgagtctaaggaagactatgaggaaggaataccactgaactaattgaatgcggagaaggaaggaaacgattccatgcacattagtaatttagcggttgttagattaatgaatctctgagtgacaacctcatacatttattcaacatgtatttattgggttctcctaagtctttatgtatttattaatgtgcaaaatcagtagatttatgacaggaagtgacttgtgctccaatttccagaaaacattcattacttcttcctgatgaagctgctcagttaaataatattaattgttcttcccctgatgttatacaaaaattaaaattgatagaatacagaacttaaaagacatttttactttactttttgacattattcattgtttgttgctgatgaatgaaacctcttttcgagtgtgtgttccctttaataggcactggtaatttatgtactaagatttatttctgtatggaaattacaagtgaaatttcatattgaatttatatttagcctgttctagtacatagtctctgcatagtatatccatggcatcctacttaatattacagattcttttatattagtgctgctacatgtgtattctcaagcttttaattgtacaattattacaaaaagaggtaaaaatatttcccctacaaaattgttgctgttaattttttcctgtttattcatggagtattcaaagaagagctgtgtgttcattacattccacaagttagtccattcagtttgttcaaaatatgaattctgatgtccagcagttaatataagattttggcaggctattaataatggcatactcaatttgtagctctttcatccatgtaattttggtgatgtatgcactatgttccagggaaaggaatagttcaagattaaagaggcaatcagtgtattggtgcttattttcagtgtgtcaaagctgctaaatgaaagggtgcaatttctacttgtacaatttccacttgtgctgctcaaaaacaagccattgatattagacgtgtatcaagcatacgtggttgcagatgtaaataattaacattaaaaacattttcttctttagttgtgtatttagaacagtgatacttagttaatatcaacagcttatttttagaatctgaattttaaaagtagtgaaaatacttctagtgattaaaacaatgtatgaaaagaaaaaaattagtaggctattttaatataattagtgagtatgctattttaacataattcaaagatgcattcctattttaattaaagctcattcagtatgcaagaattccagtttccattacttcttgctgctgctgtctgatcttgtgtttcttgagggacacttcttttatgagcaattcttttgcatttgcacccagattccttcacgtccaaagcagtagtttaaaagagaaggctacatttttccattttggcctggaacttagatttttgttctgcttacttcttctttaagtatagtgaatatataaacttgtaggcactcctttgcagacagacttcagaatcacatgttcagatgaatgtgggaatgtaggcagaaatcagaaacctgattgtgcttcaccgcttcagaccctgccctatgaggccctccttgtagaagaagaaatggaactgaaccaataactgaagtgaaaaacccttctggaaactgtatatatgaaaagattccatttagatccattgaattttgcctttcattttcaaacttgcaaatagaagcagcattttaatatttttcaagagggggaaaaaaaagagcgtggttccctggccctattgtatcacttccattttgtctggaactgatttcatgcaggagatgcactggaatcagcatgcaaattctatgtggctgttgttcagtctgtttttgattcatcgtggtaaaatatgcataccatgaaatttgctgtcttagccattgttaggcgtacagtttggtagtgtcagatgtgttcacattgttgtgagaaagagctccagactttgtcatcttgcaaacatgaaactctgtacccattgaacaacaactcctggttttccccaccctccagtccctggcaaccaccattctactttgtgtttctgtgaaacatcatataagtggaatcatgcgttatttgtctcatgtgactggcttatttcacttagcacagtgccctcaaagttcacgtgtattgcaacatgcatcagaatgtccttcatttttaagactgaataatattccattatatatacagtcatacgtcacttaatgacaaggatatgttctaagaaatacgtcattggaccatttcatcgctgtacgaacatcatagagtgacttaacacaagccttgatggtatagccaactacacacctaggctaatcgatagaatcttttgctcctaggctacaaactgtgcaagtatgttactgtactaagtagtataggcaattgtaacacaatcgtaagtatttatatatgtaaacatatctaaacagagaaaaggtacagtaaaaatacagtattataatcttatgggaccactgtcgtagatgcagtttcctgttgaccaaaatgtccttatatggcacgtgatggtatatgccatattttgtttatctcttcttgcatcagtgaacacttgggttacttccacctcttaaccggttaataatactgatatgaacatgggtataacattctaattatgttttgttcatctgtggtgggtgtgaaagttaaaccaatggaacctttttttagtgaatttagtcaaatttctgaaaaccaagaattcctatggaaacatactgataaacatacttttcttattatatattaaaaatgcttgtagggaaaacccagcttctaatagtactctgggtttgtgaagatgcagtaagtgcttgctagagagatgtttttaatctagagagctagagcagagacttagagttcacttgtttcttctctttttttcaatcatttataagatctctcatcttaactcattaaaactggctgattgactttgattactgacacacccaaactatttcaaaccagttagttcaaaaatgcagttgcctctttgaattatttataaaaaggatctcattacatttttccatagataacgatgatggcaaaggggaagaagggatcattatgccactcctttaaaatgcgggcttctggcctggcacggtgactcacacctgtaatctcagcactttgggaggccgaggcaagcggatcacctgagggcaggagttggagaccagcctggccaaaatggtggaaccccatctctgctaaagatacaaaaattagccaggtgtaatggtgggtgcctgtagtcccagctacttgagaggctgaggcaggagaatcacttgaacctgggaggtggaggttgtagtgagccgagatctcatgactgcactccagccagggcgacagagtgagactccatctcaaaaaaaaaaaaaagtgacatgctggttaaaggtccctgtccatatcccccttttgcaactatttaatccccagcaaagtcctagccaggatttcctggtaagagtttttctgctctgcgttgtcaacagactattttctccaactgagctcatggaagtaacctagtttctatcactagtgggtctcagtcagaaaaatatgagtgtaggttattgaagtgtcagggttgtggtggccctcttggctgtgtgcttactggggatgaagtacatggtggaatgaaggctcttactagggagacttctgagttactagtttcaccacacagctgtctcacccagtatcttggaactgtttcttgcttcatgtgtgtgaaaaatatagtaaatttcctggtcatattttagcataattaattataccaactattaatttaatattttgtttgatttttagtttccagggtaaaacattaattttctctttaatttccattctataagattcctattgttttcagcaaataggagtttccttctctgtaagcattgctgactcaagactatataatgttagaaatagaaaaaagataagaacatgttagtatcaatagcctttattattataatcggtatgggcctaacttctgctagcaacattaaaaatcttttcttttactctatcatttagtaacggattttcttttggttgtgtcgaatagaattgtttccttgatgttccttgatagagagtgttctctttaatataggaatacagtaaagaaagcatccacagtttgtgaggcagagtttagtgctgatgtgtacagaaactcaagtgatatttagacaactgagtccttactgggaatcacttaagccttaaaacatctctgccattatgctgcttattttacattgttctggatagatgctcattatccagttctcattcatgatgagcatgggattgataagggagctgacatgaaaattatggagaaaaaatgcaaatagcaaaagatagaataaagcatgtatacctcatgatcattttccccattgatattgatttggactcactcttgatgtatcaggtgtgttcaatctttggcaaacatttagggttttcgtttttgctgaggtccacttgaaccctggagcccaaaagaagtaaccaaaaatttctatagcttagtaaattccatgttctagaacttttaatgtggacctcagaaaaaggaaataaccaagagtgccgaaagctacatgtactttgaattgttcagcatgtataaaacccaatggctaaccgtgtctagaaagaaggagataagtaaagtaagattggagcctggcgtttggagttcagcaacttttctctgttgtgcgctgacatttaagttaatagagtgatttctggtggatttctttgaaacaagacagttcatctgagatttggttaaaaaatatttcattactttgaggaagtgattagggttggtcttatttagttggggctttcaaaattgatagttttgcctgatggtatatgctaaaacattgaattgtgagtttcctagccagactggaccctaagcccatcatttggaaatagtctttcttatttttgttattcttgtatttattaaagaacattggactagtgaaaattacaaaagaaaggaaaatgacacaatacactacattctgttgtatcccatttctatctcagggaattatgtgtgtttaccaaactgatgtctagatgaacattcaatttcgtatcttgccatttaaaatttaacatcatgtgcatttttatgtcattaaatgtccaaacacctggaatttttacgtttgatttgttattgctaaaaagtacttctcttgatttttaggggttttcacttttaattaaaacatattcttgaaactccttctcttctccttggctaaacctgttatgctacaggacttcaggataacttgagctgctttggctctttgattaagtgcagatgtatttagggtttgaggtgaaagggtttttaggacaaatcgcattccagtttgagggaaaaagagagagaggaagttttggaagttacaaattcattaaatttttgcttccacatggaatccacaacttttccttttccctggctgcctttctcttcttcattgagttttccaggcctctcttccttctgcacaggctccaaagagaatggctgactataagggttattagtgatattttgggagttattccgttcttatccactctcccaccaacacacacactctcacacctcctcccatcaaagcttgggatctctgggaacagggaaacatatcaagatattagaagacgtcaatgttatatatgcagaaatggtgaaaaatcaatgaatttagtaagttaaatttgtttgggtagcattttaaaaatatttaagtactttgacatatgttaccccctaatacacagagggtgctcagacagcatttgctacaggagtgaaccctggccaaagctgttttaaccaagggacagtggaggcccagagaggttcgttggtttgcttaaaatcacacatccatgggtaagcaaggtgatggataatcagctcaattgagtcagtttacattgtatacacataacaaagcatcatgttgtgccctgtaaatgtatagaattatgatttgtcagttaaaaataatattaataaagtaaataaaatcacacatctcacattgagaggagggcagcctagacccagatttctgttagccccaggaattgaggcatatatgggagactagcagacaacacacataggaaacttttgccacttaattattattctttttctcaagaccactatattcatttgggtttgttcttatgcttttttttttttttagcaaattaaaaaaaaattatccttgaatgattctaggttagctttttgactaatggatgttggaaggagctcagtgacaaaggccagggattattttgcttttcctcacctcttcctttgttcctcctcatcatattacaaccttctgcttcaggattccttctgctttttagcaggattgacatgctgggccttacccggaaaggcaaaggctgatttgattagggaggtctttgttccaggtatctcacatcagagagccttcataacaaatgagaggaatggattagaagtttcctggggataattttttgtctaccctttaagggaaatcttgccttcattaattacatctcaaatggaatatgtggaatatagacattttcataatcaacaaggtgattttcattttaaaatgcttaaaaaatgttaagcagcatgtatgcacgcacacacatgcaaccaatttcttccacctttttcttgttttaattcttaaaatatgaatttttaaatataaggaaaatcctaaaagcagaaactaataaatactaataaaatgttaattacattgattaaatcattagtattttaagatgggcccctgaaatgtctccataaataagcttaatgtgctttcatttaaacaacaattcagttagtaaattcaataaaaagcaaactaatgtgacataaacatatttatgtgattagaaaatcattatatccactttaagtgaaaagaaaaagtcttcatttttgtgttacttttccaaacctccttttggcactgaattgtactttatgggggtgtcttgtcatttttttctaaattaactacacctctgcttgcctggaaactagagccattctgacttctattccgatatgtgtttttcatctcctactttttttttttttgagacagtcttgctctgtcgcccaggctggagtgcagtggcacaatctcggctcactgcaacctccacctcccgggttccagcgattctcctgcctcagcctcccaagtagctgggactacaggcacgtgccaccacgccccactaatttttgtattttttaatagagatggggtttcaccatattggccaggctggtctcgaactcctgaccttgtgatccaccctccttggcctcccaaagtgctgggattacaggtgtgagccaccatgcctggccttcatcttctactttttttatttttaaatattttttattcactattgctgacatcactctcctacctactcggtattctttcattatgagaatctcccacatgaaaaatagtggcacctctggaactcccaaattctagtttagacagattaatccacatttatgttactatttataacagcacaactctgtaaataaatccaaatgtccatgatttattggttacatgttatgatattctgtagaatggatattattgtagccaaaaaattaatttacataggtacacagatgatgacatggtaagctttctttaattagaaaatgtttctttcatttaatatctttcatcttaagatcaaaaacaatcttgcaatattgaccttacagcactgttcttctgttatcctcattaaaataatatcaataacaatatagtaataatggccattgttgttgttatgttctctgaggcatttagctcagagaatgttgagaaaaaaacctgacaaagtacttaaatattcttgatgccatctctctcactcttcataggttgtggatataaagaactctgtttttttcattttttataagccacaaacaatgaagtaatcatttctttgttaaaacaagaatgtgcagattattctcactgaaaagttaaaattgagttgtatttaagaataagcatctagtcttgaccatagtgtttatgcctataattaaaacaaaccaaagccaaaaacatatctttcaaatggtttggtgtcacaccacaaagcgagttattttaaagccattggaggattctagcaactgagcaaataccgctgatctagtcaatatcaattgataatgtattatatgaaggaaagtaaaatctctttcaaaactttatacatgtttcaattcagttaattatgtaataatagaaatggcactatcatataagagggtagatgatataatttatagatcattttatcacttaaagcacctctaagtgtagaaatagaatcatagaacctcatattcaaaagcctttctgtttatctatagtggaatcgattaaatcatatttgtgtaataaatgacagtcataacaaatacagtaattaaaatacagttgttttacaaatcactgtcttccactctttccacttccagcattttcttttgatgggttagaagattaaatagcaagttgtaattttaagttatggctctttgacagtggaaaatggattaaaaaaacacacaacaacctactaagtcttgtagtttcttccatgtggtcttttcttatctagagatagtaagtcaggcatctacaggaaaagaatccactctagtgaattcgtgcctgcctttgaactgtgaaaatcctttgcattgccccacatttctaaagacccatgaattgtgcggtcagctagaaatatcctgtttcaaaattgagattacgtgacactgccctagaatgacacttgagctgaatgctcttgtccactgctgtagggtacacatgaaaccttttacttagaaatttaaggttcttcatgtggctggaaaaatgccacaacatgacttttatcaggctaaaatttactgtgtcatgacgaaaattgaataaagtaatcttgactcattttaatttatttcacctatgtctgactccagctttatcctaatatacaggacaaaagttatttccataggagcatctattatttgcctctatttctaaccctgtacaggtatgttagaaacactgaacataattttatatatgtctttgtctcatcaatacagtgcagttttattttttaactgaagaattcgtgttttgacatataaggggttaccagagctatccaattttattttatgaaacaaaattgtaattattcaaagtccaagacatgaacagaaaataaaaagtaatgtttaattcatgtaagaaagcataactgaagctcattagtcaaactaaaaagctcatgaaatttctcacctgaatctttcctcaccctgggcagagacttcctttcaatttgtgctcaattttaggcaacatttaaggatctgaataggcaaagagtgagagcaatgattgtaaatgtgttgttttaaaaggtttctccactaaattcgtatatgacaactgaaaaaaaccttgggacaatgtcattcagaccacaggaaagtgcttgaatatgttctctgatgctctttttagagcagctgatataaaaagcaaagaattttatgtccaaaagacttaggcaaaatatccgaacggaatgctgaatgcatggcttttcaatttatcacagtttatagacactttacatctatagtagtaatttaatttaatttcttagaattatggaaagaacaaatggtatcatttagtataaatggttctctgctcccctcacctccggagttttaaagatggtaaaactaggactcagagatgtgaagtggctcacccttgatcacacaaggagacagtgatatattttggttgagcccaagtctccttctgaatctagagctatagctgttaaactaaggtacttctcaatcatatccatggagcaaggatgtgagagtagttggcttttgtattatatgggataccactgcaaaaaagtaagcatgacagtttcaccttaggggtgaatttcatgctttgcaccagttcaatacaatgatgagagaatggctctcatggtactgaattggacactgtacaaattcatggtgttattcatattactggccataaaaagagcaagatcacatttatatatgttctggtgaaaattactctccagtgtttctgctgtcacctacccaaaccaagctgtatatttttttcttgagaattttgcatccatactgtttcttgtttggtttgcactgacgaagaacattcttcctccacagcacagatctagttatttgcaaaagatatttttaaaattataagcaaatgttgatttagactccttacacattaattaagagaagcacttttgtggatgttctttggcttagttcaagactttgtcaatctgacttttcattaagactttatttattattttccccaaaaagtacttgttgctcagatttgaataagagtagtttacttgtctacagataaaaacaccttggctgtattcaaagagtaaaatatttaattcaaattttaggctatctgaattttatcctttctgcttagaaatgataaacaaatatttattcttttattgagcaacagctatattccagaactgttttaaatgcttgagattggggaatagagataagtgatactagcttggtatgcacgtatatgggtgaccagggggattgttaggaagaggaagaaagagaactattacaaacacgcatttataaggcagcttttaatcatcaataaaatatggtaaaatatgttagtttattaattatttgattaaacacatacttttttgtatgtgaaatactcaagttaatttgtcttgtttatttggccttgcttgaatttactaagtaaacagaaatttctagccattctcaattcaaatgaccacaaattgagagaatcaggaacacttagatacttagccaacacttttcactaacttatttaggatatatgcctgagatcatgacaataataataatcatggtaaaagtagcaattattgttattttaatagtcataacagatgagtgttgccatggagtcagtatcacaacacagccaagtccatctgcctcattttgatgttttagtggccacctaactgataccgtctggtgacactcaggtcagtgactcccgctttttctaagggatggcctcagtggtttggggaaggtgccaaggaaagctaactggggacttgctcctgataagtcagtgatcatggaccacaacaggtggccatgaccccaggggggctttgcacacttggaaaggtggagttgtgcaacattttgctgtctggctgccaccttcagtggcagatctattgccacttgggttgtctttctcataattatgttccgtatttctcaatatgacagaagtttgttaacctagttttagttctaactctgccatttactgctcatgtgacccttggcaatctgtttaaattttagcattttcatgtttttcccacctataaaattaatatacttttctcaggttagctgtgaaggttaaatgagatgatatatgtgaataggattttgtaaactttaacaacggctgacacttactcaatattggctatggttttatcagataggcatggattgagttatgcagcttctctgttctcaccttgtccttggtgcctggggaatgtctagtattcgtagtcagtgcagtcatcccagttcctgcaacgtggtactgataggaggaacaacaatcaacatttaagttttgtctaacttgcctaagtttcttccatttacagtaagtgatgagaaatggggtataagtgtgagatttatgtcactattcaagtggggatggttaagtcaattaatattaagtaatattatttaaattaattattgtctccttgactctaatgtaggaatacattatataaaaagtaaagattttgtcatctcatcatccacagtgttttgcatgtgctaggttcttagaaaatacttttttaatgattggcttttgtgtttacctcaagagtatagagagagactgaaaaatatgtaaaattatgataatcctgaagtttaaggttcatgaatcaaattttcctcttcaaacaggtgaataattttgaaatttattagtaaatatttaagttgactctttcccaaatactgcctaacttcttttcttctataattaagtcagataattttaggaaattggacaatttagtcatctttctatagcatgtacactacagatgactattaaattatgattccttcagaatctttattttacaagaatataattaagcttggctcagtggctcatgcctgtaatcccagcactttgggaagctgagcggggtggatcacttgagctcaggagtttgagaccagcctgagcaacatggggagatcctgtctctacaaaatatacaaaaaattagccaggcatggtggcacattcctgtagtcccagctacttgggaggctgagataggagaatcacttgaacctgggagacgaggttgcactgagctgagatcatgccactgcactccagcctgggtgacagagccagaccctgtctcaaaaaaaaagaaaaaaattattcaatcatttatattttctggaattttttctaaaatttctcccagatactttaaaaatactcctgcaaacaatttccacttgcctagcaggccattcagaccacagaactaaaagcaaaatttatcagcctttccttccaatttgccatacccccacaaatcgcacttataaagtcaagagtaagcacatttctaacaaggaccaaaacttttttctcaccaatgacactttcctatatcaagtgtacctaatcaggcctatcattaagaaacacaacctttgctgtcctctgctatatcacatcatcttttcaattcagattctatttacaaaaatcctctaaactcattggtttttctacaatggtttttgatcacattatattactgacaaatgctatttttatctcctatatgggtgaatcatgcatattaactctttcctgggatgatggacataaaaaatctcctttagagatttaattacatttaaattattttcaagtcaagtagagtataaattcacattttacaacagcccatcatagaagtctcactggatttgttttctttccgctaatgtcccaggtcacctatctgaaataagctacttaaaaaggacagggtggggagatggcagagaactgtgctgcaggtttgggaagcaaagaaacaaataataatgtaaatgtcatctgtgatctaagattgctatcagtatcagatattttggcttttggtcctctagcctacctaacatagacttttttttttctattcaaaaaaatattacacttgtaggaaatgactagtgttgactttctcactctgagtccaattacgggttctttaaactgctcatcgctagtattatatgatggtcagctttaatgagtgctcagaagcactctcattatatacaaggcttttgaaataagctcctgtctcgatcaattgcttcaccttcttcagagcaattagcataagaataaaggaggttaaattggacttccgggctttggtgaaattaattaataccacttcaccggtaaggacaataagtagataaccattttcattactttatgtgaaagacagattatcacatgcacagcacccagactagtacaaaagtaacccatgctgaatgtgctatcttttaagtccatgtattatgaaagatttttttcctgtaattttaatagctcaaaaaaagttttaatttattggtgacgagctgggtaaaggttggccattacatactggcaactgcttgggtaggatgtaagttgaaaaatataagaaaaagaatggcattaaaaaaaaagtagcctgactgggtgctgtgcacttgtagttccagctactcactaggaggctgaggtgggaggatcgcttgagtccaggagttcgagtccagcctggaaaatatagcaagacatcaccccaaaataaaataaaaggaaaaaggaaatatctgtactcagatataataagctatctattctagacaaatgactgattagtattttcatgctcattcttgtacataaaaggtaaagtgtcctataaccatcatattttttggaattccagagcataatgccagcgatttaactgtatggatagtagttaaatccttaacaatatatagtacatgttcattttctaaatagtagttttaatgttataaatgaaatgcagcttttgcaaattgaaaatcatgataatagaagtctgtaccctccctttatggcccattaactatctttgcatcataatatagttatctttctcaaaaaaattaagcatttagctctctcaaagatgctgtcacttttttaccctaatacgtaacaaagttgaatggactcctttcctccactgttgtataaatttaatctacattacaagataccacactactattcaagatctatttgagtgtttaggcatttcttaccaaaataatctgatacctactttttaaagaagtcaactggtcatgtcagtgaaaatggcttaattttggcatatagttagtaaaggctaaattgcaagtccaatctatttttctgatcttatgtgttcacctgaaagcaaaataatgagttcagatattcttgcatggaaacatactcattgtgatcagaatgaaggaagttattgctaatgcacttacaaatatgtttatccctgcgagctaatgtgtctcaattcctgaaagtcattattaccttgctcctttctagtattttaaaagatgaaaaagtgataaatttcaaaataataaaacatcattatttttgacattgaggatgtcattttgtaaattaacctatgacatttttactttttggttaatccttcagatttactcttcattgcttttaactatgaattaaagtaatgagttgaattaggtaaatgtctaacataattaccatgtcctcagtaaaagatgattgttaatgtgtctgatgatggctggttgactagaaattatcttcagttccacattttcaaaatgaatgcaccgtgggtggaatggaaaataataatttaaggcacattaaccattaatatagatctagggtgaccaattgcccctgtttgcccaggacagggaactttgggttttaaaactgataccaaggggtacctgggatgctgaatgttcagtgctaaaaccaggaaagtccaggcaagtgctgagtggatcaggctacatagattactgcacaattaattatagtaaattgattctgtatgcaacttaaataaacccagtttattgaggcatgatccagtttgcccgtgtgagaacctgatttctgtgaacatggagatttagccataggtggctgaaggagagacataatatagatgatgatgttaatgatagcaatggtaaccatttattgatgacaggactggacttttttaagacttagccaaagataacattctctgaaatctttcttgatatccttaccctacccagaattttctgattcttcctttttactcccaatgtaacctgtgccgaagtttattataatgcccttaaacttccttatttgtttatttgtcttcctctgctagaatataagcttctttaggaggatagaggcattatgttatttatctttgtaccccaagcatccagtatatttagtgaatgaatgaatgacctaggtatttttttttactcttcaaagtaatacaataaaatacatgataccatcctgttttactgatgagaaacaagtatctaagatgttctgtaacaagcataagaatacgttaataaattatgaagccaaagatggaaaatcagatctgtctgattgcaaagccagttctctttccattactctgtattaaataatgctggccaaacatagtgacttggaggaccctctcctttcagtaagagagtaggaatcagatatacaaatgaagactatgtcagtcttattatggatactgatgaaagttttctggtaatctgcaaaatagattttatagataattgctgtggaaaagaagtgactaaatgtaaaatataatctctgctggtatgtttagaccaggaaatcaaaatgcatgacctagtcagacaaagcaaaaggttctttacgtgttcttcttgtatcatcagtgagcctttttcatttaagtacaatgaagtgtctctgccttaagaaattcttcagaggcagaaattcattattctttattaactcactgtgcccttctccttcttctgcaccttttcctgtgtattgtctcccattttaaaatgtattaactgagaactaaagatagcaaagtgttgtcaatattataaagtatagtaagacagcatagaactacatggagaatatattgataacagcatcttttacacagtgatgaattaataattaaaccaaacaaaaccaaacaacaaaacagttttacagctacttgggaaatatctgtaaacaaagtttcataataattaactcttggaatatcgtcacttgtacaaatgctgcaattctagcaagtttgggacacttacaggaaactgtctgcaaataaacatgtataatgattttagtgtatatgacatgaaacagacggcgacccatttattaaggtccattacacagatataggagggactttaaaggcatcacaaaatacttgccaggaagtaaatgttgactatttccaaatctcagtgcaaaatgagatagataacgttaacatgcacatggagtaatacattctttaagtacctattcagtgaggacctgctatgtgcaaggcacgtattccagatatatattaatgaaaattgtgatcagttaaaaataaatgttactattttcattgatctcattttctattttcaataaatcaattacaggtaaaatgtgttatgagtgacaaaatgactggaaagtttttgccttaatcaaaatttgtgtaattattttttgtaggtaatcaggtgatttagaagcttaggaaattatgatgctatttttatagttattatgctattattatgatgaatcacccattcatgtgcattaagcagcattgattaatatttagattttcagcgttttaagtgtctgtaccttatttacatattattaaaaagtcaccttggttgtaatcatctgtcttcccatgatcacaatacaggtttgtggttttcaatatgtcatgactaagaagagattttatggtgcttaaatatgtagtaaattcattaaaccttagtcatgagtaaaatgatccctgtaataccactagttgcataatacctgcttctgatgcctgcttttaatttttctaaatacattggctggtttctagaagataaatgtaatattctacagagctatagactgttttgccacttggaatatctcgaacagttgtcatgggcaaggccgcaggtgctatatcccaagtgtatactgcttttatttttacatgtacaaaatattagaataataaatatatggtaaggcttctagaaatgaaaactgttgtcaatctgtaatttatagaaaatttatgtaagaaaacttatgttgtcttttaagcaattctcctgcataataacttagtttagagtaagaaatatgcatcttatctaaactgatttatagaccacatgctatttttacaaatatttaagaaaattcctagataaactttggaaccaaaaacaatgtagcctaataacaatgtcaactatacttacagtataattttatatataaccttttatctttataataataaatactatcacagccatttagagaaggcaattttagtttacctctattgcttaaaggctttagctattatttatgcacaacaagaattctgactttttaaaattagttttaaaattttggatcagctttataaagaaacacattgttgttaagtgcagacaaatgagaaccttgccatttctgcatttatgaccagaagccaacagagtcaattttcatgtttatttattctttgctttagaatgttatgtcagttgacagtattcagggcttgtgttgatgtaaattgccataaagcaaggaaacacgggctatagtactgtcagggaggctcagcactgcagaacaacacaatttaagaaaagcatttgcagaaagattcagtgtcagtcttcggaaattgactgtagatgcaaattggcatcaactacttcacaatctccctctaacaaaagagatggaaagggtggaatcaccaaacagagtgcacttttcggcatagtagctttcatgaagacaaaaataggatcccatttgttcattcacaatggatattcagactccacattctgccacccccatgttttattggagcctgcaattctgccaggagaagggttgcctcatgctaattcatcctaatgtttctcctccttcctacataggggaagtcttccaacccttcctactttttaagattagaagaaaagattcctcttaagccaaccatctctttggttacctttctgtaatgcctttatactgatgaaatgctgttatgttttacctaagttcggatattgtcattgtctcctgctgactcaacatgcattgtagccaggatcctggtctaaattcctgttatacaaaaccctgagctcttctaatttgcttcttgaaaaaaaaaaaaaaaaagaaaatctggccaggcacagtgggtcatgcctgtgatgccagcactctgggaggctgagatgggtggatcacttgaggccaggagttcaaaaccagcctggccaacatggtgaaaccccaccgctactataaatacaaaaaaactagccaggtatattggtgcacgtctgtgatcccagctactccgggaggcggaggttgcagtgagcagagatcatgacactgcactccagcctgaacaatacagcgagactttatctcaaagaaaaaaatagtcagctctagaattcttagggcatagaggcaatgttaacaaatcagaaggtacattaccattttaaaaaattttgtcaggcttatactcagatctctttaaacattacctacatttaaagaattattgtatgtaagagataaacacacaggaaaaaatatttgatttttgcttttgacctgtgtcattaaaataagatgattctccttatttctcaagaggcattccaattttaaatagagtggtagggaaaaaagtgattttagcagggatttacctgttcgtttgtactggtaagttatttttgtgttgataaattatttacactttaatggaattgaggtgtcatcatcttccatttatattattttgccttcctttttcacaaattttttactattaagaaagctacaagaggtgttatttgaggaaacagtcctataatatcattctttttttaaaattgacagtttcctcaaatatttatgggggaacctttctacttctcaaatttgaacagacaactttagtcaatgcttagcattgattttttgacaactcatgtccatttcaacattttattgtgagatagctaggaaattagttgtaagagcagaaaggtaattaggtaggtggtataaaatttttgacagttttgacactactgatattttcaggaaaaaaaacgcatacatatcctagtttagagtaagtctagctgaaaatttaaatatatttttaactgaacataatttttgagtttgagataattttagatatacatatagttgtaggaaataatacagagagaacccctgtaccctttgtccattttccccaatggtaacattctgcaaaaccatggaacagtatcacaagcaagatattgaccttgattcagtcaacatacggaatattttcatcagcgcaggaatgtgactattaaaaaaaatttaaatttttgaggattattctacctccaaattctttagtactaaatattcttacatctagacaaactaaaataggatttataggaaaaatgatttgactagagagtcaatatgcctgaattcatatctcagctctgccaccatcactggtttaattacatttggggagtcacagcgtggtggggcctcaatttattcttttggagggacttagtctaaatcagtgattgtcaactagaatgaaagtgagggaactcctcccttggagacttgtcagaatcttggaggagacgttttgcagacaaagcccaactcttttccctccacactcctacctccaccaccatcacaagcaaattctgatgtttgttcctagacttctaagattttgactccctcatcttccattgaggattgcttatggaaacaacgtaatagattcctagcaaatcttcatgtatagtgtgtcagcaactagtctcaagtgtctaacgttcttttcaactttaaaataataataagaaaaaatatctaccaagaacactaaaaatctttgtgcttcacaccatctagctgatgacgcataagagtagaggaaaatgtggtcaatacatgagccaaattcagagtggtgcatgcagaaggcttcctccaacagggatttgagagaaaggagatctgaggaaatccagttccactagggaatgatcccacagaaatggaatcttccagcttgagaacctgaagaaagtgactcacactacatgagaatttgaccctatctgatgctactttcaaacatatttgagtatttatagtttctaatttttggaatacgtagctttctctataattttgataccctatctccagaaaagatttattataaagttagagcacaaagaaagaaagatacagttgtgtttttatcattacaattgctgccttaagcatttctttctgtggtctagtctaagttattaaacctcattagttttttacttctggttagtgctgtctccttgattgtggcaaatgcaagttaccaatatgactctttgctacttctttccataagaagacaaaatatatggcaaaaagagaaaaaaactctaggattccaaattataagcactactcatattgaaagttagaaaaagaaaatgagcctgaactgaaaatcaaacaaaaagacgagaaaaggaaatggaaataaagtttccctgtatcccattagggttgatacattaaagaaagagtgaggatagctggaaataatattttccttcaaatgacagctaaatgagatctttggagctgtgccacaatgagtgaagtcagggagacagggccggtagtgacaggaggagaaaagtgcttcttcatgtgtcagccctgggtttaaaataactcagaaggtataaaagaaattccctcctcagatacaagattatttgtgggacacctgattaccatttaagagatatcaacagttaaaggaaggtgatttaaatctggatagctcccttttaaatccagccctctgattctataaggcaaatgacaaggctgtctagacatggagtacattgagcaaggtttagatgagggagccccggagactgtgagacagacctgttctgtgcctgagaatgtcagtgatgactcacaggaggtggagaaaagtgtgctcaatgtatgggccaggctcagggagctccttgaagacagatcatttggtattaatgatacagcgataccacaaagcacaggaggtgtagcctgctagcattgaagttaggaactgatttgaattaacccagtgtttgaatctggatgcaagagcctgtatggtatcttgcatgctaacttcttcataatcttgttcctgaatgggtgccagattgaggagtctttgggatagttgatatttcttttaaaaagcctgatctatataaagctgtatcaaccacgtgcaaccactttagcataccactctatattaatagaatagaaaagataattagcagagaaaaagagccaaggaaagctaccaagaattagtgaaatataaaatgtgttcttattatcccttcctcaataaaggggcaaacaaggttgttctggtatcatctgtgggaattttacacaaactattttaggaggaaggtgggtgactagatgatggatggatggatagctgatggatggatggtggctgaagtgggtatgtgcattgaaagaaactgcaacagagcactatcttctgaagtcacttgaagttatcccaaaggtcaggggaagaaaagggaaaaccagaaaccacatatgaaattagcaaagctgagcccgagtctgaacgcactgtgaggaggaagcaccattagggaggtgatccattgccagtggaaagccagaagctcagaaccattagctgagaccgtgctcctcccaggcagggaccctctagttgcctggggagatgatctgaattcacataggaatggtcgttgcctcttccatgaggatcatgagaacatcactaggtccaaaccacaagctgttcttgtaaaagatagagtaaatggttacatcaaatataatcataactgtagtcaacctgcagctcagagatatgtaagagtacaagtaaagctctttatccacgtgctgaacatttttattaaaatgtgtgaatgaaaaactattttaaaaaatagaccaggcatgatggctgatgcctataatcccagcattttcagaggccaaggtgggaagactgcttgagatcaggagttcaaatccacccccatgagctagtcacctcccaccaggtcccacctccaacaatggggattacaattcaacatgagatttgggtatggacaaatatccaaactatatcaggtggttactgtagagaaggggagaaatgaactcccttaacgttccagctagatcttacagaagaaaataggaattagttttgatggtatacagaaaggaaaaccatgtgaaaacaaggcataaggctaccaatatgtttaatgagaataaaaggaagaaagaataagtgactaacatacgtacgaaacatgcagctcttagatccatgttccttcagtgctctttatacttttcatggcttttcccacgtaagccgctcaactcacctaaacttctgtgccccataaccagtttccattaattgacattataaccatctttcaaagcatggagcagatacggccctttttcccagctacgaggatttgtcaaaagcagctttttaaaatggttatcttcgaatgtgcctaatttttcttatcacactgtaaactttttaagtcaaaaatcttatgatcaaatcatcattaccatttattacttttcatcttcacctgtctgcctcccctctgctcaaccccagcccctcatgcagtacgtgcacaataaatatttgttgaattatgaatgaatacctaatattgacatgcaaggagtttcatgcctcagttaaaactcccagaaaatctttttccagtccccagttagagccagtgtaataacagtgactttttttcaacaattacttaaataacattattaaagcaattgttgctttaggttgttcattaataaaaataaatgtatattttctttactgttagaacagtttgattctgtatgaattcctattcctgattttattatactcctgaaaccacagcttgctgctggttcatctattaggcatttgaaatgttgaattactttgaattgcatttgttcttatattgcctaggctctggttggcctcctagggtcgtcacaccataatcttaaacacaacatgtgccttgtggcccagatgttttccaagagggagtgctgcagccaagaaaagcaagatagtatcttgaatacccaaaggggttgatatgactaaaaagcaaccgtacagccaactgtagagctgtccaagaaaaagtgagcctattatttgtatagtttaggtttttgtgatcaaatagtaaaatttgcaaaagtttcatgataagatcttttgcttcacagattctcgtaatatctgcttttgtagtgtggactccagtgttcagcagtttgtagataaaactgggatcgtggcaacaataagagaaatcaaaaaaaaaaaaaggaagagttcatggactcttgtttcttcataaatgtgacatgataaaaattacctttctttcttaatatttgaaaataacataaagaatgaacaaagattgcttctagaactaaacttggattgaggcaacttaataaacggctgtttgttgttgtttctgttcttttcttctgacaatatttaccttttatattcttgtggagagctgagatacctgcaattgtgcttttaaaaaattgttctgtcttcttgcagtgaggtctcttttttggcttacttattaacaaagaagcaaattacatatatacatatactttatgtaacatgtatacacatatgtatatgtaacaatgtaatgctatgtgtatacatatatgtatgtgtaatatacatatacatatttatacatatgaaatataaatatctatatttttatttcatttacctactagctgattcacatcgttttcataaccaaaatatagctcatggcttgagtatgaaaccctgacaaagtatggaatttcacatacatgtcatgataatgtcctagtcagattcagtcctacctcttgcttctgaaaatgtgctagcttctgttctaatcctaattgcatgaattagttcattgtccagtttagaagagaggaacgagtaggaagctgctttggttctggggtcaatctaggacttcaggtctattttagggaaagcattctagaatgtccttgcccttcctgatacactttgatataccttcaactttgagatcattgacttagtgttatcttgaatgagggggtccaatagagccagctactccatgctgatttagatctcaatgcttttgaaattcaagtttttaaagcacttgactctctgttttctccaaatgaaatcctattttgtatttaaaacagtaagaccagatttccccttttgaagtaattataggatcccaagaacccttaattccactggtcccatggtctacttatccccccgccccccacagcaagtcccttacccctgaggcagcttcagcgactcctccactcacccagcactgtaggaaaatgtctgctgtgctccagccagagcagacctactgtattgcaaatttatcgtggctggaccatcctccagagatgtatgccataaggacaatggaggcctcagctaagtacctcctgctgcattcattcccagggtagtaggtggtatagctgcaagacacggaacccagtattaggccttgctccattttctctaggcttcaaagctctgagccagtgatagtttataaaagcccaggactccaaagaattaaaatcagcacctgtagatctcctggtgaagataaactccatgggcatgtaaagaaagcaataaagatacacacatagtttttttttttcttttgaatatcaacagtaaccttgagcagagtgactctttatcagggctcttggtacttaggctgagctggtgatcacaaaggaaagaattagaaatttaaggtgattttattttattttatatttttagtaggagtatctggctgctatctaaggaatctcttctattagttacatggaaacttggagattttattgtttccctctcagtgtgtgtgtgtgtgtgtgtgtgtgtgtgtgtgtgtgtgtgttagccatttattaatcctaactcccccaagaaaagacaatctataaatttcattttcactcacattaaaaggtgagatgcaggctgggtgctgtggatcacacctgtaaacctagcactttgtgttgacttagtgttatcttgaatgagggtggacagatcatgaggtcaggagttcgagaccagcctggccaaatggtgaaaccctgtctctagtgaaaatacaaaaaattagctggacatggtggcgggcgcctgtgatcccagctacttgggaggcaggagaatctcttgaaccaggaatgggaggttgcagtgagccgagattctgccactgcactccagcctgggcaacagtgccagactccgtctcaaaaaacaaaacaaacaaacaaaaataggtgagatgccaattctcttcctgactctgcactccagtgcagtgctccatttcccctattgataataccaccccaaacatacctatttttccaggaccacatttcttcaaattgcactagtcatgctgttaagaaacacagaatctaaaaatgatctgagaaaaagagaattgcaattacaaccacaaaattttctatatactagtgaatggataaagatatttattgtgacacattgagcaatttttttgaaagttcatgtactcttgctcaactgattgaaactttgggaaaatgtaactttttgagttgtaagatcatgtaaaagttaaatgaaggaagaacagcaaagaagttatgggaattgttgttgtgattaagtagttaaatttgtatatttttttcctgctgattagggagttgttactgaaatacgttagcaggatccttcttttagcttttcacatgaatatttgggttgctttctgccttgataattaaaagagaattgtgtatatcttgttttccctaaagaaaggtgatactgactttatcatgtcatcataatcttcacagctagtagtgaaatacctttattgaacatccaccatatatataagactgttctaatctaaactcaataaacctttaaggtctatttcttattcttcttactttatttccataacttaattagccttcaaagcccaattctaatatgcataatgacttgaagtattttccaaatacaatcagtgatttttttgtgtgtgctaagtgttctcaggacagggtcaaaactacctattacatacattcaccatgagaatttagcacagttggcctctggcaacagactcaaagatttattctgtgtagctattttctagcctgctggattccagccagttgcctaatggatcatgagtgagtcagtttcattcagtctcttagcaaagtcaatttgtccagcagcacacaattttctgtcatgtagggtctttgcctggcattgctgtgacaaacacaatctaactgttttgcttccctagattccaactgagctttggccctggaaggctggcttagataatcaaagtcccctctaaggagggaaagatggtataatgaaggcttcctggaaaaattagaccctacaatttacccatctccaaaagtgggtcatggaacaaaaatatccatgtattaagttagattaatatttgtgtgtgcaatgaacaacagcatttgccttttgattacttcgggcccaaatgagctttctcttttaagtagcagaaaaataacaaaagcagagtacacctggaagggacagaatagtcacaggccagtgttgtaagagtcagtgtggcacttctgaaggaaatctgccgagtgcatgggatactagagcaccatgatgggcaggaggagaaacaccctctttctctaccttccttctctaccgccactccttcgagatggccaagtatggaatttctctgtcaggggtcctgccacctgacatgtgcaggtccagttaggtagttgaaaaggacacattactacacttatcagggttctcactacaaacaaattttcatagtccttctggaaataagccacatcaccgaatgcctttccggtagctgacatgattgattgtggacaacgaagaagtcacttattcctaaggaagagactggagtgagggttgctgtttgcacatacataaaatcctagaagagataccaaagctacattatgcagaaagattattattttagccagtggctctgaggacaacctcatttgtcttctctatgggtcactctttttttttttttttttcttttgagacagagtctcgctctgtcacccaggctggagtgcagtggcacaatctcggcgcactgcaacctccgccttctgggttcacgccattctcctgcgtcagcctcccaagtagctgggactacaggtgcctgccaccacactggctaattttttctatttttagtacagatgaggtttcacatgttagccaggatggtcttgatctcctgaccttgtgatccgcccacctcggcctcccaaagtgctgggattacaggcgtgagccaccacacccggccaggtcactcattttttaagtgaatattttcatttccaaaaaaaaaaaaaaaagcctcatgtttccaaagtggcataaaaggccctggcatgtagagtgtagaacagaggctcctcctttttagccagtctctatttcagaaatcattagatagaacatacttggtctgaaaaaaaactatgaaattttgatcccccttggagaaaatgtactttaatgtgtatattagttttcatttccttcctctgatacagtaaagtcaaaattttgcgaaccattgtgaaataaggagatatgaccccataaacacaaacaattttcgttcccttgttcctacatatgtttgttaggagtacataaaagacaagttagctctatagaccctctaattttgagaaagagaagcacagcattttcctctttgattctgttttgaaagagtgcacataatgatgcatacctcatgcttgtctgccttcccctggactttaatttcttcctgtccagccaaaggagaaggtttttggcttggtttcagctgtgcttccatagctgctacacatcaaacctatcctaccaggtagagactagtgtattcttttcactgagggtagatggtcttctaactttaatcttccattctgcctgtcacgtctagaatctatctggttaaaactcacgttttaaaaatgcatgtcctaaattgtatccaacacttgttagtatcaattattatcataatttaaagcctagattgcagatgttcatcgtaatactttgccaatattcttatgactgtttcttttttcccatagataagtgttccaatttaagtgtgttttcctttccagaatgttctgtatgtaactcttctgacatttcagagattgtgttattactaatatttagtctcgtgaggtgcttcattttttaaagtattctttattgtgttttttcttcatgacccatcatggtgctcgatcagttccttgttttttcttttgagcatgactaataataataaagtctgagctctggtctcatatcacatattttaattgtataaaacaactatgaagacccacactgacaagatcctgagcctaaataaaattaggtcatgtctaaaagatattgtcctttgaattaagcagaacgtgtgggtgtgtgcacatgtgtgagagagagggagagtttgctcacacacagccttgacactgataatattttcccagacagcttctactcagtgactttgtagtaaaatcaaaggagctttagtgtgtactcattttacagattagaatagtagagcccagagagagtaagttatttgcctgaaatcccacagcgagggtccacgggagctaggactctggctttcaggaccctccttgttcagtcctctttactttgagtcaactctgacgggacctggcatggtgccctgcaattactgatgatgcgaaaggtgagagcggatgaaattttagcacactgatcaatcttgagatactaaaatataccagcaaagttgtgaactcgaaaattactaaacaggctgggcatggtggctcatgcctgtaatctcagcactttgggaggtcgaggaatgagattgcttgagcccaggagtttgagatcatcctaggcaacaagaacaacaacaaaaaacaattagttggggatggtggcgcatatctgtaatcccagctactgaggaggctgaggcagaagaatcgcttggacctgggagttcaaggctgcagtgagctatgatggtgccactgcactccagcatgggtgacagagtgagaccctctctcagaaaaaagaaggaaagaaagagagagagggtgagagagagagagaggaaggaaggaaggagaaaagaaaagaaaagaaaaaaagaaaaagactgaacaaaacttgagaaaagcaatgtacccttatcacagttttatgggaaagtacacaaatgagtaaaatgcaaaataatggcattttctgtactgagaacagagataccacagagcaatcgaggaagaattagttatactgttctctgttggattacaaagcagaattctgaaaagcacacgttgtttgacacgcagtgtgaagttgcttgacgttcactgtgatgttggctgggacactgtgccgggtatgtgtgggtctacagattcatcaaatggcacatggtcagaacgaccttctttttgctaatgtcattaagtgccatctattaaaaatcaggtgcttacaaatgagagtatttaaagaatcagagggagcaaggtattatgtgtccccttgttatcaaactatattatccaaataaggatatgatataatcaagccaattctaaacagtccaaaggcaaaacaaaagaatgtgcccagtgctttcagccagtgtctggatgctaaaaatcagactgactagtcaatgaaagcgaccacaaaattagatgattttgacccaaaagaatgccttggcctcccttcccagagtgtttgccagttttccatgtctgctcttcccctcttcacccccagccccaggtggaaatgaagatggttttccattttgttttgaagagagagcttcatgtcactgatctataatgtgaaggaaaatatcttcatcaaaaccaacattcttaggaatacatagaaaataaaaagactactcatgtcttagaaaagttttcccaaaagttggatcatgttggataatgttatgatccttttcactttcaaagttccctagttcccttagagaggggaaaattatattactggtagaaatcaacatttccttttctttagtgaaaaaaataacacagcactctttaattgaaacctgtgtatctttgccctccccactttctgcctttgctttttcattcacatttaactcctgcagcaacaataacctctgggctgttctgcattagagagaactcaagagccctggaaattataatttcagaagtattgataatattaaacaacatcaaaaatttttaccacttttgcctgcccttcttacttttttcacaagttaattgaagatggaaggcagtaaagcctcgtgattctttttcaaaaaggttaaaatacaatataatctatcttttttttttttttttttttttgacacagagtcgtgctcttgttgcccaggctggagtgcaatggcgcaatcttgactcactacaacctccgcctcccaggctcaagcaattctcctgcctcagcctccaagtagctgggattacaggcgtgcgccaccgcacccagctaagttttgtgtttttagtagagacggggttttaccctgttgccaaggctgatctcaaaactcttgacatcaggtgatccacccacctcgacttcccaaagtgctgggattacaggcgtgagccaccgcgcctggccaaagtaatctatctttaaagatggtctgctatccttaattgtgtatttggtataggttaatagagtgaaagtcctgtaagctataggattagatggacgttgcctgcaattcaattccatctgtagagcagatttcattgtcacattaaacattagaacttaagaaacaagttcttcagagaagtggattgagaaagattgaagtagtattgtgtgagctgagcttgagtcagctattctgttggagaatccctaggttacatcagagaagatagccgtgggctagtcacctctatgagctttgtcatggctataattttcatcaccagtcagtccttcaaatagatatttcttagagatgcatgggtaattagagaaactctcaattcagttattaaatttttcctactcatatccagagttaactgctcatttttagcttgaacaaattagaggattgcttagtgctgaatacttgtctctttgttctataagcttgacagagctttcttattgcctatatgataatgttggaccatcttcaagtgtctacagtctttcctggggctggtatggtgctccagcataaatgcataaatgtgtaatgcagtggaatttcaactcagtgataaaattctctaaaagagagaactaattaattttagagccagaaagaggcctatatccaacctatttatgtatgtgctagagctggttactacagagcaaattagagaccaataaaaagacatggtgatcacttcaaattgaactgtcttaacagaaataaattgcagaagcagataagattttcacaaatcagtgcagtatggccctgttactttttatagcatctggattatggcttagacttattaagaattagaaaaacaaatttcagtgccatcactgatacctcaatataatatgggacaagctgttagacatcaatatgctgaaaaatggccaggcatggtggttcacgcctgtaatcccagcactttgggaggccaaggcaggcagatcacgaggtcaagagatcgtgaccatcctggccaacatggtgaaatctcatctctactaaaaatacaaaaattagctgagcatggtggcacatgcctgtagtcccagctactcgggaggctgaggcaggagaatcacttgaacccaggaggcagaggttgcagtgagccgagattgcaccaatgccctccagcctgatgacagcgagactccatctcaaaaaaaaaaaaaatatatgaaaaggtaacagcaattttcagtgagtaagcatataagtaaaggataaggagagaattgcctcttttctgtcgcattcaaggaacagctggaaaatggaagaaacatagaaggagagaaacatcaagaaatacgtattagtcattccactgtaggaaaagttcattacaggagagtcatgcaggcagacagggtcttcttagtatcaaggactgattttgataatgtgcccacatttcagcgagggcgttttaagacataagcacagcattaaggtgtttcaatagcagacatacctgtctttattgcagtggggagaaagcccaggctcatgaaagaggcgtgagcattcacgggaaggaagaaagaccaaataaaggcctaggaggaggtgagccggggaactgtacaagggagcaaaggccccttcttcagatgagttcaggatggccttagcaccagtgcttggggaagaatggctcacatcctctatggcttaccctcttcttccaaggctaattttggaggctttctagtctttcttttgggatcaaatatatcatgaaattgaaacaataaaaccaccccccatagagctgttacttggttttcacttttcatataatattaaaatctcaggactaggagcgatttccagaagctattaagtctaaccactacctccagacagaacttcacctagatagactaagggaatgtattccttattgaaaatatattccacctcattcatttacaaataaggtgtaaaccttcctggaaaaaaattcacaagtgccattataaatgcttctatggataaagaccttaaagctaacccaaagttattttgccacatatacttaggtgtcttaaataaataatatgcattctctcgattccatccttgtgaatttgcatttgggttcccacttcttcaaaagagagtgtgtttgttccatggccaattagtttgatagtacatataagtaattttgcatggataaaaactaaccatgcaactttaactctgcctttaattaagtaatcattaaaaatgaaacttgtctacttcctcctgttctgtagttgacggtgattgaggggcttggtatggctgtagtggcacaaaaatggaaatcagtaaattagagcagttgtcagacccagattctgattagctaaacagcttgcctgggttagtgattaatgcagttgtagggaatgaaatctgctttcctagaaaagtcaatagagaacgtttaatgaagtagaattatgtgacagttgtccagttgtgtgaaccatctttgaacttagtcaaatgcagatgtaattttatattaagactttaaaagaatggaaaaatggcttcaaacataggagaacaaaattttctgctttctttgtttacttcttattttatgtcaccccataaatgtgattggtacggcttttgagattattggtttagaatttcttaccctttgttgtcttgagccatcttttctctagaaacatgctaatattacagatggttcaaatgttcctataatgtcaatgtgtaaatccatattgagcaatgtagaggtccggctgtgaataggacaaagaaaaaattaagaaaatatttaaatgtacatacctccttttctaggatttaataactcgaattatttataaaatgttattgacaactttattaaaagtataagttacacgttataagattcacacttcaaagtgtacgattcagtgtttttagtaaagtcacaatgttgtacaactcattaccactatctaactccaggatattttcctcattccaaaaacaaacctcatacccattagcagaccccctcccatttcctctttccaccctttccccagctattcaagttattttttaagcagatgttctgattaaaactctgtatctgtctttggtgctttagctagcaaaaaaataatgaatataaaacaattgcctccccatatatattggtatatataatttattagaatgtttttcttttcacttttaatgaaataataatgaaatttcaatatgtataactggtgaaataattttggcaatactgtgagtgaaatgatagggcaaaaatgaatgcttttatttaactcacaattgatataaacaaaaaaatcaaatgatccagtcaggtcgagggtaaattctcttaaggaaataacaggtaaatacttttccttgagtgtaaagacacttatgtgtatttattaacacatacatagaatttagataagaattatctttaaaaatatgcatccttttaaatttattcaactagtattatcttttcactacaaacacaataaatcctggttttgcttgcctccactagtcgatatcttgagttaatcttgcacatcagctgaaagaatagagttaaagtttgtatctatgaatagaaggacttgataaactatttgataatgtaaataagagtagaaagggaatatgtagtgtattatgctaagatagtatatgtaattcatgtgagtgagcacactgatacattttaagataagcaagtgccagattaatgcatattcttgccctgattccttttcatcccctttcccttcatttcctcccctttcccatcctcttccctttagacccttgtcacactgacctgcattcacttactggaactggctatgtcccctcctgcctctgggtcttcaagcaaggcctctcctctgcatgtcttaacccaatccgcacacctcccacaccatgctggccctttgcttacttaaattaacttatcatccttcaaatttcaactcagtagtacttcccctagaagccttttggaactttccagaagtcgggtcctgttcatgttctcagagcaccctgattttttggaagtaacattcatgcttctatcctcatcttctctattttcaaagaagaatcaaagaatgtatgtatattctaatatatattgtgtaagtatactaatgattcaatatctttttagaaaatctgcaattttggactttttagtaagtcagacatcttttgcttctgagaaatctgaactattttattttgttatgactgtgacattcattccatgtgttgaaatcaagacacaagaatgcaagaaatgacgacttgccagtaaatgcccagttttcactattaaaaaaagcctggcattgctctcccagaagaataacaactcagtgatagaggggcgtaaagaccatggggccagcatatttgaaggtgatttttaaatattaactgttgtggtcttcaatgtgagtaagcctgcatttttcaaaaggtttcatatcttacaaactcctgatttctccctttattaaaatctattttgaagtaggccaagctgtcaactaaagtgaatgttttcaactaaaagatgattcactttctaacttgacaaaaataaatggagaaaattatagattatagatcaattatcactttctaatttatctctatgatttcaccctgatttattccatgaacaatttaaggtattttaactatctgacattcatttagttgaacaaaaagaaaacgtgaaaccttggtaaataagggacccccttaaactgaaactttcctaagtacatttgaaagtccataaactgacaatggataccaagatcatgagatcacaaatgtgacttttccttaagatttcatcacaagataaatcaaagtgctaggaattgtattttcccttttcctagtaatcaagtatccttctcagatgactctttttgtaaaagtaacaacttctcatctttgagacttgactcacataccaaatatcaaaaatggaaaatctttgaattctttttcctgttgtgggaatacgagtcatttataacaacaaaaaaaatcgataggaaatggatgttttagggaagtgtatcctgagtgctgtctttaaggcattgattggagactgcccacatctaaaaaatgactctaggacatcactctcatgtatttccgtgaaaaagctggtggaaaaatgtgttttcttctaaaaggctatgtgtgggacgtgtgtcagtgttcacatgtgcctaataggcatacgtaaaatcacacttgtatgaaaatcaagtaaatctgctgaaataaacagcaacccatgtttgggcatttgtgttggtagagattggcttttaaaggagaatggattaatatatgattctcttgtcggtattactatgaattgttcttttttgaggaggagtctcgccttgtggcccaggctggagtgcagtggtgcagtcttggctaactaccacctcctcctcctgggttcaagcgattctcctgcctcagcctgctgagtagctgggattacaggcacatacaatccacacccggttaacttttgtatttttagtagagaagggtttcgctctgttggccaggctggtctctaattcctgacctgatctgccttcctcggcctcccaaagtgctgggattacaggtgtgagccaccatgccaggcctgaattttcacttgcaaaattatcagtcagttcttaaaacttgaggaagggaggagtcaagaaaatgaggtgaatgagaaggctgtttagactgtttttattgtcttacagtcccatttttgtctttcactcttccttctctctaatggctgggttttcaacaataatacaggcaagcataaaagttagcaaatgagggctaacctagaattgcaaatttgattgggtttcatgttggttttccttaaataaatcaacagttttaacagggtggcatttaattatatttgtttacagaaatatttttatatttgaatttctttcataacagtgtttattgtggtcaaaggatgggagggatgaggaaataatatttgaagaccacaggggcattcctcacctctgtagtcttattatctggccttgaaacactacgacattctttaactgaatttattaggggctgaataccaacaacataagtcagaaaagggtttacattgacccctttggattctaaatattgtaataaatattattagttccgaaatatcatatctgtttgatttcccaaatgattgcagaaatgctttgatctttttagtcctatgatattgtagagatatctcactaatgatgttttttttttttttttgagatggagtctcgctgtgtcgctcaggctggagtgcagtgagccatgtttgtgccactgcactgtagcctgggtgacagagcgagaccctgtctacaaaaaaaaaagaaaagaaaagaaaagaaaaaaagaaatgtaattcactttcttctggtcagcagctgacaggatagaacacattggactagaaacctgttgtattcttacttttacccatgacatggcttcttttagaatacaaactgtttagaactaagacaggaaaatttaacaaagcattagatataaaaatgttcacaacatgtatggtctattctttaatttgagaatattttaagaaaatttgtggttgaaagctattgctgtcattgaggtggtgttacaacacaatcgatctttgaaaaagtattggcttcaccagggaaacactagacctctaccccagtgactcctgctaaagaggtctttgccatcgctgccctttctgatacctttgtgtgtgctcagattggcacactgattaatttcagataccatcagcaaaaatggaatatgctgaacaagcacttacaaagtagtggttcttcatagaacagagttgtagcccttcagtaacaaagaatgagtcagaggaaatgagttaatttaacaaattgctagttgcctaccagatatcatagcaaggaatgatatatgcaaggtgtgttaaaggcaatgtttccttaatttcttctttctatctcccatctcccaatgtcctctggggaggccgtagaggtgggagggacatattaagtaaaaagtgtgaccacttgctgagtaatttttagtgatttgttgagctggattaagtgaatttagagttgaatcttcaaaatgatcatttcctttttttaagagtttatattctggatattttcatttgaagagcagtgatagtatccggctaaggtttactaaattgttcaagtgagtttgcagaagactaagtgaaacaacttctgtataatgaactggaagattaatctgcatatcacataagcaaataaaaaacaagcaatcatatattttataatggaacaaccgtaagataaacaaacaaaaggcatagttaaaaatctgtatgaaaaagcaaattcttggtttcccaagaatccttggtttcccaaggctcaagaattttatgatttgagaaaaatacttaagtgttgcctgcacttctgtgcaataaatctcattatttcatactttattgccactactgtcatgaaattaatggatcacatttaagtattccttcttggaaaaatatcactaaaatgtaatgttcctcaagtcatagtgcaaacaaaattatatttatcatttacagacaggttttattggtcctggtgcattcatctgctgatggccaataaaagctatacaaagtctcatcaatgaaattagtaatctgtggggacaaacatgccattagtgcctgtcattcgagatttgtgatcattgacgtgctttttatggcatctgaaaatattagtttgactttaaaaaatgtagagttgtttctattgttggatatatttataaaattctgaacataaaaatgctctttggtagccacttgaatttttaaaactatatttaataaaatacagcttttaggaatagcaatcagcatgggataggtgacaatgaattttttttttttttttttgagacggagtctcgctgtgtcgcccaggctggagtgcagtggcgagatctcgctcactgcaagctccacctcccgggttcacacctttctcctgcctcagcctcccgaatagctgggactacaggctccagccaccacacccgggtaattttttgtatttttagtagagatggggtttcaccatgttagccaggatggtcttgatctcctgaccttgtgatctgcccgcctcggcctcccaaagtgctgagattacaggcgtgagccaccgcgcccggccaagtgacaatgtattttaagtagcctctgctatccttgacgaaatgtgctaaagtggcaaaatgtttgctttagagatgtacaaaagtagaaaatttgtgaaggacattaggtgtttctccactttgagaggggatctcctcttgatctactctttatttcccatcccagagtgaacaaggtactagttgatgaattcgaatcaggatacttgaaattaagacttagatgtagcactttgtgatctgtaaaaatcatatcagatcttaaatatgaaaatgtttgagtttagccaaaatcaccagcatcattggtgtatatcaagtttaatcctatccttggaataatagaacttcaaggttggaagatgaatcttgaatagtttgaagttaaaccctacctgccgttgcaatgagtcccattgaaaaacatttcctacatgtcctcgacaagtctttgctttctttagttacaaggaattgcccaacctaccaaggcttccccattttatctttgactatttctataaatttctttttaaaaattgtggccatattttaagacacagagggagggtagacacctagatctaaaggatattaatctacttaagaggaatttgcttatggaaagatgatctagcaaatgagataaactggactgataaaaattatccaaactcaggtttagatgcctatagcagtttcacaaaaactaaatctttgtctctaatggatctgagctgatagcagtgtagtagagaccaaaggtctgtgactgtcgtggagaagccccttttggatgaagctttacggaggattttcaaatgttaattatatttacaaacagatcagatgtaggcatagatatattagaatactttatatcttctctcatttatttttctactgctagataaatgggacttataagtagctgagtaggcaaacaagaaagaatgcatacagttttatcaatttatctgagattttgtgataagctacagaccaagtcaaatggactagttttggcaggggcttgctgtccatatgatggtcagttagcttttttctgagttaaacttgaaaactaagaactttaagaagtgcatgggtatatataggtgtgtgtgtgtgtgtgtgtttgtgtgtaattttacaagactgtagaattataaaatgacatttgttttaaggaatatttgattgacagtttcacttaccaacgttagcctctaattatgacactgaggatacccaaatttaaaaatttcctttataatggtccctgagacctggtgattgaggtcataaaaaaggaatggtagttttctttcagaattttaaattttctcaaataatatttcaccaaatattagccacacttgtatactttgactctgttggtcgttaaaatgtatagtcataattactcctatggaatagggatttcaatagaaagaaagctttagaaatgaatcttctttgcagataaatgctatttaattttcagagttaatataattcaaattatttagaagtttacaagattctattataaagccagtttatttatttttttaattccattatcatctgaatattctaaaaaatgtaaaaagaaatctatttgtagagaaaacaatgccttttaaagaaaaatgtattttgtgctgggctgcagtcttattcatcacttgataaatgatgcttttaattcagataattagagtaatttgtaacaaattattagatatagcagacttgccattccatttctataaaataaaaatacattgtaatgtttacattgatgagtaataataacaacaccttagtagttgtaacaatatatgacctaaaatcagtggtaataatgtcctatgataagaagattgtacaaacttaaaagctagattttctttcaaatcttttgtcatactcctgagagaaagatatgaggggaaaaaagtcactatagcaaaatgccttctcagaactgtttcagagcaattgaggggagaaggaaagaatcagtcagagattgtttcaaatttaatatgaaataaactgttacctttaactattcagcaatgacacagttatatttcattccaaaggtgtttacaatcatatgagtgggtttctgtattcaatgttacaataagtcaacttggaatttcccattaaatatgatattaataaaagatttaggtacagtcccctggtgtgtttgaagctgtgcactctgcaaacacataaataaaaatatatctaattggtttgtggcattttgagattttttttttcagaaggaatgtacttaaaaaaattaaattactgcagttttctttcagaaaattgggcttttgtattaaataatgctagtccaaacttaaaaataagaatatttaagcctggtaagcatctttgttctctcaataaaaagaaaaaaattagagactctctttctccctggcctcatacccccatcatcttctgaagttatatgtatatgaagtattttttttaatctacagggataccttttaaataaaatattcctttattatcataaataatctgtaaaacaaaataatagtggcagtatttgtaataaagtcctaaaagttaaatcatccttattatacttaacataatccaaaagactcctaattaagttttcctttcctaacttatattatcttatgatgatctacaataattttgatgatgttctcaaatgttcttatatctgcttctgaaatagttaaacagattattgaaaaagacctctgaaacaaagcaaataaaataatgcatagaaggaaacagcttttagtcttatctctaatggaatcatgttattgagttttctaaattatggaagatgtcaaaggtcatttagagctagacttcatgtgaagaattcttaacttgaattggcttcagaaaaagaggtccatgaaactccaaaattgtatgcttggtttttatttgtacatgtaaacaaaaattgatagctttccccaaattctgaaaggagtccttagctctcaaaatactgagaacctccattgaataagacatttgagtagggactttgtggtcagagatctgagtttgaatcccagctctgctattttccacctgtagggtcttggcaaactcctaatctgtctgagatattgtttactttctaataagtgcaggtaaataatacagaatttacaggttattgtgagagcctatgagatcatgtgtatttttgccctggcatgttgaagtcacacaataattctttcctttctctcggtttctctcttttaagatgacaggaatggttagctaaagcaactgagtgttaacatgagggttcctgctctattgcttgttatcacacatgggtacatataacagtgactgcctataggaagaagtcattaccccgggacagctttcactggtggatttttatgatggaaagcaaccgcattaactgcaatatggcccagggtgacacttgacatctgtatgttttatttttattaaaaaagtaatttaaattattgccttttctttttattatggaagaaaatgtaagaatgttgactgttcactaagccgaagattccctttttgctttcaaagcttttctcaaggacattaaacactcttcctaattactttttattgatttcttgacatttctactcaacattgactgcttatttttaggaaacaaagaagcctaagtgaaaaatgttaatggtgcatttgaaactacaaagttcaatattttagtcacgcctcttatatgtaattgtaggtaaaaactatataatatttttgccatgtgcctcagctctcttatcaccgaagtaaatagaaaattctgtgattctcagatttcttccatagctttaacttattttgaacaaatctgtgacttaccttgctatatttcaaattttattttattattattcatttttatttttatttttttgaaacagggcctcactccattgccccagctggagtacagtggcatgaactacagcctcaatttcctgggctcaaatgatcctcccacctcagcctctcaagtggctgggactatgggcccataccaccatgcccggctaatttttaaattgttttatttgtagagatggggtctggtactactatgttgcccaggctggtctcgaactcctaggctcaagcaatcctcctgcctcagcctcccaaagtgctgggataataggtgtgagccaatgagcctggcatattttattatatatatattttttgtctcaagaggttctgagaacatgtgtgcctgtatttcaaattttaaatgagtgaagataaggcttggcatagtcaattgaataaaatttagtaaaaaatcaacggaatactgaagagactgatgaaaattacacaaattaactcacattttacattgttcttccaattttgcagttatttgccattagtaaacactttaaatatgtctgccactctgatttttagcattatttttgttaggagtaactatgtaaagcaagtctgattagatgatcctcatatgtaatttaaccaaacgaaagatgtcttatgttaactatttagaacagcccatttatttaaatgttgctcatttaaattacttgacagtcaggaattaacttttaattaaggagtgctaccatcagacctatttttaagagtttcttgtgtgtgatttgcatgttatatacaaatgaggttaaagaaaattacaagtcaacaaaatgaacctaacatcaaatgtccctggagataatttttttattttatgtaatttatctgcatctcttatagaaatactttttttgtcttttctccctatctctttgttgtgtacaatcagcttttaaaggatccagtggtattaattttgcattgcggtcaatcagagatcttatgcaaatattaaatattgcacaggcatcataactaaatttagcatttcatttggaatagttccttgtgccataactccctgatggtgtttataactcagcatatttatatttgtatgtgcatttttatgtatatgcatttctctttggtctcataaaaaagtaaagtgtgtatttttttctaactctacagtcattactaaatgaaaattaagttgtttttaaggcatattttttaaaaggaaaatgatgttaatctgaatgaaggttaaatagaatcccttataacactctggcactatgtggtcacatcattgaatttctgataactttcatattatactttagtctaactactcaagatcagtttagttttctagtgtttaggaaagcttaatgaaaaatataagacaacagacaactagaaaactagacagataaactgaaacagacaacagaaaactagataatatagacagagcgttttccgtgaatgaaaactaaaatgcatcagtttgactcacagtggcctcctgccttctgctaagtatgcacaacctaaaggtaatattttaagtctcattctctgacaatgtagtttgcaaacatagagaaatattcagatgtagaagaatatggcttctctaatggccttgtttgtttttagctacaaggtgacatatatagttctggaatgaaagaggcgtcatcgggcagaatatttcagtggctgtattatgggcctagcaagtaacctgccttggaattcctctttattattttgagaacaaaggcatgccatttaacttttttcagcctcagttttttttttttttttccaactgtgagaaagagaaagtgtcacctatttcttgttaaggactaaaggtgttaaaatgctagaatgtctggcacatagtagatatttaatgaatgtcagtttatcttgtcttagctaagaattttcatgctttactatacagataactcttggattttatctgcattcatttcttctccaaaaaaagggaaccaggaagaagagaagcaaaagacataactttacaatgcctagctaacattatcaatgccaaacacctactggtcgtggtaaaaatgatttctacttcaaaagacaagattgctgtaaaaaatcattgctacactatgaagttatgctgtaatgttacgctatgaatttgttgtgctataaagaggaaagaagatgtttaagaacaaaacatgctatccagagcacacctccatttttgcaattacaaaatgtcttctttctttgcttctcatttctccagttcctccctcgtgacctaccttgaagatcacctataagcagaacatgataaatagcatgcccagtagaaatggtagttgtgagcacatttaaagtgctctgtgatgttttactctcagctgtattgaaatatagttggtgatgactcattctagaaatatgactattaagaatgagtacatttatttcttcaataataagaaaaccaacagaatggtaatcccagaatcttagttctacttttaacatttcacacccagtaagttggataacggatggcagagtgagcctgcgtaggtaataacttattattattacccttaccgtacatggcccttttccttgtacttttctccttgagccaataatgactttgatggttcagtctttctgcactttgtagaaaccatatcccaaacagtattttctagacatcaattctagcatgtgaaagaatctagacagcctctccgattttcatgcttctgggacagaaaagtatttatcacaggtaatgatgataatccagttaaatttgttatgcctttccttactttcaaagttaatttccatttttccattttggatgctgtgttttatggaaattgtctgtaaagagtctactagccttacatgtaatggtcagcagacatatttgatacctttctttttcctttagtaaaaggagttgtaagtaaggagcaagtgaaaagtgaaggggaatttagtatgtctcctatttggcagcaactgcgcatgctattcaatctttaaataatttttaaggaacttgtctcttattgtaaattatgtctggagaattagaagtgctacacataaaaattctgtctttggaatcagtacagatccatgttaacctcgttaaaatgatgacttctcatctaacttcaaatattcatttttaccttattaagtcatagagtttagctaagcactgagggtatgtcctttttgttattttgattctgaaatcctcctgatggtttttagggtagttatggttaagattttggtgccacgcctgatatttcctaccattactgtggtagtgatggatttcttctgtctggacctccgcttctagtggttctctgatctaagcatggttggaactttgtactgacctcatactatgcctagtcacagagcttgtaaaatacagccaaaattttattaattcagctatatctcttatctctagaattggatcatccatggctcctctgtcagagttgtgaaaatggtcagctttgttacgttgagcctgaagcactgatcccacaaatcaaaagaccacgtgactcaattcctagctcagtcatcttttctctttcgacctttgtgtatatacttagtgtacctgtctctcgaaagtgattccagcaacatagattacataccccacttaacagattaaatttcattagacttatcaacgaagatcctttgttgccatattgctgctatgatagtcctatataggaaactccagcttcccatcaggatttgaagctagactttaccataaattgcaacagctgccagcctgttgacccaagaaatgtggtgcattcaaaaagaaggaacaaactcagacaagtaaccagctctgtacatcaaaaatccttccggtttcggtaaactatcctgtgactatctaactttagtccctgaagggtattacgccttatttaccttacaaaactggcatcctagaccttcctaattgagttgaacttcaaattcattgtctaaatcctaagaaatgttgaattttcacaaaccccatttcctgcctgctctctccttttctcccatacatccaccatcagatttttttttgtttactttctctctgataattcatgagtaagtttaaaaaaaaaaaaatgtgtggccagagttttctgttttctgtagatattgctgtgggtttgcccatgcctagttccaacttttaaataaatatatataataatatatttatgttataaatatataatatatttgttataaatatattatatatttatataattaaaatcttatatgtaattataacataaatatatatgatattatatacatatatatatttctttttttttgagatggaatctcgctctgtcaccctggctggagtgcagcggtgcgatctcagctcactgcaacttctgcttctagggttcaagcaattctcctgcctcagcctccccagtagctgggattacaggcacacaccaccatgcccagctaatttttgtatttttggtagagacggggtttcaccatgttgagcaagcttgtctcaaactcctgacctcaagtgatctgccgacctcggcctcccaaagtgctgggattacaagtgtgagcccctccacccaaccgaaaagaaatattttgatgctatgaatgcatttgtcatttctattctgtttcatccatgtgttcttcttgtttacctttgtagtagtcatttacagtgaaaataattgacaaatgacatggtgttatgttcttgaaaacaaacatacaaacaaaaacaaaaaatgaaagcagacaaatgaacaaaatggccaagtaggtgtttaaaggcttaaattgagcaaagaataaaatggtattttttaaatgttaaagaatgatgatgtgttttaatagtattgttaactattgaatcaatttatgtttagtctgcttaaaattatatttggattcaagatggactactgctatcaattgattagattgaaaacaagcaagcaagaatctagacaacacaaatgggggaaaaaataatgagatgtattggacactttcctggctgtaggaaaagagctttgataaaaggagtgatgagatataattaagcacaaagtaacctacatgcttatttatcagtgaatctttcagttccagatcatttcttctacaaaaaactaaagaataaaaatcagtctttcagtcactgggtgacaggatgcactttgatttttccaggaaaggaaagccaggatcacaggcatgcgcatgcacacacacacaaacacacacatgcacactcacacatacacacacaagctcaagcgcgtgcacgcacagtactttggcaagtagagtgttagctccccaagcatgagcttcaggccagactcagtggctgtgatagacccatgcagccatttgacagattttgataacctttttattcaaagcagcatgaagggccaatgaaggattgctgatttttttttaagacaggatcttgctctgttgcccaggctggagtgtagtggcacaaacatggctcactttaactttgaactcctggacctcagtttcccaagtagctgggaccacaggcacgcaccaccatgctcagctaatttttaaaattgttgtaaagacagggcctcaccatgttgcccaggctggttgaactcctgtgctcttgccatccacccgcctcagcctctgaaagtgctgggattacacgtgtgaacaactacacccaactggattgctgaatttttataacatgtctctggtaactaagatcctttgaactatgaccattgaattcctaggacttgtgtgatctcagtagagcaatgactcacttccctcaggttttcagacttagaggaaaatccaaggatcagtctgtagtataatgctaggcatgaaaggcatgaggaaatgatgggagcctccagacagaaaaggtctcccactggtgactgatttctattcagagacaatgccatccctgtgattgaagctccaacacactgaaaaggtgtgaaaccaagaaaagtctctctttcaataaaagttttccatatttcaaaaattttcagaagtaaggatttcttaagggaaaagccatgaataaatcaggccctttttttttttttttgagacagagtcttgctctgtcgcccaggctggagtgcaatgatgtgatcttggctcactacagcctccgcctccctggttcaagtgattctcctgcctcagcctcctgagtagctgagtagcctcctgaggcgtgtgccaccacacccatctaatttttgtatttttagtagagatggggttttgcaatattggtcaggctggtcttgaactccgaaccttgtgatctgcctgccttggcctcccaaagtgctgggattacaggcgtgagccatcgtgcctggcctaaaccaggcctttttaaagaataggatcagaggtctggtttcttcttcttagcaaggtcttgttttcctggtaaggccttgttttctgcttagaggcatcactacaaccagcctgtcatctgtgaactcttcccttggtgggattcagaagtgtagctcctgcatatgtctctccattatgggagtcactggattctgtggttatttaattagaacatgcctcactaggtgttggctacacctatttgagctgaactagaaatgcaaattcctgctacacatattttgcattacaaagtgttctactttttgaaagcttttgagtaaatggcaaatctcaactgaagactttgactcttctacaggaactgcatggaaatgtgaggaaccgaattggaagaatgaacacagcctaccatttggttttcaatgctttgatttttaggtggctttgtagtaatggatggaaagaacaaagatctgtattaaacacatgcttgcagcgtctacaaaaatggtttatgttttaaaagaagcaggggaagacctcagtcattctgagttattacagctccaggagatggaagtgttttattagcccatatatatatagatagatacagtgctaccaggaaaaaactaatgaattataactaaggtcctatgtatggaccttaatattccttgtgtctgacgatgcaggaatttagccaggcaagctgagataaggccctaacctttgctctacttttctttttatgatcttcttccacatgcccttttttggtttaaatataaccaagatgatttccattagatttttctaacaactgcatgatgtgtgtgcgtgcgtgtgtgcatgtgtgtgtgtgcatgtgcgtgtgtgtgtgtgtgtgtgtgcatagcagcaaagccagatgatgatagcaggatgcagaaccccaattttttttaatattatgtaatgtagaaaaggagtgtgcacacctgtttgcttccttcccattgaacaacattaggttgaaagccaacagtagaaaaacaggtgcttgttatgtttgagtgtggagccccaaaaatggaaaaagaagaaaaagaaaaagcaccgggttttagggaaggcttctttaggcataatgtaaagttaatttatcattttggccctgttccactaaagacacagaatttgcggcaatactacctccccatggcctatttctctgaactaaaatgtacattttctttagagaagcaagaactattatgaccagctagtcctggttttgggtggcgggggtggcaagaaaaaaaaggaaatcgttttctttaagtaaagcacttaaaattatatgtttttttgaaactggttttattcctgttcagattggtcatgagtgaaatgacgtagagtactttaaaaagttagattttcatgtgttatttggttaccatagaatttgtactggaaacctaacagcagatatacatttaataacacaatgtattacagggagacatgttttgctactctgatcgtgaacttgggaacaaggaactcctgggagttgtgggaaaatatatggactgaaattagccaagtgttatggagcaagattcatatgctcaaacctacttttactgcttcgttgctttccgtgcagcaatttctggcctcagtgaggaaaatgttgtgtttgtggaaacataaactggctatttatgtccacaaccatcacacaaacacagaactgcagtgatttggctaaatggtatatagcaacgtgcagtctggggttttagagaggcgtgtttcaagctgcatgggcgacattctaaggaatattaggctttttacctgcaaagccactgttcaaagaggcctggctcaaacccgaaacacttggaagattgtgtctaaatcctagaacccactttttgctacacttttagggaggctccttgcctcaaagtactgaaagtttagattgtttaaaacatttgtcagaaatcatttcctggagtgaagatgcttctataactcataggcacatcactgccttcatcatctctgtaaaaaacatatcatttcaagccaactatggtattgtccatcttaatgggatcctttatatcaacagacacgtagtctagtgagattaggaaagcacagtgacagctttacctgtaacagacgttttagtgttaccggtgagtattgcatattgagaatgggcctcagttcctctgttaacatgatgagtgtttcctagattgcgtgaagagtaatgagaaaatgtgtgataagcagtttgaatgcctttgaaagaggtgtagtacaaggtgtgaaatacaaaggaactccagcagttagctcttctcaaattttcatgtatataaatataaagtagtgtcatttcctgaatatgatccctattctttttccatcattttcttgcaaacactgttatcctcaaaccctcttctactctcacctccttcactagtctcatctccatgttttcccgttccaaaggctgcaggagagaccattagtttcattaattatggccctactcaaaagcctaactctcttcatggcctacatattaaacattaattccaaccagattatcaatggcttctctggtatggttgcattattattttatagcttcattaacttcacctccttatttataatccatgtcctagtcaaattgaactgctgcctctcaccaccaaacatgacatttactttcttacctccgcatttatttgttttttccctttagtggaatgccatcttctcccacaaccataggccaaattcaccttcttaatatatgactcttttaatatagttcccattctcacatttattgttaaattcatgcctgactgacctaactgattgatattttctgttgctgctgtgaatatgatcacattatttcactgggttttcttgatggttactactggtatccaaccatatcatctccagatcgtgattattttatcttctcatcttctaaagctgtatcataatttttttattcctgccttactgcattgattagaacttttaagagcaatgctgaatagtagcactgatagtcaatatcctttacttgtgtttgacagtcatggaaatctcccctagagtttcactgttaaggatcatttagattattagctaaaagcagatattcttagtgatacagaatatcattctagttttacaatataaagacatgttttgaaaaacctaaaatcattatatttttgcatttttaaattttaaatataaatataagcatatatttaaacaagtacatatataatatccatttaaacatgcatattaaaaacctgaaaatacaagggattgtgtaatgaatctccatgtagccatcacccacttcagccgttatcagttttgtttcatcttcatcccagtcatttcccttctctcttactattttatagcaaatcccagacatcttatcatttaatgtataaatatttcagtatgtatctctaaaagataaggactcttctatttttaaatatatccataacatgtttgacacacataaaaattaatgataaccccttaatattattattcattatctaatccatgatcagatttcctacatttgtaactgtttgaatcaggatctgaataaaattcacaaccattttgattggttgctatatttcctaatgctattttaagtgttgatattcgaatttttctccttttttcactctttgtttgattctagccctagctccctttgtctcttttttctacgtttaacttttttttaaagaaaccaggttgtttgtcctgtaaagttctctgggttttattgcatcccctcttgatgccacttaatttagtccctgttggttacatgtatgtggatgtttgattaaattcaggtttgatttttaaagataatactgaatagttttacaaaaattgactttctaatttcatcaaaggttgattcggtatccattgaaatgaccatatgacttttatttgttgatgtgccatgatgtttttttttaaatttgttgaataagataatgaatttaccttatgatttctctcttttgacctttcagctactttcatttctaagtgggctttagttggtgaataaattaacatgtcattaaatgtcacatggtaatttcagtagcttgttgaataactgaatccttgattcttgttggatgttcagtcctctttgttttgatttgttttgcttggtacgaaagatttgactagtttggaaagtgacaggttaacattttctacattgacttgaccttcttccacccaaaatgatcctggtagaaaatgcagagtatagtaaagaatgtgtgccttccacatttagcctggtgaggtctataaatatatcaaattaagccagtcagatggcctgctgatatttgctttgcaggctagacggattgtactcctttagaatctaagtattgatggaaaaagattcaagggacagcttgaaagtttgtggactccggctatggaaattttatactcatataaaactgtcagtgattagtagaaaatatgtagcagaactgtgtttctggaattggcttctcagctaagaaaagattattggctttgtgaagaagaaaatgtagctttcttgtaactccatttagtcaattatccactatgggaagatacttttcttcttctttggaaaagctatgacatcctccatggtattcgtatcattgagatgtttctcctgagaaatagtagacttaggatgattagactgtgccatgagtaaaatgcactgtctgaaaaaaacagaaaaaaaacagcaacttgtaggtttgaaaaataacctttcctggcaatcttattattctaaggataacactgtctaatgacaccaaatcatttgctcagccactgctgggaacttagaatctgctttctgtttagctacaaatgagatcagtgttacaacaaaaattataattttgttttatcaggagaaacacccaaaggtcacttttcattctgctgaataggaagaaatgatatcagggtctgcccagaaagcttgtaagggagaaaggaatcttacccacttaggaagcattttctaattcacttatgtgaccttgggcagccttcccctgtgcacttttgtgaattcttagctagaggtattttactaaagactgcagaactattcttttgagatgatctgtatcctcctttaaaatataggataaactataaaatgtgctaagatccttgatagtcctatcattctatatatgtttgaacaatgccaaagcccaagttcatcagttaaaccagttaatctccattggcccttggtgtcaacttgttctttggacaaagtgtcaccttgtaggaagtctacaaacctctaagtgctcccagcgtattagctaagtcctgagctccatggagttggatgccctaattctgctttagaaagtcctagttccattaaccgtctcctgagaattctcctggcttccctttttgtttcttgagcagagttcagtcaaggagaggtcaagagagatgatacattacttccagtcactgtattggctctgggaacctccaactctatgcaggttctttgatctcctctggccactttctttctttttcaagtacatatttgctattcagcaaaggattgaatgacttctcaggaaaaaatgccaacccagaatgacaaggcttccgtggttctgagcctggctctgaacctttcctttggaaaactaatgactccacctatcattcccttggcatctagagaagctacattaggtggcacagctctttctgctcagcttctgctccagagcttcatcttcaggaaccacctaagcatttttttccccagtaggagttcagtctgctcattatacctaattgcaaaggagctatattcagagcaagaataataatttcagattttttaactggacttcaaagagcaggaaagtatgcagattcctaaacacataagcattgaagatattacaggtaaggttaaaaaaaatctgtaattttgtagtgactagcagtttaatattcaaacatttaaaatgtgcatattttattaagcaaatggcgtagagttatttggtttaattttctgtaagtaactcgtaaagaattgtcctaaaagctgtgggtgaggactaattcattcaagggaaacaggatctaatgattgctttgtgaggtatatatacactgtatactcatgctaattcctgctaattgtcaaagaagaatagtggctttttatcagcagtttgcatttgtgtaatggtcctggtctactggttttgtctacttcactgataaggaaaacaccacttaaaacaagcaagaaaagcaagccatcctttacagtattattttctttttagcctgtcttgagaagaaaaaaacctagccttctacaggaaatactgtttgattccatgggaaaatatttagtaacaagcagagaacacttgattatttctcagctatttattctgagtatttacaaaatgggcaatagtattatttccaaaatcttaagttgtaaacgaagtttatattacagtctacatgctatggatatgacactattttaaaatattttatactttaaaaaattgttataacacataatacataatattgtaagtaagtttaattcttgtaatttggaaattcagtcagaaatattaaagaattatgtagatcttgaaagggtaaaataatcctgcatttatgatattaatttctcttaaattgttcaattttattttataaggaaattaagtggttatacatttttgacaagtagttttgataaagttaaacacagattattgatatttacttaatgctttataatcactcaatgattgtcactccaaattaggccatcttttttcacattttgcagaagaataatttcctaagaaacaactattgaggcttggttatatatgtaacatttcagtctgggcagaatttctttttttacttttgtttgctcaatatttatgtcattagtaatagtaacagtatcatatatttgtgtgcagtgttgcaactgacaaagtgttttaataaacttggcaacaaccctttggtatccatttttgcagctgaattttctaagacaggtagatagagagaagtcccacagctaataattggaaaattgtgccttggacctgattcttcccagccaacttcagtgttcatttcagtacattttatctatgaagggtttcttctagggagagttggtcatggtcttacaatttttaaccccagtgattttggttgttatcattatgtcttgcacataataaacagtcactaaagaattgtgggtcaggcgtggtggctcacgcctgtaatcccagcaatttgggaggctgaggtgggtggatcacgaggccaagagatggaaaccatcctggccaacatggtgaaaccccctctctactaaaatgccaaaaaaaaaaattagccgggtgtggtggcgcatggctgtagtaccagctagctactcaggaggctgaggcaggagaattgcttgaacctgggaggcagaggttgcagtgagccaagtttgtgccactgcactccagcctggcaacagagctagactccatctcaaaaaaaaaaaaaaaaaaaaaaaaaaaaaacaattgtggaaggaggtgaggaaggaaggacggaaataaggaaggagggaaagaaggaaggaaggaaagaaagaagggagggaggggcaggctgaaaggaagaaagaagaagggcatgaaggaaggagggagtccttttgtgtggtaaaggatttttggaacctctaaatgataatagtagtcccccagttctcagctatttcagagaactgtccagcttccccagcaatgatcatttgtcctgaccttttttgccaaggcaaaccaggtctagagtaaaatactacaaaatacattctctggtattaaaaaggaatggccaaaaccgtaattacttttgcaccaacctaatagtaagtttctgctttaccttatactttcttccttataatactgtagttgttgacataccaaggaaagtgtgtttgggataaagtggtcacataaatggcaaacatcaaagtaatgtcagattttgtagtgtttctaattgctgttcattttgtagtcactagaagacaacttacaaattgtgaaaaactagtcataaatcagagggagacaaggtttagtgagatccagttcacctccttcctggaacaactattggggggtatcatcttttatatattgaaacatattttatcttccaaatctttagtttacctttaatacaactcctcccagcccccccagaaagaatgctgtttgctctgattggcataggaccggctttgtcggtttcattacatcctggttgaattaccaaatggaaactgatttaggaatactgagtgtgtacggcacagagaaaaaatatcactgcgaaatttataggcctgtgtaagactgtcagggccctgtgttcaaataaagagagcaaaaggaaacctggcgaaaatcaccatctccatcccggcttcttccgacaattacaacttattcctgtgcttggctgctggtttggagcagctgcatccactcaggtaacacttcgcatcacctgggagctcattgttgccttacaattcgtgatcattttttgatctcactactgctaaaggataaaagtgctaagcataataatccataactgtatgagatacttgctacttcatttccctccaagaatcattttgctatgaaatatcccattactagtttcaggtaatgatctaagaattttttaaatgactatgtcagagctaggggcttcaggatagcattacaaggataatcatttcagagagttatatttttaaggccttttaaaaagagggttgtttctagtttttaacatatttgttaatcttattttgatgatctcataaaatcagagtctaaggaagagatgtgtctatgtgttgcttatgtcactgcttttttttattgtttacattttataaggagtgtctacatttgggggggagttggaatgttggttttgttgtttttagcaaaagccttggcatttgtcctgagagagctcatgcagtgtttgctgttcaggttgcatgaagggcaatctttagcaacctgtcagagatgcaaaggccactagggtctgcttgaggttcagagttcctctgcaggactgcgtggtgacagcacaccacaggtggcccattcagcactgtcatctgggacagcaaggataccctgctccatttgtcatcctatggaattctgtcagcagttgaaagcctttcagcacaaaacctttaacattcgaggcaaacttcctaatttttttttttttttttttttttttttttgagacagagtttctctctgtcacccaggcttcagtgcggcagtgcaatctcggctcactgcaaccaccacctcccaggttcaagcgattctcctgcctcaacctcctgagtagttgggattacaggggcacgccaccatgcttagctaatttttgtatttttagtagagacggggtttcaccatgttggtcaggctggtcgcaaactcctgacctcatgatcctcccatctcggcctcccaaagtgctgggattacaggcgtgatccaccgtacccagcccatttcctgatatttttaaaggcaattgccgtggatgaaaatattaatacatagcacctaaataagtagttttttacatgaaaggatattatgttaagattatatgctgtgtgatatatagaaatgttgtatactccatgattttacagaccaaacaatgcaaatcatgtttcccctcttcttaatgaagatgttaaagtataactgataattgatggtaaaaatcacctgtctactcattctttcttattccttttgtttagtttgtttgctttgtaagcctggaaaagatgccttgaaatgtattttgaaaatagctttttgttggagtaataaaaaattagtccaattcttatttatccatagtaatgattccagaataacatgcacatccttaggaataaagttctcctttaaaaaaataaataaatagcatacatctttgaagtccccagatttccattgtcaagatttttctctcttatacatacccaaattaagagccttccctgcttgcccattaatatttgctattattcattgaatgccaatttttttttgccaattcctttatctagattatttataacctctacagaattctgtaagagtgccattacccctcttttcttaatgggaatattgagcatctgagtggttaaatgacttattcaaagccagtaggagacaagacttgaaccacatctgtctccaaatccaagttgttttgagtgtcttttgctgttattcgaaaaagccatgctgagatcaatgaaaggggtccaaaaacatgccttagacaggataataagaggtaagcaaggccatgagtaattcagaaatggaataatcagatattgagtattccagtcagatagaataaaaatcaagcaggggagaagacaaaattaggttatgtgtcacaacaaaatgtagactttcgaaggaaatgaacaggaaaggcagaagaaaatggaaaagtaatacatggcaggtcaaataaaagtaaacaaggtcatatgaaactcacatgcaaataataaagtagaaactagtaaggaagacagaaaggaattaaaaaggaattaaaaattcataagaatgttatcagtagacaagacaaaaaattgcctctaaagatggatttttttttttttcctaaaagagtatatagaatctgtactggcttgatatactggttttgcttttcatcctgaaaatatcattgataaacattgtgtatattagactatttttggttgggactgagtattgcccatggtgttcccaatgatatgagaagaaacatcctggtactaaatgccctggtggcctggggctgagagctttggctttgtataattcatgcacccactttcatgtaacatgaagtttgacaagtgaatattaagttcattatatgaaggtgttgcaaaccaaacttgaaacttatttctacctctcattctaaatggagatattttgtagtgctttagtctacatttacagtgatattagactctttccatttccttaaaagtatgatggcgtttggacattcaaccatgttcctctaagaaattagagtagaaaagaaatttagaagagaatggcttctaatctgcatgttgatatgtatctgactaataatctataatgttttcatttggaacaaataagccaacttgtgtttctttttcaatatatacatcatgtctaaaaaatgtaaagtcaataggcatgtaaaacatttcaaaaataaataattttatcaattgattgccattaaaaatagatgtctaaattgagctgcactgacatgactttataccattaccttgaaccttcctgagaaatgtattttgcttaatgacaatagagcttctcttttccaactacctggaagataaaatattggttaaaaaatgttgagcctcttttcctatttagttatagtaaaattagttaactctataattctctcttttataatttgattctatgtagtgagaccacaaacagcttaacttctctgctattgtttgtaaggtctgcaagtttagtgaaatctgtaccttatatgaactcttccttttaggataatttaagattaaaggctgcttagaagggggaaaaaaagtccatgttaacctttctcctttctctcctcttcagctacatctacatccaccactgggacaagccatcttgtaaaatgtgcggagaaggagaaaactttctgtgtgaatggaggggagtgcttcatggtgaaagacctttcaaacccctcgagatacttgtgcaagtaagaaaagaaatcctgtgtgtcgcttatgtctataactccttgtttcagatgattctatgtctcatgatgtattgttgctttttttccaattttgttgcatcatgttgaataatgctgttttatatgtagagtgttttaaaacattcacaccattcgtcatcactcctctgtcatatgcagaattgttttttgctcttttcaatgtgtgtgaggtgttttttgtttttgtttttgttttttgccatgttatttatagtgttgctttccttgtggtttttcttgttgttattcagaaaagatgtgcagatatcacagaggcctataacttttggtatctacttctacatccaatgtatgaattaagctgtaagataatgttgctttcttatcccagtgatcacctgccaaatgaataagacaacaaagagaagcagaagggcagaagattatttactgacatatatctattacacttgggattgtcttactgttgcataactattttttaaacggagtttagttttatattgctagtaaaaaaagagaaaaaagtaaattgcatatatttggaaatacattgtatgtagcatccctgtgggtgacagcagtgttctttcatttgtctatagatatatctagaatagcactgtctttccaatgacctgaaggagttgatgcaccattaagaagtatccaatttaggcctgggcacagtggctcacgcctgtaatcccagcactttgggaggccgaggcgggcagatcacgaggtcaggagattgagaccatcctggctaacaccgtgaaaccccgtctctactaaaaatgcaaaaaaaaattagctgggcgtggtggcacacgcctgtagtcccagctactcgggaggctgaggcaggagaatggcgtgaacctgggaggtggagcttgcagtgagccgagattgcaccactgcactccagcctgggtgacagagcgagactccgtcccaaaaaataaaaaaaataataaaaataaagaagtatccaatttattctctctcaacaggcagcgtaagatagtgatagtatcagtacattaaatatttaaaccttgtagtaaaaactaataggactcattaaaaagtatgtttattttgccatgcattttaagtttactgttgatatttagtctacatatggtatatggacttaaaatttgatgtgggcataaaaatatatttaatattttattgaaatgatgaaaatacacctttgttttcctctttaccaacagctatatcccaaaagcaaggtattttaaaagtcgttccttaaaaaatgtaatgtagaacatctaataaattttgccagcagtccccagcgaaaacatgcagtggggacattattctaaagcagcaatgcttgttctaaaggagggaaaaccattttgtcacaaaaactgttttctgctagaatattggcgtgtgacttaaatcttgacaaggaagaacaagtctgttagagaggcaattgaactgataggagcaattagcaaaatgaaaaaggcaccagaaatagtcaacaaagccatgtcccttttacatcacagaaatactatataaatatttaggtgccaattctaataaaatcttaattatatttataagtaaggaagtgcatcttaaaaaacatatgttttaaagacaaaaaaagcaacgatcgaaaatgccattttgtaggccatgttttgctgctctctgagctgtggtagattgggcgtgtctgtagcgtgcctgatgggacctcatggctctgaacaagcaccttccagaacttctcctttgttgcactctaaagctcttctttgaaaaaagtagatacagtgccaagacaagtgttggtggttgtatagctgattttatcaaagacagacaatttgtaaaagtaaatgtaatctgttagagtgaataaaagacttagagccagaacagtaaaattctaatctcaattactaaacatctctttcacggaaataaataatttttataagccaaagtgaaatgataggtaaaagtcttgcaaaaaatattaaagcaagatgaaatacgagtatgaggccaggtgcatgcctgtaatctcaacactttaagaggccgaggcagacggatctcttgagcccaggagttggagaccaacctggacaatgtagcaaaacaccattgctacaaaaaatacagaaaaataattagccgggcatggtggcatgcacctgtagtcccaactattcgggaggctaaggtggggggatcacttgagcccggaaggttgagcctgcagtgagccaagatcatgccactgcagtccagcctgggtgacagagtaaggctgtcaaaataaataaataaatagaataaaaaattaaaaaaagagtatgtagaaaagatcattccttttagatctgaattatctcatacgactatgtttattgtttaaaaaataatcttagagattcacttcttggtcactaaaatattcaaatctatatgcttgcagcagaataaaaatctgtctgatttagtctttagttctgctgacttgctgtgaatacagcacaaatatgagacatccccatatttatcatagcaaattgggatgaaccaggtttttagtttgtaaggttttctctgatcaaaatagaaaatgccagaagctgagaattgtaatctataaaatatgaggttcatttgttatatggggaaaccttgttattttttcctaatcttaagcatacagtgtaattgtattttaataaatctccttgaaaaagcatttaaattataggtccttaaattcttctcctttttaaacagtgtacccatattatctatgtctcatatttttacttcttcagaaaagcatctgagaccactatattttaattatagtaatgaaatatgatcatttttcatcatcacttagcaaagatttacaagctgagtgagtgcatatgatagtttctgcatacctctaaggaaccagggcagttcttttccacatattaatttcagctattctttagccctcccacgtccaatacaaaacatgcaatcgcgtaagtgctgttcagttttttcattttaatattgtgccaacaactgcaatttttcttcactcaacacagtttctcattaaatcttaagcctaatccagtagtaaaaacgtgctatattttaaaaatcttgaagtgaaacatttgttactcttctgataattattaaagccccaagccatcctctgagctaattgtctagtggatcattcttgccttctagttctaagaaattacaccttttttttttttgtaattaggatcttttaggtaagttatttaaattattactggatcttatcagaaagaaaatctttgacatctatgattttgataacttccccctcctttgagatggtgactttattcacatattaaagcaagccagaaccttgagggaagaattggagagtatattttacatccaaaatacttcaaacctttctcgttacatgaaactgtttttatttttttaaatcctgtatgtaaaatatgtatagcattaaaaataatcactagtcagaatttaaacaaagacataatatactaggtcttatgataatacattgttcactagaccacttgaatagaaacagaagacataaaaatattgcattggctcatcatggtcctgtctatgaagccagttcatagtttccatatggtctatctgtctagagctaagcattgctgaagcatgagccacatcattgaaaatcagctttatccctgactaaagacatgactcagaaacaccacaagcatggaagtttccaagtagtctctctggtcacctaatctgctgttgtcttcttgggagttgaagtagaagatgttacagcaaatctcttttgtctctctgcttagaacaaggtgtttcgaatggattaaacatattaacagtgaaaaacttctctgaggagaggtttccggattgcttggacctcctcctggggactgtgtgggaatttcagtggtagttctcatcttttatattttgtttctctacagtaatttaaaatttattctgtggaaaaaatagttactattccagattataaaaagatgagaaaagaatcattccattttgtaccctctgatgctttatgtagtcctgtggttcaaagaaacaagacacatgaaatcaaacatgaaattgtccagatttcctcttgcatcttttctctattcttgtgtatctgttcttctgaacagtttcagtggagaactactttggaagatgttgatgtgattttttttaatctaaaaattattttatatcaggctgtgcttataagtccaacatgttgtccagtggacagatgtgccttcatctggaggggattagagttttaaactaccaattttggtgaacagtcttatgtcctttcacttcaactctctggacaatatatttatttataacatgaagttaatatgttctccaaatttcttcccagggagtcagtgaaattaaatgagttcatttctgctaaagtacttttaactctggggaagcaaaatttatttttccttataataaaaagtaaatggtagtattacattctctcagtagacattggaaaaatatatacacctgttttaacagactgtgttatcatgtttaatttctttttttttttttttttttttttgagatggagtttcatgctcttgttgcccaggctggagtgcaatggtgcagtctcagctcactgaaacctctgcctcccaggttcaagcgattctcctgcttcagcctcccaagtagctgggattacagacatgcaccaccatgcccagctgattttttgtatttagtagcgacagggtttcaccacgttggtcaggctggcctcaaactcctgacttcaggtgatccacctgccttggcctcccaaagtgctgggattacaggcatgagccaccatgcctggcccatgtttaatttctaattctttattttacttaagagtagcagttttatttggtttgttgggaccaccaactatctttataacttttctttgacagatcgtttaatatttctgatcattagtttccttataatgcaaaaacaacaaaaaacaaactaaatttggaaagatggaaggtatctgtaaacatagacttttataattttgtataatgaatgtttatgaagccatgtagggccttattatattatacattattataagagacaggtatgaaaaacataactatgggagacaaaatcacagcaaatataatactttaagtttgatagataaaatatttatcaaacgtatttgataatatatataatgtaaatgaaatatttatcaaattatgcctgaggtcgcaatttttttaatttttgcaatcagaccttggcaatgaccttgagcagtagggtattaaaatcttccacaggcttagcgtcccaataatggaacactaagcataaatggattaacatttgtttatagaacagctatttgccaggcactttttaaaacacagagaaaatataaggaatggtgtctgatctctgggaactcagtctgttaaagaaaatgaaattgctaaaatagaaaatcaatgagtgaatatatgccaaatggtacaatgctgactattaaggtaatacaaatttaaagaagggaaagaaaagactgaaataagttagagaagactttttaaatataatcatcatttatagagtctttcctttataccaggaaggcattgtggttgtaggaattctttctctgagacacggtaacatgcagcttaattctaggaagtaaaacaaacaaatgaacaaaataaaagaactaagttaaacagtggagccacttaatgacctctgaaggtcaggcagaggactttgggtattgtaatagctaacagggagccatagtaacatctggagcagaagagtggcaccatagacatagcagatgtttagggaagcgagtcttccttacaggctagaagaagtctggggactaagtaagatggaaagagaaagtcaaagacatcaaaggcactagctaaggttaacattttataaaatactgacataatgatgctgatgatagtaacttttataatatgtattagtagctgaattaatataattaaacaagggggcaacggtacaaactcacagttgtgtcctgcagtctcatcatcatggctgcagaaagagaaatttggaaaaaataaacaggactgggttagaacttccagtctataagaacacacttttgttgtatttgtagtatttgttgtatttgtagtattgctgctaacaccaataccagcctagaagagttctttctttagaatcagtgttacacttgcctgtggtacttctctgttcttgaatattgtaacatttaacagatatagacagcatttgtgagagcaagtggtgggactcatgtggatctagatagtgcgctcttcagacgactgtgtcctctatttctttcatgtcctcatatatctagaatcctactatgtgcttatgaggaatttattaactcatttagacttttaactcactgaagtagggttgaagaaaattctttagtttttataggattcagtttaggtgtagttttacctaaaatcaggtgcattgtctaagtgttctgaatagcttcattcctcacttataaaaatcagttgagcagccatgtacatttattgaactcatatgagacaggctctgtgctcatgctacagacaaagtagtgaacaaaaccatactggtctttgcctgatggagtctgtaggctactgcaagtaacaatcatgtttcatgtaattaattgaattataaatcacaggtttgccaagtgctatgaaggatattaattgagctaagggaatgtacaatgaaagacctagtcagaggctgactctgctctgtggaaaaaagaataaaaaaagagtatgcagtcatactcttcagatgtatatagagtcaatttaaaatatttcattgtgtatatataccacattttcttaatccattcatctgttggtgaacacttaagttgattttataagttggctattgtgaatagtagatttttttataacttggctattgtgaatagtggattttataacttggctattgtgaatagtggatgaatattttagctagattgatttaattattcaacgttgtattcataaatcataacatcattttctaccccataaatgtatacaagtacaaattgtcaatttacaggaaaacgaatacacaattttgaaatatttatattgaatgatttaaggaaaaagtgaatatttagatgttttatcacagaatgaggctggtgaagtggataaggctataaagcccctcagaacccctaagctgtttgacgagacagggaaacttcctcaagagaggaaaaccaaaccacaaattagcagtcgatatgtcattgtgtcacaatgacgtggagatgtatgggatgtagattgatcccacatccaatgaaattgtttgacccccaacttaaggattcatcatgtagagtaaacatgggcaagggttttagtctttctgcagatgagcatttcagagcaagctgtgcaaacagagatttaggaagggcaccaaggttcaaacaagaagttaattcacaaacaccgccaccctcattattgggattatatgtcctggacattgaaaaacaacatttgaaaaggcaggacaagttaggtttggtttggttttgtttttttctcagcatttacccatgagtctagtgtggccactctatgtatcctcttatctcatggattggaaactagtccccagattgtcattaaaaaaaaaatggaggatatatactgtctgaacagtggtggtgagatataggttggatctgaaggaaacattactggaacattttatatttaatattttctttaatgatgttaaagaaggcattcccttggggaaataaatgtcttttgcagatgatgctagaaagaacgctaaaacacaaattagaaaagcatatgcaaacctcaagaaacttcacttaaaggtagataacagaatgaggttcatcttggaaaaatgcagactaatagtaacaatacctttgggaaagaataatctacaacacagatactcagccagtgagtgggcgagttctgggcagaatgctgagctggctaagaggtgagaaaagtcaatgtttgcaacacgatactgtaggaaaacagaccagcatagttggagctggcgtagacactgccacctcgagtttacacagagagagagcaaaggctttggtgtctgatactttctcaccaatattccttgatagagatttgttgatatttctatcatttaatatttgtaaacataggcatcaaataatttcaaataccacagctagtattgaggaaaagcagacagataatagggacttttcatttttcgacaaggtattttttaaattgtccaaatatttcactgtggaatgatgactagagagagaggaaatatcagctgtatttttttttcttcctcttgttcctgatcaagggagggtttgatgaaaatgaagctgagaagagaaaggatgtctaaggatggtttataaattgaccataaatgtgtggtttataaaattagccaaccctaactagaagtttcttggggtccgtgaatatctataaaaacgtctagaatctccaccaagaaaaaatggaaaataatttattcaattggaatataaaaaatacaccaagcattaagtttatttcaaaatacatacatctatgattgattacatagtaagcatatcaggatattaacagtatattgaagttattattaaccacagtttttattatactggtgctgggcagaagtttggttagtagaatgcactgctttattgaatctgaagtaaactggtatttcactaatagtatttaaattcaagataacagacttacttttaaagaatcaaagaatcttttccaaattgcaaacatgatgttaaaggattttattggagggagggagactgtgagaaggatactgggaatttctgtaaaaattatttgagggcaggcacagcagctcatgcctgtaatcccagcactttgcgaggccaaggcgggtggatcacctgaggttcaggagtttgagaccagcctgaccaacatggcaaaaccccgtctctactgaaaatacaaaaattagctgggcatggtggtgcatgcctgtaatctcagctacttgggagactgaggcaggagaattgcttgaatctgggaggtagagattgcaatgagctgagatcttgccactgtactccagcctgggtgacagagcgagactccgtctcaaaaaataaaaaaaaaattatctgggagtccacagaggagagtgtatcataaactataaaaataacagacagatgttcaagattgacctgtgcttgcaaatcaattaactgtatgacaatcttcctttttttttttttttttttgagatggagtctcgttctgtcacccaggctggtatgtagtgttgtggtctctgctcactacaacctccgccttctgggttcaagcgattctcctgcctcagcctcccaagtagctgggattacaggcgcccaccaccacgcccaaccagtttttttatttttgatagagccattcaccatgttggccaggcttgtcctgaactcctggcctcaagtgatcagcccaccttggcttcccaaagtgctgggattacgggtcttagccaccacacctggcctgaaagtctcctttgatacaattgtggatcagatacggacgctgtggtctgatcttaagttcattttcacggacattttgtgagagcctattatgagccaggcattgtgctaggcattagagatacaaaatgatcagaatgtgatcattgtctgacagaatgtgatcagtgtgtcacagatcatcacaatacagataagtgcagtgaaagaggtcaggatagggtgcaatacaaaaggcaaggagagaattctccccagagcatagaagtgggtgatggggaggtggaggacagggaaagagtgatgcctaagttcagaaaaaactgtgaattttcaccccattaataacaaatatagaacaaacatgatcatgttaagagcaaatactaaaatttttaaaaaccctgatttccatcttctaatctgattaatgaaacgaatggtatatacatacacacacacacacacacacatatgtatatatatttaaagctacaacaagtacttgttattcagatccttagattgttctcagacataaaattcttggaatttgctcaaactcatgccaaagcttatttttcaaactcaggtttgatttactgttattcttatcttccaggaaagtgatggattgaatgtttaacatacaatgttgataatagaaatgtatcagaagccagtctccctagtctgttagaagtaattccacagaatttcacagagcttatagatcaactgggttttcatttgcatgtgctttctctacacaatcaatgcagtgtgcagtttgcatatgcagaaactatctcagtttctgcttttcccttccatctcatttggcaacaaatttagatgtctctgaaggctacatccttttgttgctgaacacttgagttgcttgggcacttgcagtttgttttacctcaacgattgtcttaaaaatccattttatcaagaaggatttttagaagtcattgagttctgtcgtccctgactggtaatgcattcagaagaaatgatgttggggttttctagcagtgattccatgtgttagaataagtatcatttcccagaaccttagtgggaaaagaggtctttgataatcacttaattacattccttcattttatcactgaggaaaatgagaccccgtaaagcaaaatagcgtgtccatgtgcaaacagcaagataccacagtgccgagagagggcgtttgcctcccttttcccagttcagggcaccttacgtcttgaactttaatctacatccacatctcttagggatcttgttaaaatgaagcttcttattccatagttctcggctgtggcctgcgtttacactagcacactcctaggaaatgctgatgctgtcagttctaagtaataacagggtcttataacactaagaaacaatgctgagaaaattcatctcccaaatgaagacaaacactagcaaaaggatagttctggttgagaggtagctgctatttccaaaaaatgactttcatacctcaagtagttctggtgttagtgcacccagttttccgtatgattttatgatagagataagccatcatcttatgctagcttcctaggaaacatcatgttagaaattcatagcagttagaaaattgattgggtaggatttctgactccctttacctagttgtcttgtgccttctgatcacagaactggttataagatgcctaatgacaatttccttataaatgccttccttctcttaaggaactcgtgattccttagctatttgttaatttaatgattcttactaacgtaagggcatttcctgccttgagcaattgtgtggtgtgtgtgtgtgtctctcttacacatacacagcgtgttcacatatcttatactatgttcttttgtaagaaacaaatggattatttgtgctcagtatgagaattttaacttttatcaagaattcaaagaagcaggatggaatgataattactgaatacatcattaattctggaaacacctgctttaattatagggtttgtctatatgaacttatagtcctggtagagaaacaaataaaaaccctatttacttcagaaataattttgtcaaataagttatatgaaaaaagttcccatgtgttttttcttatatacgttcagtaagaatgtgaagacattcttattgaagcatatgaaatggcgtctttttgagaaatgacccaacctcttttttttttttttttttttttgagacagagtcttgctcttgtctcccaggctggagtgcaatggcacgatctcagcttactgcaacctctgcctcccgggttcaagtgattctcctgcctcagcctcctgagtagctgggattacaggcgcccgccaccacacccagctatttttcatatttttagtagagacagggtttcgccatgttggccaggctggtctcaaacacctgaccttgttgtgatcttcccacctcagcctcccaaagtgctaggattacaggcatgagccactgcgcccggccaagcttatacttcttattgacatgtttctcaaggtagctcttcctctattccctgcagcaaaaatattctaaacaaaaataatccgtttacttatatgaaggtgtttccaagagtttgaaagagctgtgtcaatataagatgtttgttgtttaagcttaaacacatactcacagggcaaaaaatctgaaactgctagtattttatcgcgcaggctattttcataaagtaggagaattacatataccaagtcacttggtgaattggtttgaagggaaatgaaattacccctatattggtaacaaggaacagttttgttcatatctctttgatgccaaaaatatagtatgtattcttatttactctgtagtgaaaagggttgtgtaaaaatcactagggatgagctaccagagctaacttggataggctctttgcttgatggttgctgtatagatgaactattaataataattatgatgatggatgttgaggattcaaaatgatggtctttctatctgtaagtatattgcttcctagaacctttcagtggccctttttattagaggatatactggtaaaatcaatcctacttaaaatgctttagttattagagtaacagcaacagcaacaacaaaaaagtggtaattataaagagcttccatatttaagcacagccccattgcatgaccttaagaacaatattatatcaagattctagaattttgatagttaaatatatgtgagtgaataacatgaaaaatgttatacagttttaaaaatagtttttccttaaatgcaaaatgacatgtattaagtaattctgcataagaataactgatctaaattttaaaatgtatttgtctttgatttgggataatgcaattaagtgaaatttgtcttgataaaaatctgcttctagtatctttgaacattaaaaacaagagtttatttgtaatgtctttttaaaaaacagggaatgtagtttttcttgtcaataatcattatagtgtgaaagtacttgacttctattgtttaatgacttaacttgtaacataaaacacccatgaaataaatacacaattgaaataagtatataaaagaaaaagctcaagatcatttattgataagagacagggatggaatcatgttagcgcttatcaaaaccagtgtttcaacatagtgagaatcaatgatcagtggcaaatagggtcatgccaaagggaaattgacagctctccgggccatgctgcctcttattccacatttcaacttcactctagttaaatttcagttaaccaatcatttgaagactgaagcaaacaacaacaaaaatctgtaacccacagttttcgtgggacatggttttctaaatgttgtgtcttttcttttctttatattgcttggtaccagatcatttttaggaatctccatattccataggaggaaaattgccagtctgaaagctcagtgtctttagcattttttttttgcttaccacatttttgccctctaggtgccaacctggattcactggagcaagatgtactgagaatgtgcccatgaaagtccaaaaccaagaaagtatgtcaaaataatctgaaatttgctttctcccccaactacagcaacaatcactaccacttggtgcttttacagctcagtcgtaactgattcattttgttctaattatggcttaacctctcaaggcataaacccattcagtgttaccttatttaactgtctctcaaagtgggtccctaagtcatcaatttacaagaatggccagtcacgatggcccgtgatgctgacaaactattgcaggcaagccaaccgagaaacattttcttccaacgtgtgtgaccaaagccatcatatggaaaactgagatgaataaaacatcggatttcattttaaggggttccctttgaaagaaggcaaccacttaaagtgctgggatctttccaccataccaacttaagaactgcattctgtccaaatttttaaccatttgggggaagtgccagagcctgaaagccatgatcagggcaaagattcagttcctgagggtgaactcaccaagtttcagtcaaatgacactgaaggagcttctttctagcatatattcacctcttctctttttctctgtttttctaccattgtttttttgtttcttctctcaggtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaaggagttcagatgtttttcttcattaaccaa

SEQ ID NO: 912 - DNA, 216831 bp, Homo sapiens; identical to SEQ ID NO: 901

SEQ ID NO: 913 - DNA, 954 bp, Homo sapiens
ttagtgattggtcttgagaaaaatcctcagcactctctctcgaatctgctttgtcctgactccatagattacaggattgagggctggtgggacaaccacatacaggttggctaatataatatgtatatactgtgggatattatggccaaaacgatgtgtcaagaatgaaaaaaatgctggtgtaaaaaaggctaagataacaccaatatgagaaccacaggtgttgagagctttgagtcgagcttcccaggagggcaggcagaagacagcatacaggatcctgacataggagagaataataaggataacatccagtaacaagagagatatgttgccaaggccaaacctaatgttgactttgatgctggcacaggccagacgggcaatgcccatgtgctcacaataagtatgagggatgatacgatgcccacagaagggcagcctcagaaggagaaacaccagtggaacaaccatgtacaggctcctcaggacagcaatgcctgcaatgaggctgatgattttgctggtgaggatcatggtgtaccgaagaggtttgcaaatggcaatgtagcggtcaaaggccatggccaccaacacaatgctctccatagcagtgaagaaatggatgaagaacatgtgagaaaggcagcctccaaaagatatttctttggtattgaaccagaagatgcccaacattttggggatggtggctgtagacaagcccaggtcaatggaatccaacatggccaggaagtagtacataggctcatggagactctgctcagtctggatcacaaacaagagagcagtgtttcccaggagtgcaacaagatacacaaagaaaaaagggactccaatccaaatgtgcacatcttctagccctgggatacccagcagtaggaatgaagaaggatggaactgggtgtgattagacgtagacattcttcctgccat

SEQ ID NO: 914 - DNA, 225920 bp, Homo sapiens
gggtatttgacaggagcgagggcggacgcaaagaacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcaggacgcggccgatctcccgctcccgccacctccgccaccatgctgctcccccagctctgctggctgccgctgctcgctgggctgctcccgccggtgcccgctcagaagttctcggcgctcacggtaagcccgggcccgcgggacctggagctcaagtggtgccgcctcttgcagccggccgggttcgggtccccgcgccccgctccaggcccaggcgcctgggcacggggagcaggtggccccgggggccgtggagccttcgcctgccggcgaggctggagcaggtaggacgcagcgtgcgcgcctgggacccggctgggatgggcttctggggaccctgcccgccggggtcctgctgcggctgcgacgggctcctcgggttccacccggctgggaccccacctgcctcgggggctctgacccggctgtgagaggatcctggggtcctgcagaccccggacaagtgggagctgcgggtgcgctcgggtgtcccgcactcactgctgggcctgagcctgtggggaaccaggtctgggagcgccggcgccgccccgcggactgtcccaaggccaagacagacccgccgggactgggcgcccacctcgcccacggggacccggcctggagcgtgttctcccgaccgctttgggctcgtgcgccgcgcggatcccgggcctctcgccggctgaaggggctgccagtcgtgggccccactcgtgggtctgactctcccagagaccctcgtaagtgagccgaggaagaagcagatgaggttacagatgattcttcacgggcctgagtgttattagagaagcgctttcttcccttctcaggacagaactggaggcaggcggcggctccccgctctgcggggcctctgggttcttcctcgtggcagggatgctgcgctcctgagcgcgagggtcaccgcggttgaccgctgtgtgtttttctttctgagctgtaacttctatgcgacagccttggcccggccaacgcacgcggtgtcaaacgaggagctatgtagagggggctgagccaagcccccgccggccaagccaacccgcggcggccgctgggccaaggccgggtgtctgcagcccccagctccagccgtcctcctgggcttgcagggtttgcaaacccatcattaatgcaatcgccagaaacgaaaacattccacttaaatgtgtttttgaacaagtgtttgagaaaacacgaaggtagtgagaacgcctctggtggacagccgtcttttttaagtggccggggacttgtcctaaaggtgtttattgtattgaaaataaagatggttgaaataagctgtggtcggttctgcctttcagcaaatttaaaacagtcatgtgggcatcttttctttttctttttctttttcttcgtcttctttcttttgcgttttagcagtgtgaaggatggtttgtgagttcattgctcatacctcaaattcttctgcagcagcccggggtccctgccttgtgtctcacaaatgacttgtagattagaaactgctaactggggctccaaggaggttttcacacactcaggctttccctgaagatcctttatctccccagagggggccctcagaggatactcactggaggcattcatgtatatgcacatctgtacatgcatctagacataaatatactcacgtatacactcacaaaaagaccccccacatactcttaaagcacactagaggagacagagaaactaaggccaattctccaaaggagatcatagcattttcttccaggactgtagcagcaggtacctacagttgccacggattttcagattttctgaaagcgcaaaaagtagagactgccatctgcctgctgccctgtgtgtgtggggggtggggttgggcctgttggtcccccctggaagagcagaatcaaggtagttagtaattagaacagtttaagactcggcaggttttcttgtcttctctcccctgtctcatctaactatttacttgaaccctctcaccttttgcccccttgaggttgccccaaggatgtcttgggttgcggtgagacccgctgcatgtggggtctctgtgcaggagctgataccccacgtgggctttgccctgttggctgcattccccaagaacagtttgcctgaaatttacatttgcaaataaaatcagtatcccgaagaaaagattaaagccataacacattttggcacacttcttctcaccccacccccagtctagaaaatcaagaagtagttgagttacaaagtaactgaggcaggcctgaaatctgactggtcgctgggagatgtgagatgtgcaggatttttcagtgtgctcatctcttttcaaattgccttctggtttttggaaatctcttttgtctccggaggccctcattcaaagaagggccttctctccctacgatttgcatcctacctactttaataaatcaagaggcagtatcagtccatgcagtgggtgggacccacagcttagggtcttgctggatgtgtgacttcaggcaagttacttaatttcataatcttcagtccccttatctgtaaaatgagaatacataatctctttcaagcatgtggtgaggattaaaggtagggcttttaatgcgcctactatatgtgagttctccagctaacattgttttgatggtgcccatgccgtgggtccgtataagagagtgctatcaattgataccgtaattatcaatgcatatagcgttgtggcattaaggtgtgtgtggattcaactttgcagtattttcacctgccgcagattctcagagcacaccacttggctctgggtgtatctgtggactttgtgggagtagccatgtgggactctatagaccaaggaggaaagcttgcctctctgcctccttctactccattcatttcttctcatctagaagcagggaaatatgtcagcctctctggggctttcagtttgccatacctggcttctcaggaccacgcatttgtcttactcacctatggtgagtgtgctttcttggtgggtccagcattgctggtgtgctcacctctgctactttatgtttaagattcagagaatccactttgtctggtaatgatctctcttctttccaccaaagtcattctttagaaatggcaccatgaggccctctgtgtctctcattgtgactttctgatggctttgcacaacttcctggttattgctcagaccctctcacctccagtcaacaatggcattcttaagtgtgtccaatgcgctcttaatttggatgcaggtcaatttcttccttgaagaaggaggtacattgaatgccacaccgtgcccattttcctttttatttctgtgaatgactgagatgagggaatgatctctagtataaatggtttttattacacataattctgttttcaaagagcaaacaggcgtgatcacaattactcaactttatcatggttgtcattatatgaattttgatggactgatccataagcccatacctaggtgatttctttaaaggcagagagaagaacaatattgcctgggacccctttcccagaagtttttggttagagccaaagtattcattcccatgttgactaaatcatattttgctcacacttagaatgttgaagtcacattaccatccttctcagacttctcttactgccaatacctaacgctcccctaaggtcatacgcacgacttcgttaaaggtaccgttgtctccacattcaagagatgaggaaactgaagttttgagagactctgaagggcacctggtcactaagcagatccgaatatttctcaagtcatcctgccattatttttctttcttcgtgggagttccctgcactgttttttgcactgtcttcaggaactttacaattccacactgccgtttcacctctcagactgtagttgactttcatcctgaatcctcatcttctcacagagggtctggcacctggtaaatgcctcttattggtcttgtggaatgcatgaccacagacctgaaacagttatttcccactcctatttgtgtttatttgctttgaaagagaagaaaggtgataagaaaacaatatttagccatgtgtaatttttttaaagtttcattagcaagttcatgagatgatttaatattgattttgctgaaacagccaaaataaaaatgctattccatttctgagcagttgtggtttggaatgcgtacctcatcctgttttgatatagttctcactcagccttggatcttcaagggaattactgtgattttttttcctttcttcttccattgcaaatgccttgagtccatttcatgctctgggagggcttctactgcattccccagtagaagacggaccacgaaggtggttaaggaggagagaactaaacataatcaaaattttccaacttagaagcccatttacatggcgtctaaaaacccaaacatctggaagaatcactttaattttgctgtgaaatcaagaccgtaaataacactataagcaattgcagtccctaacaagaccatgcagccaatgggcatggatgtaacgtcagttgcaatggctcagaaccgaacagatttctcagtaattctatatcaaaataagccttcttgccaatccaggatcttagaatggggattgttattaagattgtcagcagaacattggtttggaggtcaagggtaacatttatatatttttgaattagaagataaactgggccgggcgcagtggctcacgcctgtaatcccaacactttgggaagccaaggcgggtggatcatctgaggtcaggagttcaagaccagcctgaccaacatggtgaaaccccatctttactaaaaatacaaaaattctctgggtgtggtgacacgcacctgtagtcccagctacttgggaggctgagacaggggaattcattgaacccaggaggcagaggttgcagtgagccgagatcctgccattgtactccagcctgggtgacagagtgagactctgtctcaaaaacaaacaaaaacaaaagataaactgttctacacatacaacacacaaacttagaatgatgaatttccagtaggattttgaagttagaggagaaaattaaagaaatagtctttagaactgccagcccttatgtttctccaattgatggcattgagtaatagagcaagatcccagcattagtcattgtgtgtctgtaacatatgtacaacagttaatatattggatatttaactgtagctcacaagagggaagatttataatatgaattaatatttttgttgattcctaatttcctatgggctaaaaagaaattgctctgaaagtgaaaataacagacattcttatgtggttttgcagttccaggccagacatcaaatagcaaagattgtaataaaacaaataaagagaaccaagtaaaatatgaaatcacatttatatgtttagggttaaaaaattacaaatgaaaattttataatatctggcttaatttaactagatttttcaacacagagagtctcagaatgacttctttttgatgaaccacgattttattttgatttttattatgtatgacataatgtggcatatccaccaattaaactgtcacttaagagaaggcaaatgtcaatatagcatgtccaggctacgttctccttcagcacatatctctgcccactttacggtcttcttccccgtggtcatctatttgttttcttttttgagacagggtcttgctctgtcccataggctggagtgcagtggtgcactcttggctcactgtaacctctgcctcctgggctcaagcgattcccctgcctcagcctcctgaggagctgggactataggcacacgctacaacgcctggctaattttttgtatttttttttttagaaatgaggttttgccatgctgtccaggctggtctcgaactcctgagctcaggtgatccactcactgtggctggtcatcgattttctttctcttttatgcttctgcccaaattagaagaaacttcctttgcttctccttttaccaagatactgaccgtggatgctgctatttctattttagcaccagctgagactccctgaagggttttctagtttctgttcctcacactccttccttctgctaaagtgtgggtgccctgggccctgccctagagccagctgcatcatctctcactgttcctatccctgccctagcccccagccgagggcagacatttttggggggaaaggggtaggcaaactcttaacatttgaggttcttagaaaagagtcttccaataataacaaagtttctgaaggtggaagagttgtaggtaaacacgatggcctgtggtgtgtttgatcaggggttcagagcccttgagtgcaggtcaccattaggcccatctcattttggataccgagtctgctggattttagtcacttcttaaaggacaagttcaccagtttgttggcaaaaaaaaaaaaaaaaatgctgtggtatgtaagttgaccttgcctgcgtcagggtgttttgtttatctcttactctgttcagtgatcagtgaaggcgctagaatcaaataaatccaccctgcataccagctgggtgtcaccatggacatttgatttcttcttgggattagggacattgactcctgaaggctttccctgcccaggtcagggttgtcccatgtatcagcccacagtggaccaggaagatggtaggcattctcccacatcaggcccaaaccgacctgcgatttgtgactaggattagtggtgagttgatgatattgagggctgagttgtgaaggagcaaaatcctcccacagaagagactctttcaaattctctgccatgaaagcaacattgtgctggacttgagcagccctcctggtggtgacctgggctttcaggagcaaagcagaaggtgtggaaccactcccaggaggctggggaggaggatggcactggggaggaggatggcgctggggaggaggatggagatggggaggaggatggcaatggggagaatggagatggggaggaggatggcaatggggaggacgatgatggggagaaggatgaggatggggaggaggacggagatggcaaggaagatggggatgaggaggaggacggggatggtgaggatggtgatggggaggaggatgaggatggggaggaggacggagatggggaggaggacagaactggggaggaggatggtgatggggaggacgatgatggggaggaggatggtgatggggaggatggtgatggggaggaggatggtgctggctaccctgtctccactgaggcaatgaggcttatgcacatcttttgctaaactccctcttcctaccataagccttgcgatacatatttacgttttaaagtaaagtactaattaacatattcgtagcactttgagcaaggatggaaacgtgttgttggagtgagtagactaataattctaatgtctttgggcacgttttcagttttagaatggtagggttgatattacctcaatggggtccctgtgttgggcagacacatatcaccaaatattttccaattttactattttatgatgccctgcttgcatttggtgttgtgggtctaatgtgccactcaaaatctaacccccatgttcagtttttttacacctaattacctggttttttctttcttcgctcacatggaaccacatttgtggcccatcgcccatcttcagaagtgaacgcagacctgcctgtggctccctgtgtccagcttctgttgtctgattcccagtgtctgtgcagattgatccgtcttcacatgaatccacccacacgcttgcccccttattcctctgccatggcgtttcttataacgttgagaaaaaaatgtaaatctgaagtcgtatctcagaaccatgtgtacaaactttcctcacatttatagcggtcactgtaatattcttcctgacattagcaatcgaattgagggaaaatgacttcataaaatatagtcaccttttaaataagagaattacttttagataggagatagaaatttcaaataacaaaggaaattccatatgtgcttataattttaaaaataatttgagagatctggatgaaaaagaatcaggccaactttagggtatatttttggttttggttgtatattaattcatgccacatgggatgtgggtctatgtaatcaagaatttttttaagtacaattaaaactaacctaaaatgtaccttggaaaaaagaagttagtatcctttcattttgcggtggctggcagcttgggactgtcagataaaccgtgcatggccattctttggcattaagattctgggctgtccagctccctgtgtgtgacaagcacttctggaccctctagaaggtttcattacctttaatgaagcataaaataaacacgtgcttttctgtcatcccttcatttcaaaggacaattgagttaaattttgtaacatacatatctttagagggacagtcatattcttcactgtgaaatggccgcatcaaagaagaagcagttagcagcctatcaaatcccattccgaccctggtcaggactgtgccctgtggtcctacattcccaaggacagtgagtttcaatcaggatcctgtcattgctgcttccttgagatgtgcttatctatcaggaggaggaggagaaagagaagagagagaagagaaaaaagaaaaggaaggagagagaaaagatgaaggtagcttttactggtgaatcaatctggataatatgacattacggccctttcaaagacagtctaggcctctgtctttggaatacaaatgtacataaagttttgaacactgagcaagaaagataatgtgagcattctggtggcctgctgtcatgccagtcaccatagagcgaaatttgttctaaggagaattcctcttggatcctatataagaagttgtcaactaggaatgctgaaagggtttgtgtttgaatgaaggctgagagttgtgtaatctttaaacatttatctcttaatgaatcaacaggaacggacatcatctattttccagggccccttatttaagtatttaaacaagatgcttaggttgtcagcagatgggtccccttcccagccagtccttctcttccctgttcctctacccctttcttctcaggccctgggttctctcttccagtatttggggtgtttgtgtagactaaatgagatattcatgttgaagtgctggatgcatgtagtagatgctgcttccccaggatgtaaaagaatgatctcgggccctgacactttcagttccttttctccaccgggttctgtttggagctttggttcattgatatccttttaagaatgtggtcccaacaccagatatggtcttgcacaagcatttggtcacttaaacccgaacgtgaccttgtgaggtggcactagttggtgatcagataataatcctaagtgtctccaaatttaagattctgctaaaccagtttccaccactcattgttttttgaattttttggcacccccacatgatactttacgtattatttttattcaaactagattttcatcttgattccattatcctaggttggaaatacagccaccagttgatgcaaatgtgttacaggatcctgtttcttcccgtgaatgggttggccttaattctcccaagcaatgggtgtggctagagctcactccctcaggctacctttccatttgctgcactgatttattccccaggggaaagcccaggagagctgaatactgagctttccctccctccctcgggtcgcccctgcctgcagccggggtcttggaaatcatcagtaaaatgctaaattgaactcccgagtacatgtaactggaaatgttactctaaaagcttacactcatccaataattgacactttgtgaagaacgttgtcccatgagctctgaatagtcataagagcatgttttctgcctcattctgccacatgcgaaggctattttctggaaacatggacgccttctccagaaacaggatgaaagcatctgaaacatgggattaaggtgcctgtaagaataaaaaacccactttacactctgtacccttctctcctaaaacatgacagagccctctctctgtgccctgcagacatgatctcctgtgtcctcacagaatccctgccaggcagctcgcgctctctctctgtctctctctgtctctgtctctctctctctctctctctctctctctccctccctctctgggtgtatattttctaggtttttgtaaacatcttaggctaaggaaactgagcaatctctctgacctgaacatacacgtccgttaagttctttctttttaggatacgcagatctgtgagtatgctaatcagttcttcattcttaaaagatttctcttttggagagagttgccaaagatagatctttcttttcatttagagataaaacccaggtggagtcataacttctttttttgtactcttggcatctctcccaccacctacaccctgctggaaacatccaggtgcaatcacccagctggtgtgaggggaagcccctgtccttttttggaagaggtggaagaggttgtctcccaggttccctggttccaagaatccaccacaggagggagccccagaatggctgagctctgtcttttaggggagggtcgcatggtggggtctggggttaccaccaccagcaaagtttctgccaccttgcctgcaaaaataccccacgggcctgctgccccaagtgagttcaactttccagctttaaagaattggctcatgatgcagaatgctaaattagggaattaaaaagcagggacattttagcttgatgtttctactgtctttatttagaagtctgggatatgcatgttacattcaggattactacccacatatcagataagagtatcatgttattgaagcagaattttggttttaaaataaccagagtaagcagggggagtgtgaggcgggctgcctgcctggggcctggactggctaaatagggtgctattttctttttgctgtgaggtcagtccactttgtgagtcgggttttattcaaagcaatcgcttaacttattttatttgctaaatgaatattatatttcagtgttctccagtaataggattctcagacatgtgattttcatgagggattttaacccaaaagaacaataagtgcagcaaatcaaaatttctgtgctcagatattcaaaacaccacttgcatttttttgtaccccaaaatctgaaggaaattttgaaaaatcattagcagctgtcatttagatttgtacaccattcctagtcccttccctcatttctactaccttttaatttcgttttgttttgttaaattccaaacatatctgtaggttgtctggccaactttattctagaaggcagcaggaaggagggcagcccgccaggccgaggcttttgtcctgctctgctcctggaggctgacacgaggctgactcccaggccacactctgtcaatttctggggcttcctctgggctccacgcaggacccccttctcccagtggctctgacagcaggggcaggacgccctcctcccagtggctctgacagcagggccgggggcatagttccctggaagtcggtcttgggaggacacagcctctgtttctgcaccagagtccccagggccttggccggacactcagggcaatctgccctgaggaattcagggcagtgtggcttgaatctgctgtccgacgcaggcaggtgcaggctgttctagagtgtgctcagggtggcctgacaaatgcgggcgggggtgggggaggaactcgggacccagggctgtgccccaagagggtgtggggcagccagggggtgtggtggcctcaaggctccgtcaccctgcggccctgtcatttcgggctgtgcctttgtctccgggtctcctcctcactcttctcagtctaccctggagttcaacaaaaaggagaaaagaatttccctggcaaagccaagtggagagttagaggctaggctctctctttctctctgtctctgtgtgtctctcagttctgtctctcagtttctgccattctctcgctctcttttttgtctctctgtctctctctgtctctttgtctctctctgtacctgtctctctgattctctcagtctctgccatttgctctctctctttctgtctgtctctgtttcttcctgtctctgtctctttgtctctctctgtctctttctctctgtctcttcctgtctctttctgtctctgtctctctaattctgtctattgatctctgccattctacatactacatctctgtctatctctgtctctctgtctccctctttctctgtctctctgattctatctcttggtctctgtcattctccatctctgtcctctatctctctccgtctctctgtttgtctctcattctttctctggatctctgccattctccatctctgtctctctatctctctttctctctgtcttcctctctctctgtctctctgattctatctttggtctctgccattctccctctctgttttgtctatctttctttgcccctctatttctgtctcgatctctctctgtccttgtctctgtgtgtcttctttctgtccatctctgtactatctctgtgtctctcttactctattcatctatttccctatctttattcatctctctgtctctgttctcccaggctccacccagtccatgatgcctgcagggggtcactctgtgtcctcctgtgactctgccctgtggccgtctctcctgttgggctgcctctgggctctgtgtgtcccggctcccccaggaaggatgaggaggcccaagggctctgtggctctgagagctgaggcatcgctgaagtgtttgtgaagaagaattgaactaacctagaactaacctcagccgaaatctaactgggcttttttttttggtcacacattttcttcaccctttcttctttagatgctttctgggttttccaggttcattcagaactgaaaatagcccctcgtaacttcacagcacgaaacccagagctctcaggacacgtgcccccaactcatctccccatcctgggtagggccagactgcggctctgacaggttctgcagatgggaggcacctgggcagtgagaccaggtgtttgcaggtagaccgtttgcccttcagccggtgcttgatcagattgttcttgggattttctaaacacacattctggggaacagaggaggctttgatgaagaaagggaaaagaaaacccactaaaatatgtgaaaaaaatcataccacagcactccgggtgtgtcttgatttggaggtgagcttacaacttctccatgggacgcatcctgaagctacacctgtactggccatgtgctgaagacgctgctggggacaggttgtgcgtggccagtgttccagcagatgctacaggtgcacatcctgtggccggggtccctgtggccagggtcccggtttgagaccggataatagtgtggggccgagggtcggcgctggcccaaaggtggctctcaagatgactccagagggtcttggtggccggggtctcagatgggagctgtgtgtattgggttcagggagcccaggacaggaggggagggcttgttaggggcccctgcagggtgccggggcggagtgaggacgggctgccatgaagggccttgggaggaactggggctttgtccaagaaccaggccagcttgaggtgcagcccaggggtgctgaggagagcctggctctgacccttcagttggccccagagaggaccaggggagggcagccgacttggggtctggtctatgagttttcttctttaagatataaaagaattaactggtgaactttgtaatcaactcaacattttcctgtgttgtgtcttgtcccagtcgtggttttctctaagcagaatcagaaatgatggatttagagagaggggcaggaaggacgctggctcggcagccaccaagcccgggctggcctggcagctggctgtggtgggcggccctcaagtcccggctttgagaggctgggcccttttctttcctcattctctcctacttaaaaatgttcatgtttatacttgtttattgttcccttcttaaaatgaactttctgaagaacatttgatacttcttcaccttataaaggttacacagattttataaaatgtaaaggaaaaggtacagatttcattattatctctggggtgtcactcaaaattactgatgttgaatatcacagaaaggacatagaatgagccattatctcctggaggtccgaaaccttgaacttagaggaagacctgaggggtttaaaacaaaccgaacaacctagcctcactttatacaaatgggcagctctggggagaaaattgcaagtggcagaatcaacgtggattcaaaacctcgtatctcaacagcattagaggactagggtgacccgctccgtgaatccatgcaaacgtctgggcggagtcttcacctcacttcccgatttcccggtctgttcctgtgaaagggcgcggcactcaggcagggcggagatgcccccagcccagcctctgactgcagacgcctcataccagggccaccccagagcccagggagggcggagtgggcgtgggggcacgggcctgctgggaaggagtcactgcttggagctggacgtgtgggccgacgtctcttgcctgagctctgcgaagtgacttcatctgcttctggttcaattgctagatagtttaaaagagggtcccacacacatcgttccctaatgacacagcctggctgtcgccgtttatgactgcgattagctgtgcaggggcaagagcaaggctctgggtttttgcaagactgaggcagggtgggtggggcgtggaggggctgcagggctggcaggtggccgcggccattctcaggccatgggtctgcccttgagttaacctcaaccaggtcaggctgcattgaagcaggccacaaagagaaacctcgcagtgggttccgttcacaccaggtaccttcggtgctgcgagaccctcacggcaccccagcagggtctctcacggagactccccggtgccacttggtggccacagtgactctcccacgtggagctttcctctgtcagcaaccccagtgccgaagcttgagaagggaagtggccttcccacaagaatgttctggctagtactggatttcaaaacgcgccccaggtcaggctgatctcagagaagcctccttacatttttaggagggtgcttccagattgtgggacatcaggtactgttaacaggaggagaaggtgggatttcctggaggggactctggatgcatcgtttttggtggcaagcaaaaggcatgtcactgtgagggcaggaagaagcctgggctgctccatgtgggcaacgggtgggtcgtcatgtccaccgaggtgaatgagttcagtcttcatccctctgcctgtgaggcatgagctcaggggaaaagcaacaacaagactagggctgcagggttttgaagaagctgctcgggacaagcatgcacacgctcatgtgaaacggcaactgctccacatcatgctccattttctccttctggcaaactgtgcacaacctgggagagatggcaaagccctgtgtcctcacactgcctcaggcacagcgcggccgccacgcccctctccagctctcccttccacggtcacctggagatggcagctcctctggaccgtccacgagggctgccaggaggaacgtgtgtttagacactttcaataaaaacaaagtgcagcttccagtgagtgccattccactgtctacaacgggggagtcagaacccagttgaaaagctgccccagcaccccagcgtgacgccagccacggggatgccacccatccaaccccaccttcaacacaagcagtgcccgaggggctggctgactgcgatggactcagcgacaaacggcacccaccgaccctgcactggagctgcagtgacttcatcgccttgtgtttcccgtcgggtgcccagtaatcacaaagtggcctggagtcactgtttgtaaatacacaggagcctgcacccatcatatgtatgcggcagagtaatcctcccagaacatgagccccgcgtcacgtccttccagccgtgcttgtgatcactgccggggtgggagcctggcctcgcactcgctgcagccccggcccagacccaccctccccacgcccacgagtacatgtggtgccgcctcctctctggggctggtcctaatggaaatcaacctgaccctgctgagcaggatggcaggcccagctcggcgaaggcctggaatttttccaagcctgttttgttctctcttccctcctctttctaatgagtctaatagaaacattccagttgtttcttttttcatggtggtatttcacggtcatttcaaggtggggggcccttgcagcctgtgtgccatcatcttctggggaggggggcagcacagggggtggccggtctttcccacctgccacaaagattggtcctgaagatcctgctgcgagacacactctcacgtggaatcaacgcaacctgggcctcttgcacttactccaaaacaattaagctcctaggaaggctggggggatgtcatgataacataatcctgcagtgtgacccagaggccgggctgtggtgaggcttcagggtgtggggaccgttcccctggggccatcaacgtaccggctcatcagagagaactgggatccagcagcctctctgggagggagacggtctcaccctgcccctccgggggcatcgtgctgcctgccctgggggtcctgggagggagacggtctcaccctgcccctctgggggcatcgtgctgcctgccctgggggtcctgggagggagacggtctcaccctgcccctctgggggcatcatgctgcctgccctgggggtcctgggctttggcgtcaccagttctgttgtgagtcctggattcccactcgccatgggtttggaccagcttctgagtctcagtctttcatgctgtaaaatgggaagtgcagcctctttggagtgcagtattttgagttgtgtgtgatgttggtgtgtccttgacaacaccctttgccttcattgctaaggaatggggcccaggcatcttaggggagaaacgaaggctcccagggtcctgggccagcttgcacccctgtccgggccgtcttcctgctcgagatgtgaagtgcttgttctgtcacgtccccctgccctccagttgtgtttgtgccatgttgctgtgtgcctcacacccccagctctccttctaggaacactttctgcaccctgcagtggtctgaacgcccactcctcggtgtaaaggaggcagagagcaggaagatgtttgcttatactaattctcattgtataataattaaagctaattcattgtattaactgtgtgttggaaaatagtgtaacatggaagtttaatttatggacattaagtactccctctgttgtcatcaacagtgtggaaacgtggtcataattatgaataatgcttactatatccagggccttgttcaaaatggtttacccaaataaactctattccccacaacaccctcgatgtggtgggtgctctcattgttcccattttgcagatgaggaacttgagacacagatggacgaggtcatgtgatggatttaggtcataggcctgaggaaggtcctggagcaaacggtttgacaggagcgatgtcatcagtgcaagttctgtcaacccgaggctcaaagccggggcgtgggcctcgtgctgtgcaagcgtctagggcttcgtaggtgtgttttgatgaaggtcacagacgcgcctgggtccctggtggggaatctgggccatcggcaggaagcgtgacattgaggacaagctggaaagggggcgtttgccgcatcgggaagggtattctccggttgtggggaagatgagttccttcggtcatgcctgggttgatcccagtgagttgatgaaacaggatcctggcaccctcacatgtgaaaatgaagcagaacttgggtctgtagctagagccccagggtgggtgagccctggggtgggtgagccctggggtggatgagccctggggtgggtgagcactggggtgggtgagccctggggtgggtgggccctggggtgggtgagctggggtgggtgagcactggagtgggtgagccctggggtgggtgagccctggggtgggtgagccagggtgggtgagcactggagtgggtgggccttgtggtgggtgagccctggggtgggtgagccggggtggtgagccctctggtgggtgagccccgggctgggtgagccctggggtgggtgagccggggtggtgagccctgggctgggtgagcccgggggtgggtgagaccttggtgagaagagccccgaagtccgtgtggttgacgctggcccgattcattttctctgtgctttggtttcctcatcgctcaatcatgtttccttcaagtgataggcttcaaatatcttccctgatcaatgtttctctcactagaattttgaactctttggaaacctttcatagataacgtttactttattgtaaacaggataaaatttgctttgattgactgataccccaaaagatattcttggtgtactgcatttgcccacttatgtggctacactcacatcacaattagcacacttaagacctatgtatttaaatgacctcaaaactcctcaaatgaaatcccctagaccccagtcctccaagcagttgcttagaaagaaattatgggatatccttctaaggtaattaaaggaattctacaagcaatgtaacaacataatagacactttgaaaagtagtgatgttcctccacagtggtactacccaacaactttggggccttttcaagactttcctcacatgactttcttagaacattgctataatgaggacataaaacattttacgtctgtcttacttaataatatttaggggtagaatattgtaaagaaaactagtctattttccatttacctccctcacttgagcattaggaggggtttggaggtctgcccacccaaatcctgaattttataatagggcatctgagccctgggaagcttcaggaacccggtgtggggccaggtgtcttgtctcagcttcaccaacttccttccacactcctttgctggcttgacatttaaaggtgaattaatgccacattttaacattgaagttgatcatgatctctgtatcaaccctcaaagtatcttacatccattatgaagaactcattttggtggaaatgtgttaagagacaaaagcatcacttgtgagaaccaaagatgcaaaataatgtcaacatattgtagatattctttgattaaaatgcttgtttgataatgagtaatcactatcaaactgggtcagtgtgagggagggctacaggaaatccttggacctcagctctaaacacagaggttcttccctgtgtctgtagaagtgcccaggctttaggcagtattttggttgaaaggtgtattagtctgtttttacactgctgataaaggcatatccagtactggcaatttacaaaagaaagaagtttaatgggcttacagttccatgtgggtggggaagcctcaggaggagcaagtcccatcttacatggatggcaggaggcaaagagagcttgtgcaggggtactcccgttttaaatccatcagatcttgtgagacgtattcactatcaccagaacagcatgggaaagacctgcctccatgattcaatcatctcccaccaggtccctcccacaacatgtgggaattatgggggctacaagatgagatttgagtggggacacagagccaaaccatattaaaagtgtaagaaaaatttacttcatttttcaatggtgttgggtacactctgaattgcaagtgaatcacttgcaaaattttgttacaaatttttagagaatacctaaaaatgaacttttatgacaactttttaggttttcgccctttcagttgaaccaaactaaggtttaatcttttagtggttttcatttgacttcatgttgattttcttaattttttcgtttaatatttagtaagagtctgatattgagttttactgcactttaaagcatttcggatgttaattaaaatcttgactctagtagcacattcagtcgggtcaagcgtcactatttgacataaatggagacatctggctgtcacccaagtttgataagctgaatacccatgcagatgaggcagccgtgctagaaacaccactctattacgcctagtggcatttccctacccatattgttacaatggtgctcatgtcctatgaatttttttttcagggctgctattatttgagaagctgtgatattttaagtcaaggatacgatgtgcatcactaggctcacgtggcaatgggatgatgccttagtgtcttagcccgtctgactgtcactaacactttctctccctttctcatagtttctactggaggagggctctttatttttttattttttatttatcagttttttttgaggagggctctttatggtgggcctccttgtccagatcaactgagagtaatgagctgtgctctttccccatcctgcccatcctctgatttcttcccttaactttgaggcacactttttcattactgagtgatttagatccctagaacccatcagtttagcttgcttttaggacacagggattccagttctgtgaagtgtaatgaagactatgtccgtattctgaagttcatgctaagctatgacagattgtcctgggggaagtttgacttttgcaatgaagctgcaatgaggttgtaaacatgtccttgttggaactgcctgagtctgtatgttgaattatcgtttcccggcatcctgctggggctcggcctccctatcttcccaggtccttccagctcagccccctctttaaagttttcccagctctcgaaggtccggctgctgctccaggagggtggtcccctgtcctcccagcaggtcccacatgaccaagacctcgtctctgtggtgctggaattcccagatgtctcatgggctccatttggtgctctccagtggtggcttatgatgaatgacacgaagtcacatgactggaatgttcctcagcaattcaggctgcaagctttgcagagatatttagggaggaagaatagttagtgacttcagaggactcagggagaaaaagggtttgggctgagagtctccatgtgtcgaggtggtgcatctctttaggaagtgactaacctcaggcactttgagtttgctttgccaactctctgtgtagagctgtgtgatttagtgagaggtggaaggcagagcggagccttgggaagggtgctaagtggatgatcagatggtgagaggagctgacattcctgtagtttctaagattcaaatgacctctataaatgttggtaattaataataacacactaaaactctcccaataggaaggctcccacatttgtttgaggacaatctttgaatcaaaaagcggtcccattcccacaggggagttggagcctggctttcgtggagcacttgctcagcgagccgtggtgtgacaggggctctgctcccactgggggctcaggctcactgaacttcaaatgcactgaacaaaatgaaacacagaagatattaaagtgcagaattgtcttcctaatattaagtaatagacccccttttcccgtacttaccccaaggagaatctcattctcataaatagaaagcgctggctgtggcgaaatcaaggcgttagaagatgatgcctctagaaagctatcctgaagcagtgtcgggagctgagctggcacccgttgctgcgtatgtgctgaaatacacgaggctcattccccagtgaggcctgggaagaagcagttattttgaggggtttgagaggttactaaaatctgctagttttacatttttcaagtaatgcatgtcgacatttaagggaatttgataatcagaatatggaggaatgtgaagatgtggggagtgatgtatccccaggagccaggggagtgtgagaaaatgaagtgagacctctggaaacggaagaaagaagagtaaggtgcggctgggtaacatcctgtgcttacagagaacattgtcctgagagaaaccctgtgcttacagagagcatcatcctgagagaagactctcctaacacttccggactcctctccagaggcaaggtgcaggcccaggcgtgttgctcaggcatcatctctacaggggcacactcctaggtgggaagaggattgccctgtagagacgtcggctgagatgatgtctggagaacttggatggacttctcccttatatcacattttatcaccaggatttgaaatctggccaggtgaggtggctcacacctgtaatcccaacactctgggaggcctaggcaggtggatcacttaagcccaggagttctaaaccagcctggtcaacatggtgaatccccgtctctactaaaattacaaaaattcgccaagtgtggtggtgcacgcctataatcccagctacttgggaggctgaggcacaagaatcactcgaacctgggaggtggaggctgcagtgtgctgagatcatgccactgcactccatcctgggcaacagagcaagactgtcaaaaaaaaaaaaaaaagaggaaggaagaaaggaaggaaggaagaaaaggaaggaaggaagaaaggaaggaaggacggacggaaggaaggaaggatggaaggaaggaaggacggacggaaggaaggaaatctccttccacttggctactcggataatagctctggagactggcttttggatgacgctccataacaattagctgacagtgacgctgtgccatcactatctgccaggagggcagcctgtccggtgccattcctggatgtattatttccactgtgaaagggtagacaggttctccaataagaaaaaaacattttgggatcaagtgattggttcagttataatcagtttcatgaatattcaattaggattttcattttttttttttaacatactttctgcatctaaggctcagaaaccaaaatgccagaatcaactatggtagtatttccactaagccacaaatggataactccaaacatatcatgtgccacagccttttaaacatttttatcgttgaatgtgtaaatagtaatgttttgaaggtttccagatttctctccagattgtgctagttaacttcattctgccgtcatagaacaattaaacagaagcatttgggagaggaataaaaaaagtgccagggaggaacattgtaagtcagacggcaggtgcagaagtgccctggaaacctgaggcagaaactcacctggccgcacagtgcctgggccttccaggggtggctccaggtgggtggaagcaccagtgtctgagaagctccggaggctccacagactgcagggcagccctgccccagagagtgagtgacttacgtccaggagcggccccaccttgccccacacagaccttcttggccagagttggcccctgccccatggaaggaagggaacctgcccagcggttgtctgctgccttgtttaatccatcactggttgccaaggcttcaacacacacattcctttctctttttaacaacaaaatgaatctctttgtttttgtttctatatttttcactcagtggaataggcctccatcctgccgctgctttctgtggtcttttctttcttttaaacccttggttatagatagaacgttgtcctttacacttaagctctacatgataagagcaaacttaaggcacttttgtttcctccaaaatttccgggctcttcatgaagagatttttctcgaatggtcaagatttagatgaaacttaggaacacacagttctctgctaagaagccatcagatcagccggaaaaaaaaaaaagaaaaaagaaagacttttagaaattgctatgtgagacagtaggaatcattctgggtgcaggtggacaaattactgtatttgtgattgttaaaaatgctacttcttttttttttgccaagagattttacgaaagtgacatagtttgtgaaagccaaatagggaatcagatgaaactggggagctctggatgaagcgaggtgctgctctgagagctggaactgggggctctggatgaagcgaggtgctgctctgagagctggaactggggggctctggatgaagcgaggtgctgctctgagagctggaactgggggctctggatgaagtgaggtgctgctctgagagctggaactggggggctctggatgaagcgacgtgctgctctgagagctggaactggggggctctggatgaagcggcatgctgctctgagagctggaactggggggctctggatgaagcgaggtgctgctctgagagctggaactggggggctctggatgaagcgacgtgctgctctgagagctggaactggggggctctggatgaagcgacgtgctgctctgagagctggaactggggggctctggatgaagcgaggtgctgctctgagagctggaactggggggctctggatgaagcgaggtgctactctgagagctggaactgggaggctctggatgaagcaaggtgctctgagagctggaacattgggggctctgaatgagttgaagcactgctttgaaagctgaaactggggtgctctggatgaagcgaggtgctgctctgagagctggaactggggggctctgagtggaagcactgctttgaaaactggaactggggtgctctggatgaagccaggtgctgctctgagagctggaactggggtgctctggatgccgctcccacagctggagtcctgctctcgtgccctgctccaggggctcctctagggcagatcagccgcttctgtgggttggtggtgggggaagggttgagagacacttgggcagcattggagggggcattcattgtcaggccactgcctgctggatcaggagatgaggaggtcacttccaactttctccctttgctcttctcagttgtagtgagtttccaaaaatctcaagaaaaacagcatatttgtcatagtatttgtgcatgcgctttgtctgggctttctgcatctgtcccagaggacgaattcttcaaaaccccagctccacgaagggtgcacctgcaacatgtttatttccatgtcggccaaggccggtggagggaggaagcgggatggggagaagcgccaaaagtcaaagtcatcctggacgcttggtttctcccggatgtttcagcagggccaaggaatggtgaatagcccggtggggcggtaaatcccaagccgcttctccaacattccttttggaaaagggagctgtgtcttccgttcccttgtctactctgagctctgcccacaggatgctgggcagggctgcgccattgcagccacatcctgcggtcgggcgaagggacaggctccccacaagcagcgccgtgctggtcatgtcatgggtgggaactccacgtttcgggagctgcagcacttctgccgtccagactgcagtgggagtgtgcttaacaaatcagtgctctcaaacacacacacacacacacacacacacacacacacacacacacacacgtttatttcgagacagggtcctgctctgttgctcaggctggagtgcactggcggcaaaacagctcactgtagccttgaactcctgggctcaacacttgggggacatgcaccaccacaccctgctaaggttttttttttttcagagatggagtctcgccctgtcgcccaggctggagtgcagtggagcaatctcatctcactgcaacctccacctcctggtttcaagcgattctcctgcctcagcttcccgaatagctgggactacaggtgcacaccaccacacccggctaattttttttgtatttttagtagagatggggtttcattgtgttagccaagatggtctctatctcctgacctcgtgatccacccgcctcggcctcccaaagtgctgggattacaggcatgagccaccgcttctggcccaacctgctaatttttaaaaatgtttttgtagagatgggatcttactatgttgcccaggcggatctcaaactcctgggctcaggcaatcttccccctaaaaattacatttttgaccagggtgaattttatggtatgtgaaatagatttcactaaagccataccaaattatatttttatgtgagatgtcctattgagtttattcggttacttttcctgttgatcaatgattattttccttttgatactcctagtatgctatccttatatagattttttaaaatttaatgtattatttgttatgcaaaaggatttacaatatatgtacatattgtatagttttgtatactataaaactgtagcaaaaagttatctgcaaatctatctacatttctcagaaagtaccaagtgttgttttgtttttaaaaaatagtggatgcatttcactgataattaccctgtaataaaagtaactcaggggggctctgaggtttgtactcttcttttctccttggctcaatgaaggctttcttgttgagtcagtgtcaacaatgagcaccatgaggagctggagacagaccatcctgctgtgcacacatggatttatatcgagggacacagggcgctgcgggttctttgcttcccatggtgatcgcagcaggtgaggaatgtgtatggtcagggctctgccagccttgctggaattccggaagcacatgttctaaagtgttggcaggactttcaggtcagtgattttcaaaactttggagccaagggaatccccccattcagaatgtgcagatgttccttaaggaaaacctataaccactcctgccaccaccttccccccgtcccccaccgactgccttctccctgccatgggcagtgggcaccatttagaaattcttttgaatgctggtcttgacaatgaaggttttttgttttttgagactgagtctcgctttaccgcccaggctggggtgcagtggcacgaactctgcacacagcaacctccacctcccgggttcaagcgattctcgtgcctcagcctcccgagtagctgggattacaggtgtttgccaccacacctggccaatttttgtatttttgtagagacggggtttcaccatgttggccaggctggtctcaaactcctgaccccagatgatctgcccacctcagcctctgaaagtgctgggattacagacctgagccaccacacccggaggattatgaaggttttatttgtaaagctcatttctgcaactctcagtaatgtctttaaatagtggtttaatacgttaagcagttttatccataattctgtttcttttcgtctcaagaagaaactctagaagcagcacgcatacagacatcaggtgatacaagctggcattttgggattacttatctaaggcaggtctggctaaccttggctgatggatccaatggtgtttctctcacagtcacttcttcctgttcttgtttctaatgggtcagacccagctgtggcactggccaacatggcccttctgttcttactccaagagtccttgccctgatgaaaggggctggttctcatcaggctcctcactggtaaaaagagataagagccagtccttccagggccttgccactgctccctgaaggaaacctgttgggaaggagcggtttcagtcatggtggaacccctggagggtctcagattcttactctttgcaacttcctaacggagcagtgctttcgcccgaggaaagtttggcaaaactgaaaggagggacaggctttgctaggggtaatttagtgtgttttgtaaacggataggggttcactagtttatataaacatgcagacttggttggttgaacttcagggatcaatagaattcagagggtcagggtttgaatacagaagcaattttgtaaatctttctgttcgtaaatggtgtcctgaaatcaataaactttagcaattcaaatcatcgtgcaaacccaggcttgtacggaaagccaaatcacaagcctctgcttctccaccagcagagctgctcggagccgatgacatttgcagagactgaccacatggccagcagagctggtcggagccgatgacttttgcagagactgaccacatggccagcagtgccaagaggtcccacgtgcagcctcgttaggagtgcgtcctcaccgctgcagcctcgttaggagtgctccctcactgcttcaagatgtccagtggaaatttccactccattcggtgatattgtgcatttgtctttctcgttgtcttgggttggaagactaaattagaaacaataattttctctaagttttatctgctcacagaaaatacatatgaaatttaaaatatattcattttcccaaaattggcctttataagtgactgtgtgcttcagtgcagaattccttctgctgtgagccaaggctaatctccatcacaattgcccacaaggctggataaaagtgcgatttggatcctctcttgagcccctgctccagaatctacagggcggagccggaacatgctttgttctaaagtgtggctttgtggtgatcctcctgcactttgaggtctcagaatcacagtctcagtctgccagtatcagtctctgctgtgagtccttttggacatagtttcctactctttccgttataaagcgtcttcacattttaatgaaaaaatacctgttgttagtgaagctattttgtggtatatatttgtaataattaatttccttaaaaaacccaatttttaaactgggtctcctggtcaagcgcagtggctcatgcctgtaatcccagcagtctgagaggccgagtcggtgggctgcttgagttcaagagtttgagaccagcctgggcaacatgatgaaaccctgtctctaccaaaaatacaaaaaattaaccaggtgttagtggctcatgtctgtagtcctagcaacttaggaggctgaggtgggaggatcacttgaacccaggaggctgaggttgcagtgagctgagatagtgcccctgcactccagtctgggtgacagagcaggactccatctgaaaaaagtaaaattaaataaataaaaattaaattaaattaaataaactgggtatcctgtgacattactttgttctatgtttaaacaaggataattatgtttttaaaaaaggatttctattccagggttccatggaatagaaatttgtttcttaatgaagtcatatttgacacatccaaagccacagatgccaaaacattgataattaaagagaagtatagattttcttcactgtcatttgaggcatttccagaataatttttacccaaacatgaaacaaataaggaatatcaaatgtgagatgctgagagtttcttatatataaattttattacatctgctaaattttgtaatattgttgtaattcatgaaacatttttaattgaagtaaaatacacacacagtttatcatcttaaccatttttaaaaatcgtaagcattttaagtgtgtggctgagttctgttttaaggagatataactgtcgcacaaccgatatccagaactttttcaactggcaaaaccgaaacttgacccgtttatctcagcccagccctagtagccaccattctactttctgtctctatcagtttgctccgagaattctatcaatctgtctttattaattctgctctaagtacctcatatatgtagaatcatgcagtagtggtctttttgtgacaggcttacttcacctggcataatggcctcaaggttcattcatgcggtaacatagttcagcatttccttcttttccaaggctgagtaatattctattgtatgcatacaccacctttagcttatgccttcatctgtccgtggatacttgggctaatgctgctatggacatgagtatctcttcaacaccttgctttcagttctcacggatatatacatggaagttgaattgctggatcaaatggttacttttactttttcaagaaaccaccgtattattttccatagtgcctatatcattttatattcccaccagaatatacaaggactctgttttcttcacattctcaccaacacttgttatttctgtgtttctttctcttttttatttgtctatgtatgtatgtatttatttttggatagtgccatcctgatgggttgggtgtgattgctcattggaaggttttcatttttatttccctaatgagtaatgatgttgagcatcttttcttattcaagtcctgtgcccatttttcaattgggttatttttgttgttgttgacttgtataagttctttgcatattctggatagcagttgctttttcagatacatgatttgcaagtattttctcccactccgtgtgtgcgtttccactctgatgacggtgtcatttgatgcacagaagttttacattttgatgcagtccagtttatccatttttcctgctatggcttgtgcttttggggtcatagccaggaaatcattgccaaagccaatgtcaagatattttcctccatgttttcttctaggaattttatagttttgagtcttaggtttaggtctttgatccattttgagttaatttttgtctgtggtgttaggtaagggtccaacttcgttgttttgcatgtggatacccagttttccgaataccagctgttgaagagactgtcccttcccccagtgaatggtcttgccatcattactgaaaatcatttgcctgtatatgtaagagcttatttctggcacttctactctattctattggtgtatatatttatttttatgccctcttccactatcacctggccattgcccaacactgcaattaacaatttttaaattgctcccttaacaaaaaaagtttttttaaaagacattttttaaaaagtattggagattgtaggatgggcagcagactctcatctttgaattatgagtgtggctgcttaaggtaacaatgtcacatgtttattctgataagactttccgtgttgctgcaatattaaaatgctattgcttttggacatcttgagtctttagtaaaattatcatcctcttgcaaattgttgggaatgcaggcattttttcccctccaaggcataattaggacacattgcagaagaaagttagattttttagaatcaatttttttcttttcatattttactaatactataggggaaatggggaaatgctatttctcattcaaaagcactgcactggagcatcgtgatgttttgaagctctctcctcacctcctcccacactgtttggtgctcagtcttctttccatcagaatcattgctgatggatgcgtctgtgatgctacagcaccggggaaggctccgattcatacaaaccctcttccactgtcccctggccattgcccaacactgcaaaatcctttgtcctttggctgagcagccctttggtgtgttaagatgaagagtacgattgtaaattcaacctccacccctgaaggtgactacagtttggatgctgccccagggcagaattccagtggacagagcagggagtgggatcagggctgagaccactgagaccttcctgggtgaggcagatgcctggagcagggtggccagaaagtggatctccctacatgtttataagattctggcattactgaagggtattgaatggctcgaaagttcaagccctccaggcacagcagggactgcgggcactgccaggtgtcatggcccaattggcattgctcaggtcctttccctgcagcaccgcccttacctgccacctgtgtgccctgtggtcttacctgccacctgtgtgccctgcggtgagcctgtgaaacgatactgttaccttctctcacttccttgatgcctgttgcttattctcttgaaggagcatggtgcaggtctggattctacctgaaacgtctccaggtgactgtgtgggcaggacttttggaagcgcattgaactccaggtgacagagaagaccagcgactctgtctttgttagaaacagaccaaaacttgagaatttggtgcaggccgtccttgtcatccctacttgggagaggaatagttagggctgaaacaggtcaccgtaactgatgagggcacagtctatgcaaagccagtgctgccaaggaaagtgtcttctcacaagcaagactcctttggcactagtgtcttgtgtgtctcagtgggtgtgagcgtgtgtgtgaggaaggagggcagggggctgctgcctgttgggacagcacggcatgtgtgctgcaaattaatgggatctggagcctggagacagagtcttgtcccttcccagctatatgacgttaggcagatcactgaccttaccacatctcagtcccttctaaatccaggacttagcataacaacccattcgcctctccactctccacgcaggcttgtgtgagggctcagtgtagtggtgggattttgttctttcctctgttcatccgtgcattgatggattgcttcattcaatagtgagcatttagcacaggtggggaggaaagccccctggggaaggagcacagacccgatcctggcttcctacagctcgcaggttcctgcacgttttatgggggaggccaatactgagcatctgctctgtgcacctgtgcataagggggagggacgataagggctgcattgacctagagctgccagctgggctggggcttcctggggcacctttcacagtgccccgctcctccttccagcatttcctgctgccctttgctgattccaccctctcgtgattttgttccactgatgggtccatttcagcctcctttccaggctccagctcctgcgtctgagctctctctgctggtgtggtctggccgcttggttctggcctctctgtcctctctctacaagctctctgtcagtaatgccgctatgtccctgcctttaaatactatttgtgcttgataatttacaaacgtgtctgtccactgaaacctccggagacgtatacaactgcctccttgatagcgccacagccaagaccaccaggcacagctgcgcaggctgtgcactgcacaactccaggggcatcgttgatacacacggtaaagcacagtgacgagcccagcagaacagggtaggacacgacagttattgctgctgatgttctgtgtagaaaacgtgtaacaaatgacacgtccttaaccttttgaggcatttatattactccgtatttggatactgaagtgccataaagaggttttgactgctaaactacagtttcatacttatggggatgcatttgtgattcctttatgtttgtaagtgataccatactgctgactacctagaaagcttctcatctagaactaaggattccgatacatttttgaggagaaagaagaaaaaagaatgtaaggtcgttgtggctgtagcttcagaatagatccctttatggtaggtcagcactcatgccatacactcttgtcagctggtttctcattttaggaaaccacggtctagtgaggagtttggaatcgggaagatgagttcaaatgccagccctgctgtgggtgatctggggctcgttggcctcacccttgctttggagaagctaaactttgaagtgtgtggaaggcagcttggatagtcctggcatgtttgatggatgtcacatttcaatgcctttccttcctcttctctgtggacgtagattaaattcactctcatttattcctgaagcatttggagagcaggtgccaatgtcccaggcacaggtggaaacacgtggtgcgtacaaccttgctcaatccctcccccaccccaccaggtcgtgatccctgagggaagcatggtctcatgcgggctctgagcaagacgggtgagatgttctgtaaacctgtggcaggctggggagaggaggccatggccagcgttgccttgggggacagggcatgaaggcacatgggtctggaaggcagtgtcaggactgagacaggagggtgagtccagagcggggacagaggacgagaactgagacctgcttcccacgcgtctgtggcccagggaggccacgtgtgagacctggtgtgggtcgaggacactgctcggcgttagaagaagaagtagtgaagggcagtattggtggaataggcaggagagggagacaacgtctccggagccagtgggtgggagccgcagggctgggcagtgggcacaggtgccaaggggaatggggtcagggttctccaggcgtgggcttcacgggggtctgtgtcgttaactgaggggcaggcaggagcaggtggaccaggaggcgtggaagggctgaggtttgctaaccgtagtccacttgggaccttcccacacgtggtctcccagaaccattccggtctcacaggtacagagatgaggttggagaggttttaggaagtcacccaataacacacaagcgtaaaaagatagaaccaggatttaatatattgatttctgattcaaactctatttttattttaaccatctccaactgtgcagaggcagttgggaaatacatgagagtcttggctgcactttagatttgggagttaacagatatggcggaaataactatgatgggagtgtttttgacccacaattttcgtgatatatagttaatcaatcactcactagttaatcactgagtagacgagaaagtgatgtctaaccctatttgaagagaacatggcagtttctgtttttcactgggtgtttggtgtatttactttttgctattgttttcctgtaatatcactactaagagattaaacatttagagttttgcagtactgagcagttggcaatcttttatcctgtgtgtgtgtgtgtatgtgtgtgtgtgtgtgtctatgtatggtatacataaaattggggtcatattctatatttgtattttaaaatattttgtttgaaaatatataacagatattttctatggtttttacatgattttaaatgagctggtactttaatatatatagatgtgtgtgtgtacatacatacatatatatttataataatttagccaaactcttactgtcgacatttaattttaaaatttactttactactaaaaataatattgcagagaacaacattgtacataataatttatgtgcatttctgattttttcttcacatatattttggatgtgaaattgttgggtcaagagttatcaacacttcaagggattttaatacatattatagaattagcgtttctgcatgtatgaaacatttggaactgcttggagcacgtcactccttcaagttgagcatcagcaactttatttcccttggttctccatctaagagcctacattcatcatagacgtttgtgtgcaataacaccaatggttccaaacctttaaccaaagctggacgaaattagaatacttttgagtcccaattaaggttggttaactttaaaagctgcagtcgatgtagtttcattttcatgtgggtctgcacttttcaaaccttggtgtcaactaggaacagatgggctcagatcctgaaagaacagcctttcctgtggacactccagcccatgctaaagacaaaattgagaattgctcagatagatatccaaacctcaagcctgtgtgaggactgcacatttgagatcagcaaccgcaacctcatgcccacactggctggccctgatgcatgtctctgagatcccaaatcttactctttaccttttcagttttcagagcatgaaaaggtatatttgggcttgtaacatggtcctgagtcattacatgtgtgtttaaatggactcctaattatttatctttctcctggaaagtatgaccaattggtattttttataacctctattttctactaagagaattgacaagtacagaggaaagttctggacatataacagagccctttctctttctttcgtggacagctcaagtcctaaacggaaaatgatgatggagcaagagagatgtgtgatgaagcagggttgtttcttattgtctgtgcgccctcactgtttgctgttgtataacaccttggtgtgtgtgtgttggggcggtgggttgtagggggagtcagaacaggaggtggggaaagtactttggatgcggtgctctaaagaaccatcccctaatgtgcttgacttttagggatctactggggatgaaagccaaaaatacacaacaaaagtaaagtacaattctgcagcactgcgtattctacaaagcattttctcattccgcgacccactcgattcttcttacgacccagtgaaggtgggattactgtccctagcttctccaggagaaaactgctcataaaggtcttctccttaccctgctaacttcccttttatccaccagaggtaccccgagcatgtaggatattcattagtctttgttgtaaggacctaaggcatgccatgctctgacagtccctttacccttgaagggaagtggggccatttcatcttgacaccttaaatgccagctgtgagctcattcccaaacgttagggtgatgtacaagagtcctgggccgtagttcctggccttaaagacctaaagtcctcttgggaaggtaaagcatagagacttgggaccacaagaggacagtccaaaatgaatagtccaaaatgtctcctggtgtagccaagaaaatgatggtggtaggaatttggctagagaaaggataattgttattggagtggtagatgatggtatactagagacagagttttagggaagtctttaaatgtgtggagaatgtgcacctgtaagaggaggtcaatgtgggtaagcacagcattaggaaataaggttggaaaatggtagtaaagtaagtattcattaaaaaaacaaaataagatgaactgcctgaaacaaagatctccttatgcccagacttgcagcaggtgaggttgacaagtaaggggtccatttgaggtaaagaactttcaactcaatttcctcaaacagcacagcttcccagcttccttagagtcccatgtgctgccatgggagagagacaagttgtgctggatgtgcctaatctctgtctgctctgtctcagggaaaggagtcaggaacattgaatgatatattgtatctggtctagaacagccctggttgtcagacactgtcctggggaaaggagtcaggaacgttgaatgattcatggtatctggtctagaacagccctggtttacagaccctgtctcggggaaaggagtcaggaatgttgaatgattcatggtatctggtctagaacagccctggtttacagaccctgtctcgggaaaaggagtcaggaacgttgaatgatttatggtatctggtctagaacagccctggtttacagaccctgtctcgggaaaaggagtcaggaacgttgaatgatttatggtatctggtctggaacagccctggtttacagaccctgtctcgggaaaaggagtcaggaacgttgaatgatttatggtatctggtctggaacagccctggtttacagaccctgtctcgggaaaaggagtcagtaacgttgaatgatttatggtatcaggtctagaacagccctgggttacagagaatgattctgccattgatcagcaatttaagatacaatgttcgatttgtacttgtgagcattgggaagactatgtataggagatcttttggaaacctgttaaaatgtatgtataagccatatttataaggcatcgctattttccagcataaagggaattaagaaattaaaagtgttagtagtttggaggaaatagtggagaaggaaacatcagaaatctgtattcccacctagataacagttgcactggcaaaatctttctgatgtaactattttggaactctggagtccattgaaagtttgcggtttctaggtaaaggcttggacagtaaagtgtggttaatttgggttaattttggctctagcacagtagcagctacccactctccaccccaaccttgcggtgaaagctgtgcacatgttcctggaacaggctgcatgcagtttgtgagaatcagagtgcggagaaagaccctgtccttcaaatatgaggaagctgtgctgtgaatgttgattgcagctgttgataacaggggtgcagacgaaaaggtggtggctgacactgttgcatcttacccattgtcccaacccttgcctcccacctccaccagcagaagtgacttccaaggtatttaaaaggctggcacacttcacccaaaaccctttattttactttttcctccttggaagccagacattaaagactaggacactcagaagcaacttaatatatggagagaattagaaagtgaccacacatgctcagggaaaggtgcaggctcagaaaagacctgagaggaccttcattttacagctcagtctcatccttggcacagagacagcccacaataagaaaaaatatatacatatattttaaaattaacaacaacaaaccccaagcaaaccctgggaaaaatgaagaatctgacttcaagagttatcacagtattaaattcaaatgtccagtttttaacaagaagttacaaggcatacagaaaatgagaaaatgtggcatatttaaaggaagaaaatgaatcaacagaaaactgtccttgaaaaagacctgatagcagatctacttgacaaacatttgaaaacacctgtcttaacgatgctcaaagaactaaagaaagatgtggagaaagtaaagaaaataatatatgaacaaaatgaaaatgttaataaagatataggaaacctaaaagaaataaagaaattctgaagctggaaagtaaaataactgaaattaaaaaaattactagagggattcagaggcacatttgagcagatggaagaaaggatcagcaaacttaaagacaggaaaatggaaatcactgagtctgagaaatatattttttttaatggaagaaaaggcaaaagagactaagggacctgtgggacagcatcaagtggaccaacatacatgttatgggagtcccagaagtagaagtgaaagagtaagaggcagagagaatacttgaagaaacatgaatataaagatccaagaagctcaatgtactctaagaaagtcacacagagacattatgaccaaactttcaatagacaaagagaattttgaaagcagaaagagagaagtagctctcacatacaaggatcctcagtaagattaatagcagatttttcctcagaaactttggaggccagaaagcggtgggcagataaattcagggtgctaaaaggaaaatcaaaaacaaaacaatcaaactatcaactgagaaccctatctccagcaaagctgttcttcaaaagtaaggaacagttcaaaaattaagatattcccagataaaagctgaggaagtttcttaccagtaaacctttcctgtaagaaatgctaaagggagtcctgtgagatgaaataaaagacactaaatagtaactcaaagctgaataaagaaataaagatctcagcaaaggtaaatacttgtcagttatatagtatcattgtaacatggtttaaaactctacattttgtttcctacacaatttgagactaatacacttaaagaaattattacttaatgcttcgatgtacagaatgtatgaagatgtgattttgtaacatagtagcagaatgaacagggtaaaaaacatgatctcaaatagaaataaaacaacaatcgaaaggtaggaacagagctgctaaaagaacagagtttttgtatgttattgaagttaagctggtataaatttaaataaaaatgttcttattttaggatgtaaaatataatcctcatggtaactaaaaacacacaaacagctatagagtatatatgaaaggaagtgagaaagaaatttaaatgtttcactacaaatagttaactaatcacaaaataagacaggacatgcaggaaatgagggacaaagtccttataagatatgtaagaaataaatagaaaaatgaccaaagtacatcccttttatcagaaattaatttaaatgtaaatagattaatctctccaattaaaagacaaagactgtcagaatggataaaaagtttaactatatgatgtctacaagagacttgttttagatcttatgtaacttgtgtctaaaggcaaaagtagcttgaaaggaaagaatggaaaaagattccatgccaaaaaaataaccaaaataaagtaaccaaaaacttaggaaatgcagtaaaactagttgtaagggaaaaatgtatagctattaattctaccctttaaaaaaataagaaaaaaacctaactttacaacttgaggaactgaaaaataagaacaagctaaacctaaagctagcagaaggaactacataataaagatgaagacagagatgaatgaaatagaaaacagaaaaataatagaggaaaattagtgaaacaaaaaattggttctttgaaaagatcaataaaattgataacattttagctacatagactaagaaaaaaagagacgtttcaaattactaaaatagaaagtgaaagtgggttttcctaagaaaaagaaagaaataaaagtgggaacagtactaccaactctacagaaataaaaatggattaacagagattactaagaataattatatgctaatacataggataatctagttaaaatggacaaattcctagaaaaataaaacctaccaagactaactaatgaaaaactctaagtaaatttataacttttataacatgattgagccagtgaccaaaaatctctggacagagaaaacctgtggacctcacggcttcactggtgaattctaccaaactttaagaaatgaatgctaatccttcttgaatgatttaagaagagggaacactttctaattctttgtatgaggccagtattattctgattccaatgccagacaaagacactctaagaaaaggcaactagaggccaatatcccttatgaacatcgatgccaaaatcttcaacaaaatgtagcaaactgaattcagcagcatattaaaaggaatatacaccatgatcatgtgggatttattcctggaatgcaaggatgaatcaatatgtaaaatcaatcaatgtaatacatcatagtaacagaatgaatagggtaaaaagcgtgatctcaattagatgaagaaagcttttgagaaaacttaacacacttccatgactaaaaactctcaataaactcagactagaaggaaactacctcaacataataaaagccacatatgaaaaacaaaaccattgtaaacattatattaaatggtgaaagaccacaagttttttccctaagatcaggagtaaggcaaggatgcctgctttcaccactactatttaacatagtactgaaagttctagctagaacaattaggcaagaaaaataaatacaaattggaaaggaaggcatacacattggaaagggagaagtaaaattatctctgtttacagatgatatgattttatgtgttaaaaaaccctaacaatgctgtacacacacatacacacacacacacaaaaaaacttgttagaaccagtaaatgaattcagaaaagtagcaggatatagaattaaaacacaaaaatcaattgcacttctgtacactaatgatggacactctgaaaaggaaatcataaaaacaattctgttcaaaataatattaaaaagtaaaatgctttggaataatcaaataatgtgacagatttgtacaataaaaattataaaacattgccaaaagaagttaaaaaagaagacatcaacaaatggaaacacatcccacgttcatggatcagtattagtactgctaagtattagtattgttaagatgtccatactactcaaagacacatacagatttaactcaatccctatcaaaattccaaaaacatttttttgtataaatagcaaaattcatcctaaaattcatgtggaatgtcaagggacactgactagacaaaataatttttaaaaagaacaaaactgagtactctcactttgtgatttcaaatctcattacaaagctactgtagtcacacagtgtggtactggcataaagacagatgtatagatcaacagaatagagagcccagaaataaatcatcacatctatgccaaatgatttttgacaagagttccaaggccattcgttggaaagaggacagtcttttcaacaaatggcatgagaaaaccaggtatctatatgcaaaagaatgatattggacctttgcctaacatcagatacaataattaactcaaaatggattaatgacctaaaggtaagacctaaaactgtgaaactcctggaagaaagcataggacaatagcttcacaccgttagatctggcagtgacttcttggatatgatgtcaaaggcacaggcaacacaagaaaaattgtacaaattggactttaagaaaaattcaaaaattggtgtatcaaaagacactatcaacacagtacaaaggcatccatggaatgagagaaaatatttgtaaatcatatatctgacaagggataaatatccggaatatacagagaactcttaaaatttaacaaataaggtacctgatgtttaacttatgcaaaggatttgaatggacattttttttaaaaaaaagatacacaaatagccactaaggacatgaaaacatgctcagaacacatgcttagcatcatggaaatgcacagaaaaactacaatgaggtgccaacccacacccattataatagctactgttttaaaaacagaaaataacaaatgttagcaaggatgtggagaaattggaacgtttgtgcactgttggtggtaatatacaatggtaaagctgctgtggaaaacagtatggttgcctctcaaagaattagaaataggattactgtatgatccagcaattccacttctgattatgtacccaatagaactgaaagcagattctcaaagagatatttgtatactcatttttatagcagcactatttacaataattaaaacatggaagtaacccaagaggccaccagcagatgaatagataaatgaaatgtggtgtatatacataaaaaggaatattattcatccttaaaatgaagaaaaataatcctgacacaggcagcaatgtggatgaaccttgaggacatgatgccgagtgatagaagccagtcactaaaaggcaaacactgtgtgattccacttacaaaagctacttagagtcaacaaagtcatagagacaaagtagaatctggtggccaggggctggggaaggggaaatggggagggagtgtttgatggagacaggggttgagctttacaagttggaagtggttctggagacagatggtggtgatagttatacaacatgatgaatgtatttaatatcacttaactatgcgcttaaagatagttaagatggtacattttatgttatatgtattttaccataatacaaataattgaaaaaaatgaaacagcatttcatacacactagaattaaaaagtcagaaaatagcaagtattgacaaggatatggaaaaaccctcatatagtttggagagaaatgtaaaattgttcaagtgctttggaaaacagttttccaaagtttaatcagagttctcttatgaaccagtaattcctttcctaggtgtataccaaaagaattgaaagcaaaagtcctaaaaaaaacacgtacataaatgttcacagcaacattattcataacagccaaaaggtgaaatcaacctgaatattcatcagccagtgaatgaataagtaaaatgcagcctagtcacacaacagaatgttatttgaccataaaaaggaatgaagtgttgatacacactacaacaaggatgaacctcagaaacattatactgagagtagttattcacaaacgacctcatatcatatgagtctctatataaaatgcccagaatagggaaatctatagagaaagaaagcagattaatcatttactagggctgaggaggttgtgtggaaataggggctgtgactgctaatagctatgtttttttgggggggagatgatgaaaaaaattttaatatcgattgtgttaatagtgttgtggaactctgaataaatttaaaacattgaattgtacaatttgaatggatgaattgtgtgataggggaattgtatctcaacatgcatggattagtaataaatttctaaactctcccttataggttcctatgacttcatcaaattcaaaagtattctgtctaatagatttattttgtaatgttacgagcaactgcaaatatttaactgagtcacagaaaatggtgagaaataggggcaagggttatgcaattccttcctctgctgcttctcttttgcatcgttgtgtaccgttcgtacggttcctgtgtatggtatcataataatttatcttctctacttcttactgtggggactgtttgtcttagtgtccctggttcagcatggtttctggctcacttaagtcagctgaacaaatatgagtaagtaaaggagttgcatagatatataatattgttccccaaatcactgaatacaaagtctagtggcagaactggaaaagaaaatgctagatgtctaaattctcaaggcagcactttatccatccaacagccttgtagattgaatactcacatcatttccttctctacacactctacactgcttcacagaagctttgcactccaacatttgcaaaggacccacacattcccttgtgcaattgaactcaagagagaaaaaagaaataaaatcatgaaaggactgcaccatgtcttctctttgctacttcttccccaaaatttgtaataagccatgcagcagagatgggaagtttgatttggcgtattcttacatggaagagcgctgttctttatcacattaattttggagttggctctgatgacctcccttccccaagccagcactggctgtgagcgcatccaaaccgactgcgattcaccaatggatcagtaactgttttggaggctgatgatatgaaaacctatctggcttgttctgtttgttcacattctattgtggttcaacggcattttacaaaacaaaacaaaacaaaacatattcttagttccaactctctgctatccaaatccatgtcttctgacttttcattaccaagtagaagtccagggtaagagcttagcctccataggcttgtcacttcttggaagaaaatcataaaccaacgcattagttatcttatgccaagggctgggcagcatgcagagagacatactccgtcccctcactcattagaagggcctttgcaaccttttggtgtaatgatgtctggccagggaactgcagataacatgagaattaagtgacatggccctcgctggcctttgggctcctctcccagcctctcctctgccctgtggccatctcagcactcaaacgtccccctgcttcttgttgctggttgctcggaaaccttgggttccagacaaatctttttccccggcaaagctgcacctccacagggccccttaaaattctactttcccctgtgttctgatctcagctgcggatggggaaagctccaacttaaataaactcacagtggacaggaacgactcatatttggcttatgaattagtcaacttgattgactactcgtcagggtgatgggcaaggcagtctttatttcagaatataagagatgctgtgccaacagtatttgggaattgcttctatatggtgcattttagtatttattgagctatctcatgcaccgaaaattatcgtatgtaggaaagaattaaatattgacttaatttaaaaattaccttttttctttttttgagacggatcttgctctgttgcccaggtgctggagtgcagtgtgcgatcttgactcactgcaacctccatctcctggattgaagcgattctactgcctcagcctcccaagtagctaggattacaggtaccccaccatgcctggctaatttttgtgtttttagtagagatggggcttcaccatgttggccagggtggtctcaaactcctgacttcaggtgatccaccctccacagcctcccaaagtactgggattacaggcatgagccactgtgcctagccaaaaattaccttttgattaaaaaacatacatggcacacaatctatacgttgatgtagttcccttttaagtattttttttggcaatttacatgtatattctatatgtaaagcagtaaaatgctacaatcattctgattggggaattttatgtgacagcatagtttattagtaatggtgatttcgagagcaatatttgaggaggagtattttactgcttttctctccggttatagagcaaggcaatacatctgcagtcgttctaggggctgccctatcacagcaccacaaatgggtagcttgaaacagcagaaacttatgctttcccagttcaggaggccagcagtccaaaatctgggtgattgcaggcctgcactctgggtaaaatcccactggtctcctctggcccctggtgcctccggcactccttggcattcctccgcttgcagatgcagctgtctgctcccatggccgcttccccccatgtcttcacattgtcttccctctcttccatctatgcccatctgtgtctgttttctcttcttatgagggtgctagttgcatgagtttgctggactgctgtaacaacatacccagactgggtggctcagacagaaactcactcagttctggagggtgcaggtgtgagatagtctgtcacagggcagctcctcctggggctgtgaagagcacctgtttctggcctgtctccactcctggcagtctgcagggtgcgtccatctgctgaaagccagggcactgtgggtgggaggcagagaaaactaacattttcgcaggaggcagagatcaggacccaggttctcaatcgaatcgtctgggtccccttggatcacactgttttagagtggaatatattgagtcatctgggtccccttgcatcacacagttttagaaggaaatatatcaaatcgtctgggtccccttggatcacactgttttagaatgaaatatatcgaatcgtctgggtcctcttggatcacactgttttagagggaaatatatcgaatcatctgggtccccttgcatcacactgttttagaatgaaatatatcaaatcgtctgggtccccttggatcacactgttttagaatgaaatatatcaaatcgtctgggtccccttgcatcacactgttttagagtgaaatatatcgaatcgtctgggtcctcttggatcacagttttagagtgaaatatatgaatcatctgggtccccttggatcacactgttttagagggaaatatatcgaatcatctgggtccccttggatcacactgttttagagtgaaatatatcaaatcgtctgggtccccttggatcacactgttgtagaatgaaatatatcaaatcgtctgggtccccttgcatcacactgttttagaatgaaatatatcaaatcgtctgggtcctcttggatcacagttttagagtgaaatatatcgaatcatctgggtccccttggatcacactgttttagagggaaatatatcgaatcatctgggtccccttggatcacactgttttagagtgaaatatatcaaatcatctgggtccccttggatcacactgttttagagtgaaatatatcgaatcgtctgggtcctcttggatcacagttttagagtgaaatatattgaatcgtctgggtccccttggatcacactgttttagaatgaaatatatcaaatcgtctgggtccccttggatcacactgttttagaatgaaatatatcaaatcgtctgggtccccttggatcacactgttttagaatgaaatatatcaaattgtctgggtccccttggatcacactgttttagaatgaaatatatcaaatcgtctgggtccccttgcatcacactgttttagaatgaaatatatcaaatcgtctgggtccccttggatcacactgttttagaatgaaatatatcaaatcgtctgggtcctcttggatcacactgttttagagtgaaatatatggaatcatctgggtccccttgcatcacactgttttagagtgaaatatatcgaatcatctgggtcctcttggatcacagttttagagtgaaatatatcgaatcgtctgggtccccttgcatcacactgttttagagtgaaatatatcgaatcatctgggtcctcttggatcacactgttttagagggaaatatatcgaatcatctgggtccccttggatcacactgttttagagggaaatatgtcgaatcatctggttccccttggatcacactgttttagaatgaaatatatcaaatcgtctgggtccccttggatcacagttttagagtgaaatatatcaaatcgtctgggtccccttggatcacagttttagagtgaaatatatcaaattgtctgggtccccttggatcacagttttagagtgaaatatatcgaattgtctgggtccccttggatcacactgttttagaatgaaatatatcaaatcgtctgggtccccttggatcacactgttttagaatgaaatatatcggggaggaagacagagactccagccatcattctttctttgaaggtcatgatattttcttgtgtctcgtcaaggcgcgcagcatacaaggcattgtcacaccaggtgggctccagaggggacctttcactgggcagctgactctcactcaccccttgatggcctgcacgcccacccatcttcaagttcacagtggcaactcggaagcaaagtggtgtgccaagtgagatttcaggatttagccttgataggatcttagaaattgctccttgcaagcccctaggtttatcagtggattgaggggtagaattgagatttttaaaatgtcatgtggacaccttgggtgtttagagacagcaggtcagtgcacctgccatgatgccagggctcagggctccttggaacaaccttgacatctattgggacatctcctgtcttcaaatccctccattctgaccacacgcttactgtggctgagtctgggctgaggctgcatttgggatttggattcccgctcagcactgagtggggcagcaggtggaggtgagccctctgttgctgcccaggtgtgcccatgcatgacttgagacacggcagggcagctgggggcagcgggggcggctggtctcactcattaaaaggtgaccccgtaggactctggagaggtcattcctgatggcaggaaatatttctgcatcatcttgtgcaagggggcagcgggggcggctggtctctctcattaaaaggtgaccctgtaggactctggagaggtcattcctgatggcaggaaatatttctgcatcatctcatgcaaatcattgcacatgctgctcacgccagccttgcttccatgctcctgagtaatgccgtgtttttgatcttggtcttgtggaagctggagaatttgaactatgaggatgcaagagacagatgatgctgaacggacattaactttatttttattaaaatcacaagttaactctcacaggtgaaattttggatgctaagataatgcaaagatgttagtttccataacatccgaatcatgggatgagagtcaagagaagaattaggaaaggaggtctccaagacctcatggcagtctgagaagtttctggcggctggaaggtgaagactgcttggtctcatgatgatgtcacccatggagcatcttttaaaataagtatttgggatcaattcagctgtaagatcctcctgggcaactcccaccagtcagccagagcttcctgtgcgtatgtaaagatcaaaaacattattgataataacaataaactatttaataaaaatttaaaccaaaacattaatttgatactctatttaaagtatctgcatgagctgtgggaatgtgtctactcttgtcagacacagatacagaagagccattgagttgacttaattgtgattttattttgttatttttaaagagattgcttgttggccgtattataagttaaaattaagcgggaaccttaactgcagaaatgataaaccccatggagagtgaactgtgctgttcatcatcttaacttctctctggaataagtgcaggtatcgctaactacatcgaaatattatttttaaccattttcgagccacccacacattctcccgcattcttctttttgatacatttcattttctcactttagaaggaagtctcctaattctgaatttctttgaacatggctcagtcttactggtctgcatctggcattactaatgcacttaattaaacaaaataatgtctccccaattttttattcatggaagagaaattacaggttgtatctgaagggaatatttctcttgaaaggaaaaatataggacttacctatctaaatgagaaaagtcagttgtatttaaaatggaagtttcaatttgccaagcacatgagaataccgttggctggccccatcctctccaagatacgaggcacacacacacatgcatgatgctcatttttaatccacaagacacccacctacctttccatagttttcagttcaccttctattttcaaagcaagaactatgcaaacataaaggaagctctaccacctctcagcctgctagccctaggccaaggggcaaattcgcacaacaatgggttgatcaaatctgaccaatctcaacttcacaaagtcactcttacaggtgtcactcaaaaccaacaactcagtccagtgataagggtgaaaaagtgtggcagaaaatatacacacaagcatctgttacgaatttcatagttattaccacatgattaaataaaaagtattgcagtgtgaggtaggtttctctaaatcaacttttctttcagtctcaagatgacgtgacctacgaggttgatgacattttagagagagcactgtctcacaggacaaaatgtggatggtgaccagaggcacatacctgtcctgacgctctcccaccaccacaaaataatttgtcactctgagcaagacattgcatttctctggctttaatattgccatctatagagtacagaaatgtgccttctcttccttgtgttgtaggtttgttaggatcgaatggaatctgtttcagcatcactgcatgacgtcgtaaggctgactttccttgagctctccatacattgtgaaggtagcttcaaaggaagagttcacaaatttgaatgaagactaaattgttggaatgtttagatatgctcaaaagtgattttttttttttgagacagagtcttactctgtcatccatgctggagtgcagtggcaggatctcagctcactgcatcctctgcctcctgggttcaggcaattctcctgtcttagtatcctgagtagctgggactacaggtacacgccactacgcctgcctaatttttgtacttttagtagagacgaggttccaccatattggtcaggctggtctcgaactcctgatctcaggagatccacctgcctcggcctcccaaagtgctgggattacaggtgtgagccaccacacctggcctcaaaagtgatttagttaaagaactgacttgaacatttatctgcataagtatggatttgttaaaaacttaattcctttcccttcataatcttactttgtacaagatcttctgtagctttgcatgatgatgaaggcaaatgttttgtgaatgatgtatggatggcaaagtaagtgacaagtttccagaagcgaaggaaaactgttactgttcagaaaatgatgttcaaagtacaaaggccaagatatcttcagaatggaaaccactgtgataagatctggctgtctaatagtattgcaacttaaaattatattaatttgatatattaatatcaacattttagggatattaaatcctaggtagttaaaattagcttttgacaaacaagttgacattgcggacatgattttatttttcaaaaaagtgtataagtcctagtttttcttttcttagttaaatgacagccaagaaaataaatttcatctgaatatttatttcatcagacatattagtttttaactgtctttatcttttctattttaattggttcttgctattcagtgtctgccaagaataacttccagaggagttgttcttcaaaaaacaaaattagattctatgtggtagccacctttcataagtgcatttggtaaccttaaaatattatgagtgtgggatcattccgatgccattggaacgatcctgaagtcttttctctgtttccatcataaacctcattgttttcttggtttgacattattccaggcatattggtctgaatcttggcaagtgtattagatggttattccagatgttactaagagcagttttccttctacacgctctgagtgcaagcattcttcatgacatggcaaagctaagagcagctttccttctacacactgtgagtgcaagcgttctttaggacatggcaaagttttggtctgggctcaggtagttcagtggtagggcaggcatgtgataagctggtctccttaggtttcagcagacacgcacctaatgcgcacccaaccagtaaatacatgaaaagagtgaatactttgcctctcttcttccttctcctctttttctgaatttaacacctagatagacttcttcttggctttagccgaaacactttactagggctaaagtgcccatcagaatctttttggataaatgaacacacacagcaaacattttcttctatgcattttcacagccaacaagataggggatcacttcctaagcacgttgaaaatgagtgggcagtgccctttgacttacgctgcttagagtgccactgatttcctggtaagcctaagacttggaggagacgtgaatggagaaatgcacctctcctcatactggggttttgcgattctttcccaaagggctgggagtgagagtgaaccctcggctggagcagccccatcccagcagctgaagggcaagggaggtggctgggaagggcgggcaccacttcgctcccagctgctgggatggaatcacagccttgtctaagtgcactgggcctgggagggctgggatggaccatcctggctgaggcctccctctgcctgcagttcctggggaatagggaacctcccttgggccggggtgtgctcacctcgctcggccttgccccttccctcatgcctgcatcctccaggccccgcctctggcaccttcctgaaacccgcagggaacctgctcacaccatgacccttctcagagggtctaaggtaagagcaaaacagggtgggctcaggacacagacacctcctggctcagagtggttccaggaaagccatgctcctgcgccctatgtgggctcctgcagaccaggctttgtcttgctctgagtgagtcacaaaggagggacctccggccaagggaaaggctccttgtggcccaggtgtaggtccctctgcgggtccacccccctctaactgaggccctgtggaaagcccaccgtggcaggtggatcttcttcacttcctctctcagccactggctgacgccagccagggtgaccttgtccgcggctcccggtgcccaccgctggggtcgcttccagagctccaacattttccttgggaacctgagtttttaattctatctctttgtcacatttaatttttctataaagtacagatcgtagatgtgggatgctgtgagcacctcccgaacgataaatgagtgtgtgtttgctgtggtggcagccctgaagttcgcaatgcccgggaagcgtttggtgaaactttaaagaaagcccaggtgactcctcctggggagcagcgcttcgcaaacacctcaggcctgcgtctgccactcccacactgcctgccccctttggccacaggacacaggcgtgacccgggtcacagggctctgctagctcatggcttcactcacctgcgcggttccctggcagcctcacccacctgcagggttcacctgggggctccacccacctgtgcagttccccatggtggcttcacccacctgcacggttcacccacccacacggcccgccctgccctccttggcctcctcaccgatgagcggtcagggccgggccgagctgggagctcaggcctcaaagcctatgggtgccctgcatgcatttcctctcgcctcctcgctcttttcttttaatgtctaaaatacctttgaagtccctcaaaatcctctgtactccctccacaaaagtctccaagcttctcatcctcctgtaattaaggtgtttctattctctctgtaattaaaagtgtgaatttcaagacactgttcttaagttactctgcttggcatttaggatttgttcgattggtcacagagcctggaagcttttcggtactcatcttgttgcaactgtttgtttcttgggcattttgtggaaaacactggggtttgggaaggcagggtggggagtgcttgccctgcaatccctgtttctagataacactgtctggaagagctgtctgcagtgatggaaatgatttatgagctgccttgtcccagacagcagccactagcacaggaggccatgaggactcaacacatagcaaatgagcgactgtcttcagattttacttcattttagttaatttaaacgtgaatagattcatgtggctaatggtttgtgtgttggactgtccaagcctgggggaagcctacccatgctcgggggtgatggtggagttgcagacgggaccaatcgcctgtcgccccagccctcgagttctgtcccgagaggtcctttcttctgagaggtttcttccttggccggcacctggacggggctgcggcctgagaggtgtcaggtgaaggactgcaggaggcagcggtgagggcccccaccctggggcctcccgagcccttccctgcccatctccaagattgcactgtgcacctcagcgtggggacccttctgagtggggtgtgatggcttttcagttgttccatttcagaggactgtggggagaattctcttggaaggattccatgtctgggctatcgcatagtgtaaacaaaggctgtcgaaaattcaaagaatctgttttaatgcgtgacccaaggtgagaggggaacaggagcctgaccggagcccccaccgcctctcctccaggcgaggggaagatgcggcccccggcaagcatggggaaggctgagcagagggctagagggggctctgtggcccaggcccgccccttcctctcaaagcctgtgagtgtaaagctatgcgagagccctggggctgccgtcctggggaaagaaggcccagccctggccctgtggttaagggccctggttggaacggagggcagggcccgggccccaagcccatgactgggttctccttccctcgcagaggagcccggtggtcactgggagcctcagctgtgcgtggtcaaatgaggtgcctgggctggcatcttcgtgtgttcctgggtgaccctgtgagcagctccgtttagcctccagccctgacaacatcccttcccaaagggacggcctctgcacctgcccccaggcgtgggcaaaggggatccagctctttttattacagagaaaagaattcgcccttcctttcataggtatctgtggcctccgcggcatgtggtggtgaatgcggatggaggtgggggtcttcttgagtgccctctctcctccagggaccctcctgcctacccgggcagtgggcacgcagatccctcagtgacgggggaagcaggttcctaggagtcctgagtgggagcaagaggcctgcccccggaacgtaccgttctctggacattcatgggaccaatccccgttaggagcccgtggtcttgtcaggaaaacctggctcagatgaagtgagagacaaactcggttttcgggttattcaatcatcgccctgcattggcagctaagcattcttagttttgaggtctccttacaaccacgttttgccccccacaaagcaaaataaatggacacagtcagaactgtgatgatggggggtgctgaagggctataggtgacatttagaataaaatgaagtctcactgcctttagatggagacacagggctggaggctgcctggactttatgcagagatcagaggcccctgacctttaccgctgggccattttgtcgtacttttaactcacgggactgcacagccgctgcccatacaggggagccgtttctcttcaccagcatgagtgggagacaggtgatctgtggagctgcctctcggacatattgtttccagcaaggatctgcctttctgtttcctattttaaatccttcagttatgcctctcagtggaaatgatttcaccgaataacacagtctccactgaggtttggctaagaaacaaattatctggtatcttggcgtttggatgcatttccctggctttccaggttactctcatattctgtaacatgtattttagtgtaatttgctctaaatgctttgaaatgagcaagagcctcagaaaagaaactctggctgaatgcctttgaaaatgtcacttcatcagcaaacgcattcgctattccagggaaccctaaggacagagagggaaagagtggctgtccggcgggtagtttagctgtgccagaaaatgtcgaggctatcagcgaatttgtgaattatatactgtaataaaaacagagctacttcttcagtaaaagaggtcaggtcattggggttgtctgtgtccctggaatggtaggggagccgctcttttctgatcgcccttcctgctgcaggctgagtggtgagagagccgcaacatgtgactgtgttgcatgaggacggccagggcccatagcctgtctactacacatggaaaccctgggtcctcccagccctacgagtcagagtctctggggggatggccagggcccatagcctgtctactgcacatggaaaccctgggtcctcccagccctacgagtcagagtctctggggggatggccagggcccatagcctgtctactacacatggaaaccctgggtcctcccagccctacgagccacagtctctggggggacagccagggcccatagcctgtttactacacatggaaaccctgggtcctcccagccctacgagccacagtctctggggggacagccagggcccatagcctgtctactgcacatggaaaccctgggtcctcccagccctacgagccacagtctctggggggacagccagggcccatagcctgtctactacacatggaaaccctgggtcctcccagccctacgagccacagtctctggggggacagccagggcccatagcctgtctactacacatggaaaccctgggtcctcccagacctacaagccagtctctgggggtggagatgagagtccattgcccgggagacggtgctgcatgctgccgctgagagccactgcgattccaggtgccgttgggcatgtgggaaccgcagtccaacgtgtgcttcatacttactttcatggttgatttgtacttttattttcagatacttctcatttaacctctgtaatcttgtcactgggtaatcactccccaggtagcatgtttgcttttgctatcagtaaaggtcggagtttatctgatcttttgtgcgttgcagcccagagaccgatgagctatacatgagctatgaagtgtgcggcagatggggcagtgatgagagtcaaaccttcaggttagaagtcagatcagtttttccctatatgcctacagcagagaattccaactgtgtgttacctcccaaagttttaattgtcttctacgtgtgaaggaaataagtttatgtatttccagtgcgtatacttttatgtcaattggaaactactactttatatccagtcatcctgtaattttccactgggagcccgtgaggagctacacatttcatttttttaaccagaaccaataggggactgtggagcagattggccctggggtcccacgctgaccagcagtgcaatcaggaaggagtgagttaattaatcactctgtttccatgttcttctccgcacaattggactaatgatagcatttaatgcagaagattgttaggttaaaggtactaatgcagtaaagtgtttagaacaatgcctggcccgggtgctcagtgttcaagctgtgagcagggaaagaggctaacagagatgaagtccatgccgggtgcagtggctcatgcctgtaatcccagcactttgggatgccaaggcaagtggatcacctgagctcaggagttcgaggccagcctgggcaacatcccaaaatacaaaaattagctgggcatggtggcccctgtggtcccacagcaactcgggaggctgagacaggagaatcacttgaacccaggaggcagaggttgcagcgagcccagatcgccccactgcactccagcccggatgacagagtgaaactctgtctcaaaaaaaaaaaaaaaaaaagaagaagaaaaaagaaaaaagagatgacatccgaagagggttgagcaagagaaggggagactgaagtaggaggagagggaactctgaatgctggaggtgttttgtacttggtgttggcgggtctcctgttgactcgggtggaaggacagcattcacgcgtggaacctgacggggtccctcacggaggtgttctagggtctccgcgtggtcatgccccgtgttcttgcactcattttctccaacaccttctctcggccctgctacttgccccggtgattctgtagggaccccgggtggctacgcgaatgtggctctgaagacaacactcttcactgagctgcagctctggccagacactgctggactccaaggccatgtgggtgcacaagcttctctaccccccgaggaggtaccgtccatgggctcaggagcactgggcttagagtccatgcccatgcattccgtgtctacaagggtactgcttcacagtggccgccgaggacgcacacgagtgcttcacactcatccaggggcatctcgattctcactgggaccctggataagaagcacttttgtagctaaagcaataaggatggtgcctgaggctgcatgaacccccggaacacttttaagtgaccaaaagcatgacaagactctccgacagagtgggcattgcttatgagagggggaagttcagctgtgttacagtatttcataggggacttgtacaatctaccttgtgcctctaaacacttctgacccctaagaatcgtggccggatgctaaggataatctttcgttgtcattgccagagataattattgcattaatgtaacaccatcctcatcatatcttattaggaagaattttagaataacagagcttctactgaatctcaaataaaactggattggaacaatgaataacctgagagatttcttaaattatctcaaaaattactaacagggaggaaaaacatccattttcatcattgaaattaacatggatgtggagacagggaaggaaaataaacacaaaataaatgttttggaaaaggagaagagagttgcagagcaaaaagtacaataaagcaccatccgtcccttgctgcggtgccaggaacctgcattgtccatccctcgctatggggccaggaacctgcatcgtccctccctcgccacggggccaggaacctgcatcatctgtccctcgctatggggccaggaacctgaagcccattctgcagaatgtgaggtggggggaagatggaaccaagagctctaggaaatcctggctcaggggaccaaaagccagtaaagcattggtaaatgcacttataaaaagttccaggtccactaaaaaacaataaaggcagtgtggcaaacagagaaacaaccacggcctcagggctcctgctttcctctgggatctccgtacccaacagcgtcacccaggggtggctggggttcagccttgcttggttgtgtgtgcatcctgagaggtccgtcttgattccccacagaaggtgggagcgtctccaggcgtttggtcctgagaggggctgcctcgccctggccacatcctcctgcacatcccttgggtcttcccgctggctgcagatacctcactctggcagctctgtgcagggctgagcccctgccctctttcctgcatctgcctccatctttcccaggcttcctgaagaaacctgctctctcttcttgaacttctaatttagctccctttttactgcacacttctcattttctctttgaaaatgatcaccagcaagaggatcccttagtgctcacacagtagagttgaaatggcaaacataccctatattcatttaaatggtagataagcaggacctctgctccaagggcttcttgcaaataacatcttcatatcttttccaaacactttctcgtgcactatcacattttgttttcacgatcatctttatgaaacaggaatccttgttatcacctccattggacaagtgaagaaatcagctctcacatggctccatacacgtccctggtcactttgctcttctgccatcgccaaggtcagcatgttccctttgaccacagagccttgccagcccgatggccctccatgccctgcatctgcccacagccaccttctgcgtatttattgggtttgtggctgtaatctagtcatgcagattaaaacaaattcatctcattcaattgtttgctcttggttttaaggtcctatggatacccagtaaatagaacaaaaaggcaaaagggggtcaggaatgccgatgggacctacattatcaccactttcctaactcactgagttatttcactcagactcttaaacttactaagacaagctgcctttgaaaagctgacgaccagtgtctctgattcatgcctcacttacttttttattttattttaatttaatttaatttaatttaatttaatttaatttatgttattttgagacagagtcttgctctgtcgcccaggctggagtgcagtggcacaatcttggctcactgcaacctccacctcctgggtttaagcgattatcctgcctcagcctcctgagtagctgggattataggtgtgtgtcaccacgcctggctaattttttgtatttttagtagaggtagggtttcactgtgttagccaggatggtcttgatctcctgaccttgtgatctgcctgccttggcctcccaaagtgctggaattacaggtgtgagccgccgtgcctggccttttttttttttttttttttttttttttttgagacaaaatttcactcttgttgccaaggctggagtgcagtggcgcaatctctgctcactgcaacctccgcctcctgggctcaagtgattctcctgcctcagccttccatgtggatggattacaggcacccaccaccatgcccagctaattttggtatttttagtagagacggggtttcagcatgttggccaggctggtctcgaactcctgacctcaggtgatttgcctgcctcggcctcccaaagtgctgggattacaggtgtgagccaccatgcctggccaccttgcttgttttctaaatgagcagagagcacttacgtcacgtctccacagtgagctcctcctggtgagtctctgtgctcctgtgaggcacctccgtcagcagggctgtgctgaggctgggaagcaaatgccctccccgcatggtggttttcttcatggtactcgtccacatatgaaagagctcgttattttatcctcacagctacctcaaaggtgacaaggtattattactctcattttacagattagcaaattgagtgtcagagattgcacgggtggaaaaatgcagaaccagcattaactctcccctgttggtgcagagcccagcggcaccacccatttgtgctaggaacatgatgccggctcagtgtcccgcagaggctgtggtggccagagcccaatgttaatgcccccaaactgagcatctgtgactcagtctagtgcatcagggaggatcaaaaaaacgcaccacaaaattggtgagatcctgtgcagagttggctcgttggcctcatctgtgtcatgttgaggacagcacactccccagaatcctctgccggagggaggagcccagcacctccttgttttctgtttgaaccccggtctcctcaggtcctcaagtgatgccagcacattgatttgagaggcactggccaccacgatgacacacgaggcctgctttcagtggcatcctttccgatttcttcctactgctggccttgacacatccacgtctgtggatttgccctgggatgccagctcacatggcttctcatccagctcctctgggttccttagatgggcggtccccaaccttttcggcatgaggaacgtttgacattttttccatgaactggtgggtgggggatggtttccagatgattcaagcatgttacatttattgcgcactttatttctatcattacattgtaatatataatgagataatgtgcaactcgccatagtgtaaaatcagtgggagccctgagcttgttttctggcaactagatggtcccatcttggggagaagggagacagtgagagatcatcaggcattagattctcataaggaacccgcaacctagacccctcagatgcgcagttcacaatagggttcacactgctgtgagaatctaatggtgctgctgatctgacaggaggtggagctcagggtaatatgagcaatgaggagcagctgtaaatacagatgaatacagggttggggacctctgccttaggtcatcttttaggaagcagcagatatccccccagatcagctttgactgatcttccctctgagccactcaggcacctgtgttcttccttatacagcgtggtcatttgtggatgtacatttctgccctctggattttcagcttcactagggcaggctcttcttcaaaatcccatcctcctggaggctggtagaatgccttttacagagaggggtcacttaataactatttaatacattcagtttaagctgggtctgacttttgagctaactggaaacatgaggctttactcttaaagactgggagcaagaagtcgaagacaataaaatactgaagttaagggtttctaaaatacatataaagtggtgcagctaacttccatcagatgcgagatgaatgagtgaatgaaatgtccgtctctcagataccggatgaatgactgaatgaaatgtccatctctcagatgccaggtgaatcagtgaatgaaatgtctgcctctcagatgccagatgaatgactgaatgaaatgtccatctctcagatgccagatgaatgagtgaatgaaatgtctgtctctcagatgctggatgaatgactgaatgaaatgtccatctctcagatgccagatgaatgagtgaatgaaatgtccgtctctcagatgctggatgaatgactgaatgaaatgtccgtctctcagatgctggatgaatgactgaatgaaatgtccatctctcagatgccagatgaatgactgaatgaaatgtctgtatctcagatgccggatgaatgactgaatgaaatgtccatctctcagatgctggatgaatgactgaatgaaatgtccatctctcagatgccggatgaatgagtgaatggaatgtccgtctctcagatgccggatgaatgactgaatgaaatgtccgtctctcagatgctggatgaatgagtgaatggaatgtccgtctctcagatgccggatgaatgactgaatgaaatgtccgtctctgggagaaaatgtcctgtggaaagttatgttttcctttagcatttaagttttgtattgcgggctctgaaacaggatttccatatttgcttggaagatttaggttctgtgttctaaaagagtaggaccctgttttctgaaatctgaggaagtccaggctttaaaatggagaaatgattctttaaacaggcttgagtctgtagcccctctcccacctgtccccagtgactttcagaattgtgcaggctcttcacgcactgggcctcattgccagtgctgccctgtcttctgttcaatctcatttcttcctgtgtgcacctcccactaagaaagcaaacacgtggatgccatctattttctcttggcctattatttggaaagtgtgtgcttttgagaatttttttttttttgagacaaggtctcacttgcccaggctgaagtgccctggtgcgtagtcatagctcactgcaacctcccattccccgggctcaagtgagcctcccacctcagcctcctaagtagctgggtccacaggtgcacatttattgtgcactttattttgttacacccccatacctggctaatttcctcccacccctgatagagacagagtctcactgtgtggcccaggctggtctcaaactcctggcctcagcagatccttccatcttggcctcccaaagctctggggttataggtgtgagccactgcacctggccttgcaaatcttacagctacaagaattatgtatttcagaggcaacatttccttaatgtcttcttatgtcacgttatctcatatagtcagagacgtatttaatcaatattataaggagaaattttaaacatgttaagatttgaagagtgcttttacctgttttgtaaacggtttttgttttaatctttttcttctggcccaaacccagtaatttattaagaagaaacatagaccatgactttgatccattgagtctgtctgactggttttctaatgtgtgagctacttggtgtccacaaagacacttcctgtgccctcccccccaccacttccttacacctgggctcctcgcacctgtgcaaatagcactgcttcgtggaaatcaaaagaaatgagaaccccctgcaattgtggggttttttaataaagtcactcgatgtccagttcattgcattctacatttagcaaagtactttttatcttgaattagttttaagactctcaaccgagttcttttaacacatagtgaattctttgcaataggaatatttatttttcttgaatgggctgtttattaatgagcacaacttagttaaaagcttattttcttacatgcactgtcttcctgtgaaatttaattgctattaaacaggaggaaggggagaaacatgtccataacctgtatgttctcttatccctgagaaataacacttccattgttagttccgcaccagtacattatcaagaattatggtcaaattccaaatgcctggatgctgggtgcttttatttgagaaaaaatgtcgagactgtctctttccctttagagaaaatgataattacagcgtcttacctaagttctcagcatctcctcacttagggtttcaggaaatacatagagaccacctcttaaacataaaaattaacaggatttaggttattccatcttttcatctacagtaggagaaagctattaatagggccggcccctgtttgaaacgaaggcacctggggctcctactgaacacactgcaggttcatgttttctttctgttttcttccctctttctcagtgcaaagctgtgctgccccagccagctgtgtgctgcgagaacgaggctgctgagatcctcaagtacctgtgaggcgcctgtgactcggaagcattttataagatccaagcagcgtctcagcgggtggaggaccttcccatggcacagcacccgaaggtcatgtctcccaggagctgcctgcccccggggcgccccccactgctggaagagctcagtcaatgcgtgttggtgacatgaaaaatgtggttgagactcatctgtggcagaattcaacagaatgtatttatgtgccatctctgccctctttaagtgaaagcatacatatttgcaaaaccctgaaaggcaatgatctgttttcacttgcgtcttagctaaaacaaacctgaatcatttcagcaggtgagcttattctcaggaaaattagagcacgctgtttgaaatggaacaattgtgaaaaatagctcactctgagatggcaaaggccccatcacctctgggtgccgctcacctgtctcttggctccagccttcatccccacatctgggcaaggccactgccaagtagctttgtgagctccaaaacacacaggcttacctgttcttagccacacctgccactgtcacggtcctcaggtcaggagctctgaggaccccgcctggatttctggtgaggtctggggctccccacgggccgtccggcccctacagcatcttgtgtgccctacctggctttgagtccagctttggcttttggctaatctctgtttttaattcttttattggcgtgaagattttaaaaaatgtatgagtaacattgggcaaattatttaaagttgataaatttccattaaaaaaatcacagattatgattccttccactgcccatcaaggtcaccgtagttcctgcaaaacttgggtcaagatttatcttcaagatagcagagcagccctttttaaaagaactgagacttaacccacagtggtgctgacagccctatgtgacaataatataaaagtgagtgcaatttccacagccagccttgccgagttagctccactgacacaacccacctggtgatccgcagccacagaggggtacaatgctgattagctgggcaaagctagcctttaaacagagccagctgagatgcagacttcaaggtggaaagtttcattagcttctcaaggaatgcagcatcctgagttggtgaatttctttttcctctcttactggtaaaggagcatgttgatgagggccccccagcttctgctgaacctcaaccctattttccccctgctcaaactggaagagggattggaccagtgctctctttatctccacaaatgtccctgggtgaacaatgccacatagccccgctcacgtgcacaccacgtccagagggccacgtactaccatagcctatgctctgccagccacagctctgcgcgtttctttctttctttttgttaatgcattgtctatgctctgaatcaaggagaataccccttggggcaggtgatagtctggggaccaaaggcctctgacaatcctgtttgtcctggagcacagacgcttcctcagggtcaccttgagcttcaccttggtgtctggtgtttcgtctggcctgatggaggcctggacgggactagttggccggtcaggaagtggcaggacactggtgacttgtccaaggaaaacacacggggccagcacgcccagatcggaggcttccctggggtccggtgagctccgaagtctgtgtcaagctgtaaaagagcaggagggagatgaagggcctggggccaccgtgggaactgcggagcacacatggccattaggtgatttctatggcctgcggagaggattcctgtgccttaggcattttcagagaaatacacaagcttcctctgggccatgaggtcactcattcattcaacaaacatttattcaaagaacaatagtccaattgagtgcagtctagtccaattgaatgtagatttcacctaccttcagagaatgtagatgaaattgtgtggcaccatttaaatcaggaaggattccctcccatttccagatagtggacattcctgatactcgtcacttccaaaagaatggtacaatgtgatgaatgtggaggcaaattagtcgatgaatgtggaggcaaattagtcaatgaattcacaaaaggaaaacattgctactcagactttaagcgttgaactaggcacacgtgcacccccttcaaagatcaatgattcacatgttgttctgtgtcagacggccgatattgatgtagagaacttccaaattatctaggcttttgaaacagatgatggctaaaatgttcagaggtgcacgtggcgcttctggcaggggtgagaaccgggtggtgttatccctcaagctttcattccctgaccgtgaagtggcctgaggcagccttctgttttctgctgctctgaagaatgtgtctttaaatttgtctggcttctttttttctcctttaagtttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaaggtaagctgctgtttgatcattcatccaaagatgggtacatccatcatcaaaatgaatgcaaacatattttcatacttgataactttttacatttacaaactcgggtttatgttggctctttttttacagcatgtaaggaagaagagtaatttctatgaattttaagagcagtctttttttacttgtctaatattcttttcttagaatgccttattccaccatgaaagaaatttatccaaatatttcagtttttttccccaaagtcttctaaaattattctcaataagatttctttctttctttctcatttttctttttagcaagtgggatgtgtacaatagcacgtgtgcagttttcagtgattttttggtgttgattttatactctcaattttcccaatttaagaattagattcagagttaagagtctaatgcttagagccaaagattgaaatgcttcctacatcagtgaagggtttgattcagcaaaagatgctgatgtttcagagttattttcagaaagagatttaccttgtttgtcatagtatctaggaaaaaagaccacaaagactaaagatgcctttgagatgaagttctgcatcatctggcagttagcttcagcaatcctcttaaatgaaacaaaacagcagccacactgcaaaccagcactgagtgcagtgtctacgtccctgcttacccaggtgtggaataagcttgctcttcctttcataatgcaatataataccaggtaaacagatttcagttacttttgcagacgacgaaggcagaattttgccttgttctttaggcctgagagttcttcctactgacattatgaagacattcctatatacggtcacaaggatgttttgctccatgacagaccgcatgtccagcaggggtcccataacgttgtaatggagcagatgtagaaacctgttggatggcgcttgatattggcattgcgatcaagtaggggaaatgactgatgttcagtaatgatgctgggacattctgttttccatatgaaaagataagtatataaatgaagatgtatatatcatctaagtgtgtgtaagtacactctatgatgttcacacaatggtgaacttgcctaaaggtgtgtaatagtttgttctcacactgctaataaagacatacccaagaccggtacatttataaggaaaggtgtttaattgactcatagttctgcacagctggggaggcctcaggaagcttacaatcatggcagaaggggaagcaaacgcatccttcttcacatgatggcaggaaggacaagtgccaagcaagggaaaaaagcccactataaaaccatcagatctcatgagaactcactatgatgagaataacataagagaagccacccccatgattaaattacctcccaccaggtccctcccatgacacgtggggaactacaattcaaggtgagatttgggtggggacacagccaaaccatatcagggtgatttctcagagtgcatccctgtcattaagaaacatgtgacttttcccagatttagtgctctgaaaacaaggaacagcataaactccctctggagccttggtctttgcccggtggcaaactcaacccctatgcatttatctgccagcagtgtgcacagactccggatttaaaggccagactcctgtccacatgcacctgtggctttgcccatgacaaatggctattcattatcaagggttgtttttttttttttttctgaaattacagtttgttcaaagtcagagtatttcaggatgcagcatttaaaggctacacaaatgccaggtatggggcacagtaagtaggcaggtagattctctagtaagtgtccctgggaagatgattgtattatacatctgagggcacaagagagaatggtgctgtggagcttaaagtcccgttctggtttgtcggtcagatgctgtttctaaagtgtttatcatgtgatgatgttatcctcccctcatgctgggggagtcatgaagaccccaggacagaagcccactcagagggtcctctgaggaccgacaggagggcccgagagggaagtaggtggagccgggctggcagggctgagtgctggatcccggaatttgcactctcctgtgggaaatggaaagacacaggaagtcgtgggcagaacagggatggatgcaaattgctgttctgcacggcgcatgcttccctgagctcaccaggctgccccatcccagcacccgccttgtgcctttgtccaggggtgccagaccccagcgtcaccagcacgattgcagtgagtcttgctgtgctgaagccctggcgtgctttagaaaggaccacaaatggaggggtgagctactttcaaagggaaaatggaactttaattcactgattaacctcaatatgctactgagattgcaaggaacaaaatgcagtaaaaaattatttgattcatactttaaataaatgaagtgcagtggcagtatcatagctgaatcccaaacacaaagtttaaagatgctgacatgaacttagtgggacaggtttggcaagcacagcttgtggcctggaatggtcgctgccagcttgtggaacccaccccagacctcaggatccatttcagagagctgggctctggacactcatctgtttgaaacagctctgggggactctggaaaaccactttctatggcctgagggagtgccagccccttctagaaacagctaacatctggtgatgatgccacacattgaccctccagtgtacccgcacactgaggagctgactccatctaactttagcccaaatagaaaacaacaacacttggaaaatgtgtggaagtgaaagatctatatatatacaaatttcactgtagtagaaaaatagtttaaagttatttaaaacacagatgtgaaatatctttctataaaatgtccataaaagtaaagacaacatgattaaaattgaaagcatttgacattctttcactgaattatatacttgtatgcactatttacattaaaacacacattgaaactttgactatagtagcagcaatagctgctccagctttctttgtggtggtagggaaaatagaatataccatttaaaataaatgatgttttgtaaatgactgatttatttttttccctaagcatccattcttatctcaaagaaaaggaaaataatttgttgaatctaacgtacctgaagttctatagttctatatcagtattttgtccttataggtttttttttcttagtagacatttaggtttcagtaaactgtacgttattttagttttaattcccgtggtgaaaacttggatgaaatatcttagagtcattcaatgggagacacacacacacaaatacacacacacacatacatacacacacacacacacacatagacactcacataaacacacacaaacttagtttattcaagtggacaactgatatttactaagcagcttggttctatgtgattctaaaactatgatcaatttgcttcaacctgattctttcaataagtcctgacatttacttgatattaatacattcagtaaattggcgttttcttcttactgaatgattccttgaagagcgctgaggctgcgagtgagtccatgctgttctccatcagataacctctcagggagctcgtctcttcatttgattcagttcagcactgggtgccccagaactcagggactgtgtaagaatctttgtccctggcagcatcctccaggtgggaagtgactggcctgcttctagcactggaaacggtttcacgtgagattttcaataggatcccagatgctcccaacgcccggcctgtcttcagactctcctatgaggtggatggctggggccctccggggtggcaggacacctccctccacacaagggccagccatggggcacacagcggggtgcacagggggccctcatgggacttctccagagcccagtggtgcctactttgtggggtcataagcacaggaccccaaagtgccgaccccacccagcttccctagcctgccccaacgctgcaaatttgtttactctgcatctgagaaaaaacaagtcagtctgtttctttggagaccagctactcctttaagaagcatctttcagactcaaggacacacagcgcccaccaagaacagtgtgtctcgttccacacactgaatgagtgtctccttccactgccgatactctactgctagaagtcttgcttcattggctaggaaggacagtggtgcgttggacaactgtccggggataacgtgatttccagcatgcttcacccaggaaaccgcagggccatgggttatggaaagttggcgtggagccaggtacatggcttgaaggaagcatgttcttctttcctttgtgtctgaccgacgtgtgtgagactcacactggagaaagactcagatgtgatttgataccttggctgtagttataaatctcagctatctgtgctgagaaaggagaaacaatttaagaataaatttaaatatcagatgatgtactcttcagagaagtttttacaagtgatcgcctatgaagtcttagcttgtggaaacaagcgctgtagaagtggggaggtcacagcacctcattaaacttggaatttcatcttcccttttcttgccgtgttcccttagataactccagtcggatgtgccattgaaaggccgcgaagaagcttccgctttagccgtagcctttgaggatgagcatgtgagggatttcttagacaaaggagggaggatggttggtccatctctctgggtggaagctcgacacctgtgaccctctctggctcgtgggcttttcaggtgtctccctagcatgtgacttcggatctttgccgtacccagctgcagggtcacagtgacattctctttggacagggagaacaaatgtcaattaaacacagatgtcctttttggtaatatccttgttagtttatttgtacctgcatctaagctaatttttctggatgattatttcaataggaattctcatttatgttactgaagaagttttataccataaattatgacacacaaacaaatataagggagaagtaggcaaaaataaaatggacctaaccaaagtaggtctcacttaaatctaaaggattctgttggaaagaacgcacagacacctgtagtcttcagaatctcgtgtgtggtgctgcagctgccaaggcggcaaacgttacaatcagtctgcggagagactgttccccgcgcatcacagatcttgaaataactgggtgtcacgcccttctgatagtctagatttggatgtggggctgggctcggagaggctccgtccgctttccgctccacgagttgcctccagttaagtctgttccctgctgggggctgcctttgaaaaggggctcctgcctcccgtctgcagttggagttttcctaaagaagcagcctcgcacctgcatcctggctcgtggcggaagacgggccttgccctgagcggccggctccttcctaggcctcgccctgaggggccggctccttcctctaggctgtcacactgttagtcacttacacactcatcccagcatccagcctgtcccactgctgcaaacgcagcataggggctcctggggagcaggagcaaaacacactgagcccaggacgggtgagaacagacacggggcttggtgtctactcagcaaattgtgcttctgtttccctctaagagtataaatattgcacattccacaacaaaacccaggttgagaattttcttccctgaaggtaaaagagggagcacaggattgtccctttagatcattcgtgtaacacaaataaacctccaggttttctctacgtgattcctggagtgggcgctggctagtgtagcacagtgtcgcctcggcacatatgaggctgaggctgtctttagcattttgggggcatttttacatttttggtgggtgatagttctataggcctgtctcttttggatgtactatttggaaacaattcaaatagtttactccatgtttgattaaattcgatttaaatgttttgcacacttcacacagtgatctagccattgaccttgaatagaactgcggtagtttacactgatgcatttttctcatattttcatagaaatttgtggagtttatgttttcagaactctgcacacacattaatatttttcttttgatctgagacttttagggctgtctttcttttcaacaaaatctctggcattccatagaaaagccaaaaaaaaaaaaaagccaaatgccaggagaacttggaactattttgagatttctggaaacagatattggacaaaagcagcttccttggagatctgaggaccaagagcttctgaacgggcgagtctcagtgaagggaacatggtgacaaaggctctaacttcacctgtcgctctgtgcatccatctccgaggctgcacaatgacctcaacagccctcagcaaagcggctgggactcagccagcatctggcacacatgaggcccacggtgcaggaagtccacaggtatcacaatcagattcgaatctccacaagatgaacgcacatgctgttattattaagattattaggcgggcagatcatgaggtcaggagaccagcctggccagcatagtgaaacctcgtctctactaaaaatacaacaacaaaaaaatagccggtagtagtgtcaggtgcctgtaattccagctactcaggaggctgaggcaggggaatcccttgaacccgggaggtggaggttgcagtgagcccagatcgtgccattgcattccagcctggcgacaacactgaaactccgtctgaagaaaaaaggttactgccacgatgaggtttagagactgttctttccgttggtgaacccctggagtgatacacgcagaagtttactcccatggccaagtgatggttgtaacaggaatctaactgttggttttggggccgctcatccaagttcgctgtgccgtgacaaggcgtttcgtgtcagcgcttccctggaaaagctcctttcttcaaggttgccccagacagtcagctgtgaggcctcgctctgaggcctgtctgcggctgtctctctggcattctctgtagcttctgcagagctggggtggggtggggaccactctgcccctgtggccagcggcgccgtggcctggctgtgaggcccagcaggggtttggggtggcaccttcccaggccttctcaagccgcctcacgcctgctcctgatgcttccagagaggaacagcgggcagcagtgtctccgggaggaaagccaggcggcttcacgtctgatgtgggtcgaggtgcagctccttccacttcccagcgtggacctgaggggctgccctgccgggggagcagctttgccatcctttgaatcagcagcgacagctctcgggctctgaggccaggcgctgcctaagaagccggagccacgggtgtctcacactccagaggaaccaggcctccccgtggggctccgtccacgcgctctgctccttctgttgcagttttcctgagagcacggcaatggcccctgcggctcgcagcttcttctcagcacctgtagggaggaggaccccgccttttcctcagctggggctgggcagactctgacgggtgaggcgctggcagcacgtgggaaccccctgtgggggtgaaatgcaggggcctgggcggtggaggggcctgggcggtggagggcgggctctgcaggtgtcccgatgcccagcccagctccagactctcagggctacaagctgagggcgccggagcgcgagcctgggccggggggctctgtcctcgcgtctctagaacgaggagccggttcagagaaacccaaagaattctttctctctggaggttttcccatcgcatgagtgtttccgtcgagctcgtcctcgtactcagcggcctagaaacaggccagagagctccacacctgcccgttcctcggaattccacagcctcgccttggaggaagcgggagtcgcgacgtccccatgaggctccttcacccccgcacaagcgcccggggccggagtgtcgcctggctcctatcgggcagcatcgacctgttcattttcctcagagaacgggcatttccatgaaggaaatctgtgcgggggtgtgagtgtgaatgtgtgaatgtgtgagagggcgtttctgttgcatgtgtgtatgcctgaggtgtgtgtgcgtgagtgcgaatgtgtgttcatgtgcattgtgtgcatgtgtgattgtgtatgcttgtgtgtgaatgtgtgcatgagtgtgcatgtgtgactgtgaatgtgtgaatgtgtgtattcatgtgcctgtgagtgtacatatgtgagtgtgcatgtgtgaatgtgtgtaaatgtgcatgtgtggatgtgtgagagcgtgtgtatgcttgtgtgagtgcatgtatgtgacaatgcatgtatgtgtgtgaatgtgtgttcatgtgtgtgcatgtatgactgagtgcatgtgtgagtgtatgcttgtgtgggtgtgtatgtatggagagtgtgcttgtgtgtgaatgtgtatgagcgtgcatgtgtgagtgttatgcttatgtgagtgtgcatgtgtgtgaatgtgcatgtgtgtgtgttcatgtgcgtgtgtgcatgtgtgaaagcatgtatgtgcttgtgtgtgaatgcatgtttatgtgagtgcatgagtgtgcatgcgtgtgtgtgcctccttgtgtatgaatgtattcatgtgtctgagcatgcgtgtgtgtgcgtgcatgtgtgagtgagcatgagtgtgcgtgcatatgcttgcatgtgtgttagtgtgtatccgtgcacgcgtgtgtatgcatgcgtgtgtatgcgtgcatgtgtgagtatgcgtgcatgcgaacatgtgtgtgtatgtgtgcatgtgtgagcatgcatatgtgtgtgagtgtatgtatgcgtgcatgtgtgaacatgcgtgtgtgaacgcgtgtgtatgcatgcatgtgtatgtgtgcatgtgtgagcatgcgtgtgtgtatgcgtgcatgtgtgagtatgcgtgcatgtgtatgtgtgtgtatgcatgcgtgtgtgagagagtgtgtatacgtgcatgtttgtgtgttcatgtgcgtgcgtgcatgtgtgagtgagcattagtgtccgtgattctttctgtgccctgggctcctgggccaggtgcttatccctggctccaccctttccaggttggattttcttcttccagcagacacagttatcagaagcaacttcaatcggatttgtgcttgtgtcttgcagaaactctacccagagtatgtttaccttaactcgcttatggtattttaacacgtctgatgtttgggagcgcccttcctcacaggctggggtagacataacaggagattcagggccttcggtctcgtgtgcagccgtgatcagaaacacagccggacgttcctagaacatcgcacatccaaagggcctttccttgtttgctttagtggcaccaccaaacccaaggcaccggctcatcagcagagcaggggcctctccgcacagcctagggagcttctgccctctggaaggttctagtcagccttcctgcaaaggatttagtgaccatttacacaatcatccatttcgatctgttgcaaatcactgatattttcatagagatgggcatgatctgtggtttcttgtataaatattataaaggctgtctgaatactgtaatatagtcttgcaatggtttgcagtttctcttaactttctctttacaatttggcaatctcagttacatatttagagatttcctattataattttgtttctgcctttatgcatttaaaaagagaatacttacgtaaaacgaaaatgtcgttcctgtctcccttagctctgaaatggtgtcgttctggtcatggttgagggaaggttggacggatgcgctagtctgctgctgtggggatgcatcatgctgcttttgctggccaagggctgcagaccactggggttgggggcgcttatcacagcactttcatctatattaggatattaggatggaaaagaatacttcagttctgctggagagtgttgcagcatggcattcttagtttttctgactctggccttcaaaattacgggtgggtaaaatactacaacttttaaaacacagtgtctgccttcatttgatgccaaaatcaataaaagccatgccactctgagggctatcattgccgtggccactacaaagacaccatatgtgtcctctgcctggctgccatttgctcgttcagcccgtggcattcccacaccagccccgtcccggccagccctgcactggctcatggggagatggcagtgcaagctgagcctgaacttgaagagtttacatggccgtggccataatcatagccattcagtgacctcgcgagatccagagtcagagcatctgttgaccagaaacatatccagctagctgctccttccatatcgataaatgagacaccacagtcattacctgtgtcccaaagttctctgcctattgcagtaggaagctgagtggcatcaaagtcttgagacaccatctctggtgtaaaccaaagcatcttggaagaccaacaggaagagttactttgattcacttttgcctagcttagtgtgtttatgttattcgattctgttacagacaggagtccctgagagaggaactctctgggcttaggactaccaaattcatcatcacctgtgaagatcactgtttcttggccctgttttgaaaagttttctcaaagatcccttttaactgttccttttaattgttgctctccagatctctgtaaaatgttcagcaaagcaatctctgctgattcttgcctaatcctgttttgagagattctagcaaagtagggaattatttgctttccgtttaaaagaaaacactcatcataagtaaccattataaaacactgttttcatttctactttgtagtgagcatcacattttaatggtttccatgacatatctttttttttcttttgagacagagccttgctctgtcacccaggctggagtatggtggcacgatctcggctcactgcaacctccacctcccaggttcatgtgattctcctgcctcagcctcctgagtagctgggattacaggtgcccaccaccaaacctggctaatttttgtatttttagtagaggtggagtttcaccatgttggccaggctggtcttgaactcctgacctcaggtgatgcacccgccttggcctcccaaagtgctgggattacaggcgtgagccactgtgccaggtctccatgacatatcttgatatgtaaacaagcttgtaatctgattggagcctattttgttttgtaactgagagagatgaaatatcatccaacaggtagaaataaattgcttgcacaattaactatcattaaccaaaaattcatcaaaatatttctgttagggctaggcgtgggggctcatgcctgtaatcccagcattctgggaggcgggaggattgcttgacaccaggagttcaaaacaagcctgggcaacaaatcaataccccatctctacgaaaattaaaaaatttgccagtcgtggtgcctgtcttcccagctactgggcaggctgaggtgagaggattccttgagctcaggaggttgaagctgcagtgagccgtgatggcaccactgccctccagccttgccgacagagaccctgtctctaaagcaaaacaaaacctgttgttagtgatgccttgctaagcaatgatgagttctttctttataaagtcccggctctgcaggtaagagcaaacattttctaaaaatagatgacaaaattcacataagaaagtttttatttggtctagtaaaaagtgactaaattcttcaattagaaggagattaacacttttatttaaagtgttaatattataatttccagctaagatgtttttctctgaggtagacattgattatagtaatataatactatgagccaaagtactatgaaaccatttcatcccagtcagatggttacaacagtgtaacaaagacaaaataaattctgggtggataaacacttgtgtctgttggctggacatacaacggtttagcactgtggcagacagcaggcactccctccgtaagttacatgcaggactgccatgtgaaccatcatttctactccatcatttctactttttacccaaaagacttgaaaacaggcgttcaaacaaaaatttacatctgcatgtctataacagcattatttacaatagccaaaagatcctaagtgttcatccatgagtgaatgaataaacaaaatatggtccatctgttcaatagaatattattcagccataaaaaggaacatggctctgaaacatgctgtaacatacataaaccttgacaacatcacgctaaatgaaggaagccagacacagaaggatacctcgtgtatgattacattgatggtgtagacatgcatgaacacacgtacatgaaccttgaaatcatcatgccaagtgaaggaagtcagacacagaagtatacctcgtgtatgattacattgatgtaccatctctggtgtagacatacatcagcatacatacatgaaccgtgaaaacatcaggctaagtggaggaagccaggcacagaaggatacctcgtgtgtgattgcattgataggaaatgcccagaataggcaaatttgtagagacaggaggtagacggatagttctaggggttgaggtgagggggaaatggggaatggcagcttaacgggcattcttttgggaatgaggagaatgttctggaactaggctgaggtggcagttgcccaacactatgaatgtgctacatgccactgaatcgttcactttaaaatggataagatggtaaattttatgttatttgtagttgtacagtaattttttttttttttttttttgagacggagtctcgctctgtcgcccaggccggactgcggactgcagtggcgcaatctcggctcactgcaagctccgcttcctgggttcacgccattctcctgcctcagcctcccgagtagctgggactacaggcgcccgccaccgcgcccggctaattttttgtatttttagtagagacggggtttcaccttgttagccaggatggtctcgatctcctgacctcaagatccacccgcctcggcctcccaaagtgctgggattacaggcgtgagccaccgcgcccggccagtaattcttttttttttgtggcagagtcttgctctgtcacccaggctggagtgcagtggtgcgatctcagctcactgcaatctctgcctcccaggttcaagtgattctccttcctcagcctccagagtagctgggaacacaggcgcctgccaccatgcctggctaatttttttttttattatttttatttttagtagagacggggtttcaccatgttagccaggatggtcttcatctcctgacctcgtgatgcgcccacctcagcctcccaaagtgctgggattacaggcatcaacctccgcacctggccgtcatacagtaatttaaaaaattatgttgcttatgttctggggatttaataatcaaacagttaaacataaagtgttcagagtggaatctcaacaaggctgttaaacagttagggttctgcttaatttttaactcaaccaaagaatcatacagagtaaaaatatattaaggagagacatttatcatcatctgtaaataaggtttccaggggacagtgttgaagcatcctattccattctttcaaagcgattaaaaagttggaaagttggaaatagtataattttgagggtgtgtttaacattttgatttttataaagaggggcatttaattcagtctaaggtatgtctgtatcaagcatataatggcttagagtgatattgagaacacacgggggccatgactgtttctgagtgctcattctctggcaattttgtgcctctcggtagaatggaccttgtcggatgctggtcaggcacttctctgtagtaaagatcttgaacctgatttaacacgagatatccagaataaggaatagcaaatctgtggaataagccgcaaccctgtagcagttttacttcataagatgactgcaggtttattttgagtgatgatttatgcaggccttgtaatttcatgctaagtcttaattgtttcctatgactaaatagtttgccataggctagacgtaaacttggaatttaatattctattaaacccaagagctgcagatttcagaactatctgaccagtggcaaatgtgaagtctttaaaagaagtccacgccaagaatggagcccacaggagtttggaaaacttagctttcttggcatgttccatgatagctcaaatattagacctaatttatagctccatctgtacctcgtggagacctcgcaagctggaactcatatcacttttcctttttagacagtcaaaaccacaggttatactaaaaaacgaggacagaagtccagcaaagcagtgatttctcctcagctaaaacacagactgcattaaaaccacatgttgctgagtgctggctggccaggccagactttagaataaagctgaaggcatgaagctgggatgcatggaggagcgtttgctcagatgtgtaggcccgtaatgctctatgcagcatgtggccggtggttctgcaaaagccagagaggagtcgcacaaaggccctggagcattgttagaggcggagcctgtaggagcccgctgtgacgggtggagcccagggctggtaatcggatcgcattttgccatagccagcactttaaccacgagggagtcaaaaagtcaccatctgaagacggaagtgaacaacatttgaagaagagtccttggagtcgagacggcctttgtgctctctcaagatgcaggcacttgtgattgaaatctggaaatacgttttttaaaaaggaaagccattttttcaagttttaaaattcaaataagctatatggtgtgatggtcccaagaagtaaagcatgcatgtgtgttctgcttccggggaggcggcccatggcagccaacgtgacgtcgtctcctgtggtgggaggctgttcttaggacaagccttttccccctgggggcactgaaagatgggcctggttgatgctgggctcacagctttcactccctgggctggaaggctgagaagagcttcagtaagcaaccgactttgtggtcctcacgtgtcttaacctggccctgattgtgcaagttagggagaaacaaggcctgcttgtggcacacacggatcctgcattactgcttttcatgtctctgtatttctgaattagtttttttccacagtgagcttagatatgcctggaagtctaaagacttttccagttttgctcatccttggggtgtcttcttaagtagtagcagtgacgttgcgccttctgtgaaatctgtgttgttgggaaggtgggatgtggagcctctggggcagaggatgaggctttctaagaagacctgacccttttatccacctgacagtcagatttccatgtgaaggtggaagaggcaggacgggaaacagagaaaagggacgagccacgctctcctctcaggctggtctcagtgggacggtgccctgggctgcagctgtggttggaagtcccaccgcgtgcgtcctgagacccccgcccctcagtcacttccctttggtctgtttttaatggtggcatctagccctgcccaccctctgcatctggacttgatcctggtgtgttcaggtggtcgtccttggatctgaggacagcctgcctccgtcccaccaggcagctggcgtttccccattttcaggaagcaggggccacctgtttccccagggataagctaggaggccttcctgggcctcagtgttcttcctcactcaatgtggagaatgggcctgcccttcccgcccctgggcctcgcatcagataggaccaggcctgcatgtgacaggcacctgcccttcttctgaggctcccttttctgagagctgagctgcctgtgaagccctttccagcctccaggtcctcagcactcctgcctaactcatgccttcacatctttcaatgttcctatatctgttctatcttcttcccattgcataaccacacctctgccctgttcttccctacagacgtgtccaggtgtgtggccgaaaggaagtatacccaggagcaagcccggaaggagtttcagcaagtgttcattcctgagtgcaatgacgacggcacctacagtcaggttaccggccttgcttgggaggttctgcacctgtgcgattagggagggagatgtggagcgggtgtggggagaaggcaggtggggggagccgaacagaagaagcagcgggtttgttctctggggaaatcagccttctgcattttagaagttaattcgtaatgagcctacttggcataaatagacacataaatgaaggtgtgtgtttatttcttagttggtgcaggcatttatatcattgctgctgtcattcacactttcattactatgaatttagcctggaagcttccttagtgaggccaattagaccgtgctaacctggcttgcagcttagaatttaattttagtttgattttaattatggggagcacacactaaaagtcgtgtctgtgccaagcgtgagctcctggatcattcattccaacctgatgggcccacagacatggagctgagccaagtcaaattcatgttgtcagccaaaggcactgttgagaaagtcagccagctctccgttttgagtgtgtcaatgctgttaactccttattaaggaaaaacaaagtactaacatacaatgctaactggcacaggggcagaaagagcagaaaaaacagcacgggttctgcactttgacatgcctggggcccattgggtgatgatgtgagttctgtgtgtttacatcatcgtttggcctttgagagacaacgagggagagaatgagagagagaggagctggagctgaaggacaggctgttctggccctggttgcagggggagcgggcggtgcaggctgcagagtgaacactaaagaggccgaggttgctctcctggctctacagtggggagctcctgaccttcccgggcctcagtttccccactcataagatgagggctagggctccatctggaaggcggtgaggattagtggcttcacaggtaaggtgtccagcccacactagcagtcagtaaagtgctgatttgggccccttttatctctaaaaccctggggtcaagacctgcacactttctttaccgaggactcaaatgcagccacagaagtagctctgggtatcccaggaccctgtctgagccactgccgcagaaagcagagtgggcctcgcagccgtgaggcgctgcgccacgggcccgggagggcttacccgtcctgtgctctctcgcaggtccagtgtcacagctacacgggatactgctggtgcgtcacgcccaacgggaggcccatcagcggcactgccgtggcccacaagacgccccggtgcccgggtaggtctgacgtgcctttccaagtggaaggcttgaagggaattggtttgccgtttcttctcatcatcttccctgggtttactgataattcaaagggaaatccagtttggccggcattgtgagccacagtgggaatagatctcgtcactgacaaagcctacattttagggagcccttgtttttaagaggggaagggtgaagctgtgtgaatgtatgcatatggctggaggccagcttactaaaggaagatagccctgcatctgatcatgatgggttaagatgattcaggtcccttaattgtttaaaataaccgcaaggacttggagtcaccagtggaaatgaccaaatgttttctttggccaaaaaagtgaaaattgctggttttgtatgcatatgttttcaaagaaaaatgggtctttcttcataagtcaatttcaaaatggtttatgttattttattactcgtaagagggcttgatgtactaaaagtaataaaattagaagtttaaaaatctgtaaaatattctctttcccattagtgttttttttttttttgccaatagtgctgtaaatgatttagatcatttttatttgaaaataatctgcagcccaagtttgattaatttgtgggggagacttatcagaccatctatgaagaaatgctatgatctagccctccagattcctggatcatatgtattaagatagtcaaaacacatcaatataaagcaataataaactacaaaatgtctctccctgtttctcatgtacaatcttgaaacatttgcatttagagtttaccttttgatttatttttctgtttaagggatatatatcttttaatctggaattctgtttattattcaaatgtttttcaagcttcctgagccatggccctggccagaactcatgacctctgtgggttccaggagaatgagggtgtccacagtcagcaatgacataaggcctaatgtttccagcgactggccatggggatgcatgatgtggaattaaaatatgtttatttgtaaaaactttttctccagagcctaaatagtgctggaaatatatctttagttaagctaacatgtatacctaatagttctgttgcaaactcatggaggaaatgaaacagaaaaacatcaccaagattaactgggtctgtgtgtgtccctctttgactttgagagacactttcacttcctatttccttcatccacaagcagcattttgaggtgagccttgttttacgaaggggaaagcagtggggataggggcatctatttccgttgctttagtgatatcatctgataattaaggagtgtcccaaagaactttcttagaaaacatgtgcaaaattggctgaattttgtacgatctacaaatagtggcttgtttctggaatcaaatcagtgtaccatctactcacgttgttgcttccaactaggtctcagtatcatctcactgtatagaaatattcctttttttttaactgcctacgtggaacgtttggtccaaggaatggactggggaagagagtagatggccctttgcatatagaagtctggtgtttattgggcagcccatgcgctgggtaggaagccaggcgtgcgagatgaaaagcttcgatgccgaggggcagtttccttgagaagacggtgctgtctgtgagggggggcagtgtttccacgtcggggcagggttccgctggctgcacccttggtgttggcaggacaagcgtccttctacccctggttcacctgttcggtgcaactagtatattccgcaggtctacagagttacggaaaaactctcttaatccctggctgtgttccaggcttcccctccgcacacatgtgggcacggcggagccagtgtctatgccagggtcactttggaaactttatggagtcatggcaaattgtggagagaattttgaaattgaagggagaattatggaggcgagaggtgttgagtatacataccccccaaacacagagaatttatcataaattcatactggaatttaacttcttcctgaaagttatataatgcagagaagcagggaagttaagtaatgcagagaagcagagaagcgggcatcacctgtgagatcgtggtcaacagcatgggccacagctgggcagtgtcttgatctgtaggcgccagggagctggacctctgggcatacccttgggggttcacggagaagtcagctcatacacagaatggctaatctgcagtatgcactgtctgtacatggcaggagtacttttcatcaagtttactaaaattgggcaaatttcagtatttaataaatgttttttgccctcaagttaataccgaggttaccatagaagcagactctataaaaatttgaaaatcagacaatgagatttaaaaagagccgtagataggagctgtttttcagaaagtgcatgtgtgtgtgtttatgaataatacatgcaaacgtaacttgaggccagccacagcggagggaaacggggctccactgactggcatgattcctggagagcagagaaagcccttgccccaaagcctcccagcttttcagttgtctcagaaagatctttaataggaaatggattcctttatttcataatcatgtattcttaaagccatgaatgcaaaatacctaaattcctattaatccataaattcctattaatcagataatataatgagacaatccagcagaaaaacggccaaaagtctcgagcaggcagcattttatttataaaggaaaaaatcctgatgaccagtaaaggcaggaaaaggtgcctaggatcttcagtcccagggaactgcaaattaaagtcacaattaaagtcaccgtgcaactcccctccacacccactggttggaaatgcaaattaaagtcacggtgcaacccccccccccccgcccccacacccactgctctggcagaaatgaaaaaccgtgattctatgacttgctggtgaggacagagctgcgggtgtggtgggaactggtactgccctttgcaacatcagtttgcccctttgcatgtgggtgattaagatcccagctcttccattccgggaggaaacccaggagaaatgcattcacctgtgtgggaggagacctgggagggcgttcccagcagtgttcacatgagaaccaaagcctggaaacagatctgtgtccattggcgtctgcctgggtgagcactgcggttcgctcggttcatcctacagagcagtgagcactgatgaaaaggtccagtgccttcctcagtggtgccgtgcgctaatgtcctcctgagtccacggagccccacacggaggcaccccaaccacaaatcctcccacagctgagagtcagaaaactcagctccagctctgagggatgcatccagaggtggcaaaccatgaagaccagcagggagtgatggccacacacgcagggccacggttgcttgcatgcggtggagagcaggggggtcaattttgtgattgcagagggggctgacttggggagtccttttcctgctctggaaaatgtcttcacaggttttggttgataataattcattacgtgtacatttatcttttgtgcacttttctgtatgggtgtcaatattttaggaatttaaaatgttaaaacgtgcaacgccactgaaagcggtaacgcaggctgaattctccccacatgtacacatttctctagcgtccttccctgaggatgtttacagagggaatgggaccagatgcttaggagctggtggaaggagaagataggaaaagacacatccctgagcctgagggagggctgggaaggaaagacccaggggggatttggggaacaggaaaattaaggtttgcctttggggatgctctggagagctggagagagcgggctgggcattgcggccccccacttggccacgcagaagtgccagccatggctcacattcgccagggccaaacactggctgcctcatagcagcctaaattgtaggggttaaacctactcttttacagacgagaaaaccttccaaggtctctgtgcttggaagtggcagagctgggatgtaaacctacatctttgtctccataacccatgtttctcccccaaataccaaagtatcaaaattcttggggccttgaattcctatttacacttggctggaagtcgggcgtaggagaatgtgggcagagatggtcaagggctctggagagtggggtgaggttgatggcaaatggtgtggtgccttggatatggcgaggacaagaagccggctctcggagacgtatccaagtccacttcatgttctgcgctgctgagagcaggtgtttcttgctcacagtttagagatgtatgtgcttctcagagccctgctgatgtcgacctgtgggatctgtagatggctttagggcaggtgtttcttgctcacagtttagagatgtatgcactcctcagggccctgctgatgtcgacctgtggggtctgtagatggctttatgctcagggagtgccctgctgccccggtgttcaaggaaggcacagtaaagggcagggttcacactacataacaagcccttcatgtccttcgtcctgggattgggggccagctccacgtgtctcctgaaagacagagttggttcttatttcttctgtagggattttctttttgtttctttcttttcttcctcaccaccctccccccctcccccacaaagatttgaagcctaacattgctgggggcaggattagaggttgaaaacaaaggcctttttgccaagagagggtgtttgcaacccattctccagtatttggatatagcttcaggtttttaatctcatctctcctctgtaactgtgcaccctgaccaagagctggttcctggcatgagtacaaagtgggttaagatattgtaagctgaacctacatgcaagattttttaatattacaatattcaaagaatcttcatatatagcttggttggagttacgtgtttgaaggaagctacaggttttgagttacagaagagggatagacacagcccatgtgtagtagctggtgcccatcttgagacccccagcctatccctgccttctaaagtagggaccaggcctcatacactgcagccatcggcctgttccgacagagtggacatcttcctgttccacctgacacagctgtgtctggcgtagaaggagtcctttcccattgcatggggaagaagacatctgtttcttcccatttatttcctaacaagctctgtaacatgcaaatttataatttggttttaattactaaagtctgtgtgatacctgtgacaggcagcagtaggtcagtggccttctctaggaattgcctctctgcggtctgaatttcctccccgctctaaaatttcctctctgcggtctgaatttcctccctgctctaggaatttcctctctgtggtctgaacatgactatgcgtccatcttcactgtggatgctcatcccagagatttctaaatctgggtttggggaaggccctgttataaatgatggatgatcttggagtcgcatgaatctcagtacatgatatacatttatttaactatgacttctgcatttttctgcaaggcctaaagtcttgtcctccatctgaaatggtggaactccatgtttgtagtagtatcctaaatgacttcagaaaaaaatacacttcataagccaaagctaactgaatttttaatttttcacatgaatttccctggcactaagttaaggaccctacatagctgagggacttgaaaggatcacccagaataattaaattcccaaatcctgagatcaacgaggcagctgcgtttggtctccaatgtctctgaagcacttcctggtagaaatcattcagggccagtgtgcagtggcttggcttgacctggagagcctgtgccttggagagaatccagcttgctgtttgtctccacctcaaaacggctttttctttagccttcgtaggtcttttcttgaaaagtgaaagttattaaagtaaaatatttcaataccattgaaagaaatgtgaaagaaatttaaaagaaaatgtaaaaacaaacaaccttaaggagaagtaggaaatgcaccgaaaattgaggcctctttctagatggccatgaaaacaatgagaggtggtcacttcagcaatcaagccacaatatcaaatataaatctgaattttatctgtttaaaatacttgtaggcagggagtggtggctcttgcttgtaatcccagcactgtgggaggctaaggcagggggatcacttgagcccaggagtttgagactggcctgtgcaacaaaagtgagaccccccaccatctctacaaaaaataaaaatttaaaaatttaaaacaattaaaaacttgtgaatttttttcagagaaaaatgttaaatttactctgtaacacgtaaatttatagcaccttttatagtatcgaggacatttattttacatccatgatgacataaaatagtaatttgatacagccaacacaggatttgtaaaattttcaataaaagattcagattgaattctgaaagtgttcaactgatactaaatttaaaaacataataataaataaaatgttaaagaaaaagaccacagggtgtaggtttagtctgacaagccgcttcaggccggcttgggaagagtgggaggtccctgcgtctgccagggcccggactggaagtcaggttcccctgcgtcccgccctggcccttccctgggtgatgactccagaggcccttggggctgaagctcccatctgggcccagcctttcctctgcttcacttttctttttaaagttggactttatgttgagttattcacaactattctgatagacaatattctggtgtaactttttctattcaggaaaaatatttattacttttaacctcaggaaaaagtactttctggtgtctaatgcttgtgttttttataatctgctcctctgttatactttagtgtacatttaatttggcggctaatttgtactggagcctcacatgagttgagaacagtatcctgtaaaatggccctttgttgcacctcatctacaagtgacttttcgctcctgttttctaatagttaataaaatgctcccaaagaaatcaagaggtctttggaagtaaatggccccaatttgtataggtctatttaaagaataatggctgagtgcttctagagattttatttttatttatttatttatttatttttgagatggagtctggctctgtcgcccaggctggagtgcagtggcacaatctcggctcactgcaacctccgcctccggggttcaagcgattctcctgcctctgcctccggagtagctgggactacaggcacccgccaccacgcccagctaatgttttgtatttttagtagaaacggggtttcaccgtgttagcctggatggtctcaatctcctgaccttgtgatccgctcaccttggcctcccaaagtgctgggattacaggcaggagccaccgtgcccagcctccagagatattttatgtacataaaaacaagtatattattttttcttctaattattttttggacaaatgctaattattttacagcaccttttttcactatatgcagctacaacagttaaatgttgcaaagatttatgaaactattaaaatgttgtgtggccctttagcaagagtgatacagctgtactcagacatttttctcctgccattgaatcagggtctcaaatcagaaatcagtaaattcagaacattccttttatcagatgcacctcaaatcaggaatcccaactgtttaaaggcagaatcactaggatagaaaaagacccacgaagcataaaagccggtgccacaaagtccaccgaaaccctcctccaagtccataaataacataaaggatcactgagcaaaaacaaatggattgcatttggtttcttcatccacagaaacaccgaagtggcaaaactgaggttgagctggaggtgaggatgtcaggagagaggcagcgccgccgggggaagatgggagggagaccaatgcgcagtgacagtgatcctggggacacgtgaggaataacgcagcagtgatgcagcttcacggcacaggggcgccgccgggggaagatgggagggagacgcatgagcagtgacagggatcctggggacacgtgaggaataacgcagcagccatgcagcttcacggcacaggggcccggccgttctctctggattctggctcgaattttcacacgtgccaacctcactcggagggcctgatgggcccaggctgtgccggctcctggagtttctggcctggcaggtctgtcgtgtggccaaagtttgctttctgccgagtttccaggcagcgctggtgctcgtggctggccccacactccaagccctgggttgaggtgaggggcctcactccagaggaacacaggcccacagggcagccatccatgaccatctcaacacgggatcctaggatggtcaaggggccagtgggggagcctgtggctgccagggcccctcctgatcccgggtgagggacgtcttgcctgcttggggtcctggcctggccatgcagctcaaggctgagacaaagaaggaatacttgggagcagtgccttcagaggctgacaggagctggcggataaggaggtggttgggtcccagggcacggtgcctgtgactctgaatgtcccgcatgggccagggggtgaagctcagcctcacggtgacccagggcctccctgggatgaggcaggaaggaggtcctaccacttccagtcatgttatcttgaggattatttgaccatgggcactcaggaaaatagaaaataggtgatattcctcctgtgcaaattgcttctccactaagcctcccccggactcagtgtggagagaggggagatgaggtgggaggagctaagggcagtgtggacctgggctgtgccaccccctgggggtactgtggacctgggccgtgccgtccctgctccagaatgtccccaacaaggagtgcgtgcaagtcctgcttggccccaacctgtggccacggtgaggctcagggatgggacccggtgaagtcggatagagcagaggcattccctgagttctggcagcaggactacagaggacaggtgttgtgtgtgtctgaagcctagggtatacaccctggcagggtcggggcagcagggtcggggctcctgccagtgtcaggacaagagtgaaaatgaaggtggcagctctcagggtacaggggagacaagcccgtggtcacctccctcggccggccagtgccgggattctggctcatgccaaggagaccctgactggtccaaaggccttgtctatttcttagctgtaagccggtcctatctagggagagcagtgttcatcctaatacagcagtctgcaggcttgagaagcacttgcttagctgaaagccggtcctatttagagagagcagtgtctgtcctaatacagcagtctgcaggctgtgagaagacttgcttagctgaaagccggtcctatttagagagagcagcgtctgtcctaatacagcactctgcaggctgtgagaagacttgcttaactgaaagctggtcctatttagggagagcagcgtctatcctaatacagcactctgcaggctgtgagaagacttgcttagctgaaagctggtcctatttagggagagcagtgtctgtcctaatacagcactctgcaggctgtgagaagacttgcttagctgaaagctggtcctatttagggagagcagcgtctatcctaatacagtgctctgcaggatgtaagaagcacgttctgttcttcgctaggactcaccccaggaggccgagtggctggttggcttctcacaggcctggagcccctaagaacacaggaccgctgctgccctggggccgagagacatatgccctcggtcctctggcaggacaccctccctgccacggccagtcttgcagtctaaggagtgcagaggagtctcaggtggctggagcccacagggtggatggatgcagttctgtcagcacgaaggggaaagggcctggcctggagttcacctcccctgccctcggaggggcacctggggacagtttctcagccctcccaagcccacctgtgtgacatggcagggaagcccagaggcacttcctcaccctggaatctggggagtggggtgagctctgctggaatctggcagagtggggtgagctctgctggaatctgggggaatggggtgaccactgctggaatgtgggggagtgaggtgactgacccctgctgggatgtgggggagtggggtgaccgctgctgtaatctggggagtagggtgaccgctgctggaatctggggtgtggggtgacccctgctggaatctgggggagtggggtgacccctgctggaatctggggagtggggtgaccgctgctggaatctgggggagcggggtggcccctgctggaatctggggcagtggggtgacccctgctggaatgtgggggagtggggtgacccctgctggaatgtgggggagtggggtgaccgctgctggaatgtggggagtggggtgacccctgctggaatgtggggagtggggtgacccctgctggcatgtaggggagtggggtgaccgctgctggaatgtgggggagtggggtgaccgctgctggaatgtgggggagtgcggtgaccgctgctggaatgtgggggagtggggtgaccgctgctggaatgtgggggagtggggtgaccgctgctggaatgtgggggagtggggtgacccctgctggaatctggggagcagagtgaccccctgctggaatctgggggagtggggtgaccgctgctggaatgtgggggagtggggtgaccgctgctggaatatggtggagtggggtgaccgctgctggaatgtgagggggagtggggtgaccgctactggaatgtgggggagtggggtgacccctgctggaatctggggagcagagcgacccctgctggaatctgggggagtggggtgacccctgctggaatctgggggagtggggtgacccctgcagaagcaggtgttttggtgcagataaaaaggccctttagaggagagggctgctgaccacatccccggagtcctcagcagcagagatgagccccagggtcaggttttctgttgtcccatcccaggtggttcagggacgccggcagtcaactcaggaaaaccaccaggggactgagtcgcttcctcccttcgctttgggcagtgctcagtaactgtggctcgtgctccctgacactgacgggacctggacggccacatgaaatgcccgcatgtcccctctcagtcttcatgctgactgaagcatgagattgcaaaaaatgtagatggcttctctatttcctcccctgattttatatattcttagatcaaaaaacttaaattttatttataaacatgaaaatcactgtgtgtagaaaaccatctcttgtctagccagagaggcacctgtttgagctgccactgacagagaatccccacggggctggccggctttcttgaactccgactccaagggcatctccatgccagcgcccagacaggcagctccgtcccactgcaccatttcacacaccacccttttccacccttctcaccaccccttggtccgttcataagtgggaagggtcctgagatcaaatcgtggatctgatgccaaccagagcccacaagcctcacaggccacactgtgcatggtgtctgggtcccaggacagcgggctcaggccttccacaccggctctagcaggctgctgcctgagagagtcctgccagatgggcaagcccagtggggacagaacgctcctaacaggtggggcttgcaggggggcacttccagcatctggagcagcttggcatccctgtggtggtggatgggctgtgtgctgctctctgccagcctgtgcgtggtctcctggccctcccggtccactctcccttcttttctggcccatgcctactcacccctttactcttcctcagagaggcctttctgctcaaagtcagctctcctgaggactaaaaaagcaggccctggatcctggctctgccgcttcctaagtggccctgggccagttacttacccctctggtctcactttccttgtctgtataacgggcatgatggcagtcccacctcgcagggctggcatctacattaaatgacttcaagtctgtgaaggacatagcagggattggcacacagtaagagctatatagacatcagctgtgtacacggttgcaatagacattgcttgagtaaattctgtttaatgcccgcctccccaaattggactaaagtgtgtagtgctgcgtccctgccgtcgtttcctgtggacacgtgacaggtgtgtatgagggggtgagcccaggaatgaatgaatgcacataaggtgatggcggcgagggcctgagggctgcaggccatttggtgccctcctagaggctgctctgttttggatggcttggtctgagtggggagcattgctcttccggaggggacctctccccagctgcgtgtccagcagagcacgtggagaggcagcttccgatggcgcacacagcacatctttggtgaacatccattgtgcactcctatgtgtgggttgctctgctaggtccattcagctgtacttggtgggctttcaccacactgcccactccagagatgaagaaacagaggtttcgagtggtgaaggtgcctggccaggggcacggagctaggagggagggacgtttgttctgctgcccatgccctgtcttctccctgcagcgccacatcctcagaaattggcaccctctttcctgtcaccctcatgttgtcctgatgagaggatgggagggcaggaaccttgagaaaagcccaatagcacagagacgccgtctagaccagagaacgcagcccttgctgttcccttttctttttctctcgcctccctcatctgatgctgtaaacctgcccccaggatgtgaagttctcggaaggggtgagccgcaggcttgtttagctgctctgaaggaggactccctgcagggagctgcccctcacccctctcacgtctgtgccgcagacctccctcccctcactcacctgggaagggcgtctggaaggagcttatgcaaaccactgcctccatcagcataacaccgttccctccactgggctgttctggtaacacgttgttaaggctgagagcggctggatttgaaccaagtgctcagagctacaagacttaacagctattattcctcccttaaaccggagacgtttcctcacattgtactttgtggcttcttccaccagaaattcgtatccccattatgacaaaacccacccctttagaatagcatttagatggaatgggatctcacaaatgggagcaattcagatgtgtcctttggaatccaaggctgagggggatcacttagcaacctctttgtgtctgtgaacagcaagcagatccttaaggtccagcctccagcccggggttcacaaaggtgttcactgtctgcagacactgtgcgtatcagtcaacccttctttctcggccccttttctgcaagtacagccggcaatcttgcttgttataaacacttggaagttcagcaaatccttatctccagaaaaatgcaatgacagcatcagagttgctttcttgggtctggatttgtgtgcttgcatggctctgctggcctgtggaaatatgtggagctattttcccatcctggaggccaggatcttacaggaaggcaggggcaggaaggttgggcatcatcttttcatcccaaggtggttaaaaggtgaagtcaatgcactatcaggatctcctccaatttctgtcttgtaaaatatttgagtcatgaatcacggagcaggttatcaagggacgctgggttctgtcttgaaatcatctcttacatatgaagaacaagatcagattaactttgtgtggacttatttaaggaaacactgattcaatgcaagggcccgaagagaaagccacagtgctggtcggctcagagacagaggctgcctgagtgtagagaatgtttaaatgttggattctgacctcaggcgaaattttgaatttgcagtctgtactgttctgtctgtacagtgcaaaatattttcttatttcaattgagaaactctctcatgaaagatattctaattattagcatatttacattttccttacgatattaaaacctgcacagaaatattcagaactattatcaaaatatgatcatttcccgtcaaaagtagaaaatactttttgcctctttcgggaacacatgataaaaataaactgatgactgagaagcttaagctctttaagaaatgtggatttgtaaagagatgatccaaaagggagaaacaagcaaaggaggattttgagagcttcaggaggtggccacacagtgaggttagctttgtatcctaggggattcttaccaagaaaaaccttgtattgcaaggcctggaaacaatgtaatatgtaaccaaatggtaacagtaacagctgggaaagagagaaaggctggctttggcagatgaaccaggagaattgtgttcctttttatcccctggggacactaaattcccaaacgcatattatttagttatttttagatatgcagcctgcagggaaaccgctgagaacattcccgtgtaaatcctcattcagctttctgaagtcagcattgtctgatgagtacctgttacagaggagggtttggggtggctgcgctgtgttccttcataggaaccgttgacatgtgtttaggggtgtctgggcactgtgacctcgaggcagtgtccgctgagagtgccagaggatggatggcgccttgaagttactccgttttctctgccatccaatgaattgcttgtaaatttcctgccacattactattgcatttcccaaaaataagataaacatcctcaaaatgtcataagctatatttttaatttgaatgttggtctgtatttctgtcatatgcaaaattgaaaaaaaaagaaaacaaaaacaaataatttcaagttctaagatgtttcccctgaggagttttactgggcatgtgtatggctatgggaattccacgttaattctaaacagaatattcaactgccagtaaactctgagacgaactatttttatttctcgagttggtattctaatgaagagggggaagtggatccatatagtggcttcagtctgttggaagagaaagaactacactttctatttgtaatatgcatctttcagcatcatataaacatttaaacttggtcacacattagttagtagattttcaatactctaccaaaaggtagttcctcgccattctcctctataaatcagaatcaagctgaaatcagggtttttagttatctttggttgtgtaatgtcttaagattttaaaaacgtttccttttttacctaattcacttcagtaccccaacatgggtatgtatgttatggctatgatgacatttttgaggtgaagagactaatatattgggttttaaggtcttatatacatgtgcaaccccttagcgccagaagcagaaactaatcttttgtttctgagtccagggtctgagtgtttaggtgacagtgtcccctcagggtactagacagcttacagaatttaagtagaacatgccgaagcacggcaaattagtcaaaatggagcaaaaatatgtgcataacttaatttgtgatggccatttaagagtccaaaataatttcatttcactccttattttcctcttttaggttccgtaaatgaaaagttaccccaacgcgaaggcacaggaaaaacaggtaactatcttagaataaatgtctatgacgatatgtaacatctaacttatcccgtgaaataacttctcaagttaaagttgaaacatccactagtgatgatgatgagagccgaaccagtttgttacttctgcattcattcagcaatgccattcactcacgatcaccagctctgttgggcctgtgctccgctggggtcgctggtgttggacctgtgctccgaggcttgtttcgggaccaacggcagatgctgttaggaccccctggaacctcccagtctgtgactgtggagagggctgaggctcagtattttggctccctgtgggattctaaaccattgcagttattgaggaccctgataaagatgcctcaactcctccctacaaggaggaagaggaacagtttttctacctacagcaatccctgcctctgagactggtacaaacaagagctgaacagaacccttaaccttaaacatcatgtcgcagcctgcaggtcctgtttcggggtctgcggggtctgtcacatgcccaccatgacccccctgggaaagtctccatcctcttctctgcccttgcctcggccaacacccttcagtaccaggacacatttctgcttttctcttacatcagcctttaaagtcagacgttgttttcaagatgagaagaaatactttagtaccaaaattttaggtacttttcttttctagtgtaggttacagtgtaatgaaccagtaacaaacaaaaataatataaacacagaccaggccgaggcaggcagatcacctgaggtcaggagtttgagaccagcctggccaaaatggtgaaacgccatctctactaaaaagacaaaaattaaccaggcatggtggtgcatgcctgtaatcccaggtagtcaggaggttgaggcaggagaattgcttgagcccaggagatggaggttgcagtgagccgagatcacgccactgcactccagcctgggcaacagagtgagattctgtctcaaaaacaaaaacaaaataataaaaataaaaatcggagttttattcaaccaatcccttctgcatgtgtggaaactgtggtggggcccatccctgccctggaagatcctttgcaaaaagagttctgtattactaggacactgacattttggagggacaagctggcatgaaagtaaatgtcaggctttctgtccagagggtgcctaccaaggatgaggcaggactggcttcctggaaggggaaatatgtaacaggtgtgagctggaacagaagaagcctcacagtcaaggaagatagctcattttccagccgaaaaatgatgacaggcataatggggacactgggttgggggagggtttatgtttggaaaggaaggggtaaagttgcatagagcaatagtgtgagctgcgtgaactgagtcgagaagataatggtgtgggtatgtcgacatttgtagagaaaggaagggacaatctcatgattaggaaaattaatcaaatgtggaaagggaggaggagatggaaggatcatcgtctttcagagggcatttcttaatcctgtttattatgatatttattgtacccactgtaaaaaaaaaaaatctagaggaattagtacatgggcatgaaagtgagttaaggaaagaacacaccccccactttaggccggaatacgcagaggggatacctggattaagcaacagagctggtttccagacacaaataagacacttcacacactctgatagagggaaagtaaaaaatgcacagctcttcgagatttttgttttatttccttaaggctgacttcagcagccaccaatggccttgtttgttgggacagagccaccccgtctgtgagggacgggggcatggagtagggcctatgatgaccgtgctgaggagggaagcatggacagggcaggaaggagagcggcctctggtgcccagaatcagggctgggaggaggaacggccagtgggcccattactcaccctgtcctcaggccacacctgccctccctgcctgccattcaggctgagctttcagactggtctggccccagtgactggggaatgggctggtggtcccagagtggtgacttggtgaggcctcagcaaaaacacacaacagtaataatgtatttgattgtcctcattccaaaaaatttcaaatatgttcttttaagactttttgtatgttcttgtgtttaaaatatgtttcccattttgttttattttcttggaagaagattgtaaaatattcaaccacagaatattcctagtttattgttattatcagtgttagacttggatatttcaaataactgatgttacatttttgtcagtattttgatagctagcaaactgtttttgagagattgctcaatgttaaatttttttgaaaatctgttttgattttccccctaaaaagtcttataagaaactttattctttagaccactgggaagttcatgacttagttatctacgtaagccttgtatctggccctcatctttgccactttttcctatatttcaatccaaaagttatttaacaaaatgatataagcaagcttcagtgaaaaaaaaaaaaaaaaaaaaaaaaaaggatgatcctgagagcaccacagtgccttgtgattgcctcctgggtggggccctgagtgtctggagaaggactcctgactcacaggctccaccatcctgccaggtctctgagccatttaaaacctctttctttaccagggggcccaatgtgtgtgtgtcaattaattaaatacagattcttcacttggaaaatgcgagtctatgggtggtgtaggggcctgtgacaccccagtccgccctttcctccattctccgatcactttcgccctgtcccctccaccccgtgccccactcacatccttacttagattatgccatggcagcagtggagagagggagggccagaggtgtagaaaggggtccaggattctccaacccttgcctttctcttggggaaaacagaggatgtgttaagggcacagggctctgctcaaccccaccccagtccctgccaagccctcttttgtaacctccagtggcctgaatttatgacttctctttcccagggctagactttctttactctaattattttgattccttcctcatctgccctatggcctgtgattggctctgatagtttagaactgatcggatattttccacgtgaagttaggtcagtgtctagcctcgagcattttaagtagcggctcactcaagactggtatagtcattccagccgcagctgcaggcagcatcgcgttgggtctgtgtggggttgctgttgtggttgatctgtggggactgagtgcaagtcctcagcatccacccgtatgcacacttacttaacttactctcataattgtagtctccttgcaaatcttttccgttctgaattcagatgatgccgcagctccagcgttggagactcagcctcaaggagatgaagaaggtgagccggggtggggattgcacagtctgggttggggaggagtgcgagggacggtatggagctgggaagtggagcgagtcatcttgttagagctccgttcagtatggagtgtaacatgccagacacagacagaaaagaccacgtgatcttacttatatgtggaatctctttaaaaaaaacaaacaaacaaaactccaatagtgaggagaggaaaacagcaagccgaaaggtggtcacgaagggtagggtaggatggaggaaacagagggatgaggccagaggctgcgaagctgcagttacgtgggatggacaagtccacacatccggcgtacagcacgaggaatctagttagtgatgaaatgacaatggatggcataccacacatccagcacatagcatgaggaatatacttaatgatgaaacggcaacggatggcatagtaaacatttcctagccacacgcccctgaagtaactgtgagatgctggggatgtgaattgcttggctgtagaaataatttcactgggtaaatgtgtatctaaacatcatgatgttagacagggataaaagagcaaactcaagcagaaacggattgtgtgtggccgtgtccagccttatgagggcacccactgtttttcctgatgtctttggagcgagggattttcagatattgccatggtgcattctcatgagggtttcgttaaatacacatttctaagttgaaattttacagcttggataatataaaatgtatggccattttccctgtttacatttcacgtctttacaagtggtcataacaaggagagatttcctgtttttacctttaatacattgtcttaggtatttaccagtgtataaaaattatcaggtcaaagggaaccggggtttaagggcaaagtgtaaggagtacacagtataaattaacaaaaccttaaaatgtagaactgcattatgctttgcaaataataataatgactgatgctgcgtggtcctaagcgctacacaatgtgtgatctgctgccatgagtccctggaccttctgaatgcccttccgcagatgagagccctgtggcaattgacccaagtccatctgggtgtaaatggcaactggcattcaaacccagatgtcttcttcagggtctgtgctctcaagcactaacggtgacctgcactacattccttttttttttttttttttgtgagacagagttttgcttttgttgcccaggcttctggagtacaatgatgcgatctcagctcactgcaacctccgtctcctgggctcaagcgattctcctgcctcagcctcaggagtagctgggactacaggcacttgccaccacccctggctattttttttttttttgtattattagtagagacagggtttcaccatgttggccaggctggtcttgaacacccgacctcaggtgattcacctgccttggcctcccaaagcgctgggattaacaggtgtgagccaccatgcccggcccattcaattttatttgttaaacaagattactacaaaaggggtgttcctgaaaagtttcaggcaaaagttatacttcacatattgcattttataatgaatctttcaactgagtgaaaacgttgtatgttatgtgaatagccattttaactacacaagaatatatttttgtacactgggtatttttctaaaatctgattctttcaaagtgaattctgtctagacccaaagagcttttaactatacttttggatagagagaagaatgccaaaaatattttaaatgtatattatgatttcctttcgtctgaggcatataatcagtgtaactatttctttacaaatgtacaatgtgtgttatgttgatttattttggctgttggactacttgctgcactgcgtaactaaggaacattgtgctttcgtgatgaattaaagatgcttgtcatttcattttggttcatagatattgcatcacgttaccctaccctttggactgaacaggttaaaagtcggcagaacaaaaccaataagaattcaggtaagatgctgcctgatgtcactttgtaaggagtgatttaatagatctagaaaatgatggggtttttttttggagttaagtgtattgtacagttgacccttgaacaacatgggggtgaggggtgcagacctggcacaaacatctgaggataactttcaactccccccaaaataataacctcttgtagactggcagccttacccataatacagttagttaacacatagtttgtatgttatatgtattatatactgtattcttacaaaaatagagaaaagaaaatttattaaaaatcataaggaatagaaaatatatttattattgattacatggaagtggatcatcataaaggtcttcgttctcctcatcgtcttcacgttgagtgggctgaggaggaggaagaggaggaggggctggccttgctgtgacagaggcaaaggataaatccttgtaacagtggacccatgacatcaaaactctgttgttcaggggtcagctgtaaatattctcacttggttactcagtcatgaaaataattcttattatttgatcaccggcatatatttttaaattcggcattttaaaattaaattttctaaattctttaacagatttctctgtggatgtcaaactatagctttagttaataagtaaataattataaatttgcttttgacctaatttcagagatgttaaaacactttgctaatttagtttaaaatcctccaaattgtgtgcattttgtttgctataaagcagtgtttgagagaactttcaccttttaaagctgactattttgacattttgaagaccagtaatgggttgcttcatctttggttaatgattttgactgttttcatggaagcgggtttgttctgtaattttcatttaggctctcagttgattgcttgtgtgtttctcattgccttttcaaataagaatttcacagattcttactgaagggaagtagctctgtaggtttaaagtagttcagctgctgaggaaatacggagttagtaacagcttgaattttctgcgatcagctttgggtgaaaaaattgcaaacattcacagaggctgcttatgcattaaaactttatctgtggttatgcatccatatattcttctgcttacaaaaaaaatcaaaaggtatattaaagttcaggagactaagagtggttcgattcccccttcacccagctcttacacacccaacctgaaaaggacccttgagggaagtgcctgagtccccttaagccagcagccacctcagaaccccatggcgagtctatggtaggcccgtccactgatttccacctgcaaagctagcgcggtgcaatgccagatgagctggcacaggtccaatgtgtgatctctgccccatgatgctctgaaatcactgcctccagccccggagtcttagctgtgtggcatcttcttgttactttacccttctgggcggagatgaggaagggcaaaccccaagggccccccaccgtctacaggcacacatggcagaaacatttaatacctatttataacatttttctcagaaatgcttgttatagatgagtttttcctattatatggagatattaatctctttacatgtctcatgaacttttgacactgggttttgttcaattttgtcaccccatttaaaaaagttattttgatttatttctgtttcatacaaatttgtatatgagagattaattaaaacactgtatgtttcaggtttactggttgatatggttgggcgttgtgtccccacccaaatcttatttagaattgtaatccccataatctgcacatgtcaatggagagaccaggtggagataattgaatcatgagggcggttccccccatgctgttctcatgatactgagtgagttctcacgagatctggtggttttatactgggctctaaccccttcgctgggcacttctccttcctgctggcttgtgatgaaggtgccttgcttcccttcaccttctgccatgatggtaagtttcctgaggcctccccagcaatgctgaaccgtgagtccattaaacctctttcgtttataaattgcccagtcttggggagttctttatagcaggatgaaaatggactaatacattggtagatcttgaaaaccattgaagaataaatatgttagcacctaaacttaatttgacattcttgtaaatgattttactggaaatatactttattttatttatttatttatttatttatttatttatttatttatttattttgagagaaagtcttgctctgtcacccaggctggcgagcagcagcacaatcttggctcactgtaacctccgcctcccaggttcaagcgattctcctgcctcagcctcctgagtagctgggactacaggcacccaccaccacacccagctaatttttgtatttctagtagagacagggtttcaccatgttagccaggcttgtctcaaactcctgacctcaagtgatctgcctgcctcagcctcccaaagtgctgagattatgggcgtgagccaccatgccaggctaagaaatataaatgtacatttttttaagccaatgtaaccatttcaggcttcagcagattaagctccatgtaaacctgtggaagaagagcatttctgtgtctcacctctcacttgccacttgcagatttccaagacttcaaatgacctgccattataattaaccagtaaaaactgagcaggcttttggtatttagtgggactgaaaataatgttttaggaaattccagtttacagaagttaccttacactataatttggtttaagtcagccgagatgagtggagcacgaaaagatggcattgagttgatttacagacacggggcatgaagctactggactatgtttgtgtttaataccagttttctagctacatgttctttctgaggggctgaagaaacacctagttggtattttaggacattaaaaataatatttaatttattaagttttaacaatgaaatgacaatcataggatatatataatgaccactcttattgaaatttcaaatatcagaagagtgtcatttatacttaattttaatttttaaaatatacttttacttgtaatcatcttcggtagacatagacacatttatttgagaaaatgtaagtaatttttgataataatttgggtatttaaaaaaatttatctagcttgtcagtaccttttcctgtttttttattaaaaaggccaaactgaaaatgcattgctttttgtttctctgatgtttctttatatcagataaaagtagtatttttccccatgaatttgtatgaaaataatgtgacttttgttcccgcagacatagaatatggttgccatgcatccaaatgcccatgtgcacactagcaagatgtggtcacatatgctttggagcatataatgatagtagtcttttaaaagggactatttttacaaaggaaaataaaatacttctctgaaaatttgcacatggtagctacacaataaaatcatgcctcctgtggggtttgaaccaaattgggatctgtaagtcaggcagaattccttcatacccaggccagactggatttagattggcaaagacccccccacccccccaccagcctgttgctcactccaggccccagcagagagcccaccgagggtggcccctcactgtcctccgagatgctctgcaggaggtgagtgacggcacttgaaaatttgcacatagtagctacacaataaatatgcattaaatgaataaagatttgtaccagcatatgttccacgggccctactgtagcatcattactctttttaaaacaagctgaatgaaacaaacaaaataaccaaattaatacataactggaaaagagagaatctaggcacccctagaggttgcctattagacttatattgatttaaatttaataaatatataagtcaaacattctcttggctcatttagtaagaaaatcatcactttcatcatgtgaatcatatacattaaataaacgagtaaaatctgaagttgcctgttacttaaaagtgcattactcagtttttcccatcaatataaaattgtgttacttcttttactgtctcaaatcatctttgttttattactcttttcatagaagatacataaactagttacaagattttatcagataagacattttgtaagatacagtcttttaattatgtaagatttaaacaaatgtaaatcgaattagtactcttccctactggcatattaagtactttctagatttctgcctgatttcctttaaaaccaatctaaaactgaagaggagactgcaacttcttttcttacttgagccagctactaacatcttcacaaaataacaaacactcttcatgaattaccaacaccaaggtgcttagggtttcatgacccattcataataaaacacatcccctctagacagaaaagcatatgatcgtggcatgtcaaagccaaggagggctctatctctggggcgaggaggcatccaggctcacgggacggtttctgtatcacggttgccatttgccaccatttgccatagtgacgtgacctatgggaaagagcactcagaaataatgggaagatggagaacatgtggaaggccagctgtctcacattttggtaggaggattattccatgggacgagtcgattaaaacttgcttttgaactgcgtgtgctgtgcatggtgccccttccccaccaggtatcagcgtttttcacgttttggtaggaagattattccatgggacgagtcggttaaaactcgcgtttgaactgcatgtgcacggtgccccttccccaccaggtatcagcttttttcacattttggtaggaggattattccatgggacgagtcggttaaaactcacctttgaactgcgtgtgctgtgcacggtgccccttccccaccaggtatccgcatctgtcacgtacagtgaggctgccatcatgttgttttcaggtgccatagtctcccacaagacaggaggaccagataagccccatcatgtgatacttactctatgcagatttcttaaagtcatgctgaaaaacttgtctcgatttccatcaattaattaacaccttggggtgtcctactactattatacagagcactgaagagaacatgaaagaaagaagaaataggtgcaggagctcaagaagcttctgttaagcttctgcaggaacttttttacacttaggaagttagaagcattctgctgggctcctgggctcctgggctcctgggcagcctgcccctggaaggggtgggggtggagaggaggggcacggaggccccccgtctcaggcctgcacaggccgttctgggactgcgtgtcctggaagacctttcctgattatcaggacacaaggccagacgtgggaccacacacagtcctcggagctggcagccagactttgtggctggcagttaaaggcaatttggtgttcgtggcccactggcaaggtgaatttggttgctttccttaacaccgtgtgcccaattcctgatggagccatgctgccacagggctttgccacgtggggagatggtcaggtcggctgcccaactacattctgtgttttggggacctcatttggttctgaaatgggtctcactttgcccaagatgccgggggcatctgctgctgggtcccctctcaccacagggcgtgtgctccctcgggcacgagttctctctggcatttttgaaaggccttttactgtgatatcagtgaaaatgaaagctgaagcagttcctgataaagggggaaagtggatttcgccaagtgggcctgactggtcccagcatctgcacagcgctcagcgctcgcctgcaagcgcagctcagggcttccctggggccagctcccggctcctctcggcctcgccctcaagtcgggactttccttcttcggtaacatgtctccaccgggcctgcaatcattagccagccgggatgagactaagtgcttaaaggctatttcatgttggagatttaaaaaagcacatattgcaaaagcggttcaacgcgcggagaaattcacccactcttgtctccacccgtcaaatatccggggtcctgtgacctggggtcctggggttggctggttgcgaagcagagtgacgaggaagacggaagagctctgttagcacgcagctcccaccatcaagcttcccaccaggggccaagcagggaagcccttaccttcccgtcgcctacacagagaggctgggtgctggctcagccagcccagcgagctccttctccctctgccagcaccctgctccccgtgggatttgggatggacgtatggcgtccacggccgcatgttacaaggtcccactcatagcatgcactgtggaacctaaatcatgcctcttgcgggatttgaaccaaattgggatctgtagctcaggccaaattccttcacacccaggccagattggattcagatgggcaaagacctcccagcagcctgcagcggggagtggccgcccggacacaccttcgctttagaggaagggtagaggaccgtcgagcttgatcctctacgccctgagcacctgtttctgttgacccctctcggccctgagcccttgtctcctgcgcggtcctcctaaggccgaggcagcaccgggcagtcccttaccagcagggtgggcggctgctggatgggtcggggccagacaccgctgggggcactgcgtggacgaggtggacgctgaagtcagggcctctgagcgacaccatcctcgccgtggcggggtccaggcaggcctggggcctcgggccatgcgggtctcagcccgaggcgtcgtcttcactgttgaggggaccccctccacgtccaggccttcccctccccgcacggggaagctgaagtgttcccgggggtccgcggctgtgcgggagggaaggagggactcaggtgggggtcccagctccgagggcgtccgtggcctctcccggctggggtggggctgcccacaggactctccccacgcccatactcgggaaccaggggaagctgcgggctcctttcctccagtgtccttgttgcccacatggggtgcgggagcagccttgggatgattagcttttaaggggagtccggctctgcaccctcggtccccagcagcccaccctgcggcccccgcacctccccacgcgggaagctgttcctcgtggcctcgcagactgtgcgggccctgggcactgatgcctcatctcctttatttcacatcccacgcgggcgctggaggcgtctgtttcctgcctcctccaaagctctcccaaaagcccagggctgtttgaggcccccaaaatgcgccttgggatcttttttttttaaattatactttaagttttagggtacatgtgcacaacgtgcatgtttgttacatatgtatacatgtgccatgttgtgctgcacccattaactcgtcatttaacattaggtatatctcctaatgctatccctcccccctccccccaccccacaacaggccccgctgtgtgatattccccttcctgtgtccatgtgttctcattgttctgttaggttttttttttgtgagctggagagaacgtagaggcctccagttttgtcatctgtgaaattcctcctgcttgggagaaaaatgccttcctccctaacccattaaaaacagttctgttcaatgtccaggaagagtccttgatgttcaggacatcccgcagttcatggagcccctcagtggaaatacttctttgctttatttagggatgataatttttgttatatcggacatattaaaattagtgccaaaagataattatcttttgattctgctttaaatcatgctaaaatgcattccctatgggaaaacgatacaaattatattttccttttttatttctaagtttttcgtgtttattctgtttttcaaatatgacattacacaaacatcaagacaccaattagatttgtaagttattaatttttggtcatttgaagagattaatgctaaattaaagcaaataccacctcataagtgtagactgtaaaagtgtattgtttaaaaacattaattaacttaccaaaaatatgcataactaaatttatccaattttcataattataaaagcttttaatttcaatcatatttgattctcagatttcaatattcaatcacactgtggttaagtaatcagaatgaagcttttcaacctaagtacagaaaatagtaatacaagcaaaccctatctgagtggtttggaaacacacaccaacacgtgtacacgcaggccttgagctctcgccatgaaagaaggggtatttgccttacttcgttttctaaatataaatgacatcaactcctccttgaactaatgaggtctgatgttgacatcactagttgctcatgggtctgctgttggcgtcactagttgctcatgggtctgatgttgacgtcactagttgctcatgggtctgatgttgacgtcaccagttgctcatgggtctgatgttgacctcatatgatgcttatgaggtaccaggcaaggcaccgtgtgttctaatgcatcatagaagctgattcttagaatagccatgtgaacttggagctgcttgtctcataggaagttcatttttcaaaatctcttaagtggctgaggccaggatttagcccagagttgtgatttccaacctcctcctgcggcccgcagattgacaggcacactcagttccagagctgctggcctctggggcatctctgaggctgacagtgtgggagaggccccgtggcacacacctgtgaatgctccctctcccagtgatactccaccaggcaagggactggcttcagaagcgatctcatggtaaacagcaccagcagaagctctctcaggctcacagatggggcctccaaagtgagaaccaggagagcggctgtgtctccaccctgaacctgcaggcagagccgcaaccttctcattgtcttatttaggagggatcatgtcaggcatggggaggagacgggagagtggttggtgtcatgtaccgtgaaggtgcattaggacactacctgccctaggaaccatcttttctgcacaagggaacacagtggctggagagatattaggtgtgctcactcctcctcctgcatgccatcagtccccctggaacctttcttcccatcgaagttattgttgctgctgctgggagcctccctggtccctgggaaggacagaaggggggcctgggctggttctcggccccccctgtgtgatcctgatcaatgcattttacctatctgggtttcagcatctcatctttaaaatggtaatggtaagacccacctcccggaaaagccccagagctcagtctggttggatgcaccagtgtccacttggtgtctaggaatggaattaacttccaggtgtgcacatcgagcttggtactggactcggcaaatagggattcagggcatctcttgaggctcttccctgaatgtgtgtgtgtttgtgcatgtgtgtgcacatgcgtatgtgtgggtgtgcgtgtgcgcatgtgtgtgtgtgcgtatgtgcatgtgtgtgcacgtgtgtatgtgcgcgtgtgcgcatgtgtgtgcatgtgtgtgcgtgtgtgcgtgtgcatgtgtgtgcacgtgtgtatgtgtgcttgtgcgcacgtgtgtgcgtgtgcatgcgtgtgcatgtgtgtgtacgtgtatgcgtgcacacatgcatgtttactgtaatagtaactagttttttgagaaatcaggtactggaaatcgtagtgacaggattaataggaccaagatttacatgttgttatgaaatttgtgtcgtcgtgattacagatttggcttgaagcataaactgagtgaaatatctctttttgccattcacacttaagaatagtaatttagggccaggtgtggtgtctcgtgcctgtaatcccagcactttgggaggccaaggtgggtggatcacctgaggtcaggagttcgagaccagcctggccaacatggtgaaacccggtctctactaaaaatacaaaattagctgggcatggtggcgggtgcctataatcccagatactcaggaggctgaggcaggagaatggcttgaacccagtaggcggaagttgcagtgagctgagattgtaccactgcactctagcctgagtgacagagtgagactctgtctcaaaaaaataaaaataaaaataaaaataaaataaaataaaataaaatagtaacatagtagaagagatttcactgtgattctgtttccatggtcttcccatcagttagcttaaagacccacagataattaatatggcccatgaataatatgaccctttgggagatgactcatgtagttgcactaagataagaattcatgcctgtgctcatctgccagccaaggtgcacccaccaacggcgtttccttcaaccgcaccttgttctatcaacagcaaccctctccctagctgtgagcaattaacgatttatctcgggtgactagtaaagaattttaccagcccccctaatatttttaccagtccatcctcctttgtgaaaggacaaagttcatacaattaatgaaatcatctttctctgtagtcacccttatcaagtgctgactgatgaggacttgtttgccaagcacgatgcattactatagttacaatcaaggcaatgactgcactgagagtttaaaaaatgttcatgcatttgctgaggaattttattcattccccaggaatggtgtggtgcatgaatgtgcacatgtgtatgtgtgtaaccacacatgtacttcataattattcttctctaaaaagacagctttatgtttttaatagaggcaacctttttccttagctctgttactttatatttatcatctttccccttttatgtacctgcagcctacatttgtgtctcagataaaatctagtatagacatggatctctctgcttttgcctgaaagtcacattagtaactaatgccagaatacgtcacgtcaggctattgtgtttcagatgaaagggcaaacgaagaagtcatttcaaaagcattgtaaagcaccttcttcagttatatgttgcgtctgcatcaaaacacagaacatttaagtgatggaagagtcatggttactgacaaacagtcttcaaggtcatatttattttttaaaactctttcaataactgaagaagaatgcgtcctctgtgcccacctttctggccctgagatgtgaggctctcactgcgttcttggaggaggtgtcattttcctgccctgagacacgaggctctcactgcattcttggaggaggtgtcattttcctgccctgagacacgaggctctcactgcattcttggaggaggtgtcattttcataccctgagacacgaggctctcactgcattcttggaggaggtgtcattttcataccctgagacacgaggctctcactgcgttcttggaggaggtgtcattttcctgccctgagacacgaggctctcactgcgttcttggaggaggtgtcattttcctgccctgagacacgaggctctcactgcattcttggaggaggtgtcattttcctgccctgagacacgaggctctcactgcattcttggaggaggtgtcattttcataccctgagacacgaggctctcactgcattcttggaggaggtgtcattttcataccctgagacacgaggctctcactgcgttcttggaggaggtgtcattttcctgccctgagacacgaggctctcactgcgttcttggaggaggtgtcattttcctgccctgagacacgaggctctcactgcattcttggaggaggtgtcattttcataccctgagacacgaggctctcactgcgttcttggaggaggtgtcattttcctgccctgagacacgaggctctcactgcattcttggaggaggtgtcattttcctgccctgagacacgaggctctcactgcattcttggaggaggtgtcattttcataccctgagacacgaggctctcactgcgttcttggaggaggtgtcattttcctgccctgagacacgaggctctcactgtgttctcggaggaggtgtcattttcctgccctgagacacgaggctctcactgcattcttggaggaggtgtcattttcctgccctgagacacgaggctctcactgcattcttggaggaggtgtcattttcataccctgagacacgaggctctcactgcgttcttggaggaggtgtcattttcctgccctgagacacgaggctctcactgcattcttggaggaggtgtcattttcataccctgagacacgaggctctcactgcgttcttggaggaggtgtcattttcctgccctgagacacgaggctctcactgtgttctcggaggaggtgtcattttcctgccctgagacacgaggctctcactgcattcttggaggaggtgtcattttcctgccctgagacacgaggctctcactgcattcttggaggaggtgtcattttcataccctgagacacgaggctctcactgcgttcttggaggaggtgtcattttcctgccctgagacacgaggctctcactgtgttctcggaggaggtgtcattttcctgccctgagacacaaggctctcactgcattcttggaggaggtgtcattttcataccctgagacacgaggctctcactgcattcttggaggaggtgtcattttcataccctgagacacaaggctctcactgcattcttggaggaggtgtcattttcctgccctgagacacaaggctctcactgcattcttggaggaggtgtcattttcataccctgagacacgaggctctcactgtgttctcggaggaggtgtcattttcctgccctgagacacaaggctctcactgcattcttggaggaggtgtcattttcataccctgagacacgaggctctcactgtgttctcggaggaggtgtcattttcctgccctgagacacaaggctctcactgcattcttggaggaggtgtcattttcctgccctgagacacgaggctctcactgtgttctcggaggaggtgtcattttcctgccctgagacacaaggctctcactgcattcttggaggaggtgtcattttcataccctgagacacgaggctctcactgtgttctcggaggaggtgtcattttcctgccctgagacacgaggctctgactgcgttttcggaggaggtgttattttcatgccgtcctcactttgggggtgaggaggtactgttttcctctttacatatgaaaaaatgcaaacgttcacccaaacaagaggcgagggctagatgacccgcctgagcttcagcttgccttgtttattgtcagagggtgcgtttctgatttacgcatccggggttatcaggtaggacggcttaaaatggtgaaagaaatgcactcacatttcagaggctcagcaggtcggaagcgcagtgttttatcacgtgatggtcctgccccgggagagcgttgcccgtggagctgttttcccggtgatcacgcagggatctggatccctccaggccgtattttcacggatgacagtttcaggagggggtagatcatcagaaggaggcagaatctttctcctaaaagctccagcctagaatcgaaccaaccctgttccctccatctcactggagcaaacacagtcacgtaggcatgctccccggaacgggggctgggagtggagactcgctgtgtgcctgccataattccgtctgcgtcgaggaagggggcggcttgggaagcagctgggcacctgtgccacagccgccacagactcagcctctgctgccattttaggaaaaagcaggtattcatcgcgatctctctgcatggtgtggatcctgtgtttaactcacactgatcacttgttcacttttcattttatggcattcctgagcttaagcacacacgtgcattcatacacaatatcgatgtatgtatgtatgtaagttttatgtgtgtgtgtgtatatatatgtgtgtatgtatataaagtttatatatgtgtatgtgtgtatatgtatgtgtgtatatgtgtacctgtgtatgtatataaagtttatatatatttgtgtgcatatatatatacacacacacgtacatagatacacagtcatacacacacacacatataaactttctttttgctaaaatattgtgtgtctgtttcttgtctccctgctatggtctaaatgtatgtgtgtccccaaattcctgtgttgaaatcctcacccccagggtgatggtgttaggggctggggcctttggaaggtgatgaggttgtgagggcaatgggattagtgccttatgaaaagaggcccaggagacccttgcccctcctgccacatgagctcaaccaagaaggcgccatctgtgaaccagggaatgggtccccagcagacactgaatctgccagaaccttgatcttgagcttctagcctctcaactgtgacaaatgaatgcctgttgataagccacggagcacagcagcacaggcccgcaccaggtaagactcctcccaaccggaggctcggtgtccgtagagcaagcagagctctgcgtctccggcttcaggggcctgcagggggcgggggcgggtgctcacctgcctcatctcacctctagtcctggttaaagcacaccctggagtagaacctctggggtgggtggggccttggagacgcaatttaagcagcttctcaggtaaattgttttatcttaaaatgtacagatcactgtgacacatggcaactattatcaataaggttttgtacatattttaatttttcccaaattacgtatgtgtataagacaaaacacgaagtttcttgaaggcatttgagttttagactcctttttgtattctagatacaagtccttaccagatttatgattcacacgtattttcttccactctgagccgtcctttcactctcttggtggggttcttcaaagaagagtgcctattctttgcaccccatctgcatgcctgtgtgtgtttatacaccactgcacaagtccccgtacagtacatgattctagggcactgtctaatcatgtatactgcatatgaaatataacacttcagactttatgacaaatccttgcagtaggttgtttgtctttaacttgtatgtatgtggatttaatgtattttcagaggtaaacattctagctaagctagaaagcctgaaaggaagtttcaggctttattatggatattgtagcacttctaatgcagagttagactttataaaatgtagtggatggcacattctgtcatactggaaatgcacagtgtttttaattttggtaaagtccagtttacctatcttttcttttgtggctatgcttttggtgccatgtctaaggaactagtgcctcacctgagtccccctttgtgagccagtgtcaagcccatgacaggaggctgatgacgggcagccgctgccacccagggtgacacagggctcactacccctaaggcagcgggtctcactgctgtgcaaacaatgcactctgatgcattctgctgacataaggttaacctggacctggaggggtaggacttgaagttaatcccactgggtaattttttccttcagtcttgaacatgtttttttaagctagtgaagctggtaaaagtaacatcaacagcatctctgaatggggaagaataaaaggcaatcctattttaaaaggtataaattttgcagggaatgtttgtataccgaaaattattccttatttacctgaaattcagattgaacctggcatttgcattttatctgacaactctgcctgtaaataaatgcagttcccttagtgaatcttcagttaaggaaatttccttgggctttctttaaaaatcaaatgtgaatacggtgtattaatcagctagggctgctgtaacaagtagcacagtcatgtggtttgagcagcaggaatgcctcctatcactgttctgagggctggaagtccaggcccgaggtgctggcagggctggcctggtgagggctctctctctgactggcctccatgtggtcttctctccgtggtcttccctctgtggtgttccctctgtgttcttccctccgtggtcttccctcagtttgctccttagatgtctccatcttcctgcatggacatcaattatactggatcagggccccactcttatgatgacctcatttatccttaataaacttcttaaaggctttatctccaaatacagtcacattcagagttaagccttcatccatgaattttgaatccataacaagcaggatagaattatttctgtcagtgtggcttggatttgaattgcttgcattgaaaacaaagcgtatcaataaaaggctcagcatggagctgaaactgcccctgctctgtcctcaggtctattgacggcaccaccaacgccatcacccttctttctgcaatcatctaaggtcccagctgtcttcccagtgaaaaacggctttacaataggaatgcttgtgatgtctagtaaagaaaagggatactagtgaaagaggtttgggggattctcacctgacctcgatacaagtttccgttttgaactggagtgaaatttctcccagtgtgtcaaatactggctgaagacaaagtgagaatttcccccaaatttatcttttgttttcatggccacagatattttatataaaatagttattttcaattggtgattctttttttactatttttatggggaccatccaagcatagttgaagtgaactaagaaaaaatccacgtcttttacgaagctatggcaatgcgtctaccaccttggccggcagggaggtttctcttgaaagaaacctctatcctattatttatcctagaataaataattctatcttattctttgcaccccctctgcatgcctgtgtgtgtttatacaccactgcacaagtcctcatacagtacatgattctaggacactgtctaatcatgtatactacatatgaaatacaacagttcagactttatgacaaatccttgcaataggttgtctttaacttgtatgtatgtggatttaatgtattttaagaactaaaatttttagctaagctaaaaagcctcagacgaattttcaggctttattatggatattgtagcacttctttttttttttttttttttttgaaacagagtcttgctctgttgcccaggctggagtgcaatggtgtgatctcggctcactgcaaccgccacctcccaggttcaagtgattctcctgcctcagcctccgagtagctgggactacaggcacgtggcaccacacccggccaattttttgtatttttagtagcatttagtggagagtagagtattttgtatttttgtgtttgccaggatgatcttgatctcttgacctcatgatctgcccgtctcagcctcccaaagtgctgggattacaggcatgagccactgtgcccagcctattgtagcacttctaatgcagagttagactttgcaaagtgtagagtgggtggcacatgacggaatcatacttgaaacacacagcagtatttggcaaactgtttggaagacactataaaaaaagacagaatgatacacggaaaataggagacaggcccgctatccttatttatgattaaatcctgaccacaaagcattctctctaacctcgcatttttatagctcataactctttgaagttaacttgggaaataaattttccaagattagtctcaactaaaaggcattttttctcttttgtttggaaacttggaaataagtttgtttttctgttttggtatgagtttgtatcagaaaaaaggatactttaattgtataagtcaatatttaaaacaaaaaatgagaaaattttcttaaaaatacttctttgggaagagagattttattggctcaataatttttttaaatgttaagcattttcaatcattatgttttctcatgaatgctaaaatgctttatctaaagccattagttcaaatttttgaaatagcaatatgttacaaccaaaatgtatcagaagttaaattatgggtatatacaaaattttaggttgaagcagatgtttgttgataaattacttaagatatttctctttgtttaatgctttacctttgtgtttaaaatactgccttttatttgtgcgtgtgtgtgtgtgtgtctttctataatttgtaaagccacgttgaatatctagtatatgctcaataaaatattgaacacctctgagtttccaatggtatcttgtaacatttttagtcgttttcagaggtggcaaagcaaatatttggagtcttgagcaaataaaaggagagggagaaaccagaagcatttccgagactagaggacttgattcggtccagaaacgttatctgaagctcgatgaggagccacaggcgaagaccagatggtgtgtgtcggtgtctcacattagaatttagtgcgtcttctcttcagatgagcaactacaggcgaagactggatggtgtgagtcggtgtctcatattagaatttagtgcgtcttcgcttcagatgagcaactacaggcaaagaccggatggtgtgagtcggtgtctcatattagaatttagtgcatcttctcttcagatgagcagacacaggcgaagaccggatggtgtgagtcggtgtctcatattagaatttagtgcatcttctcttcagatgagcagccacaggcgaagactggatggtgtgagtcggtgtctcatattagaatttagtgcatcttctcttcagatgagcagctacaggcgaagaccggatggtgtgagtcggtgtctcatattagaatttagtgcatcttctcttcagatgagcaactacaggcgaagaccggatggtgtgagtcggtgtctcatattagcatttagcgcgtcttctcatgtcttctcctcaggggtggaacagtattttctttttcacagactttatttttagagcagttttacttttagagaaaaaaattatgcagaaagcgcagagtttccaggtacctccagagcacccacacctccaccacttttcctggaatgaacatcatgcattagtgtggtgcatttgttataattgctgaacaaatattgatacattattattaaccagcttccagagtttacattaaggttcactcctgatgttggacattctatgagtcatgacaaatgtataatgacaggtaccccccatcatagtgtcatacagagttgattgactgccctgaaaacctagagtgacgtgtacccaccatcatggtatcatatagagttgtttcactgccctgaaaaccctctgagctccacctacccatccctccttccccctcacccttggaaaccactgatctttttactatctccatagtgttgcctcttccagaatgtcagagagtctgactcatatagtatgcatcccttaaagactggcttcctttgcttactagtattcgtttaaggttcctctgttactaatattcgtttaaggttcccccgtgtcttttcgtggcttgatcactcatatcttcttagtgctgaattgtattccattgtttggatgcaccatagttcatctgtttaccactggaaaggcatcttagttgctcccaatttttgacaattatgaataaagctgctagaaacactcatatgtaggtttttgtggacatcagggttcagcacatttggctaaataactaagaacacgattggtggatggtacagtaaaactctgtgtgtcttcataagaaactgccaagctgtcttctgtggtggccacgccattctgcagtctcagcctgctttgtagcctccccagcagctggtgttgtcaatgtttttgattttaggaattctaataggtttgcattggtgtctcattattgttttaattgcaatcacctaatgacatagggtattgaatgactttcatatgcctatttggtatctgtatatcttctttgatagggtgtcggttcagatattatgcctgatttttaattaattggggtttttttaattgttgaattttaagtgttctttgtagatatattttggacataagttttttgttcatttgtttgtttttttgagacagggtctcactctgtcacccaggctggagtgcaatagtgcaatcatggttcactgcaacctccacttcctggactcaagccatcatcctgcctcagcctcctgagtagctaggaccacaggcgcacaccaccacgcctggttagtttttatttttatttttgtagagacagggtttggccatgttgcccagggtggtccccaactccttagctcaagctatctgcctgtctcggccttccagagtgctgggattacaggtacgagccaccatgcctgacctggacctaagtaatttttcagatgtgtgttctgtaaatattttctccctgtctgcagcttgtcttctcattctcctaatggtgtatttgcagagcggaagttttccactttgaggaagtcccgtttatcaatgatttctttcatacattgtgcctttgaggttgtctttaaagagtcatcaccgaatccaaggtcacctagattttctcctgcgttaccttctaggagttgtacagttctgtgttttacacgtagctctgtggtatattggagttaatttattaaaggcgtaaggtccgtgtctagacggcattctctttgtgtgcggatgtcccgtcgtcctggcatcacgtcaccttgcttcgctactttgggaaccatcagctgcctctgtgggggtcgggggagggctcagctctggaactgggttaaggctgaaaaatattcagaaattggccatgggctgagcagccgaatgggaatagaactaaaggtgactagaaaaaacgtcaaagaagtcaggaaatgagaggtgcaatgcacagaagacagtgagaagatgtgacttctctgtgggggtctcttcaggagcaaccagaggagccttgccagaatcgtcaggctgaggcccaccgcgggggccgactgtgggaggaacgtcttgcccaccctagaagactaggaaagaatgctggaaataaaagcacccaacggcccagggcgcactcctgctaattctccgtgctcagctaggagggagccaggttttcacagggccctgtgttgtgtgtgggatatatttcacctcttttgaaaagtgttgtccatctttgaaagcaaatcggaggcactgaagaaaattctgggaaagttggaagcatctacaatgggccttgtttccaacaagatatgtaggaaatttttcacccttaggagagggacgctaaatacttttgcaaagaatttaaagagaaaacttgaggaaagggaagaattgaagataacgtaactttaatgactaagaagcgtattttaagcattctgtgatggatggaaaaggtagatgtctaattattttcaggtacatctctaatcctttcctgcactgatttctgtgttatttatttgtctggggggcagtgtattttttaaacgtcttgttttcttttctctcctcatcccttcatcttttccaagagcacataactcatagtgaagtttttaacaaccaatggagcgtagctgtctgagcagtgcaggattatctgaaggaggggagttcagggtttccacgaccctctttgcagtgacagtggcgcatggcctgaccttcgtaacaatgcatttttgttgttaacccccgagcatggaccgctgtgtgtattacctgagaattggttctgctgaggtgcaagattgactatgttcagaatggcagttgaatacatctttttgtttagtaaaaaaggtttattgtaggagatattaacaagcaaggaaaataaagtaaaatatcttgtgaattcataatctggtgatgactgcctgtggaaacaccggtgggtgtgtgaatactgtattctgttacgcagtgctgcacctgtgccgccatgcctgtgccgtcggcaaatgttactccaccatgtgctccatacataaccatctcaggttattggaaaaatgcagcctccgagccagacgtgccgatgggacacagggatcctgaacgtgtctcagcaatccgggtgattcttcggtgtggtcgcgtttgtgaggcgcttttccacggcgtggtgtgtatggttctgtttagacggttgcatgatggaacatagttgaccaaaccgagttctgaggaatagattcgtatactgtgtgtagtattttggtagggacacttccatgaggaatacttctctatggatacaattttctgtgcttctgtgattgtgtccaggatggatttcctggggactcatggaggtgccctgccgagggagactgatgtttccgacgttgagtcctcatttgtttgttcactgaacgcaatgttcactttctccccgcatccctgggtgctgggaccagggctgcgtgctccctgaacgcgatgttcatttcctccccgcatccccgggtgcggggaccagggctgcgtgctccctgaacgcgatgttcacttcctccccgcatccccgggtgccgggaccagggctgcgtgctccctgaacgcgatgttcacttcctccccgcatccccgggtgccgggaccagggctgcgtgctccctgaacgcgatgttcatttcctccccgcatccccgggtgccgggaccagggctgcgtgctccctgaacgcgatgttcatttcctccccgcatccccgggtgccgggaccagggctgcgtgctccctgaacgcgatgttcatttcctccccgcatctccgggtgccgggaccagggctgcgtggtccctgaacgcgatgttcacttcctccccgcatccccgggtgccgggaccagggctgcgtgctccctgaacgcaatgttcactttctccccgcatccccgggtgccgggaccagggctgtgtgctccctgaacgcgatgttcatttcctccccgcatccccgggtgccgggaccagggctgcgtgctccctgaacgcgatgttcatttcctccccgcatccccgggtgctgggaccagggctgcgtgctccctgaacgcgatgttcacttcctccccgcatccccgggtgccgggaccagggctgcgtgctccctgaacgcgatgttcatttcctccccgcatccccgggtgctgggaccagggctgcgtgctccctgaacgcgatgttcacttcctccccgcatccccgggtgccgggaccagggctgtgtgctccctgaacgcgatgttcatttcctccccgcatccccgggtgctgggaccagggctgcgtgctccctgaacgcgatgttcatttcctgcccgcatccccgggtgctgggaccagggctgcgtgctccctgaacgcgatgttcatttcctgcccgcatccccgggtgctgggaccagggctgcgtgctccctgaacgcgatgttcatttcctgcccgcatctccgggtgctgggaccagggctgcgtggtccctgaacgcgatgttcacttcctccccgcatcccctggtgccgggaccagggctgcgtgctccttggacgcgatgctcatttcctccccacatccccgggtgctgggaccagggctgcgtggtccctgaacgcgatgttcatttcctccccgcatccccgggtgcggggaccagggctgcgtgctccttggacgcgatgctcatttccttcccacatccccgggtgctgggaccagggctgcgtggtccctgaatgcgatgttcacttcctccccgcatccccgggtgccgggaccagggctgcgtgctccttggacgcgatgctcatttccttcccacatccccgggtgctgggaccagggctgcgtggtccctgaatgcgatgttcacttcctccccgcatccccgggtgccgggaccagggctgcgtgctccttggacgcgatgctcatttccttcccacatccccgggtgctgggaccagggctgcgtggtccctgaacgcgatgttcatttcctgcccgcatctccgggtgctgggaccagggctgcgtgctccctggggacttggctgaaaggcagctctgctcgggctcccaggcgagcctgctgctggtgctgctggtccctctgtgtctgtgtgtccagcctgggaggaggcgcagaggctggagtagcctctgcccacacacgtgcaggcagcgagcgcctgcgacagggcagagagcagcatgcatggggcaggcaatcttcctgggaactccgtggcccctgcgtgccctggtatccgcttcacaccacagcctcaggaccctgtctccccagcaggaccccgcctccccaccctgcaggctcatctcaccagcctcattctcaggcaggtgcccccgacgtgggggcccacaggtttcattgtccatcccactaacgatccagtggaggctttttgtttttgttttaaaatagaagtcccagatcttatctccagtgactgtcttgggtcacacgtccacccctgaaccagtcgctgtggccagtggggtaggatgtgctctctggccataaggggcacgtgcccttctctggagggggagggatgggtggacccgggccttgcgcccaccacaggggctgactgggaagaatgtcttgcccaccctagaagacgaggaaaagaggctggaaacaagcgcactcaatatttcctgcagctgtcttttccctgcacatgtgatctctgtggatagagaccctccttcagggactgagcagtgcatgggcacctgtcatccagcaccaggaagatgggagtggtgtggcagcgctgggaggggggccaggccctgagcatgctcatgggcagggcgggtaggtcgaaggctgctccaggaccctgcaggccgggcctccatagggcaggtcagcagccatcctggaacagggctgaggcagcaggccgggaggaagcccccgtccttaggaacgagcttggagaacacggcgcagatcctgtgggcagcacaggggagaggtcgcctgaagccctggaaatccctgggagagtgaaccttcccgccgggccttggggagttggagaatattctgaaacaagtcacatcacagaggtaaagggtgcaagagcagctctggagaaaggtgaggagggaggtttgcctggaacgtctgcagatgtgtttagagctcggatttctcctgaagggcctgagcaattctgcctgagtcaggggggattcctgtgccgtgtgtgtagggggtccggtgggtgacagcacaggatgaggtgcagacccatcccgaactgccggactcggcgctctgtccttcccgacctccctgaagaccggcacattccatgctggtctcacttcagacagccaggagggccctcctttctccaagtcaaaacaaaagcaccacttaggcacagagggtgacatgggggccggccaccgccctttgcatgaaccagaacaaaatgttgccttattaggtgacttcgtgccggggtgcgggggctgcttcctgtggtgctgctgatctgcaaaagctaaacatttagactctgctccactcgaacactcctgccaagaagtctctttaggtattctgtctttgtcaggaaggcctgccagcttagcagcacccttggtctgggaggcgggaggaagtgtgtctgtggggaaaggtttgtgcgaagcgctgggcgggcgtggactgggcctgcctttaggagccacacccctcccagtgttaattctcacagggaagagctcagcaccgagtggctcgcttttgctgctgaacatttcaggctgttcttctgtggcttaaaatgacagtaggttataaagtgagcactcaacatgcatttcggatgtttcctgcagaatattttttccctccttagattccccccgacttctttctaagccctataaggataaatctcttactctcctagcatatctagtaaaatattgttgggaagataaatgcatagatagcgctttactgtagtgggtggggagcccctgtgagcagggtgtggggaccctgcaaacagccagaatgaggagcgtggacacagcagaacttcccttcagttccccgatgcagaagacggggagctcctcgcagggggtgggtatttctgtgaagtttgaaggcggagccatgcgaagggtctgtctttactgtgggatgcagaacacaggcagagccatttgaaccagccaaaaacatccaaaaaataaatcatgctaaatagcacccacactgctgcagctaacggacttgcgccaggctcccggccccagctatacccctggctctgtcttattcagggacatgacaggacaccagccaattccagtggctgctccagactgtctcggctctgcggtgaagatgaccgacttccttgatcatcactcagttcctctctcaggatcatcctccaccattgtgactttactgacttgggtgccctcccaagcacccaggtgaaggccagtgcacccctgcctgtcggccacatgctggcaggaggcagcccgccatgagacacagaggcagggtggctggggttagaggcaggactttggagcctggtggcctgggtctgaaacctggttgtcccctccctaccctagccttggtcaggttgtggttgctcagatttagttgtgccaagcggtgaagactgggtgaggccatgctgggcaggtgcaccagtcagccctgtgtaggtttcctcaactctgctcattcaaacaggtaaatacataacacacaacccttattctcaaatagctcaagtttatggtctaattcagcagctcccacacttttttgatataaaaattcttttgtgctgttataactcatcaaggaccccaaaaagctcttgtaatcatgggctgtatctactgacatcagtgaacatgtttgcactaagcacgttgtgatctgaggcacgtccagtcgggcagcagatggctgacatcgcagatcacctaggctcacacgcttccagagtgcaaggccagagaacaccttagcagtctataaaagtggttccgaccccacggatctcctgtgaggaccttagggagccctgggggtcccttcagacctcgctctgagaatggctggtctaacagcagggacaccaaatggacgcatcacaggcaaaccggcgggcctcgctccatggaacccccaaccacaaggagctctaagtgcagtgggatcctcaggtgatccgagtccttggggtggaaggaatgagggaaggtttccctgaggaaacaaggcagaagcaaagtagaaggaaggttttctggcagtgtcgtgatcgtgttcagggatcacccgtcagagactcatcgtcgatgtgaacacacatccctaaatctagtttacatgcttaaattgagcactttgctcctcagtcacagacatctacacgcaggcatttagatttttcccctcaagcacgcatgagatttcctttatacctggagaaagaagggcccatcctggagattttcccagaaggaatccctggaaggtgaattccagccactgagtcttgggtgacacttgctgttttgaaatggccccttgcctgttgaaaactatgcacgtttcaaaaacatcttaaaaccaaagttccaccaggatgacttattccatctaaacatgctttcttctcatctctgtaagactctgctggaccaggacgccatctaaacatgctttcctctcatctctgtaagactctgctggaccaggatgccttattccatctaaacacgcactctcttcttatctctgtaagactttgctggaccaggatgcttgttccgtctaaacgcgctctctctcgtctcatctctgtaagactttgctggaccaggatgccttattccatctaaacaagtgctctctctcttttagtctctgtaagactctgctggcacctaaactctgagatgtttggttctttttccttgacccagtttcagatgagggttctggtttccattgtgatggttatgttgcatccggtgatcaggctgaaggtacctggaaaatagcggaatctctccacatggcctgtctgcatgggaaatgctttatacacatgtcccagccttgctaagatcgccagtggctgcttctgggtgacacgcaccctcatcctggactggctctatctggtcccgcagcatctcccagcagtgattcattcactcctgtttcatctgcatgagggtcacgcactttcgaatctggtttagagacaggaccctgcagtgctgagggcaacacatcgacagagccctgttgagaccctggaggtgacgagacagcaacgcatggggcctggaggtggccacttggatgttccctgagctgagtccagaactgagagtttggctttggaagagacctgccttgatcacaactgatcccactgaatccatctttttctaagtttggggctcctgaagaaaatggaagtagttgcgtttgactctggagtttgaacccttggattgcattctgcttctaccataacttgttgcaaaaccttggggaagtcacctcactctcctacatctgtgtccgcagggttaaaacccaggtacaatgacaccagcttcacagggtcctgggattctgtgagaacaatcaccgtgcatttgcacgtagctgcccagctgctgtgtgtagcagctccaggtggcaggaagcttggccgtgccctgcaatcttctgtcccttctcccctcgtctgtgaagtgggggcaatgggagtcctttgcgagctgaaagtctaaggaggtagctcatggaaagtgactggcatcgtggctggcacatcctaagcctcaggaagtcttagcaattatacttgaatgaggtcatgaatgggaagtgtttggagctggaaagtgctgtcaaaatgttattgtttccttcaaattccattgaggtaggagacgggggcagacagtctctgtcctttctgctgtcattgaatttgagtttgttcatctctgaataatttcaagtctagcacatgccctgaccttccttgcccttggtgcaaaagggaccagcccttgttcagggctgaaggtccccagggcttcatgtacagcaacggtttctcctaagaacaagcatggcttcgttctggggttttccgagaagagagaagaattctacacacgggttgagttatatcttgggattatattatgccaaatggcaaagacctaacgtagcagctttctaacctcatgtcatgaatttgctgagttctggctcagcaaaagtgcctattatgaagaattggacgtgggtaatggagtttggggcatgacagtccagggcttgcggtatcttttcttccttgtgttaaaggttaaggattttcaagtagggatcgctgcgtggtaaaatgaaatgcagcattcctgcctctgatgcacgcatctctcctgaccggcattctgggccctcaagtcatttatctgcaccctggagaagagggctaaaggccctgagtgcccaccaccgacaggtttcaattctcacagtaatgcagcacatagaagctgttattgtcatcctgcagatggggaaacaggctttaaaaggtcaacctgagaacacatggctagtaagaattcaaaccgggtggcccttatccccaggtcacactgtgtcctgttcccctcggggtgggcagtggcattgggttcccaagcatctgccatttttatcaaaatgctattttgatgtttcctttttctcatcttaattttttaaagccactattttttcttttatccacatgaaaagtgaagtgttaaaaagtggccccctctggctattggcttatgccgcctgtcacagtctattttaaagtgggattgtcagcgtcgcttttatttctcatcagctgtattaggtgaaaccactggccctaaggcagcacttttggaaaatggaaactattctgattgtttttgtaaggcttccaaatataacatcaggtgacttttattaacttcctttaaatagattcagtgtccaaattctacagaatctgacagagaataaagtcgcatttctgtagcacttttctggcatagctgtgtttgcacccgtcctgaggggagctggtgagggtgttatcattactggtaacaaagcatccaggaacttcatgagtagcaaccaagttccagtccttgggggcatcacgcggagatactccctgtggccttgattgtggtgggtgggggtggcctttgcagccctgtgagtcagggctggggacccagggatgaggggagggagggaattaaggaaataccatagaaacttaggctaaatgagtctaaggagagaatggaatcagggctaacttcgactccggttttcaaagcttatgttggtgtggttgtcactggtagagaaatgtggaaagttggcctttcaacacaggtaattcccctacaaatgctgaggacaccggggaggatacagagagaggtaggaggttagtgtgggaggcaaatgggacttgggaggcattcccatcaggggctctgagatgcgttccgagatggtctgtctttgtcacggcttaagacgtagttttccctcctccaccagggcctaggattcatgtttcagaatggaaattaacttacaggtctatggttactttatgtctgagtttgttgctatgggaaatacatgtgaaaagaaataaatcagaacagacacctgtggtcattactttctctccaaaggaactggatccacgcattttatccaaaccctgttttttagaacatacatttgagtatgagcttcctatagtatctaattttccttttcacgggtattcctggagagggcctggtcctcagacgccgaggctgggagaggcaggggtgccgttttagggacggaggcacctgtcactggtgtgaatatgaattcccatgcagcctttcctggctctgtgatcttgaggaagacagcaactttttctgagcctcagctttctcactgataaaacacaggttttggtttgtttctttgttttcttttgagacagggtctcactctgtcatccaggctggagggcagtggcacaatcacgactcactgcagcctcgacctcccaggctcaagtgatcctcccacctcagcctcctgagtagctgggactgcagacacagatcaccacatctggctgatttttttcgtttttcatagtgatgaggtcttagtatgttgcccaggctggtctcaaattcctgggcttaagtgatcctcctacctcagcctcccaaagtgtgggtaagccaccatgcctggcctaaaacaccatttgaatgcataattttaaaacacagttttaatgctgtgttgttatgaggattaaaggacagcatgcagagcacctacagtgcgtgtaaatgtgatggcaagcatcttgtatttaataattaaaagtgagtttgcaagtattcttgggaattaaagtatgcaaccagtcagaaatgaatgcccgtcataggcacagccttcgcctctgattcccccctggtttttataccaaaagtaaacatatgaagaattttattccaacagaagtataagtttcaaggtctcctccccctgcccccacacctggtctgccctgtctagaaaatcaaatactaaaggggcacttttaaaattttatattttattttctttgatcatcttatttaaatgttgtataattaaaaagagaaccacgaaatttccatgactgctgaagacaacatgcgtaaaaattaagtaaaatcaattctaaaaaaaaaatgaaaacccctacggggacatctgtgacaggtggaaatgtgtgcctggcatgggcattatctggaaacttgttagacaagaggacgaaggagcttcgcccagacctgctggccagggacctgcagccaagcacctgccacctgcagcttcagaagccccggacgggtctgacactgacgtttgagaatcgctgccctagtcacattcttgccgggcgcatttcttgccgtcactgagttttaggcaatgcaatcattgcacagttattaacagatgaatatcaatcattacctattaatagttaccaggagtctgaaattcacttttgataagaaagggagaacaattattaatgtcggatgcacctgtagacacacaagctcaagctgatgtttaggtgggatgggtgatgtgaatgattccactgaaaagccgcagacctgcctgggaccccgctgcctccctgcagcccccctcccctcccttcctcattgaccggggctgggtgcaggtgtctttcccacacatggggcctgcactcagccgccttcaccgctgacttcagcgtctccttcagcctcagctctgaagtctcctccgtgcagaggccttctctgacccccctttccaaggtggcctgccccaccatcccccaaacaatcagcattagcttgtctgcttgcttcatggagttcttccgagattatctgggtcatttgcccgtttcctgatttcttcattacatctcaagctccagtttggagactttctctcaacacagcaccaggttccaggcacagagcgggagctaaacggtggttattttgttgtagggatcccatggatgggttttggagatgacttctttatgtcacagctctgcagtctcaggctgaatccatggttattgttgaagggatgtcatggattggttttggggtgacttctttatgttacagctctggagtctcaggcaatcctgctaacagcaattatagctggagatgtgtgagaccgttactagctctccccactttgttgtgagtgggtgagtgtgagtgcgtgtgtgagcactgagccttcctcagtccagagggtcccaggacagcaactgagggctgcaggggtcttggggtcaccgctgggcaggagaggattaaaggtagcaaaggaggccgagggagtggcagtgcccgaaatgcaggctggggtggggcagagccggagagagtaagcaggaaaccagacagctggaggccagttgttgccgattttgaatgtggcctggaccagctcagctgttggaggcactggaagctttctttggacggtccacctggagggacaggtgactggaacgccgccatggagagacgcaggctccccccacctgggaggagtgcgtcacgcggtgtttccacctgtttggagcatgtccgacctgccgggaactcagagcttagtaacattcagaagactcagctcaaacgaaccgacacgcacggggaagacccgggggccgagggtctttcctgacagtggccttgcccctcccggtttttatctttcttgaacccactctttccacatggacactgtggcgccctctcacccccgcctccctcaatctccccctccttcaagactcacgccagactcgtccaggctccggcctccgtcaccttcacagaggctgcccagtcgcagctgaagtcagtgattctgaactgttttgaacaggaggagccatgctacttacttaagaaaagttaccattgcttgctttttctcagttcaaaagtaattcatgctagccatagaaaattcaaaaaatacaggtggaaggaaaaaaactaaataacctgcatccaggcagagcagctgaggtggagtcgctgccagtgtggactgaggagcccgtgcctggctcagccctgccctgcctcactccttcctggctccagtgggctcggccctgccctgcctcactccttcccggctccaatgggctcagccctgcctttcctcaccccttcccagctccactgggctcagccctgccctgcctcacccctcctggtctgaagcttaggaaggaatggctgtcatatcggaaactattccttcacagcagatgaacgcacaatgtctgtgtattgggtgtttgcttctcaggcatctgctggcctacaggctctgctgggggttccagactacaggggtgtgggtctgaccccctgtctctcatcttccttgcactaatcagcaaactggggatgttcttctcatagcagcagcagaggcacacgaaagccgggcctcacacacaagcaaatttggagcctcccccgcctcttgctccccaacctcctgctggccatgctgagttcacaggcttgggcccaaagtcccaggtagggaagagcacccagcctctatgggagcactgcagagaccttggcaatacggagagagtggccagtactgcagtctgttcttcctggaataagggtgtcattgtcctgagtgggacaaactgaagaagggaggagggcagaggagggcagaggagggcgagggccttgcagccgctccgtcagggatgaggctgtgcacaggcgaggaaaccaagcatctccaaaagttccaggctgtggttgcaacagtaattgggacttggcagaggccatcggaggtaaacaaactctagtccctacacgtcagagcagcacagcagcaggccagcaaaaactggggagccaggccggccaatagtaacaagacttggggtgggcaaaggaaatggaagcaggcgattaagaagttcacccaggaagctgagatgagagagagaaccacagatggccatgcagggttgcaggtattacagtcggctggacgtgaagaccacctgtgagatagctcctcctgcggactagactcacaccagtgggaatctgagttcttccgacgtgggacctaaactgaattgagacattctggtgggtttattcacactttctaatgaaaacctcctcttgccaataaagtcagcacttcaaggcccacaagtgttcttataaacaaaacgaaacttgcatagataaagccaaacttggcaagagttgggaatgctcaaggcctgtggtttaaatcacattagtggtaagaggtctctgtttaatcgagtgtacactaatggaacaccaggtcctcttaaaaaaaaaaagcattcattaaatgcaattttctgagaagtggactatgtacttttgcctatcattgagtctgatatactattcatttttaagacctaccgaacaggcaaaaaatatgttgccaattaaaatgtgagcaatattttctcatctcttagaattcctattttatgcttactaggagcactttttcaggcttatgtagacatagatgttgtttatggagagcatcgatgtagagtgagatgcacagacggccgtgcacggtgggaggagctttgcccagtgctggtgctcaggaaacccaagcacctgtggaagtagacagcacatccatcccgggacagccccccagagccatctcccagttgatgccccctcactcttggaagcaactgctcttttgattccaatcaccatacattacatttttttaaaaacaaggcatccctctgttgcccaggttggagtgcagtggtgtgatcacagctcactgcagccttggttacccaggctcaagtgatcttcccatctcagcctccagagtagctggaactacacgagggcgccaccacacacagtgaatttttgtgtttttttgcagtcacggggttttgctatgttgcccaggctgacatcaaacccctgggcttatgcgatcctcctgccttgacctcccaaagggctgggattacaggtgtgagctgctgtgcccagcctacattactttggtctgttctggagtttcatgtaaatggaatcaagcataagtacccctttgttcctgtctttttttcgatccagtaatggttttgagcttcatcctcactgcgtgcattacccattcattctctgcaatttacatgcatgattgtagactgtatgcagataccacagcttatttctgcattttcaaattaatggatattttgtttttctctttaggttggggctactacaaataaagataccaggtactagtcattgtactagtcattcgtgagtgcatgttttcatgatgctggggataaatacctgagagtaggtttccagagtagccccagcatttcacactcacaggaggaatgtccgaggcctcccactgctcctcagctcagctggcctgtggggtggggtttctggtttgggttgttctagcaggcatgtggtgctgcctcatggtgatgttttacctgcattgtcatgatgacggatgatgttggacagtttctttcaaatacttatttttcagtcacacatctttcattttgtcatgtctgttttcacctttgttaaatttggataaggctgttcacctttggtgttgatttgcagacgttgtttatagcacctggagtctttgtcagctgtgtatattagggatctcttctcccagtctgtggcttgccttttcgttttcttaatggtctcttttggtgaggtaagttctaaattttaatgaagtccacttttttttgtcttttgtgcttagtgctttctgcatctgccctagagatctttgtctaacccaatatctcaataatagtctccatattttcttttagagtctttatatttttagcttttatgtttagatctctaatttatctcaaataaatttgtgtgtgtggtgagttaggcttttccatctttaactgtcatgtagatatctcattgttgtagaattatttgttgagaaggcttccctttcttattgaattgttttggtgcctcatcaaatatcaattgaacatatacatatatttttaaatttacttataagctttttattcttttccagtcatctacttagctgtcctttttccactaacatctagtctagattactggctttataatgatttttcaagtaaggtaatattagtcccccagtgtggctctttcggaagaaaactttgaataagttaggtccttcacattttcctatttgttttagaaccataatgtcagtttctactatagagcttcctaggatttcggtaggaattatatgggatccaccaatcaaactggggggaattaaagcatttctgagtctgctcatccattaacatggtacatctctttatttatttaggtgttctaattttttcagcaatgcttttagttttcaatgtattgtacatctttgataaaattctttctaagcacttttatgtttttgatattatagcaaatgacatttaatttttttaatattccaattattcattagtaatatataaaaatagaagtagtttttgtagattgagcttgtacttaggactttgtcattttcacttattaattttagcagcttttgctttgcaaatataaaaaagtagtgagattattactaatctaaaagtgaaagtgttcagtcttttgtcattaaatatgatgttagctatagacttttcaaatatgctctttatcagacagagaaggcttttctctacacctagtctaccaagagttttgctatttaattattgaagtacttaatcttaataaaaatgagcaactaaatttacttgtctaaagactgatagttttgctatagctgaaaacatttgcatttagggtataatgctattgcaatgtctaaaagaattgttggttatgatttgtagtattttaaatagtcccttcaattttgcaaaatgctttatctttctttctaaatacactcatatattcttccactaactcctcccgcccaccttgtgagacaattagacaggtttgacactgttgtgaacccaaagtatctgtgacaagtctcagtcaatttggaaagtttattttgccaagggtatggatgtacccatgacatggcctcgggaggtcctaacgacgcgtgcccaaggtggtcggggcacagcttggtttcatgtgtgagacatcaatcagtatgtgtaagaagtacattggttcagtccagaaaggcgggacaacttcttaagcagatatgagacaaatggttgcattcttttgagtctctgatgagcctttcactgaatatacaacgtacatctgagaggaggatagaggaacagtcgcttccgccctagtctggctcagtgaagcaatagggtggaggaagccatcagatctgcacctgtctcaggtgagctgctgagggatgactgagttctgtctgtccttggtccatgggaatttcctgcaggcaaacagcgagggaggtctgtagcttttttacctttgtagccctcttattcaggaataaactgaggggcaggtttgccgaacacagttcctggcttgacttccctttggcttcgtgactttggggtcctgagatttcctttcctttcacaccgtcttagtctgtttgggctgccgtaacaaaatcccttccactgggtggcttataaacaacagaaattcatttctcatagctctggaggctggaagtccaagatccaggcactggcagatttggtgtcggggtgaggggtgaggggtgggggtgattcatgttctggttcgtaaacggtgtccttttgtttcctcacatggtgaaaggaacaaaccagatccctggagctccctcacccttttttttgttttgtttttttgagatggagtctcgctctgtcacccaggctggagtacagtggcatgatctcggctcactgtaacctctgcctcacgggttcaagcaattctcctgtctcggccccctgagtagctgggactacaggtgcacaccaccacacccagctaatttttgtatttttagtagagacagggtttcaccatatttgtcaggcttgtcttgaactcctgacttcaggtgatccacccaccttggcctcccaaagtgctgagactacaggcgtgagccactgcacccagctggagccccttttctaaaggctcatctcattcccagccggagcctcttttctaaaggctcatctcattcctgagggctccaaggccccacccccaaatgccatcagctttggagaaaagatttcaacacaggaattttgagggggcacaaacatttgaccagtgcagattctgtgtgacaagtgattcccagcatttacattacaggattgaagcggagtggccaggttggggctgaactgagacttaaccgtatttattctcttcttgttttattttctccattttgcactgtgcaacctgccatatttttggaatgactactacagacttaaatacaaactctttgactttgaacattaaatttgcttaacatagaagtaaatactggttaggtgtgttggctcacgcctgtaatctcagaactttgggaggtcaggggcggatcacttgaggccaggagttcgagaccagcctggccaacatctctactaaaaaaatacaaaaaattaattgggcgtggtggtgtgtccctgtagtctcagctctgaaggctgaagcaagagaatcacttgaaccggggaggtggaggttgcagtgagttgagatcgtgccactgcactccagcctgcatgacagagggagaattcgtctcaaaaaaaaaaaaaaaaaaaaggagtaaataagaagatgggagtaaacagaaaatagcacccaccagcctaaactagacgtgaattatgtcattatgatgttcatttctttaatagttaagaccccttagggtaatgtgtgggcatactgtcaatacttgtaataattcctgaagaactcttaaggtgttggctgacactaaataacaatgttatgcatttctttaaaaacaaggtatgtctggggcagcatagtgttcccagagcagactggatgtggagaaaagggattcagagttccttgacaacaacagcaatgacatccattcaaccacgcagctgccagcaatgggctcaacagccacaaaacagatcagcagcagagctgtgtggcacactcagggccaggggaggcctccaggccagtgcacatatagctcagggaaacatggaaaagctggaagctggaactgggcagagggaacctgtgggttctgtctctgtggcattagtttagggagaagccagcctggtggtggtcaggtgtggcattagtttagggggcagccggtctggtggtggtcaggtgtggcattagtttagggggcagccggcctggtggtggtcaggtgtggcattagtttagggggcagccggcctggtggtggtcaggtgtggcattagtttagggggcagccggcctggtggtggtcaggtgtggcattagtttagggagcagccggtctggtggtggtcaggtgtggcattagtttagggggcagccggtctggtggtggtcaggtgtggcattagtttagggggcagccggcctggtgttggtcaggtgtggcatgagtttagggggcagccggtctggtggtggtcaggtgtggcattagtttagggggcagccggcctggtggtggtcaggtgtggcattagtttagggagcagccggtctggtggtggtcaggtgtggcattagtttagggggcagccggtctggtggtggtcaggtgtggcattagtttagggggcagccggcctggtgttggtcaggtgtggcatgagtttagggggcagccccagcctggtggtggtcaggtgtggcattagtttagggggcagccggcctggtgttggtcaggtgtggcattagtttacggggcagccggtctggtggtggtcaggtgtggcatgagtttagggggcagccggcctggtggtggtcaggtgtggcatgagtttagggggcagccggcctggtgttggtcaggtgtggcattagtttacggggcagccggtctggtggtggtcaggtgtggcatgagtttagggggcagccggcctggtggtggtcaggtgtggcatgagtttagggggcagccggcctggtggtgtcagattgacactttcaagtacttctggttttcaggagcttcgcgggaccatgtgcctgctggaagctgagcaagaactctccaaatgttgatgcaaagcccctaagcgtgtgagcttgccaaaaaacttaaaacctgcagcgtgcgatgtcttgaaatatggccaaatatggagacttcatttttagaatgcatgtgattcgttcttgctttctataaaaatgctttaggcgtcgtcatactgaatcaagtagacttcatttaatgaaataattatttaagagtttttttaatgttcataaatgtctggcagctgcttattatcatctaaaaactcctcttggttgtcagattatttgaacaaactgtcagacacattataagtcacaagcatctaatgctagtttgggaaacgaactcatatttttttaatagaccttctaccaactttacaaaggtagctttctacaaattaaaaaaaagttgttacatggttataaaacttaaaatttatagaagtaaattggaatgggaatcatgtttctataaaacttaaagtttatagaagtgaaattgaaatcatatttctataaaagttagaatttatagaagtaaattggaattgaaatcatgtttctataaaacaacacttatagaagtaaattggaatgggaatcacattgctagcctaatatttaatgagacaatatggaggaaggctgtctccaatgtgctaattacttttcgggagtgtgttcaggaaggggcacaggcctgcaggccagggatctgagccacagacagcagaaagctgtcagagaagggagcacacaggcaatgctcgtggaactagaaaagcacaaaccaccaaatagaactacctatgaaagacagcaccatgcaatcatagttatactacagaattattacaacatttatactacagaattagtacatttccttatgggttctgagtaccagcagggtgtcactgactctggcaagagcagaaaccttcagattgaggcaaagccaaaggtttgagtgagaatgaacttaatacactaaatggaaggctattctttggttaaaaatgttgtaatgtgggagaataataaattatacatattctatattgttaatataatatataattaatataatactataagtaatataatacatattatatatgtatgcatgtgtgtattaaaagtcagcctcttgaatgccttcatatcggaattgcttctatttgcgtctttttcagattattttttctttatacattaactcctcaaaatttattatatgagaaaatgatgtagttaagggccttctgaataggaaagaaaagtgacatattttcatctaatatattaaaatggaatattgcaatagggattttgtaatcattcattattactttttttctgaattatttccagaatttctagctttatttttctctatcaatggtcatttttggaagcgtagcctactccatctggaatcaaacataacttatagtaatatgattagtttaaaacttgaactttggttccttgtccccacttaacagaaccaagtgtctctgtcttgacatttccaccttggtgtcctgtgtctaccggtccctgtgtggtcctgccggtgactccaccatgatccttggagcagcctctccttccctatttccctagttctctacccttgccatcctgcttctctcaatcttcagtttcactcagttctctttttcctgcgcccttcatgcttcctaaggcctcacgggcatctttctagaggatcgtggagctcctcctcctccctgaggcctcacgggcgtctttctagaggatctctgagctcctcctccttcctgaggcctcacgggcgtctttctagaggatctccaagctcctcctccttcctgaggcctcacgaggggcatctttctagaggatcgcggagctcctcctccttcctgaggcttcacgggcatctttctagaggatcgctgagctcctcctccttcctgaggcctcacgggcatctttctagaggatggccgagctcctcctccttcctgaggcctcacgggcatctttctagaggatctccgagctcctcctccttcctgaggcctcacgggcatctttctagaggatctccgagctcctcctccttcctgaggcctcacgggcatctttctagaggatctccgagctcctcctccttcctgaggcctcacgggcatctttctagaggatggccgagctcctcctccttcctgaggcctcacgggcatctttctagaggatcgccgagctcctcctccttcctgaggcctcacgggcgtctttctagaggatctccgagctcctcctccttcctgaggcctcacgggcatctttctagaggatggccgagctcctcctccttcctgaggcctcacgggcatctttctagaggatctccgagctcctcctccttcctgaggcctcacgggcatctttctagaggatctccgagctcctcctccttcctgaggcctcacgggcatctttctagaggatggccgagctcctcctccttcctgaggcctcacgggcatctttctagaggatctccgagctcctcctccttcctgaggcctcacgggcatctttctagaggatcgctgagctcctcctccttcctgaggcctcacgggcatctttctagaggatggccgagctcctcctccttcctgaggcctcacgggcatctttctagaggatctccgagctcctcctccttcctgaggcctcacgggcatctttctagaggatctccgagctcctcctccttcctgaggcctcacgggcatctttctagaggatctccgagctcctcctccttcctgaggcctcacgaggggcatctttctagaggatcgccgagctcctcctccttcctgaggcctcacgaggggcatctttctagaggatcgcggagctcctcctccttcctgaggcctcacgggcatctttctagaggatctccgagctcctcctccttcctgaggcctcacgggcatctttctagaggatctccgagctcctcctccttcctgaggcctcgcgggcatctttctagaggatctctgagctcctcctccttcctgaggcctcgcgggcatctttctagaggatctccgagctcctcctccttcctgaggcctcacgagcatctttctagaggatggccgagctcctcctccttcctgaggcctcacgggcatctttctagaggatctccgagctcctcctccttcctgaggcctcacgggcatctttctagaggatctccgagctcctcctccttcctgaggcctcacgggcatctttctagaggatcgccgagctcctcctccttcctgaggcctcacgaggggcatctttctagaggatctccgagctcctcctccttcctgaggcctcacgggcatctttctagaggattgccgagctcctcctccttcctgaggcctcacgaggggcatctttctagaggatctccgagctcctcctccttcctgaggcctcacgggcatctttctagaggatcgccgagctcctcctccttcctgaggcctcacgagcatctttctagaggatggccgagctcctcctccttcctgaggcctcacgggcatctttctagaggatggccgagctcctccttcctaaggcctcacaaggggcatctttctagaggatcgccgagctcctcctccttcctgaggcctcacgaggggcatctttctagaggatctccgagctcctcctccttcctgaggcctcacgggcatctttctagaggatcgccgagctcctcctccttgggttccttcctggagtcacggccccatgcgcctccccaagacggaaatctcccgtgctgtggtgacacaggacctgtcatgtgcgaattcacccctccttgttccctctaccagcgtgattaagtcctttatagaataaggacttgtctcctgccagagagaaccacccccgtcagctctgcctgcagaacgctgcgttctggggtgccccaggagggagtgacagtcacaggtggaaattgtgttctgtggccttctcttcccaggggccgtcatcagtttgtttaaagatcttctgcctccactgtggcccttactaaaagaaaatggaattgcatttctccaatgagtctgaatttcccacatgcagccaggtttatcaggtaaaattgcatgggttaacagccctcatcaaccacgatgtttatataaacatacacgaagtttcttctgactctgctctaatatctttaatattttatatcatgctcatcaaattttaagaggttgatttaatccatcttattttgcttatgataagctttcaaatatcacataaaatcctcaagagagacgtttcaagaatttttgagaacaatttctatagatgcagtatgttcctggataaagcacagaaagtatgtcgtgtctggatcatcaaaccataaattctgtgcactaataaaatttctgaagaagcgctgcggcggtgctgagtcttcctgggtgctgctggagaggcatgaacaagcgccacgtgaacacggcagtgatgagtttcctgggtgctgctggagaggcatgaacaagcgccacgtgaacacggcagtgatgagtttcctgggtgctgctggagaggaatgaacaggtgccatgtgaacacggcagtgatgagtttcctgggtgctgctggagaggcatgaacaagcgccacgtgaacacggcagtgatgagtttcctgggtgctgctggagaggaatgaacaggtgccatgtgaacacggcagtgatgagtttcctgggtgctgctggagaggaatgaacaggtgccatgtgaacacggcagtgatgagtttcctgggtgctgctggagaggaatgaacaggtgccatgtgaacacggcagtgatgagtttccagggtgctgctggaggggcatgagcaagcgccacgtgaacacggcagtgctaagtcttccagggtgctgctggagaggaatgaacaggtgccatgtgaacacggcagtgctgagtttcccgggtgctgctggagaggcagtttccgccatcctcagctgctgctctccggaggcgcagttccattgagtgatgcaccaagtgctctgaggatttctgcaaagcaacaacctccagaaacatttcgcacaacccctgctgttttctgtttcttccatgacctaaagtaacttactgagcaattcagaaagaaatgcaaatcatcgtcctttttatttgttaccagtttcctcgttatcgttgaggcaaaagcctctttactataacccagaggtaggttttgttttatgcacctgtgcatttgctgagcaaaacctggagcccacacagaacttataagacacaatcatatgaaatttcagtcattgacaaatttctttctgcttcttctcttgttcattaaaccgattttgagcacctactgtgagatttgaatgatccatgagttctgagcttattctaaaaaatgttgataagagcattgtcatcgtgaagacacgatgacttcactttaatgtttatcatccactctttcaagtggctgagtacagcgtatgaggttgccaggggagaatgattgttagtcactttggaatagaaatataggggagagtctaaaaggtaacatttgtttttacattcttgcagtgaagacacaaaacgtatgcttttacaaaatctaatagcaacatttggtaatatagtcagtaatggactaatcataaaattacgaatctgattatcctcagatgttaaacagagttgctagatatgctaaaatcagggtggtttccattaataccatcacaattatttattatctcaaaagaaatttattgagtgcctattacaagccaggcatccttttagcattggaaaaattatgcaatagctaacatttgtggaactgtgtcaatatgccacactgcacctataatcgcttttaatccccagaacaatcctttctgctgggctgtgatgtggacgcaccacaccagctatggcagtgctgagcagctcttatcagcttcctactgtgttccacctgtctgatatcacctttagggtcataaaagctctataaactatacactgtagttaatcagcttcaaagcaggcttaaagcaccatttgtggaaaatcacttccaactggagagattcgtgacgtcccagcccaagcttccttcaggctgagcagagaggctgcccctgctgctccacctgcgtgttcctgctgcagccaacaacaggtcacatggtctttcattcctagatgctaccgctctccccccaggtgagggccagtcaggaggcggttgccagcacgcacttattctcaggtattcctggcttaactatttggggcagaagatggatgtcagacatacatgtctaaacaaaggagaaactgagtttattaacaaaaagagaccaacctttgcacatggcaatatgaggtcctagaatttttaagtcattgttttatttgcatgtgagtgagtgtcagtattcatgtagcacaatgcctggtgcacaggctgagtatgaatacctctcattattattctttaccagttttcagtaacaaagcttgttttggaaagagtgcagtggaaattttcacgatttggggctgaacaacttttagatagcgtgcacctgttctgcttagatttcacctaagtcagaccttggggagaccccaggtgagaaagtggattttcttacaagtctccccctcgtttgggggtgggggatggacgatgaaccgcatgttgagaatgaggagagaggggtcacacagggagcctcggagtctaaacacgaccttgccctggggcccgctctgaggaatctccagcctcaatgacacgtggctcggagcagggagtggagaagacttccagccacagggctggttctgcctcgtcacattcaggagtcctgtgggcatcagatctgctcctggatcccctctcccaggcgactgcccatgctgacttgtgagctgtgctgcgtgttgagcaggaatgtccatcactgtgggtatgctgttgagagatccgtgatcacagcagcatgcgaggctgcgggaactggagccatgtgaggttctgcctctcctgctgtgccccccacgctggcaggccctcctgctccggggtgaaggaggaccacatcgttcttggcagttctctgtggcctcccaagagctctgcatgtgggacgacgtcgctggatcctgctcaccttttgccttcttcttccccgcagtgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaaggtaaatagggtgcacccaccccccccgggaccatgggaggctttggggtgtggaagccaggaaagcagaacccccacttcccccaacacacaccgacacacagtcacacacacactcacactcacacacactgataccacacacatacccacacacacccacgctctcacacacacccacacacactcataccacacacacactcatacccacacacacccatggtctctctcacacacacccacacacatacccacacacacccacgctctcacacacccacacacacacataccacacacacacccccacactgtttcacacacactcatacccacacacaaccactcacacgcacacaatcataccacacacacccacactcacacacacactgacacacacacattcataccccccacacccacactcacacacacattcgtacccccacacacccactcacacccacacacaatcataccccacacacccactgacactcacacacacactcatacccccacacacccactcacacacactcatacccccatacacacccacactcataccacacacacccacacatacccccacacacccacacacactcataccacacacacccacacccacacacactcatacccacactcacacactcccctacacactctcacactctcacacacacacccacagtcacacacaaccactaatactctcacacactcatacccacactcatacaatcccccaaacacccccccacacacaaacatacccacagtcacacattcaccccacacacacacacacacgccccccacacccacagtcacacacagtcttatacacacaatcacccacactaactcccccgacacatccccacactcccacactcacacactcccctctcatacacacccacactcacacatccacactcacacacacatactctccccacacacacactcacacacagtctgtccatcagctgtgggtgttgcacctcttcacctggatggtctggttctccaagtggcgatcacccaacgctgggtgatgctctgctcttgtgcatgagctgcctataaaagccagtggcttggtcaggcgcggtggttcacgcctgtaatcccagaaccgtgggaggccgaggcgggtggatcacctgaggtcaagagtttgagaccagcctggacaatatagtgaaaccctgtcactagtaaaaatacaaaaaattagctgggcgtggtggtggatgcctgtaatcccagctactcaggaggctgaggcaggagaattgcttgaatccgggaggcggaggttgcagtgagccaagatcacaccattgcactccagcctgggtgacaagagcgaaactctgcctcaaaaaaaaaaaaaacaaaaaaaaaaacaaaaaaaaaaacagtagtttcaactgttggaaactggaggaaaccatttctttgatggcctccaaaagcacccgagtggcagctgggaagcagcagtagcttcgccttcacaggcagcgctggctcttctgccccactcacgccggacggaatctgaaaggtggctctgggacccagtgccagggtggaaacgtggacggcatcaaataccagtggcagcttccttctgctcctggttttgggaaagggagctcagcatttcataaagtgaaagaaccgattgtccaagatggctttttatggtattcacatatgtgtgccccaaatttatcgcttttagaaaaagtgaggctgtgctaaagacaagggcaatgaaagttattcgagggcctgaaatacaaaaacaacttgttcactggagttttgtgtgagttggagcaacgtgagggttttcacagtagctcctgaagaacaagagctgtgtgttcatggaaattgtataaccgtgagtagaaatggttttgcagctctttgtaacatgaatttgacttcgatgtgtcctagatttatataaaaatagttttaaagtatatgaaaatatgatctcttaaatgttatcaaatgtagccgctgatgtcacctttaatgcttaggcatgagcatttggacgcttcctaaactgttttccaaatttgtcaccaagtgtcaccagtagacatttgtgggggaaactgtgtagtttccaggggctcaagccgactaatgcctgtttcaccaagatcgggtccacccatcaccgtctggcccgctgggagtcctgctttggggagtgtgatgacgctggagcgtgagtgctgccccttcctggccagcgctccaccgtccggccgccctggctgaccgcctgctctcgacaccccactcagccgacactgcacaggggtgctgaggccagcggctgaggcttggcttctgcggggctgatatgggggattggttcaaacccgtgtgctccgcagggcttgaagagaacataaagcttttcaaggttttggtatgagaattattatttttttagtttctgtgcctaggtatagagggagtactgttttctaagaaaccgttcttggaagcaatgtttctgcgtatcttagagctctggctggtttacagtgcatataagttggggcagccccagcccccagtgaggcccctgtagcagaggtagagaccgctggcagatgctgttttacacacgccaatgaaaatctttaagctgtcaaacccagagctcctcaaactggctctgaaattatgagatcagcatttactacgctgtgcctgaagaacctgccaacgtccactattgtgataggctagaaacacagtaacccctctcttcccgtccatcgatgctggtttcattctgcctgggcttcattccgctgtcatggcagaaagaaaagtctctggctctcctgtttcctatttctgcctacagaagcgggcagctccgtctttttggagtttcagaaagaacatgaaagtaaacaaatggagacagctcctttgattctgcatgtaattttacctttattattattcattcattcagcacaaatactgattatcaacaacattcaaaccctctttcagggactgaggaaatagcattgaataagagaggagaggccccacctctcctgcggtttacactcttccaggggggtgtcggacccagaactgctgtcccttgctgccaacagaaagccctcaaacttacctagtctcaaaatgtacttctcactcgactctctggagacagggaagttctggatgatttcagcggttcaaagacataattgttataagtcgttggtgggggcagttgttgttgttttggtctgttctgccgtcttcttcttcctggtgtgctttgcggcttgttcatgttatagctgttagggcatcacagtgataatgtattttcgagaaagagtttttctttttgtcagcagagaaaatccttccccacccacctgcggtggtttcccctcacactaattggccggaatatcactgaacgcccagacccagacctgccttggactggggagaaaaggggaagggacctgttgtggttcctttttcagcacccagggcaggactaggattagccccttggcacccacagccacgtggagcagggtctgtggctaagacagtcttggttttgttacaaaagtggaaggggaggcagcctgcagggtctggttcctcgtgcaaacagttagacaggtggtagacacaaagatggtagaggtggtggggcaagaccagggctgggcccagtgagggcaggtcagggtgccggcacaggcctctctagggccgagatgctggaggcagttgtagccacagtggctggggagggttgtttcaggcagagggcaggtcctgggagagatgagtgtggtgtgtttgaatggggagtgacagggtttggctgtgtccccacccaaatctcatcttgaatggtaatttccataatccccacatgtcgtgggagggacctaccctgtgggaagtgattggatcatgggggtggtttcctccttgctgttctcgtgatagtgagtgagttatcatgagatccgatggttttatacgtgtctgacatttcccctgcttgcactcactccatcctgccgccctgtgaaagggtgcctgcgtctcctttgctttctgccatgactgtaattttcctgaggcctccccaaccatgccaaactgtgagtcaattaaaccttttttttttttttttttttttttagaaattaccgagtctcaggtatttcttcacagcagcatgagaacagattaatactgggggtgtcataggggtggggcagatggggagcagctggtggaagccagagaacagagcgggtccactcacaatggggttggaacatctgtcacgtctcagctcccctgggaagctgctgggacagtttagcagaggagtgatacaatctctcaacaatcctgaaaaacactcacatttattcatttaccttttattcagtaaacatgtgaatgccctcaatgttccaggcattgtattgggagctggggatacaccagtgaacaaaacaggtacagtccatgcttccacggagcctgcatgataatgggaagatgcagatataagccaaacacatcacacttagcagacatgggtaaacatgtggtataatgtcaaatgctctggaggaaaaaaaaaaaaaccagtaatccacaagagggacttgggatggggcacagcttgaaggaaatggcaggggcgactccctgaaatgccgacatcagagtcaagacctcaagaagcaaggaagcctgcagaagtccagcctggtcagaggtggtgaatgccactgagggcccagccccagaacccagtgcagtttttatcaaaaggtggggtgtatcagttaggaagcttttggtttcatgtagtgagatgagaaactgatgaatgaatataaatgaccagagatggcatgatctccctaagaggcacagcagtggagcaggctcagcctccattgaggctgtcatctggcaatgttgccgaggacattccctctcccaaagccgccctgacaccctcattctgttttcttggccattaggcaggttcccctcttggtcacaggatggctgcaacagatccggacatctcatccagatgccacagtgctcagaggacacaggagcccatctctttgtttctttggagccaaaaatcccttccctagaattctgctagcaaatttaattcatggatcattggtcagaattagatcatatgtccatggctaaacccactgctggcaagaaaaattgagttggtttacactggtttgaattgatcacctagggagacatgggtactgggcaccaggcaaaataatcaatattaggcagtatctgataagccacagccagcttcaccattcctcatctcccagtgattctgccattattgagtaaccaggtcgcatttctatttaaatgccctctgttccctcagcgcaattttcttattaattttctgaaataagcagccccagggagatacttcatagttttgatttatacctgggttggcaattaagatgtttgttttctttaatcatcctctaaatttcctgatggggaagaaacatttaataatccagtaacagtaagaagctataaacataaattgcatcgtctttgatatgtgacctctcttatcctcatgtcaccatgcatgagaattaaaaggcgttagttttgtggcagactcatcccaaggaccacaagtacatgccactctgcccagatgaggcaggagcagcttgctctggtgcagtttctagttggacccatcacttagaaggagatatgaggaggggcagaggcttcagcccttcctagtgcccctgacttttgtgtcaaaattggcatcttcgtcattgtttgcagatcccggaaggaggggtccaggcacctgtcatgagtgcaggcccccatgaatggtagagtccaggtgggagccgaggggcaagtttcccctcagccactaacagtagtgaggagagaatgggaaggggccatcagactgagctgagtcaggctgatggccagattctgcattcatgcccagaacagagaggctgatgaagcctttgtctgtctgccatccaactgctggctgttcctacctcacatctgggcagcctctgttcctggaccccagagcatgtctctcaatgaggtgtgtagcctctgttccccaaccccagagcgtgtctttcagtggggtgtgcaggggatcatgtgggcataggactgcatttctccctggcagagaacctggtatctgatgggcaatgagagaagagacgtttgtgtttttccttatacaaataagttaaaataaacctattgaaaagaatggtgatggatgacaaagctgaaattaacggacttatttctcctctttctcctctcttgagattgtcaattctgcaagtcatgggcatttcacactactcattaaaacaagcagaatactgtcatgtaaatatatatttttatattagcatcagtgataggatttgcaacatacctctatcccaaatgtggaacaaaaccgaaatgcccgtccaggtggctggcttcctgattgcttcgaagctaggagatttggaatgagggtaagaaatgatctagtctcgtgccacccatgtgaaggatacaggtactgatcctgaagggcttcaggggcacaacagagttcatgttaacacttcctttttctaacactacagagcagtccagggctctaaggaggtgtgccctctgatactcggagaagcaagatggcccctaagggctggaactctatcctcagagtctacgtcatccattctgagctgggacattcgcctggcttttggcagctcccccttcataagccctcgggcaggaagggtccattctaatgtaggtctcaattcggcccctgagacactgacccggagcttgaagtgaagatcgttcagccctcagagtgccctagttctacaaatttaacacgcataagtaaaaataagagcttcctaatccctcaggaagccagcttcctgtacacatcatctctgggtgaatgttttacttctcacctgctggccgcagcagcagctgcattaggagacacctggctgggtaacaggtcctttactgagttcgcctttcttgtgacctcttggagctgacccccacccccacattttcaaagaatatgagttaatggctttcagttagaatgtgatagcttaactgtttgccagagtgtgtcagagactttaatttcaaaaacaatatttcaaaaagatatattaagtttgtctgactggggtggcaggttttctggtatcaaagaggctattgagggccaagggtggcaggaatgtgtggttcctgactcttatgacagctggatggggtcctctcactgggactgctggactctctggggcctctgttagaacactttaaatatgtccctttagagagaaatttcattttattttctatggctgaaaagcatgtaagcaatgaaaaaaatagaacctaaagtgatctctgtgaagtaaataggatcttgtagccctttctttaagaatgaaaaaagaaaatagggcagagggagaggatgagaactggcggaacgctggcctcctgacaacctcagggctccgggccggaccccctcccgctggcctcctgcttgtcttcttcattttccaaggagtctttctggagccccaagactgcacctgtgccccatgatggtgttggcgggcactgcgtctcccagtgtgtcacttgccagggcctgaggaggccgccacgaaggattccacgtgcctgacactcatggatgggaggggcagggggctggggagccgccatgcagcatgaggtcagctgagtggaggggaagcgaggaaagttggtgtgggctgtctggggtcctgcgagtccacagaaaggggcggtgggtgtgctgacccaggaatctcccatctcccgggaacgcacctccccggcgtctccttcatgctggtgagaagccccacttcttggtgaaagccacagtgaaggatttctgtgtgcggaagattgtcctccttgggggtgggggctccgggaggcaggttctcatggtggcccgcactctgtttaaatgtccacctcctctactggatgaggctggtggtctgcgtggcaggggtctcctccttgccctacacccaggacaaggataaaacccaggcaaagcaggccttggtcaagggctgctgaatggcatgcatatggcagtgtttatgagctgtttaccggatttgaatctgacacccttagggacaggcaccctggttcccactgccaattcagtagtaccacagagccacttgctcccatgagctctgcaaccgcagcagccagggcacctgccctcttggatgtcagccctgtctgttcaggacttaacctgcagtttgtcattgatgctaagtgggaccagagagtcgtttttttttttttaacactgaggcagactttcgtagcttcacgaggtggattggaaatgagttggcctttggtgctacaggaatctaaatcctgaagtcctttgcatcctttccttgggcggggtgggggtagtggtcacaccctctgtcctcgtgcacacactcctgctctgacgaaacaacccaagtgcttcctccatccaaccctgcaacgggaggagggggaggtgtgggcgctgctccatccaaccctgcaacgggaggagggggaggtgtgggtgcttggcagctgctagatgagattcatttcagagacgggatggagagacggccctgctgtgtgattgaagtcacagtgtgcttcttcctactgactgcaagcaatagctttctatgccaaatatccacaaaggtgacagaaaggagtgaggaggtcatgggtgtcatagcatcagagccacaggtcacggtgtatgctagggtaggacactccagaaatggaagacaaaccacagctggtctcaagcccgttgttttctctctccttcccccgccttccccccgcccataggtacgagcagccgaaatgtgacaacacggccagggcccacccagccaaagcccgggacctgtacaagggccgccagctacaaggtgagcagcacccgcgagtgtggcccgaatccacaggccccaccatgcagtttcttgcaaatttggaatgaaaaagactttatctgactctgtttcccagggggcctgtctgactctgaggcctcctacctccttgcagagggccctgagtccaggcagggagacagggggccaggagcccacacggggagcacctggggggcttcctccctgctgctgtgtatggaaggtcagacatggaagagaaagaaagggcccctcacaaatcagatcagcacacagcaccctaacctctctagatgctcctgaaccccacagcccaaagaaccctttattcattctacctacatttcactgtcactttctgacattcctttttcactgaatcaacagttcatgaagctaaagtttaggttttaagaaaacatgagttgaatgtatgtattgagtttaattacaaagaaatattgtaattaaacagaggtgaattaaaatttataataattgaaaaatgcagtcacaaaaagacgtcatggggtgaatttgatatatcattaagaagcttcaaagctacttgccatttgtttcattttgatctttttttctctaaatatctccagattgtgtatgtttaaccaacatctcagagacatgaaaatcacactacagcgtactttgtttagagtacgtgcttgatcttgtctcatacagaaactggatgaattccggatgagtaaacttttgtgcttcctgtactatttgtactgtcattggtagaaaggttttaaattgtaaaaagtaaagatgttcggcttataaatgaggacagggtagagcagaatgtccacagtctatacatgtttcattgctacgtgttcatagcgattccacaacatgagtaacgagaatggttgacacagggaagcagagggcggaatgtggttccggggacacacagcacagttattctgccagctcttggtaaacaccgtgcagctcactgggctggcttgttaggaactgtctttgtcttagttcttcatggtttcccagccgtgtacctcctcagtgtcttccttgtgaggcaggtttgaggaatctgttggttctagtaatttttttttaatgagagtatggtccttgtgtgagcaatcaacttgctttctgttgaatgaatcagcttctttctggatctcgcaggtgagggtgggggaagagatcacgatggtgcaaacacacccgtccctgtgcatgcctagtgaagggtgttttgcctttgaccccgtgtctgcaggctgtgctcagctgctggctgaattccatccccctgatggccctgtcaggagggagttctcctcctccattatctggtgtcatctcttgtctctgaagtccgattttaatattggtgggcaagatgtttccttaaaagacataatgagcttctcacatgcttgctgcatggaaagccctcaataaatgtttcctggttttggttggtcttgaccttgtcacgtgcacttcaatctgtcttttgcccctagtgtacttcttgaagagtccaagattcttaacttattttttttttcgatagcacaaagttgcatcacttctaagccaagctgcactgtggtcttcacacaggtgatacgagtgcaatttatggaagtcagtttcgcttctcattggtaaaagggaccgtgacagaggctggcttctgctgcctctcaggagtgcacgtggcaggaagaccttttcctggtggaatctaatctgttacactctagacccagactattgatttaaagatgacacagtcatttgtccagtgagaacaactggtccttgatattgagaaacatgatgtcattgtcttctctgagtgtcagaggtgccatttggagatacagcatcccacactgtgaggatgggcacgtcagaaaccatgctcctctctgctaaaacaggaggagaaggatggttagatgctcacaatgaagacggcgtttccttgcccacacctcagacgaaaaccagattgctgaggcatcaaagccacgtgacgcaaactgtgcaaaggtcagcttgtgctgttgccatagatgtttgggagtgcactgttcatgaccacttaattattttgattatttggagataattatccttattaggaaaaaacaagtaggtcttaaaatagctgcaggatagaggctgttcctggtagagaggagaaacctatttccaaaataacacagcagcctttgagtaggaagatccttcaggtcccatgcaggctgatgtattttattcttaaaaggtaccgtttccttttgaagttgcttttctaaggttttgccaatgtaggtcctctattttccatgtaaagctgataatattttcacacaaaattcacttgtttggggtgagcagttgatttgtcaccaaatacttattcacatcttatgtaggacagttagcaggtgtttggcagcaaacgatcattgagtctttggaggccatcattttattatatggcacaagagatctaggtctggcttaaggggctacatagtgacgactgggtcaccgttttggcttttgaaggttcttctttcattgtgtaggtttcctcctgggactatcacatcctgtgtagcagaaattctaaaaagaggcacaaaaccacaccttcttaaaccacaccttcctaaaccagatcttcttaaaccagcccttcctaaaccacaccttcttcttggacaggttcacctcactttattttgccctggcatctctgatcacactctggttggtgttttaaataacagggttactctgtctctccagcctccccagccccctgacatcctcccaggtcctcatgtgaggctggagaaccaggcacttgcattgagctgtggctcctgtgtcggggccgtggtgtgtctgttgggccctatgtggctcccgtgtcgggcctggctgtggctcccatgtctggccctgctctggttcccatgtccgggacccaccgtggctcccgtgtcgggcctggctgtggctcccatgtctggccctgctctggttcccatgtccgggacccaccgtggctcccgtgtcgggcctggccgtggctcccatgtctggccctgctctggttctcatgtccgggacccaccgtggctcccgtgtcgggcctggccgtggctcccatgtctggccctgcactggttctcatgtccgggacccaccgtggctcccgtgtcgggcctggccgtggctcccatgtctggccctgctctggttcccatgtccgggacccactgtggctcccgtgtcgggcctggccgtggctcccatgtctggccctgctctggttcccatgtccgggacccaccgtggctcccgtgtcgggcctggctgtggctcccatgtctggccctgctctggttcccatgtccgggacccaccgtggctcccgtgtcgggcctggctgtggctcccatgtcaggccctgatgtggctcccgtgtctgagccttgctggaattcttccctctgcttgagctgcatctctcttagctcctgtgcctcccacacatccttcaggacggcttcctcaggatgcccaggcggccggccactcacatgcacctgtccagcttgttcccacctggtggggcacagcgtgtggtgtgggtgtggactctgccccgtgcctcacagggtccctggggaggtggagactgcacctccatgttcccggcatccgcgaggtggaacgaaggatgtaggcagttttcttttcctactagaagactttttggctaagtgatactggtaagctttgacttactagccatgtggttttgcttatctagggccccgcagcactggtcttgaatgggctttccagtgtggggagagggtgaccccagcctttacctgaagagcagtgctgggttcgtgatctccatcggggagagggtgactgcagcctttactcaaacagcagcgctgggttcgtgatctccatcaggggagagggtgaccccagcctttactcaaacagcagcgctgggttcgtgatctccatcaggggagagggtgaccccaacctttactcaaacagcagcactgggttcgtgatctccatcaggggagagggtgaccccagcctttacctgaagagcagtgctgggttcgtgatctccatcggggagagggtgaccgcagcctttactcaaacagcagtgctgggttcatgatctccatcggggagagggtgaccccagcctttactcaaacagcagcgctgggttcgtgatctccatcaggggagagggtgaccccagcctttactcaaacagcagcactgggttcgtgatctccatcagtcctcagggccccttctgctgagtgagaggggaaaaagccagaacagtcccttgcttgcctcagctgcggcaccggctccatttgtgattcaggctcgtaggccctcggcgcggcaatgcaagaggccatcggcacaaccttgtcagagaggagatgcaggcgaaagacagaggtgcagggagatgcacctgtccagagcagagcaggcccagtcgccggcaggttcagggcaggagcatcggccaaggagagttggctcgaaaacttacaatggagactttgatctaaagtgaagtcaaaataagtgatttcatggcctagagtgcagggtttcctctcacctttcctgatcatgcaattgtgtctttcactctcggatacggttttccggctgactctcattctcaggaccaatcgtattcgaatgagcagactggctttcctctgggcgttgcttcatttcagtctacactggcagggaacgctcacattttcgtcattgtgacgatctgcgctgcgtgcagtctgatctcactctcaggcactgtggtccaggccaccccaaaggcagcacaggagctgggccctgggggtcaggaaggtgcaggggaagtctgacgtatcctgtgagccattccttcctccaccagctcaggtgaaaacagcactgtctttctgtgggtgtcctgatgttggtggttcagcagtggcaccagtgtgaggacagagggggcggcatgaggagccccttggggagcctgggcatggcccctctgttactgccctgtaccccaagccagggtcctctcctggatccccagagctcttccgcctggcacacagtctaagaaatggtctttattttggtcaaacagcctctcacccaagtgtttctggaagctctatggacccagcagacttcatgaatggtcaaggcctctccctaaagggcatggcacagtgcctcttcacatctacagccagcacagggggcctcttcacacctacagccagcacatggagcctcttcacacctacagccagcacagggcctcttcacacctacagccagcacagggcctcttcacacctacagccagcacagggggcctcttcacacctacagccagcacagggcctcttcacacctacagccagcacagggcctcttctcctagagccagcacaggacctcttcacacctacagccagcacagggggcctcttcacacctacagccagcacaggacctcttcacacctacagccagcacagggggcctcttcacacctacagccagcacagggcctcttcacacctacagccagcacagggggcctcttcacacctacagccagcacagggcctcttcacacctacagccagcacagggggcctcttcacacctacagccagcagggggcctcttcacacctacagccagcacagggcctcttcatacctacagccagcacatggagcctcttcacacctacagccagcacagggggcctcttcacacctacagccagcacagggggcctcttcacacctacagccagcacagagcctcttcacacctacagccagcacatggagcctcttcacacctacagccagcacagggcctctttatacctacagccagcacagggcctcttcacacctacagccagcacagggcctcttcatacctacagccagcacaggacctcttcatacctacagccagcacagggcctcttcatacctacagccagcacagggcctctttatacctacagccagcacagggcctcttcacacctacagccagcacatggagcctcttcacacctacagccagcacagggcctcttcacacctacagccagcacagggcctcttcacacctacagccagcacagggcctcttcatacctacagccagcacagggggcctcttcacacctacagccagcacagggggcctcttcacacctacagccagcacagggcctcttcacacctacagccagcacagggcctcttcacacctacagccagcacagggcctcttcacacctacagccagcacatggagcctcttcacacctacagccagcacagggcctcttcacacctacagccagcacagggcctcttcacacctacagccagcacagggcctcttcatacctacagccagcacagggcctcttcacacctacagccagcacagggcctcttcacacctacagccagcacaggggacctcttcacacctacagccagcacagggggcctcttcacacctacagccagcacagtacctcttcacacctacagccagcacagggcctcttcacacctacagccagcacagggcctcttcatacctacagccagcacagggcctcttcacatctacagccagcacagggcctcttcatacttacagccggcacagggcctcttcacacctacagccagcacagggggcctctttacatctacagccagcacagggggcctcttcacacctacagccagcacagggcctcttcacacctacagccagcacagggcctctttatacctacagccagcacggggcctcttcacacctacagccagcacggggccttttcacacctacagccagcatggggcctcttcacacctacagccagcacggggcctcttcacacctacagccagcacagggcctcttcacacctacagccagcacagggggcctcttcacacctacagccagcacagggcctcttcacacctacagccagcacagggggcctcttcacacctacagccagcacagggcctcttcacacctacagccagcacacggcctcttcacacctacagccagcacagggtctcttcatcttcatacttacagccggcacagggcctctttacatctacagccagcacagggcctcttcatacctacagccagcacagggggcctcttcacacctacagccagcacagggcctcttcatacctacagccagcacagggggcctcttcacacctacagccagcacagggcctcttcacacctacagccagcacagggggcctcttcatacctacagccagcacagggtctcttcacatctacagccaggagcatcttttttcttggggccccaagcaattgctggcataattatcgtctttgactcatgtagaaaccttagaggcaacacctggatttttcagacacgattttagcactattctaattttttgaagattagttatggttttctgagagagcataaaatgaaccttaccttgccctaagtggagcttaggacattttccaaaaggtagttagatcaggagcaacacattcctgccaggtatcatgtgacatgtaaggacctcggtgtttaccttttctacaaagcagacaggagccggccaggacctcgcttggtggcctttgagagcctcacaaaggtgacacgaggtgtcaatattctgcccactaaaaatgtctacttctgtgatccctgctgtcatatcaaagactgaatttacagacacgagtcttctaaattttagctgagctgggaacaaagcttcaggctttagaaacatactactgtaattctggggatgtgagtagttaggtgagctatctgcactctgtgtccatacaggctcacgccagaaccagctgctcagggcacaggctcagactctccatgacccatgaggctgggacaaggactgggtgttgaggaggctgggatgcgaggctgtctgtgagagaggatttttaacctggcattctgcttttgagagctgtctggtggcatgatacctaaagaacatcaactcagcctcatgggtagggctggggagtcccagatatggcaagagaccgttccacatggcaccacttggaagagagagctgaatctacattattttattttttgaccactaagttggatgtctaaatatgaaatttgcccatgaataagattagtaacacttttgaaggaaattgcagtttttaggaagcgtaacagtgaaatggaccattaaatcagttttattgagaaaagactgctgcaaataaaaactcagaaaaaccacacatataattgccatcccagaggcatcataagacaggaagagcagggacaaggggtgccgaggagtcaagcggttgggaaaaggtggttttcaagaaccggtgtctgtggagcatcccgagatgccgctgcactgcgggggggttgcagggagctcctccagcagctgagggagcccacgcaggtgcagggacacaggtgaagtgagcgtttcactcagcgcttgccttttctcctgggaaagaaagtggacaggatgcaccctgcagagggcaccggagagatgagaactaagaaggagcgatatggctactcttgcagcaaggccagcagaattctcagtgggattttattacaatatttcttttggctgatattttgtcttcatgtttgagagtaaggagacattggaggtttgggggaatgtgggaattcatcattctcaaaaaaacaagaacaggaatagagaaattaaataaacaaaggcgttttattttcctcaacatgtagaggaaagactaacaaatgtctaattatgtacaggagggtgctgggcgctttttctgtttattaattgatacttcaacagctgagtgtgaataactgagcagggtggctgtttctcaccgacgtggctgagcaggagcttttctcacacccaaggacgggtctcccaggggcccagggcactgcattcgtggactctgaagacggggcaggaagctggagctatagtttctcccatgacctttcaagcaaaagtttaggactctgatgggccaggggcactccactcttgtcccgcactcacatccgcttggacaagtcctgtctctgctccaagctctcttgcatctcgctggctgccccactgcttcctccaggcgagtttccaaatagactgtaagtagattctgatccccatccatgcagcaagaagaggtgtctggaaaccccagatctggcctgtattgcttcccatcatcagggtctcctggctccagattaaatgtgaactgcttgttgtgaccgatggggcccctcctggccttaccccagtgcattttctgttttcttctctccgccatgcatgggactgtatctcgcctgattgcatggcctacttggagaggcgggggtcgcgtccagcgcctcgctgaggggccatgcctccagcacacaggacacaggtcatttccctgagaggcatgctgacatggattgccaggtttatggggtctgccagggataaaataatctgagatttttaacccacccatttatttcccatccaagaaaacggatctgtcctatggcgtgttattagccgcaaggctgcctgcatgggagtggcctggaccatcgccccagggcccagtgctccaacaggaccctcggtttattgctgtgctatcaccacgatgaaataattaatttttaaacgcgaggcctccgtgctccattttgcactgagccctacaaacaagccgatcatgattagtaacaacacacagcttgcaattcactgggcatccaatggcaaagagccagcgtagtggcattaagaggcgagtcaaggagaggcaggtagtggcattaagaggagagtggaggagaggcaggtagtggcattaagaggagagtggaggaaaggcgggtagtggcattaggagagtggaggagaggcgggtagtggcattaggagagtggaggagaggcgggtagtggcattaggagagtggaggagaggcgggtagtggcattaaaaggagagtcgaggagaggtgggtagtggcattaaaacgagggtcgagaggtgggtagtggcattaagaggagagttgaggagaggcaggtagtggcattaagaggcgagtcaaggagaggtggtaaaagagttaagacaaggccagggaatgacgatggaagggctaggaatgtcccgcatggggtgagcacagatgcagacaggaagacggtgcgctcaggacatcagtagcccagcttaggcgatggggaaggtgacatcgtctcctgcagggactatgggctctcgacgcagcaggcacacgggcatccggtctgggagagacagcgatggcaggaaagctggagtgcccttcagtcactactccacagactccactaaactgggaaccaatttctgaaattatgggctgcattttatttgtttattcaatataataagacaataaatatcttaatcttaaaatacccaggaatttgctagaatatcagagaaccaagtgttagatgacctatgacctgacacaaaatgaccctcagcacggatcggagaacttgagttctgagcagcgccggtgaccgcaacagcacattgttgagttattttagaagcaatgtggcttgtttttgtttatggtttcctttagagccagatttttaaagataaagtgccatttaaaaaattcccaaagacagcagggagcattctgaacgacaacaggacagtcagctctggccagtttagcctgcgttactttgaaagttatgattatgcagaagagagatggaataaagtttagatttacgttcatcatgaaaaaggcatctgccagacaaattaatagtgtaagcaatatttcagagacaatttaaataacttgagaacaaactggtctccaacactatcaaatatattaaattaatttctaaacaattgttattctattgcaaataattcctaactctattaaagcagtttatcctaaatgattaactactttaaaagccttccaagtacggtatacacttaaaaataacaagtatgcttttaactggcctacagtggttagtttagacttccctcctatcttttctgaattgattgaggctctaccataatcaaattaaaacctcctataacgcaagtctcacttacttcccgtttgccgctgactcaggcaggaaaccaccgtggtactcctgaaagcgcccttctttctcagaggctgtgcacttcaggtgagaccacagtgaggccagtccggacagaggggactctgcctggagtcggaaggtctccacagccagctgtcccttgtgtagccagtgcctgccatggttagaaagcccacagcttcagtttacacgctctgtgtcttgtggcccttttactctacgtaccagtcatggtcactgtgctccggcaggccgttgtccagctcgctctcaaggttccggacacacgggctctgtgctccctgaggttggcagtcactgccttcaggtcttcagatcccctgcaccaggttgctcaggcatgaaacacacagccctacctgcgtgtaatatttgcctgtggtctctcccctccaccaaaccaagcaattcagatgccttgagcgttctttagctatcggtatttcatctcttcactgaatcatgtttattgttttcacttggaagcgcttatcttcctgattcccctatgtctttaaacccaacgctggcagaatactaagactgcatggtgccttctctgctttaccttctcatgagaattacaaatccctttgttttctaattttgcaagcaagtatttattacatgcctgttgcataggtggtgcttgccaatgttctgggagatgcaagtcaatagagatccagctcccgtactctggagctgagacctggctgtgaggattgcaggtttatgaccctgggatgaatgctcttgaacaagaaagccaccttatttcagtttgaaatattgggaaaatggagactgatatataggaaaattttccctatgtctaaaaatattatggtagaattcttgtaaactcttttccagacttgtaccaatgtcaagaacatttcaccctcaccctagatagcaccctttgagtcagggaaccgcagacagcatgggcagcactgacactgtgcggagagaggagtgaacgtgagaaatcacttctgcaggagaaattaattccaagggggatcaagacagggaaaatccaattatccaggttggatattggccagagcactgcggttattacttctagaataaaggcaagactaatagaaatggcccagctgataggagcaattgagttatgttcttcctgataattccttaagaatttaattggacagactaaggctgcagtgcccagatgcatcagccgcgtgtcaaactccttggacaccctggatgaccaaccaaggtcgaaaacttctcaaaacctggcttgtgatgaataaccacaggctatggaaacccctaggatgttttctcagacagcatgatttactttttttcttagttctcttctaacttgtcaaattaaggacaatctttcagaaacgtcagaggtttccctctgacagagaaggataaatggactgcccattagttgttaattcgctttgagaaattcctgagataaattgttcaagtgtaaatttcagcagacacactttagtgttttgagtttctgtcctatttatgcatcttttctctacgcttttcctgatgtaatcaacttacttgaaatgtataatccccttatttccagaggagaatagtattagtcccagtgtcagatttctgattttaaaaacgtctcctaaggaacacacattatctgccatgaagtgctactttttggagcagtctttgatatgctctttaaaaatgtatttgaagtccatgttttatttacaattttgctctgttaagtagtaacccgcttgtactagtttgttttcatgctgctatgaagaaatacccaagatggggtaatttataaagttaagaggcttaactgattcacagttccacatggctggggaggcctcaggaaacttacaatcatggcagaagggaaagcaaacatgtccttcttcacatggcagcaggagagagaaggggaagtgccagatgtttataaaaccatcagatctcacgatctcacgcggactcactcgctatctggagaacagcatggggaaaaccacccccatggtccagtcacctccacctggtcctacctttgacatgtgtagattatgggattacaattcaaggtgagatctgggcggggacacagagccaaaccatatcaccactcattgcgttacacaggggtaaaattgtttattcaaaggcagcagaatagcattgttgtctttggaatttctctaatggattaatcttctttttttttttcttgagatggagtctcgctctgtggcccaggctggagagcagtggcatgatctcggctcactgcaagctccgcctcccgggttcacgccattcttctgcctcagcctcctgagtagctgggactacaggcgcctgccaccacgcctggctaatttttttgtatttttagtagagacggggtttcaccgtgttagccaggatggtctcgatctcctgacctcctgatccacccgcctcggcctcccaaagtgctgggattacaggtgtgagccactgcggccagcctctagtggataaatctttttgaagcaaagaatggaacaaaatgaatcttcttccaccatgtggctgcacaggagtatcagagcctgttctggcttgggaggctgccggattcatgaattgttcattgttcaattaaactcctttacattaaaaaaaaaaagacaaggatagtcctgtgcctctcctggtgcctggcaagtctcccctttgttctcgccatggcatgttgtgtgttgacattactctttattgtttagagccctggcttttcttgcacgtaccatttcctgacaggcagacctagagtccatgtgtgctcggtttcttcctgaccacttaactaactcagcagaggtgagactgttgccgtgtcaagaaagtgacaagagcagggctgcctgtcttgtcttcccactgctatttccaagccctttccaccctgagatgccatttctctaatccacacttccacagagagcctccttcacaggggggaagctgaggtacaaaatgctttactgcaaaagtagatgccttttgtgcctggtgcctggcatccatagaagggacaaggtacaggacgtgcaaggccactctcggagaccgacaccatgcccacatttctccaaggagaggacaatctgtagaaagccggatgtactcgggctgagtgtgggattgaacttccgagcagtcagccttagtgcacactgggaagggcatgcagtggtgtcttttctggaagcccctctgggtaggggagtttctgacttccgtagcttgtccatctggacagtgagttagctctgctgctacataaatttaagtaagtgagatgatctgtttaattctgttcgtgctctattgtccagggtatctctatagaaatgctctaaatataggaagcccaagaagatagtagagattgagtcagcaaaccaaggtcaacatgcaatactctaaaaggacagagcaggctggagggctgcggggattccagtcaggcccactaaggcatttggaccatgtcctgcaagggttttggctgagacatggataattaatttttttttttttttttttgagacagagtcttgctctgtgacccaggctggagttcagtgacatgatctttgctcactgcaaccttcccgggttcaagcaattctcccgcctcagcctccgagtaactaggactacacaccaccccacctggcttatttatttatttatttatttatttatttattagtagaaacagggtttcaccatgttggctaggctggtcttgaactcctgacctcaagtgatccacccaccttggcctcccaaagtgctgggattacaggcgtgagccaccacacctggccaataattattttttttatttttaatgaatctgggtgcagtggctcatgcctgtaatcccagcgactcaggaaggtgagatgctgggcggaaggattgcttgagtctgggagttcccatctagtctggacaacatagagaccccctatccccccaaaaaaatcacttcgacagcctccgggacagtgattcagagatgcacaagactggggcagccagagtggctgatgcgtgctgaggcctgggctgtcggtgcagtggctgtggggatggcagaggaagggaggagggagagaggcgcgctcacctgctggaggtcacagagcctggcggctgggtggggcatcgccgcagaggaggctcctgcagctcaggggcgctcacccgagtggctgcacggatgcacagaagcccctgacttcccacagggccgttcttaggaccaaatggagacagtaacagggtcaacaaccaccaccacaacattcaaaatggcaaatatttactgagaacttagacggtgtcagcctaggtgctttccctatatgagttcatttacgactcatgacagtgctgtgaggaagtgttattgatttgttcatagattagtggattgatattaaagacaccaccctctgtaacttagtttcactcagtgctgtggtgacctatccaacccacatggaagctaatctgagctgcatgtgaacacgcacatatgtagacgaagctcgctagagaaacattctgtacaataaagtactcgttgaaaggcaggcttatgtggagtaccttctgcaatctattattgaaggaactagaagagaattgttatgaagttgtcctctcatgtaatggagcacaaagacacacagacacagatgacaacaatacagattcacacatagacacatgcacacacacactgacatacagaaacacacacacagatacacagacacagatgtgcacagacacacagagacacagacacagacaacagtacaaattcacacacagacacagacgcacacacacactgacataaacacacatagatacagatgtacacggacacacagacacagacacacagacacaatacagattcacacacactcacagacacatgcacacagacacaacaatacagatacacacagacacatgcacacagacacacattgacatacagaaacacacagacacaggcacacagacacacacacattcacagaaacacacacacaaacacagatacataaacacacatgtacacagacacacacatccccacacacagacacacaaacacatgcactcacacagacacatgcacaccaccaccaccaccagcagcaccatctgggtcagattggaatggggctccaattcccaaaatgaacagagtgatgtggaccccgaccctgccccctggacactgtgaagcgccgcccccgcccttcctcccaggggctcctgcttcgcgtttgctccccaaggtcacgagatgcctggcgctccagcagtagaaaagcactagggcatgtggggcacgtgggtcgtcctcaccgtgaagacccgcatctgctcaggcactggagatgcagcttaggatgctgcccctcgggaagaaagacactggatcgcagcgctgcagagtccccttcctggagcctgctggggtttcaggcccaaggcagacagcagcttcgatgtgggaacgctggagcaggttgtgagcagagagcactgggtccagctcctcgctgtgccggagaggcccagagaggttcaggactcgcccagtgtggcctgaaggtcagctcaaatgccccgcatggcgttcttgggattcgagtttctttttatcgtaacatttgcttttggtggttttctttctcacttgttctttctttattaaaactaaatagcataggctcaaatccagggagcaaacacctaggcctccgtcttctgccacgttttgtgcactcgctctcagaaagcctaatttttctttacgattcttcgagggcgtatacacagccaagccgagccaagtgcctgtgtccgtgtgagccctgggccccaggagcaaatgaaagcaaatgcgcctgtccacacccagacctgcttcttccctttgcaagggcagggcagccgctccagctccaccgctgagccaggaaggccggcctgtgggcccagattaaacagaccagctctgggctttctcagcctagaggcgaggggcctcggaggaggaagcgaattccgtggttacgtgtttgatcgcctggcaggagccttgttggacccaggagtgaaggtcttgacctggctcccctattctgcagtgagcaaggcaatggttaagacgagagctgcctttctaagaaagctaagaggccagcacctgtttcctcagtcactggagaaattattcaagtagcccccacgtgaagcagaggtcttgccacgtgaaggaggcaagttccttacactgcttaggaaaagacaatctacattgtggaggaattaattctttttacttttaggttatgcgagacagacctgtctcactcctcgcacagactcaagtccgcgcccccgtttctgctccctgtgcagaagcaaagtcttcaccactgtggcttggggtgtgaggaaagaaggtggaaaaatctgaattctgttgccagcgtctgtttttcctcgtcaggaataattgacgatgtgtgcgagatttctgcaggcacagctcggattacttgaggtcgtccagagaaggggagacagctgcatttttctctatgttttatgaagaaatcagaatccatgcagttaacaggaacacctggccgtggcgattccgcagacaggcctgaggcactggggttccgccgcgacactccacattctgctacagcctgtgtctcctctgcatcactgtgggccacaaaaggcaatgggctctactctctgattatcacccaaaggaagggctataggtcactctaaagccaaacatcatttagcaaaagtgcgtggcaacttaacgcgttctgttacctaggcctgtgtttaacggcctgtgtatcttggagagtgcgccaggaagtggcatcactcagattccaggggtctttaccagaattttaggtaacggctgaaggagatgttgggctacacctgcttgaattgtttgtaggctgaaaatgtggtgatagagacccggggccctgacagcccagttctctgttgcctgagttggcctgggttggcctggacctgccgggagagtcattcttctacctgctgtgtttgattataggagtcttagtttatgtgattctcaagacaaggagcttctcatttaaccagcttcagagaagagacacactccaggccccataaccttggaggagctagatatttgtaaaaatctagcccaagaaaaatatgtatagaaaattaccatgaaacacacccccagctcctgataggccagcatgttgactttgggttagccgtgagctgagtgtattatagacacccatttctcctctagtaagactgagtctgctgactgcagggttatgccaaaggctgataattgaagcaccttataaaaattgccctttggaaagtgtgatattgtttgttgagatttaggtgagtgcactgttagctgttatgttagaggcacagggaagatttctctcttgttttaatatcaggaattggtattttatctcctgattgcttgctccatgctgagcttttaatttttattagatttccctctttttcttgtctgtattactctctgcgggcaggatgtcaggaagaaaaatgatgtgttccttaatgagaaaacaactgagaactacaaaatccagtgactctggtagttgctcaatgtgatccaattcaaacaagaaatcaattataaacttccattcaatggagtgatatattgctttgtcactggtagattcaaaatggcctttagctctgagcctgtggtcctcatctcagggacaggcagcaagaactcagtatacagtaggagccactgtgccctgagatgtagttgtaatcagcctgcacaggggtggactgtactgcacagctgtgagggcacgtgcaagggatcctttcaaactgtgcctccactggaaactgaaaattgtcagaattcaaatggagtcacttctgccaagcccagctaagcggaggagaaaggcccacaggaggggccctcacacacaccagtggggaaaaccacagccttgcacaaaggcactgcaggctcccacggagaagccttctgtgtggacatcagccagtgactgcccgttgaaccctggactaacgccactcttgccatccatccttgtcaaggaggcatgtttcacaaccaccttcctcaccccacaagcccttgccttccttggcctccctgggcgcgcctgtggccccctaggtttgccatggctcacggattctggggttgcacttctttgttgattcccagataaacacactttggagagcctcactttctgttgatattttagcttgacaaaacaaagggcctcgtcgagacatacactttcttgaaaacaaaacagtaacatcccgttgtcctctgtgtggctacctcccaaataaaaaccgagggctggagaacatcatgctgccataaattaatatcacctgaaaaaatataagtaaacactgagctttaagtgaaacacttcgttccaaaatggaactggatttctgtttgctgttacagtgatggtttgtgacagtctgtttaaaagactgtgggccaggtctccggacactctgtagtagatactaaacacagcttccacattaggaaacaggagtatgtaatttggagaaatagtctaaattggaaaatgcaaaactcgcagcatgtatccaacataaattatacttttatttgaccaattccttctcctaagtccccacgtctcactcttgtctgcctattcaacatggattctggaggacctgctgcaagattactaaactgtgcgtggtacagtagatgggactgtgctgaaggcactacctgctctccgtagatgcctgcctctgaaggcctttccttcagtcccttggccctgcctttgagcgtggtgccccgccggagaatgaactttaaccaggccattcactgctgcagagaccactcttctcggaacacacagtttccgaccttgggccggtcacggaggcgtgggtggagggcagtccggtccctgagagggaagggcagggggcccgggacatgggctgcgcaggggttccaccctccgcgttggctggcaggcaggcgagggggactcacggcctcttttcagctctctcttctctggggaaaacttgcccttgacagccctgcttgctgcctcgagctccgagaggaggcttcgcagtcactggagcagctgtgctcctgcctttgctgttcctggagttttgtgcacacaatgtgtgacaccactggttctccagaaggagccaccacactgttgttccctcactcaagctgcaaggtgcaagccttggcttcagggtctccgacaggtcctcatcgcccccaagtgccctcagtgctgtcttttgattcttcccacatgggaagggatcaagatagggcggtcccccagaaaccccattcatcgacctcttccaacaggcctgctgctctcccagtgctgctggctgtcaaaggctccaggtcccaggcagggcacctgtcgccacaggacaggctgattgggtgccgggctgcctgagctctggaccccagggatttaattcaggtggtctcttgtcatctgggaaattttaatccagctgggattactgtccgcaaatcatttgtccagagtttccaccagaaggaatccctgtagctaggtatcaccttttctgtttaaaaacaccctcctcaagtacagcctggggaagctgagagtcatcaaggaatgaaatggactgttcaggcctttaattaagcagatgtggactgagtgggcagctgactctgtgaacagatgaatgtgtgtggggaagctggtcccagagctgtctccatgcagagttcccatcactggtcctcagtttaatagaatagtatatttttaaagctccgctgaagtgtaagcatttctggtgtttatgaagctgacttggtaaatccttttgccatcttacttacattccctttcaaagcttattcttttgcttgaaacaccggggtgggtggcttggtggaggccatcctggggaagcaccactgtgctgtgagctcctgccccattcttcaggggaaccctcatttctcagggttctggggctgcctgtcctgtcgtggggcatctgaagaaaccttgagatggttgcagcgtctcgttcatctccaactcagggtgccacaccaatgctctccctccgtggccacttcttgttaaagatgtgtgaggtagaaagaagacaggccctcttagcttgatttgattccctaaactcaacaacagaagcctgtcctgttgcgggaagtcagggaccccaaacggagggaccggctgaagccatggcagaagaacgtggattgtgaagattttatggacatttgttagttccccaaattaatacttttataatttcttatgcctgtctttcctgcaatctctaaacataagttgtgaagatttcatggacacttttcacttccccaagcaatactcttgtgattgcctatgcctgtctttactttaatctcttaatcctgtcagccgaggaggatgtatgtcgcctcaggaccacgtgataattgcattaactgcacaaattgtagagcacgtgtgtttaaacaatatgaaatctgggcaccttgaaaaaagaaaaggataacagcaatgttcagggaacaagagagatcaccttaaattctgactgccggtgagccgggtggaacagagccatatttctcctctttcaaaagcaaatgggagaaatatcactgaattctttttctcagcatggaacatccctgagaaagagaatgtgcgcttgcgggtaggtctctgaactggcccccctgggcatagccgtctcttacagtcgagattgcagagatgaaatagactccagtctcctatagtgctcccaggcttattaggaagaggaaattcccacctaataaattttgatcagacggtctgctctcaaaaccctgtctcctgataagatgttatcaatgacaatggtgcccaaaacttcattagcaattttaatttcaccccgggcctgtggtcctgtgatctcaccctgcctacacttgccttgtgatattctattaccctgttaagtacttgatgtctgtcacccacacctattcgcacactccctccccttttgaaaatccctaataaaaacttgctggtttttgtggcttgtggggcatcacggatcctaccaacgtgtgatgtctcccccggatgcccagctttaaaatttctctcttttgtactctgtccctttatttctcaagccggctgatgcttaggaaaaatagaaaagaacctacgtgaatttcggggccgattccccgatactgtcccacaaaagtcaggccttggagcatcagagatgacccctcaaagcatttggcagtgtgctgggtttgaagtaggtacacactgggtgcaagaaacttagaggacaggaaaggttcggctctgcaggactaggcaatgagtgttccagagaaaatgggctttgaactaatttattaacaatgagaaagatgtgagtaggtggagaatagatgatgttcctaggagggtaacatgggctgtgctgcagacatgaaaacttaaggattggcaactaataaaactaacagtacgtgcttgggaaaagcttttcttgaaggaatgcagacattggtttggtgagcttgtttctggttggttgtgttttcatatttcctcctcgtcttgaaggaatgcagacattggtttggtgcacgtgtttctggttggttgtgttttcctatttcctcctcatgttacatgttttctaaggaggatggagtttcccattacagcctttgattatgtgtccaggtgagaaggtgcatgaggtctttcttcaggaattctccctgaagagcagagtgaagagttcatttcctgcacacagcggctgaaagctcagccttccagaccaggctcatgatgatgatgatctggaggaggacagggctgctcaaccagggatccgagcagaccctgcattccacatgcaattcctaaagatccaggcctatcacagtcatcacacgtgagctccgttcccctcactcagcatttccagacctgatgctttgtgaatataaaattgcataataattcccaaatcttacaaacatcttcatctgaaattttgtcaatgacaggaggtttttggtcacctggttgattaatggttggttgagttggttaatatttaatggcctaactcaggaacatcagaagtgacattcatattaaccatccatctcaacggctggggcttccttaattagatcactttggccatacgcaattatagaacaagtcatcagaacatagtcgtgccaagaatcaacaactttgctatctttgacaaatttttgtgagataattgcctttaaaagtacaaaaccagaaaccgtgtatgaaaataatcactctccccttatcaaaggaagtgctttcactctggagagttgatgaaattatctaagcatctgttttttactgaatagtttcaaatcagtgattacctgattgttgaaaacactgcacctccagtacgtacacaacccaggtgcatgactttggcttcgttgtatttcatattgtagatgttggctcaatgttgcagccaccataattttgagctatgattttttgaaattttgctatccagcctattataagctatccttgtgtttatgcaatttctgtttgatatacagatggttaatgtccttcttcatccacaacattgtaactggttttggaaaaggagcaggctaaggacagaattctgtggctcgtcctcagaagctcccagagactgtcatcagcccatccttttgatgccttttccctaaagctattgaaccagatgtgaattcgctgacctctattcagagatggggctcctggggaagccttttgggtcccacccaccattcctctcaggtctgcaggtgcagagcggcttcccccttccccaggggtccttggctcagctcccagaagccccagctgtctctccagcttcaagccacaggagttcactctctgtcaagtgttgatgagaaaccaggtaaacccaatctgcactgctgtttgaggacgtagggctgagatgacttcattttcctcctctgtgtctcctgccaggaatgagtaaggaggtggataatctgcaaaataaacttcggaaaatttggtgtattcagataatcatttgaaccttgaggaatgtatacatgtaaaatgttttgctatttgaaagcttcagaaactgtatcagacatgccccacctcccagaggtcctgatctgcatttccccatttcttaatttcagtggacaaatccccagagctctatagatggtccaagatatgcgggaggggagcccagatgagggcagggacaagtaagtgctccctgcacatggctcgctgcacaccggctttgccacatggactccagagctgcaaggaaataggcccttggctctcatgcacaaagatttgaactattgtaaagaaagaggaaaataaaatatgaaaaactcaataatttaagaattaccccaaacaaaaaaaaatacagaagctgtcacaatacaatgcttggccacttgtcattgaggcagaagaagaagtgagtcctccttgcaggagacacagaagggccaagggcatgggaaaaaataacagaggtcagggtgtgaaagcaggagggtgttcttggagcagagacactgtcattttgggtttaagttgagtttttgtatagagagagtatgtggttatggcacggtgctatggtttggctgtgtccccacccaaatctcatcttgaattgtagttcccataatccccatgtgtcgtgagagggacctggtgggagataatttaatcatgggggtggttacccctacactgctcttctcatgatagtgagtgagttctcaagagatctggtggttttataaggggatattcccccttcactttgaacttcttcttcctgatgccatgtgaagaaggacatgtttgcttccccttctgccatgattgtaagtttcctgaggttttcctagacatggggaaccgtgagtccattcaacctctttcctttataaattgcccagtcttggggatgtctttatttagcagcgtgagaacggactaatacacacaggctttgcagtctggctaggggatttctagagcctgtagtctatcattgaactggctacttcatggctgagcctctgtttactcattaggaaaaaagaatgatactaagtcctgagattgttgggttattgtgagatttggatgagaccgtgtctgtaactttgcatggcacaggacttattgcatgcgataattgtgcatcaagggttggctgtaattaaaatgagcatatttataaccttcttatggggatattctccccaggtggtcaatagatttaagagtgggtcataggtctcaggatcctaccacttcatgcccaattcgagtctgaaatgaacaccgcaaacaaccctcactgaagagaacgttgtttcagaatattaaaagttcatggtcctgagagagaagtccagcaattgagatgggagctaaaacttttgcatagtgcagctggttttccaagcgctaggctacaagaccagaacttggcagacatctgagcaacataattattttggagagtttcctataggagaagctgtgttatttaaatgttttccagttacagaaatgggccatcgtagacactgtttctctgtgtgaatacagggacagcaaacatttgggagctctcagcctgatttctgatttcctttgactttaaaaaatgtgtgtggcttttagttactttctaagcattatttcaacatgactttattgtggtttcataaaatgggctatattatatttggctcaaggaatacattactttcagaggccagttttcagatgctcatttaaacaatgagttagcagcctgcatgtcttcaaggatgcttaagtgactcctgatgccacaggatgtagaacacagccttgctgaaagggtcaataaacagatccccaggaagagccttctcacgcctcgtgagcacttcacgagttctctcttatttcaaacttcagagctattttatggggttggtcaaaatccatcaagagttttattacactctaactgtggttcctactctaggtgataaataatttaaaaggcaggataaagggtgttcaccagacgtacgccggacatcgagcagtttatcatctagctgtggaggtttaacatgtactaagctggtgctaatgcagaatcccaagaggaaataaagagcgcagggaaaaaataaaccctcagatcattccattctgtgggggcagctctttcaggggtcccgtggccccgcgtggggccactgaagcctccctgccagcatttttatttcatgtctattttaattagcttttatgtttaagaaacactttatttttggaggaaagtattttttaggttcatctgtctaaaggtcgctttgaaagcataaatcttgctgagtcaaaagtttactggggctgggcatggtggctcacgcctgtaatcccagcattttgggaggccgaggtgggtagatcacttgaggccaagagtttgagactagcctggtcaacacagtgaaaccccgtctctactaaaaatacaaaaattagccgggcgtggtggcgggtgcctgtaatcccagctacttgggaggctgaggcatgagaactgcttgaacccgggaggcagagcttgcagtgagctgagatcgcaccactgcactccagcctgggcaacagaacaagactctgtctcaaaaaaaaaaaaaaagtttactggtttaacaaatagttttcttggtgagacttctataggactctcacttcagatcattccaggaagcttataaaaataaacattttgctcactaattaatttatatcctcctaatttgaaagcaattttacataaaattgaaatctggcaatgaaggaggaatagcatgtctgttgtgtgactgatgaggacagcccccagcctgtgagaagtgtctgcactcagagctgctgtctcctgcaaagacttctgccgtgaaagttttcaacccagtatgtgattcagtggttctaatgcaggtgtcctcattcctgggagtcatttatcagctgcattcggttaaggatgagtggcatggtgctcggcacaggtggtcacaccagctcatcatgccagcacagtgcactaagaacaacatagacagactctaatgtctcagagcctgcttcttaggatgggtcttcccatcaggagccatatagtacaatgtgaacacttgcaatcagccttctcctaaatgtatgcactttatttcctgataatatgtgttggttgtagatgccagtgttgaggtcagtgacatgattagctgatcacatgcttaataatgttgttttggataggcttctatatttaaacatgtaccagacagtagagctagaaacctctgtagttatttcaggcacacggggactccccacgaaggagtacacactcacaacattgttggaaggacagaaagtgatagcggtcaaagctgctgctgggctactgcagacaaaggtatctctctgtcactgtgatcctgagatcaggaattggctcaccttgctgtgactgctgcgtgagaactgcttgctgctcaccctaaagagagctggtggccgaggctggtgttgcagctgcccctgagggcacacatgcctggccctggccatcagtggggaatatgcctcctgcctccctcctcccgcctccctcctcccgcctccctcctcccacctccctcctgcccgcatccctcctccctcctcccccctccccacctccctcttccctcctctttcctccctcctccctcctgctttcctccctcctcccgcctccctcactcattccaagtcctctctgtgcatccactcaagtcaactcaatccagacgtagatgtgagggacacgaggaaatggagtttgtttattttttcacttttttgatctttctaactgaggtagttggaccagagggtctaacactgagtagtttgaaagccagcatgttgggaataaaaacaatagcatattaaccatgtctgaaaaagaaagtgtgaatgaaaaccatgcagtgtgaagctgggtgtggtccattaacaaacccagatgacgcctgtgtgccagggtggccgcggccttcttgggagcaggactgtgtttgtggggaaggtcatcactgtttctgcagtttcctggacctggaagtgagttgtggcgtccacaggacagctgaagtcctgcatgctcatcaccttattgtgacagcagcaaggaggttgtttcatttaatggaatatgcttttctactccttgcgtcttcttacccaattctatcacaatacttttaagaaacaaatgctgcccagttttgtgggtgtcgacttgctagaggatcctggagaagcatacagctgagctgccgaatgtttgcgttttcctttgcgaggaacatttctgttgccggcctccaccaggcttgtaacatttcatagagtccactgattcatctaattcctaagttacgtataatttgtgaaagaccatgacatttacctccatttaaaaactgcttcttccaaacaaaactgcaaaaccagtgcctgagaccttgagaggagagaaggattcctgtctgtttgtgctgcttgcaattcaggagcagcctcttcctccccttccctacggggaaggggaagctgggcctacggaggcctcaggtgtcaatgtgtttcccagggcgtgctgtatgctgagctggagctggatgctgagctggagctggatgctgagcgggagccaggcgtgcccctgccccgcccctgccccaccctgcagcgcccagggaaggattccctctccctgcacatctgcgcactccctggccagtccctgccctgcccctgccccaccctgccctgcccctgccctgcccaggaagcatttcctctccctgcacacccacacactcgctggccagcccctgccctggcacagttcatgggacaccgttcagctgattgggccacagactttagtccccagataaataatgctctctttaaataatgttgttattgttattattatgtccaaaaatagaaagcgtaaagacagactcttttgactttggttttcaccactaagaacctacttcacaccatgagaacctgagtcaactccattttgttaggttgggaacataactttaagagcaagtgtcattaagttagacactaagcaaacatgtcttccttcatgtttctcgtgacggggtaggaaagcagccctgttttactgttatctttagttctacttggtgggaggtgggttttagccgcagagctgctggaagcggggtctggagggaatgctttcagcgagagggtgggcagagcacacagggctcccgctcagagaggagctcagctggggaggaggaggaggctgggaaggcccatcaggagggacagccggaattcccgcggagtggagtcttgctcccagcccttcctaactgaaaagactgcgaaggtgccccgggctgggggcctggggtgggcggctgacaggtgtagggcctggaaatccagtggagtctccagcacaggagcaactgtggaatcagaagcgctgtgctcctgctcctcgttccatttgagattcaagccaggaaaagaattcatagttagacagagggctgagctgacgtaaggaagaaacaaatgcacttttaaaaggagaaaatctccagtgcccagctgctccgtccgtagtgcatgagccccgagaggagaaaatgattcctgcctgtttgtgtcatatgcatttattgtgtgtagacctggcttcgttacaaatctagatggaaaaaagcaaatttaaaacaaacagaccataggattccacaggcttggttccgacatcctagcaatgtttcagaggctgaaattgtcagcactgagcgtcctttgttcagatgcagccatactctggcgtctcagtcattgaatcgtcattggagccccccgttttggctctgggtggcatgtgtagatgtaaagaaaatccttgcttaaagttacttccaaaatgtagccagaccttctgtttctgtaggacccgaccttctgttgctcagattctgccaagactactactgcaaacttgttttcattccatagtttacgaaaaagaaaaatcaatgagggaaatgctttttaaaaagttttaattgaaatatgaccgttgtacatgtttttgaggcatgtgctattttgatacctgagtaggatagggtatctgggataaccgtcaactccaatatttgtctttccgttgtgttgggaacattccagatcttttgtagctgttttgaaatatacagtaaattatttttaactataatttttctattgtacttttgaatattagaacttattccttttatctaaccgtagcttaagtcaatcttttcattgaaaatgaggaactgttcttaaatgaagacattctggcaaatacttggaatgcgttcgattccatcatcaggtggaccagagtccgccaggcaggtacctgggatgtcagcataggaaagcgtttctcagactcgctgctacttgcatccctcatttcagaacaaactcaatcataagattacagagacggcagaatggcccagttgccggtcctgtttgaatccctggtgtgaccccgggatgctagaatggggccagccacagcctcctgagagggagccctcggttcatgtgcagatctctgaggagctacgggtgtgggctttctctgccatcacctttgcctgctttgctttgggggcatagatatgcttttgtgtttgggtttctgaggaggtcattactccatgtatttgggtagttgaagcctctgggcgactcactgctccctcctgatggatcactggtcagccctggtcagccctccagtctttgttccctccaggtcctcgtggatatcagcacacggtcttggtgttggtgttggtgttggtgttggtgttgtattgtgcttgtgttgcggttgtgttgtggtagtcgctgtgtggttgccaactcagaaggattggccgctctatttccatggtagggttcattggtggtgactgtcagcctgactgtcagctggataagggaaggggaagcatggagaggaagcatggggcaggctgcggcggggggctgctgcattcccgggggctgctgcagacgctgaggggcccaggcagccaggcaccaaccccagagctcacactagactaacccctctgcagtggtagcgttgctgattggcccttgaggagacaatgcaacatcacagtgtgctcagaaaacacttgctctaaatattttgagtttagtaaaatgtaacctcacttgaaatcaatcaaggacattggagctacgaaatatttactagtacggaagcttatttcttaacaatacatgaatttttagaggtttatggtttaaaaacatagagagtctatcttgttgttaagactgactccttaagtttttcataaaagatacaaaagagggaatgttgtagaaaaaaactattagaagtaaaaacagattaggagtctggaaagaaaagtttctcttttgacttgaaagcatttcctaaactacatatgcggggaaagaaagagacaaaaacgctagcctgagcctgaacatctggacaccttcagtgcttcctggcagctggctttgcatatttggtgtcctcatgaggctagagcaacctgccagggccagttgtttggacagtaaacagttaaaagtcattcctaagaacgacttagttctccttaagaatttcattgtccgttggaaatgttccaaactttttttttcaggagaaaattcaggcagaaatagttgttttgtcatgccgagtaacactgagagtgagaatacagtcttgcaaatcaggaaggctttgacaccagaaataatcctaatgtttggcaaaatactgattgcacagaacacctccttaaaacatgagtgtgccctgaaatgctcgctcctccccggatggcagaggacatcagcctgatctcccctcaaatgctagatccctcctcaagcctgcgaaacctgaagaaatcccacacactctacagcactgacgtcaaccttacctgtatcaccataaaccctccgtgtctcttcaccaataccttcattcaaaagctccttgagggcaaaattggtgctttttaccaagcattttgttaataagtagtttttaaaaatggttgaatgacataacgttgtccttgagaaatgtaggaagactttagaaacacacacgttggtctttaagatacatattcagagttaacttattagctgtgataaattccaagtgcacaccctggccttggatgacctgacccaaaagagagttaaagtcaaaggcaaagaatttctggaatgttatggtcagaggaaccttggggagtttacggcagcactcagtttaatggatgagccgaggcagggccaagagcaggcaccttcacccaaagccttggctttcccggccacatcttcactggaggaacttcctaattcttttcaggcactgacttctaaccaagtgcccacttctatcagtgtattagttatcagtgttaattcatcaaagcactatctaaagcctatggacctctttgtctagaataatgaaaagatatagtgaaaaatcaaggatatgaaaataaatatagaaaatatgtgaatatagaaaatatagaaaagtagagttaatgcacaaaagtagtaattttcttttcagctgaagattgtgaagttttatgctttttctttagtgtcttttttaaagtatgaattgtcatgagcaaatttcattggataaaagaaaaacttcagctgaattaaatttgaaagagtttaattgagcagtgaacgattcctgaataaggcaaccgcccaagccggagtgggctcagagactccagcacagccacagggtagaagaagatttacggacagaaaaaaggaaagtgatggacagaaaacagaagtgaggcacagaaccagccggattggctacagctcggcgtcagcctcatttgaacatggtttgaacagttggctacgttggattggccaaaactcggtgactggcacaagtgtaggctacggtctgttgacgtctccacttgctacagttcacaacgtacacagaaacctttaggctgaacttaaatatataaggaggcagcttcaggctaagcttgattccacacaactgatgtactgttaaccatcactggccaggacttctttctctactgcgtggtggttaaagcgcgtacctgtcgtgaggaaactgcatctgtcttgaatcgtccaaaagaggcgcttgatgttgtcagtgttccccatatcaggggccctgcaggtctaaggccaggcccttgaggatgacgcgctgaccaggtctcagtttggaggggggtttatcaaaatagactttgtataccttttataagctgcaggcactttatgaatctcaaaatcaaagtgcctgaagaaactttcctaacacgatacttttttttcttatgtttaaactgcatggaaagttaaaagttggaaagccaagtgttacatgtaatgacaggcgtcaaatgcttaatggagcaagtggggtacttgggaaacatctcgcacccctttctgtggctgtagaactagatggtggaagttgaattaaatcccaagaatgggcttggggaatggcatcaaagctgtgttccacatgtccatctctgtgtacttgttatgttccagaggctctatttggccctggttataaccaaaccttcaaagccctaggccctctaactccatggtttcttctgaacgtatttcacaggctctccagggtccccgttccaaacttcgcctcacagccccttccctggaccacacagcaaactcaagcagggctcctgggtcctcccacagctggctgggacccacagagggagcactgtcacactttaaaacagaaacaagattgtgtcacttctcagattctcccaacagcttccagtttcctttcagataaggtccacacttgtttctggactcataagacctcctgggttttgggcccctgtcagttcctcaactttgttccctaggaccatccttcctgccccactcgacacaccctggtatcctcagggcctcaggaatgccacactgcctgggacgcagggtcttcgtgggccttccctgtgcccccagcactctcctccctgttccaaatggctcactccacaccactgcacctctgcctggcaagcagaggtgaacgtgacaccagtgcccaccctgccaggacaggcgtggtggtgggcaggggccttgtctgctgttcccggcctcatcatggccgtggggcagcggggagagctccaggtgagctcggcacaaaatcacctggacgtaggatgcactcctgcctctaccccccagcaaggtcagagttctcagcaccatccaagccttcagtctcccactgagtgtgacttgggcctcagtttctccctcagacactgatgtgctgattagtttcaccaggcagtcacgaggccacagtgtggtgctgagtgtcagctgcatgagggtgacatgcacacggccccacgcgtagatcagacaggaatgctgtagtcctgcctctgtgaaccccgtcacacatgtgacactccctggaccacacagctgggacatgctctttgaagagtgctggaggaaaatctgcgcttggaataaaacaaagaagcacagcatttaataaatgagcatttactatgtagaaggagtggtctgtttcggctggggatggagcattgagattgcggtgctttttaactctggcaatgtcaggatttaaagcggagttttcaaattcagcaaatgttggtaatccaaagctgccaagtgtgagagcacacgtgtttatggacatggcttcgggacccctccgccctgggaatttcccctttgtttctctgatgccttttcttcagcggggctgccactcagaggctcaacatcttccctgcttttctgtaccaggtcggtgtgttttaaactgtgagaatgagtagccatgacattttatttctagctgtttgtgaaaagacccagccaaatgcaggtgctgttattggcaccctctttctccctccccagccagatgaaaagagctttttctaccagaagacagatgccccttatttggtgtgcacacaatggaaccttcatcacaagtcaccagtgatgttcagggtcagggagaaactacctggtacccagagctctttccaggcacccagctatgcacaaagagaggaccaatcaaatgttgggtcaatgtgaatgcctttctttttttttttttttttttttttgagacagagtctcgctctgtctcccaggctggagtgcagtggtacgatcgcagctcactgcaacctccacctcccaggttcaagtgattctcacacctcagcctcccaagtagctgagattataggcatgtaccaccatggctggctaatttttgtagttttagtagatatggggtttcactctgttggccagactggtctcaaactcctgacctcaagtgatccacccacctcagcctcccaaagtgctgggattacaggcgtgagccaccagacccacaagtgaatgcctacttacaagtaaagataatttagaaagaaaattataaactatttgcttttatatagtttgaaatagtttataatcaataaaggaacttaaaatcctggttcctaacattcatcatagagttagtaaatgtaaaattttgttagtgtcaagacaaaactggatttaatcgcaaaggagaaattctcagcgcctttcttacagatttctggagaaggagagaaggagtcacaaaaacatcttagtaacattatttccatttctctcaacccttagaagcaataaaaagtctcattttctgtccgtttttaactctgcagttaaaaatgtatttcttttaccttggggaaatggcacaaaactagagcacactcaaacttttctatgatacattcttaaaatggggaggaagtgagcctaaaacccacggggaagggccactcagacagagaaacctctgccttattccagtgaaactggagttagcgagttagcacgggacagagactcctcagttcacctgagttcctctcctcgggccttttctcccctcagggcaccacacaggctttgagaatgctcagttcccgccttaaaattctgaccaaatcttcaaaaatccaaccctgtgggctttctcccaacccacatgtgacagcccgggcacaagagtggagatagcatttgactgccacctccacgaagtgaccccaaggtgcccagcaggtgttctcagcagacacggcacatgttcctggcccaaaccgagagaagcggtttccccccaggtcaccacgcaggcccccaatgggagacgaggacagtcttttctcaggtggctgacctgtccccctcacatcaggccagcaaaggcattcccggggtccctggctggcgaattggagcacaggctgattgcttgacagaaatgattggacttccaagccagaggagctaaaactgtgagtggatacatagacaatgatgatggcgtgaatacctgcgtgcacacaccactcctcagaagcatctgaacaacttagagaagaaagctcctttgtcatccattcttttctcctcatttctcatctataccagtttcctaaacattggaactaaacatgaaactaagagaactgatttttaagccactgctagatacttaaaaccagaggaatgcgtctcattatccccagacacttcatgcctgatgagctaataatgttacttgcgtgtgaaatctctggcccccgtccgtacacctgcttccctcgtgttcccgatccagaccctgcaggcctcactggcacaatccagacccacgattgtgccagtgtgtggctgctgttatccagtggtctcttctcttgatcggtgagtgaggaaaccactcagctccactttctcctgtgtttgagttccttcaggggcagtactgggtgttccaggttacgggaaggaagcgaaagttaattcgtgtccagacaggaggcgactgagggagcagctgggaacttgtatccatttgtatttaaaagacaaagagaaaagaagaaactacataaacttactgaaacaggaatttttatacaaaaatggtttttgtttcttaaaataaggacgtttcatagaaagcacagaacacattcattttaaacgagtgaaagtcaaaaatgcttttaaagcatcagaatattaacccagtttctgaaaagtccctggtccataggctggggtctcagggacccgccagttcagccactttgttgactggatgagctctggggttgagaagggctcagggctttgtaaggtgcagcacctttactgtggggcaaaaccaggatagaacccggtgtttccacagaaacctcacagatgtcaaggacttggattctgcagatcagctggagcacctgaggatacttgggctaagctactcccttcattgttttgccacagattggatataaattggtgaacttattctgtttctagctttgaaaagaacagtctggttttctttcttgaattggcttattattccccccaggagcctgggcataggacactgccacatggtgtggactttgagagggcctggcacgtctaacccaggtgggagtgtgtatggggtagcaccttcgtgctatgcctctgttgacctgagacttctgaactcagttcaatgggtggttggagaacttactgtgagtggaactgtcccaaaataaagggtgactgggtacatcgctgagcctgcatgcggcagttttgacgccaacccttccatgacgcagtatttacaggggccgttagaccccaccgtgcaggcggctaagtgagaagaaggccgggggcggagtgtgctagaaaggacccaccagagcaccaggctcctcatacaggttctcagcgggcagcttccccagcctgaatcacacaccacaaaatgccagagcaaagggtggctttgctatcaagatgggccagaggagttacagcaagggttggcagggggccagcgcccctgcgagggacgagggtctctgcagccatcaccgtgccggacacagctgtcatgggagaagcggaatagctccctgtgggcaacagtggggaaatcccagctgttctggggtcgtttctcttttacctcaagcctcgttgctcctctcatgcgtttgctagatctgggacatctcagggtgatgaaattttcacttcatggtacttctgtgatttctcatgcagtgaacattcactttaacataatgaaagttagtttttttcttctgattgcttgtaatctttcatttttgttcgccttttttcttcagaagtagttttgaagtacagtcgtccgtcatcagtaacaagcattattccaggtcctggggtgactgtgacatgggactgagcaggattgatttgctgcttcttgttttagaagtacataatgctttttatgttcagtttttctttttgcactaaagactcctgcagcttttatattatgttagtcatgtttcgtgatgaacatctattattttctcatttgaaatattgtgttgctttatctcatttgggggaatatgattaaattaacagccaaaaaaaatccccctgggtgtgtccctattaccacaccaaatatccacataattctttcttaaagctgttcagtactgaggattatctaaaacgccttttctcccagataataatattcttctccatcaaatccatattcctctcagaatctctggaggccagtggaggactggaaattcatagagagcagccctggcaggcaggtgcccgaggtcctgtgggtcccagcctcacctgccccggcgcctgtctcgtcgccctggacaagttctcctggacggctggcctggcagggcttctgcccacgtgttcccgagcctgtgccctggaggcattttcagccctccaagttgtttttctcatttcccttcctggttagtcctgcagctggggagctcagccttctgtagaccgggaggcccctcccagggagccgaggccgggtgggctgggcagctttggaagcaccgcggccagcagcctctgcagcctcaggtcctctgcctttctgaggggatgttcgatgagactgttacttctttcttggaaagtagcatttgccccgtggccgtgatgctttttgctatagattttgatctcctttttcagttgtgtgcaaagagactaacacagacctttttgcactctcagaacccccctggtgaaggctgcacatctgttttctgacatgtgtgtttaatgaagtggaagccagcatgactgtggagtcttgctatcggcagctcacgtgtgcttcaagagcaatcacacaaaactccagtgtcaaaaagaaacctaggaaaaccagggcgtccctaactgcataaacaggctggtctccgaacgacttggctgctgtccacaccacggccacatggtccacgccaacgtgcccttgacccaggggtggtccacgccaacgtgccctcgacccaggggtctgagaatcacgtgtggcactgcctttccccacggcaccctcagcctgtcctgttgcctgaggagtccagagagagccctcctcatctcagacaatccttcctctgagggccacggggaaggcggggaaggggccgtcctcagtcccactcggctttctgcctgggctctgcagctctccgcgtcctccacttactgagtgggctcctgagattccctttggcggggccgtctaaaacttttcttagtaaaaaatggaatctaaattgggcagaaggtgtgtggtgtaaactcccttcctgctgtggtgaggacggtccgagcagatgttctaatgcccgaggtgctctccaggctcagaagtctccgtgggtgtccctagccccagcagagccccagggagaggcagcctccccagcagggagtctgagagtgcagcgtggctcagtggggacgctgtccctccagggctggtgcctggcttctgtcttctattttcccctcggtatctttctctttctactgaactctggaagggctttctttataaaaatttaacaaaatgtaaatggtaacaagctccgtttgtcacctctcccctggatatttacacacaaatagacccagttggaatcggcaaattttgctccctgcttgtgaagctcttaaacccgccgatctcatcggggaaacgagggtggggctcctacctcttgcatttgcttattgatccagcaagcatgtattgggcagctgagctgcttctctatgccaaaagggcatccagagagaggagacctatgttgtccattgtccatgccaccctgggcataaggacacgggatgctgcctgtgtccagctactggggcagtagcaccgggaacggtctcaggagaaaagaccccagagaaagtggatggcttctttcaaatgttatcttgaatttggggtgggacgagtgtctcaggcatggtgtcagggaattcctaaccggtgggagaggagagtggtgttgagggaaggatggaggggaaagtcacgctgcagaatgttgggtgcctgaattattccctgaccccagaatccatacacagtccgcgctgggctccaaagctatgagcactaaaccctgctgtggactgttcgtgccaatgccgtggtgtggacaagtccccaggagacgggcgttggggagctcctgctgtttgccctactgcctccttttgctctgagaagcgaggtggctctggacagggtgggggtggcggtgaatcacaggccctggcctcgattgctgggatggccagcctcatgtgctctcagcgtgcactccgtatgtcccgtgtccctaagcacccggtgcctctgctgccacactcgctggatgagtgacactgcccacctccgattgcagttctgaagatcagtgagatactaatgcctgtgaattttagtctcacgtaataattcaaacaatagaggaattaataatagctatggctcaaaatcaatatatataatgcaatgtgtttgtgtttaaactagctcattaagattaaggtaggccaaaatactcatttccaaacagtaaaacaacatttccctgtattttagaggaaaatctgttaggctttatgagttaattatgaaaacatacacgtgtttttcaggttgtccgggtgccaaaaagcatgagtttctgaccagcgttctggacgcgctgtccacggacatggtccacgccgcctccgacccctcctcctcgtcaggcaggtacgctgtgttcgccgtgggacaacaagttggcagggtcccagaattctggggaatctggaaagtctgaacattacatattggcaaccttctcagcttatttggacacagtagggccttaaaaaggagccttctgcaaacacaggaagttgcttagcaggttttcttgtagcaagactaaatcactgaaaacactcccataggggtacatggccctgagccgtgactcctgggcctctgcggggtagtgggctctgaccctggcccttttggtgcggagcagggcagggggagcacttcctgcagagggctttgtgctttgaaattgcactttagagtcatcgattggattgtaaatactttgaatgacaacgtttaatctgaagttctcaaaacgtgattaggtttactgcagtaaaatgtacagcacatacatttgctgtcctaaccactttcaggcatgtgattcagttacatcaaagacattcacactgttcaaaataggatttttggaaccctggagatgttccttgagtacctggtaggcattcccgcactcctggacctggggcctggagctcggtggagtggctttcggtgaattctccaacactcctcttttccaccctctgtagatcagcctcaggagagcagaagaaccccagggttttactgcgatggcatctcaagcatcagatattccccctgatctagccatagtttatctgtttctttcaaataaagttttgatggagatttcatcttttttctttctttagaatgttggcctttctccccatagcccctgacacccaaacccttgattatctcagccactttaggtgatttttttggtctcctgaactaaaagcctctcctctcactgtctgtctgctaaagaagacttaaggaaataaaaaggcaatactaacagaaaatgtcatgaatgtgtaggaaattaaatttaatagagcaggccgggcgcaggggctcacgcctgtaatcccaacactttggcaggccaaggcaggtggatcacctgaggtcaggagttcgagaccagcctggccaacgtggtgaaaacccatccctactaaaaatacaaaacttaatccagcatggtggcaggcacctgtaatcccagctactcgggaggctaaggcaggagaatcacttgaacctgggaggcggagattgcagtgagccaagaccacaccattgcacttcagccaggacaacaagagcaaaactctgtctcaaaaaaaaaaaaaaaaaattttaatagagtcaaactgtatgtaaatttcaactttacatcttctattcttggaaagattgttttcgcaaactaagctaaactgcaaactaaaaatgaaggcagtaaatgaattgctaactaaactaaattgcaaactaaactaaatgcaaactaaaattgatggcagtaaatggattgttatctgaaaatcctccgaaaggttgagaaattggcaatggtgtcggagttcacggtgttctcatacctgggaatgtacagctcatcccaacaggcagaatccaggggccagcacctccaggagggccatcccatgcgcacacacacaccctccatctcacggagaaggtgcgtgtctgccatttggtgcacttttaaagatccgcaccttctagaagagtttatttatgtatgccctaaaatattgaacctaacataatccaaggaaaaatatctagtcccaacttaaaatgtttttgatttgcatcatctgatattcctatgacatgaaggatgtgtaaaagaatcacatttacagggctagaaaagctcagggttctggtgtgtcgggcgggtatagctgcatgtgctgacctgccagtcctgtgcacacagaagccaggataagggggcttttgtccttcaagtgcatctttgctgggcacaaattcactgcatcatttacaattttgaatccaacctgaaaaatctttgctaaaaatgttcttctaaattatttctttaaattgttatatctgatgaccagtgctgcaggctgagacaccaggaccatgagaactacaagcaggggttatgggtttgagggaaggacagtggccaggaaggagcagcccaggggtttaagcatcctgacggcatctgtgttccttccaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacagtaagagctttcccacccccgaccctgggcagtggtcaggccctgaggcctgggaggtctgcttctcacaaacacaattacagattgtgtttatggcctgggagtgcaaaaaatcaaatatgctgtttaattgttgggcgtctgtttgcagaaataataatgataattggcgactcatcacatgccacttgcccaggagagcccaggctcaaagggcatgaactgcgtgttggtttgcaatgagcctttttactgttcagaccacggttggcttcccccagaatggattgtcttctggtatttgaggtgcaaacctgggaaccactggaataaccaaccctgcacctgagctccaaccaaatgttaggaactcaccaaccctgctcctgagctccaaccaaatgttaggaactcaccaaccctctacctgagctccaaccaaatgttaggaactcaccaaccctctacctgagctccaaccaaatgttaggaactcaccacccctgtacctgagctccaaccaaatgttaggaactcaccaaccctgtacctgagctccaaccagatgttaggaactcaccacccctgtacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgctcctgagctccaaccaaatgttaggaactcaccaaccctgtacctgagctccaaccaaatgttaggaactcaccaaccctgtacctgagctccaaccagatgttaggaactcaccaaccctgcacctgagctccaaccagatgttaggaactcaccaaccctgcacctgagctccaaccagatgttaggaactcaccaaccctgctcctgagctccaaccaaatgttaggaactcaccaaccctctacctgagctccaaccaaatgttaggaactcaccaaccctctacctgagctccaaccaaatgttaggaactcaccaaccctctacctgagctccaaccaaatgttaggaactcaccacccctgtacctgagctccaaccaaatgttaggaactcaccacccctgtacctgagctccaaccaaatgttaggaactcaccacccctgtacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgcacctgagctccaactaaacgttaggccagttcacaagccgtaaaatcattgctgtggcccagaccagttattccaatggttatagcagttttaacaattgaaaatacttttttttgtgggcctggcctacccaaccgtgacaggaagtaagagaaacctgtgatggccagagcccagatgttcttaggaggcaagccaggagaagccgggtctgacttttcagctcagagacagcactgtgagatgcgtgcatgccctgatcccactgcacatgcgtgctagatactcctgcatgtgtgtgctggatcctactgcatgtgtgtactagatacccggcacatgtgtgccagatccccctgcacatgtgtgctggatcccctcacacgtgtgtgctagatccccctgcacgtgtgtactagatttccctcacacatgtgtgctagatcccttgcacatgtatcctggatcccctcacacatgtgtgctagattcccctgcatgtgtgtgctaaatcccactgcacatgtgtgccagattccccttcatgtatgtgctggatctccctgcccacttgtgctagatctcactgcacgtatgtgctcgatcccttgcatgtgtgagctagatcccccatatgtgtgtgctagatcccactgtacacatgtactggatcccactgcgcgtgtgtgctggatcccccgtatgtgtgtgctagatcccactgtacacgtgtactggatcccactgcacatgtgtgctggatctcattccacatgtgcattagctctcactgtccttggggatctgtttcctgatttgtgtaatacttgctgggtagggctagtagacaccgctcaaatctctgtcgtttatgactcttttatttgttgtcaactcgataacaaatgtggaagagaaaacaagcttgagactgtgttgtggagggctgattcaccgtggtctttaaaatcctcctggcaagtcacggtggctcacacctgtaatcccagcactttgggaggctgaagcgggtggatcacctgcggtcagaagttcaaagtcagcctggccagcatagtgaaacctcatctctactaaaaatataaaaattagctaggcatgatggctcatgcctgtagtcccagctactccagaggctgaggcacaattgcttgaatctgggaggcagaagttgcagtgagctgagatcgtgccactgcactccagcctgggtgacaaagcaagactttgtgttaaaaaaaaaaaaaaaaaaaaaaagaaaagaaaagaaaaagagaaaaggaaaaaaaaaaaaccctcccatgtttgaagctcagctgtgagacaggggccctttgatctgacctggactgagggctcctggaggaggcagtgatcatcgtctgcctcctcttctcagtgtcctagtgcttgtcttgatagtcactcagtgctgttcaaccaaattagggcaagcctagatctgtgtcatggcgacgcacttcctgctaatttctctgtgaaaagtcagctctgaaaaattaagctttagtttgaagctttttgtatagggtctttgtggttaatgcacgtcctgccgtcctgatgatgtcttcacgggagagcagatggctgtacctatggccgcctcccttcgctctgtatgcaggaggctgccccctgtgctggcccggccatccgatgaggtcagagagaatcctcagttatgttcaatgttctgtctccatcaaggactctttggcaagtgtgggaggagctggcctctaataagacaaaaaagaaaagaaatcactctgggctgatcaactgcaatgcatgaaggcagcaaatgcccactcaccactgtgggaagaggggcactaaatgtgctgccaaggtctggcaaggctcatgatccaatatccaatcctacttcatggctcaagacctcatttcattttcacagccatcctgagggggacgaggtcacagacagatgctgccatccctgacacttgcagacaaggacacacaggcactgcagtcatcagcactttgatctgagtcttcctcagcagtgctgcatgcagcaagggcagtgctgttggaaatcgtccactctgctgggctacacttgctgttagggctccttcgcccacaccagcatacacctgcaaccctccaggcatttggatggaaaaccaaggatgcctattctcagtagttgcccatgtgtgatttcccccttgcttttccctttctctgtattcagcacctgcccactgggtttcctgagcacttctctcttactgccacccgatactgcttttggcttcttggactgggactgtgtcttagtccattttgtgctgctataacagaacaccatggatgggataccttatgaacacaaacgtattagcttatgggtctagaggctgggcagtccaagattgtggaatcagcatctggtgagggcctttgtgctgtgtcatccccaaatagaagggcgaagagagggtgagaaagagagagagagcaaggggggccaaacacattctttcctaggagcccactcccaatataatggcattcacctattcgtgagggcagagtcctcatgatgcagacctcttaaacctcccaacgcctctgtattagggattgagtttccagcacatgaactttgggctcaccttcagaccataacaggctgctttcttcacttcctgtgctttttctcttattttggtccctgctcaggatcccagaagacaaatggtgttttgctctttgagacttaaaacctacaagcagggtccacatgggaggcctgggggactgatggggagatggagagcaggtggctgccagatctgcagctggggccagggaaccatggtgtccctcacccctgatggttccacagagagggaagatgaacacccacccagtgattcatgaagggagctgctcacattctgctgttgccccatctgcatgtgatgagtgacaccttgtggcacctgggggcttcctgtgtggctcctcctctgttacggaaaccagtctctgcatttctgtagaaggctaatttttatggtcataatgagaaaattaaggatgggtagagccaagtgtagatctgtttctaacttttaatcttcttccattcctgggtggtgcaggctggtcttctctttgcaaggactccatcctgttagccgttgtcaggtggcttgagtagcacctgaaacgtaagccacgcatggcttctgccctcctcagcctggtgctacagggtcatgtggtccatggcccttgctggggcagattcctgtctactaatttcttcaattaaaccgaagtgaatgttgactctttgtaagggggttggatgagttccagcaattggcgggttttcaggtagagtaattgggcccagagctgtgattatggtgacagaattttgaaaatttcgggatgaaacgatttcaagatggatccacagcagttaagaagatgttctgttctcctggaggccctgctcctaagtcacccttccagaggaacccatagctcccctcatcctgcatcacctgcaggacacagctcagactgtgtgtgtgtgtggagtatgtgtatgtgtggtgtgtgtggtgtgtgtgtgtggagtgtgtgtatgtgtggtgtgtgtggtgtgtgtgtatatggtgtgtgtgtatggtgtgtgtgtgtaaatatggggtgtgtgtgtttatggtgtgtgggggtgtggtgtgtatgtgtgtgtgtggcgtgtggggtgtgtgtgtgagtggtgtgtatgtatgtgtatagcatgtggtgtgtaaacactaatactggcgctctgggctggatcaagctctgttagggcaaatgtctggcattcatctatgtgtcctactattttaaaacataatgtattgataagaattttgaggtgtcatttggcaaacagatcaggagacaattgaaaagataatttgttactcacagatcccaaggagaagaggccatgctgtgctgtcgggggccacatgtgaagcaccagggtcagccaagagacagagggagcaagggactggccctgagccctcatcatgatttcccaggcaggcttgcctataaatgaggtggccaggttataggctgggtgagggtggaggttgtagggttggtgagagtggaggttgttggctggttgagggtggaagttatagtattggtgagggtggaggttgtaggttgggtgaggatggaggttgttggctgggtgaggatggaggttgtaggttgagtcagggtggaggttgtaggttgggtgagggtggaggttgtaggctgagtgagggtggaggttgtaggttgggtgagggtggaggttgtaggctgggtgagggtggaggttgtaggtagggtgagggtggaggttgtaggctgagtgagggtggaggttgtaggttgggtgaggatggaggttgtaggttgggtgaggttgtagattataggctgagtgagggtggaggttgtagattgggtgagggtgaaggttgttgactgggtaagggtagaggttgtaggttgtgtgaggatggagattgttggctggatgagggtggaggttgtaggttgggtgaggttggaggttgtaggctgggtgagggtggaggttgtaggttgggtgaggttgtagattataggctgagtgagggtggaggttgttgtctgggtgagggtggaggttgtaggctgggtgagggtggaggttgtaggttggcctgaataggaaaggctgctcctcacggtctctggggatgggctagctctgagagggcagcctcttcagcctcttcagatgtcaaagcattagataaagaaaatgaaagtcatggttaatacacccactctccaaggaactggcccatggattgggttctgatagaaggatatgagtccctcatgggcaagctaaatcccctagacaatctctttggaaggtggcagcaccatacagacaactgttgtgagccgcatatcctgatttcaaaaggttgtcagttccttctaggactggtccgcattgctctctgctaaggctgagcaggaccctggtgttgaaggatacatggagttctcagtagcgctgggagaaagctctgggaggaaatgttttttcattgcatatattgatagactgaaatgaaggtaacttttatgagtcatgaccttccatgggtcacgcttcatgcaagtgactacagaatcgcgatggcttaggacccaagcgtttccttctggttcacatagcatagaggctgtgggttgccaccatgccgccctgggcgggaaggcaggttcagcgcaggtcagcacaggtcttgggaagatgtggcagagaagcatgagaggctgagccactcgcacagccacaagggaggtggatgctcagagatggagcctctcagcctcccaccttccaaaggcccgagccgcagtgtggggcagggaaggggcatggatgggctggagttcttagcccctggcgaggaagaatggatggattttggagcacagcgcgatctcttctgatgccattgtcttaggtgaaaagtttaagttgctgcagaagttagagttctcttcttcagatccctctgaataatctgatatgtctcatttttactgtcttcttagtaatcaagaagaaagaatatgatcgctcctagcaaaataaactgcagtttggcaaaagaggcaatttggtcatggtcaaaaatgaacattgtggtcttggatacatatttagctgattttgcagccctttcattttccttacagaatttttttttttgacttaaaaaaattcattatcagttatatgttttgtaccctgtatagtttacaatagtgaaaagtcagaaaaacctaaagatccaggaagaaattagtgagaacattctaaatatccacactgttgctaagttttttttgttccctatatttttgctcactactgaacaatgcgctttttattctaaaaaatatgagaaatcagccgggcgtggtagctcatgcctgtaatcccagcactttgggaggccgaggccacaaggtcaaaagatcaagaccatcctggccaacatggtgaaaccccgtctctactgaaaatacaataattagctgggtgtggtggtgtgagcctgtaatcccagctactcgggaggctgaggcaggaaaattgcttgaaccagggagttggaggttgcagtgagctgagatcgcgccactgcactccatcctgggtggcagagtgagaccccatccaacctccccccaaaaaaaagaatattagtttttttttataactttaatttacagctacttctttttataactttaatctacagctacttctaactcccagggagaattctattaatcagcaagcaatacaaaaaaaactggcaattgttgaatagccaaattggctcagaatagattcaaagtatcactccaatagtatttgaatttgaaccgttggctgaaaagcctatattttttcctgtaaagtagtcattccaggcaagacaagtagaggaacagcagcactcattttggcacttagaccattgaaaccaactatttaaaaaaatcatagatttagccactgctcgatgtttttgcaatttacctaattgcaaattgtttttcaccttttcatactctgtttctatttgcgttatggcaagggaagacagtttgaaaatagagcaattttgctctttactccatgttttttattgagtggatagaaatcaacagttaatcaaggaatatgggatgaaggatacttccctcatctattgattcatttgaaaactattgaccaagtactttctgctctagatattgacagaataacagtaaacacacaggaatgtgtgtctctttaaggcttatactttggtgtggaagcgagtcatcagataaataagaaaccccacagcacgataggggttgcttgtggaggaggcagaagggaaggtcaggagggctggaacgttagatgggggcagggaggaggccctgcaaggtgcgagtgagtggagactggaggagcagaggagaaccaagggccgtcgggtggagagcagcctgcagaggacagcaggaacgccatgcccagcaagccccaggggtggggagaagtcgggcactggagaggaacaggcatccggagtgatgtgatgccacatgggtggatggggcagagcccaccccgcctccagcatagcccagaagcctctggctgcttctctgagtgaggccattggaaggcttgggtggaatgttttagaggactgctggtttccatgtttgtgtagacaacagatgggaagggctgaaggaggagagtggtgaggtgtctgctcgggtccacgtgggagaggtgggcggttccggccacggagcagcctgtgcgaggagtgtcgggctctggatagactttgggtgtagagcctgagggatttgctcccaggtgagatgaggaaggtaggagaagagaggcgtgatcatgactcccaaagtttgccctgagcagctcaagaatggggttactgtgtcctgaggatggaatacgtcagaaagtaggtttgcaagggaagataatgagtccagttgggtcctgtttcttttgagctgcctattgaatgaaactccacatggagataacgaagttggatctgataatctggactgaggagagaaagaggtccatgctgaagattacagctatttgtatccttgggagctgtcaggaaatagagagtatttaaaatcctgaggccaacctgagcccaccagtgagtgggtgaagataggaaagggatgaggatgctggagcccctggggtgcttctcagaggtttccatggagatgcaagcgtggaagctgagctgagagcaggaaggagactttcccaggaagctccgctgtgcagagggcggtgaagccaggagacggacagcacagctccctcgggctttgactctactcgaagctttgaaaaaaactattttgagccaaacacgttcatctctcctgattttaatatagaagcaaaagacttcaaagagctcttgttggggcattgctgatggcttcacttccggcaccccagggacgtgaatcccccgccttctggggaaaggttgagaaacatctagaattcagctctccagggaaggtggatttaccttagagtttggggtaaagtaaaacattcttctaaggctggactagagaatctgtatgttagaaagtacttacatagttactttcatgatccagtactcataatttgtgttgaatgtatatatagttagctcttctgtggattcaagcaaacttgcatcaaaaatgctcagagaaagaaaagatgcaaataaaaaaatgtagtatagcaagtatttacacagcatttacattgcattaagcattataagtagtctacagatgatttaaagtatataggaggtgttcagattatattaaaatattacacgataatatataagaagcttgagaattggaggattttgatatgcaggggtcctggaaccaatcccttctggatactgaggaatgactgtatgtggtttttttcatataaatgagtttgccaattgataacaccttcctaaagtgatgtggactccttcctgaaattgtgttgaacctttcattaaataatgagtctctgatttttaataatatcttttttttttcctgctagcccccagaggtcatgctgaaagtacgtctaatagacaggtaagtatgtttatattttactcttaaccatttcgtttttaaattataaacaataaaaattcagagttatgtagatttgcaatggccagtaccttccaagaaaatccaagaaaataaataattcaagggaggcaagcttactgactacaccctatggggactaaagcagccttgccgaattctatccgaaatcaccaacttgtttgaaaaaagtttattatttgaactttcatttattaagaaaaatttctgagtttccttgtttggtagatcttttttttttttttttttttttttttttttttaagagaaggggttctgccatgttgcccaggctagtttcgaactcacaggctcaagcaatccacctgggattacaggcatgcgccaccgtacccggctgaattttttcaagcaattgtctgagtgtttgtaatttggttcctccattttgtcagggaggttgcaggaacaggaggcatcctgcataagcaggtgcatttctgcttcttttggggtcccagcaagacaagtgttgggctccaaaaggggctttcggctcctgctgtgtgttcacaaacatgtgttgtgtttctggctctccctctcaatttgcaagtaaaggatgcaatggtggtgtcctccagacccaaagccacaacccatcgcaagtcaagaacactttccagaagataaacatgagtgggttcatgtctctctccttcaaagccaggacaaaatccccacttctttgctgccgcgagtcaatttgtgatttattttgtctgcacctgtttgatgccaggtcgacatttcctaaggcaagcccctgtatttgttgtggatttaagtggaggcggccagcacacaccttggatgtaatttaaaaccatttcctgaggaaagatgtgtgatatgctttcctttgtttagcaaatgtttatggttttaactttaaatctcaccgcaaatcacttacacttgaaaacagggctggtctgaaagtaattaccctccctgagtgccaagacctccagaagttgttttcattcccgaatggcaatcactgtactcatgcgctccacgcatcttaaataaactcagttcaaagcacatgcctcctgcttcagctcttttttccaaaaagagaaacagaagcaggttccccctccttttatagtgcctgcgtggacacgcggacctccatgcctttcatgctgtggctatgtcagcaaactacgatattgggatgatcctaacgggcaagccagctgcggctcctaccggccgtggccattgaaggccaccatgttgctttgaaacatctcaaagaataacatagtgccagccagcaagggtttcaccatatgcatgacccagacaggaactatcaaaagaagggatcacgggaaggtgcatgatgctaatgtggaatccagaggagctctttcctgatctcttcagcttccgctgccactccagaatcatcagagctgatattaaataagttaaaatgttagtccaccgtctcctcctgcaatcctaaccatcttttgagactgttagaatactttgacgggttgtctttctgtgcaactaatttaaacctcaagtttagtgtaggagatgggtttgtcttctcacctcttcagatctttatcaagggggaataaaagccaacccagaaacctaaactttaaaatttaattatttgaaataataaaacagaagaagggatcaacatttgtcggaattggcactcttggaaaactaagtctaggagatcatatattgctttttttttttcattctaaattacttttaattgaaagtcaagatgctgagttacagttgtttatcattataataagcaaactttttaagttggatttcttcttaaagaggtaaactagtgaacaaaaaagataaaaaggaaaattaagaatcaactatgcctttatcaaatttgaagcataagttatattattaaaattatttttgtataatcaaggtgataagacattctggaaaacatttaatgtatttagtacttagaatatttacagtggatgttacttttttgaaacgatatatttttcccaatttttctatcatgtcaaggaaggaaactgttaagaagttaccagtgtccaaaatgtcttcattgtttcttactcatacttacacctcacatgacctgcccagccctctttggttcagttcattcccagaagccaagccttagtcttcacagatgagcgacacacacctctgaatataatgtctcttttttgttttttccttttcagccaaggaaacaaggataaatggctcataccccgaaggcagttcctagacacatgggaaatttccctcaccaaagagcaattaagaaaacaaaaacagaaacacatagtatttgcactttgtactttaaatgtaaattcactttgtagaaatgagctatttaaacagactgttttaatctgtgaaaatggagagctggcttcagaaaattaatcacatacaatgtatgtgtcctcttttgaccttggaaatctgtatgtggtggagaagtatttgaatgcatttaggcttaatttcttcgccttccacatgttaacagtagagctctatgcactccggctgcaatcgtatggctttctctaacccctgcagtcacttccagatgcctgtgcttacagcattgtggaatcatgttggaagctccacatgtccatggaagtttgtgatgtacggccgaccctacaggcagttaacatgcatgggctggtttgtttcttgggattttctgttagtttgtcttgttttgctttccagagatcttgctcatacaatgaatcacgcaaccactaaagctatccagttaagtgcaggtagttcccctggaggaaataatattttcaaactgtcgttggtgtgatactttggctcaaaggatctttgcttttccattttaagcttctgttttgagttttgccctggggcttgaatgagtcccagagagtcgttcggatggtgggaggctgcctaggaggcagtaaatccagtcacagtgcctgggaggggcccatccttccaaaatgtaaatccagtcgcggtgtgaccgagctggctaacaggcttgtctgcctggttttcctcctacacgtggacattattctcctgatcctcctacctggtccaccccagggctaccggaaggtaaaatcttcacctgaaccaattatgagcagtctccttactgaaggtacagccggatacgtggtgcccccggggctggtgttggcagccggggggaggtgcctgagggtccccacggttcctttctgcttttctgaatgcatcaagggtacgagaacttgccaatgggaaattcatccgagtggcactggcagagaaggataggagtggaatgcccacacagtgaccaacagaactggtctgcgtgcataaccagctgccaccctcaggcctgggccccagagctcagggcacccagtgtcttaaggaaccatttggaggacagtctgagagcaggaacttcaagctgtgattctatctcggctcagacttttggttggaaaaagatcttcatggccccaaatcccctgagacatgccttgtagaatgattttgtgatgttgtgatgcttgtggagcatcgcgtaaggcttcttgcttatttaaactgtgcaaggtaaaaatcaagcctttggagccacagaaccagctcaagtacatgccaatgttgtttaagaaacagttatgatcctaaactttttggataatcttttatatttctgacctttgaatttaatcattgttcttagattaaaataaaatatgctattgaaactata

SEQ ID NO: 915 - DNA, 225920 bp, Homo sapiens; identical to SEQ ID NO: 914

SEQ ID NO: 916 - DNA, 244827 bp, Homo sapiens
aagaggtgaagttcttgtttattgttgcagcaactcttatacagacattagcgttcagttaaataaaggaagatagatagcacagtaaatacatcacaaccccaaactggatgactgtggccacgggacggaggagggagggagggagggaccagtgaccagactgtcaaggaagtacattcagtgggtgtgcggtgtccacattccaggctcacgtgtagatatattttatttatatatttatttatatttatatatagatcattgagttttgtgtatacaaagaacgatattgttacaaatacaatactatacttctcccgacactttacaataagctctatttcaccctctttacagaacaatagtacaagttcatactctaggtgctgtgctaagtatgtacaagaaatgtcattcccacacagtcctcacacactgccttgatggaggggaagaaagatcgagttgtgtgctcaagtcaacctaggccagggaaggagacacatgaaactcaaaccaacaggtggcctgtgaatgcgagtaaacacatctaaggaggggcggcccctggttgtaaacattggtaacggctacaccactgggtcgagggacccgggaagggctctgtagatggttttcatctgtgtgcgggaggtgttggtgcccacagggtgaggggggcagaggagcgatgggggaggtagtaggttactctgggactccctgaaggcggtgttgatgggcaatgttcagaaagcaaacccgtgcacagggacccggcacccctgccatgcactcctaggagcctgctctggcgagggaaggtgtcgctggagaagtgggctccaggcattggtctttgggggtttcttcctctcatgaacccaaggctgatggtggctccctgaaatgctcacactggagaaaaggcaggatgggttctggtgcctctgcctggaccaggagggggaggtgaacgtgggagtccaaccccaaagctgagccaccagcacaccctggtggagcagccacagcagctctgtgccctcacagcgtttgggaaggctgccctgtacatagccttcccattacatggggtatttagatatttacatgtataactatatatactgggatgacagaagggaagaccaccacttctcttgggactttcaaaaaatctagcgacttgcttttaagactgtggctgctgaggtgaccatacctaggctcactcccttgccccagtggtagtgggaaaaagaacccacttcagctgggtggacctgtaccgagctccagcaacttccactcactgggtgtgaagacacacctggattaacacaaaagaatgtggcagagaaatcttctcactctaatgttacaatgtcagtcctctaggagagcttgcagaattggctttttcagcacctctcaaagtttacaaggtttttgtgcaataggaatagaaagtatattctctcctttaggtgaacatacataaccgttatgtgcaggttgtacagggatgcactactggagttctgtcccctggccagtcgtgggcgggcctctgtggcactgcccaggtgcctagggacagacaggcatgggcccctacgatgattttccaaggctcctgatgcctgaaataccaccagtaacacttcattcctgttctatccactcttattggcagaggaaagatgaactggctgatgactctttagtgtctcactgtatcaccagatactctacagcaaatggagaaccctggccatggttccttcctggtcctcacgtttgtgatgggttgaccttgaggctggtctcccagaaacattctgtaaagcatccttcaaagaagtcctggggagctttacggaccatcccagagcccctggccccaccgggtgccactctctgcagcagcagaagtccctttccccccagggcacctgggcagccagcggcctcccttcctcagggctcctttgtaacacagtgaaactgagagtgccactgctcgttcctgtcaagcactgagcttccctgattctaagcagaaaactcagaagatgcagagatctcggggaattgatcacagaactctctggttgaagtctcttgtccctaatcttgttatagtcactttgctccctccttagaatccctccattctctctataaatacatgctacccaccatttgctcactgagttcctatttccatagacacaacataaatatctcggatgcagagaacagggactatattaattacaaaatataatagtttctcttcccctgtctctactgaggtcatgaatgaaacaaaacaaaagcaaagccaaatcacacctcacatgaacacaaaatgctctttggaccaagtgaaaactggctcagaattataatattactaaaacatctacactgaactgagacggaagcataaatatgaggcacctgatgaaaacacggaacaattccacaccagccaaaaatgctctcaggcccacaaggcagcaagagggtgtttatggaccacatctggggattctgaggcataacttgaggttgctattgtctccttaattttgtggtttatgtactattctggcctttccaatatcacatccgcctagtggccctgagcagagaagaaagttggtcttgccttgggccagaaaacaagacgcaattgcacctgcagcttgccttcttgggaacagtccctccttcccagactcctgggatgtgtgttcggcagggaggggagtccaggaggaggatgctttaagccaaagtggtgctggaggggctgggcctcagcgcagagagggcaggtctctcaggatgaggctgagcagcccccgcctgcctggccacctgccagggaaggggccttccagagaggtgggtttccaggggatctgtgtgcctaatcttcagcttgtctcactggtggtgggagcagggaagggtgatatgcaaatgggactgtgtgtgtgtgtgtgtgtgtgagagagagagaagcagacagtacctgcctgtgtttatctaatggttgataacttgaggacaacctggtaaagcttcagatgccccatgaattgccaagctctctgtgacactatggtgtccttgcccaaggcagttatttccccttttatcctggggtgagaaggctcgtattagaaaacacacatacgttgaaattagaactagcaatagaagaggtttaaggttggctcagagattctgggaagaaataatgtatggtgccccaactacatggcaggcagtgcataaccttaatgacgtgggctggccctgggtactaccacattcccacagataaactcagagagcagggatcagcaactgggttttaggcactgctgaatcagctgctttgctgccccgcgagctccttttaagaagtctgcacctcctgggaagggaggattctccctcaagcagtgacagcccaccccctggacacacccagaaagccctccaggatggtcctgggtcagtaccaggtgggtgctggctgctctccatcctcaagggagtgcatacgaaacttccctggtattgaaaaaaaaaaaaaaaaaaaagcaaatcggagagagtaaagaggtccttgtggattcttctcttcctgtgtaaaaccaaatgctgggcgcgagaggggaaagtctcagtggacacagggatgcagcacgagaaacacaaccacgaagaggagagtcctccatgcatgccaccgcgtgtggccgcggtcagatgtaaacaggctgctcctgggccgtcagcagcctgtacatcgcggctggcattgtcttcatatgaatctgagggtaaagaacacactttagtggggggctgaggctgggggctggctgcgtgggcactgcccagggctggccagagaggcagtgcctctcccacagagggctttgaagatactccctaccgcccagccaccaccagggacctgacccagggtggcctccaggaacagtggaatccactgactttctcaaaagcttaggggtgacagaaatgaacaacaaaaaccaagcaaggcttatttctcagtcaaatgctctcgctctcaccagaccctacccttttaaaagcaagaactctgaaaatggaggaagggctccaggcttctcagggtgcctgcctccctcatctctcttggcagatgaggcaaggatgacaaatcagccctagaacagcagtgatgattgatagcagtgatgaatgacagcagtgatgactgacagcaatgaatgacagcagtgttgactgacagcagtgataaatcaatgacagcagtgatgactgacagcagtggtaactgacagcagtgttgactgacagcagtgataaatgaatgacagcagtgttgactgacagcagtgataaatgaatgacagcagtgatgactgacagcagtgatgaatgacagcagtgatgactgacagtagtgatgactgataggagtgatgaatggcaacaatgatgactgactgacagctgtgatgactgacagtaatgacacgtcatgccacactgcactggggtcacacctctggaaggccactttgttgattcaacttgagtctaagacttaaatcttttaaaaacatttggggagattaactggggaaaatggaggcaacttaggcggccatacagaaaagcaacagaaagctgagtgttaaaaagagaaggtgagcacatcagatgaaagagaaggctgagggtgatctgattccatttcatggaggagctcccagataactgcttgctaatgggtttggcatttggtcagagacaggtctgcttgttggggagtgttcaggattggaaactcagggagctttcctggaaggtctgctcagggccacggtgagcatacgaggcaggggcaccagacgcggccctcagcaccaccctcagccccggacctctcctacctccccaacagcattggagagaatgtggacgatcttctcgtggggggtggccacgacgctctgtccattgatttcaatgatccggtgccccacacggacgcctcctctctcagctattccccctcgcatgaggctgcagatctgccagagtcaaaggcagagttaccctcattgcagacagtgcggtggggctggaaggccgtctttcctgaaagccccctgcccctacactctgctcttggagaaactgacatggttaggctttgggcatttaactctcttagtgtcttttcacaaaaaaataggtgccgtcggcccacatggccaccttgttcatgcggcttgcacagagactgtagcacatcactggtttttacggcacactgaattctacttctcatcccagctggggctgggtaaaaagggccatttgggtctgtcgcagagtcgccagtgtttccaaactgtcagcctgtgtgacacaggttagtgttagttcccgtagtcatgactgggactcaagcactgaagcgtttaatgccagcagactgtttttagggtcacgattgcctgagccaccatggggctggaactccactccgtgttccaaagtgtggctggctggaggggagagactccttcagagtttcccaattcagcggcccctgttcaaactcccttcccacagaaaagacagtgaggctggattttgtgatggcacagccaggtaccacagtgacccgaggttgcaggcggggctgatgcgccctccacccttacctcacacacactacaacataacttttcccaaaagagtaggtctgaatttactaagttggcttttcattccagaccatgcacctttatttaaaagtggatgcagacaagattgcaagtgacatcttgcagcaacatgctgtgtgattctgagtgtgtggcccagctgctctctcagctagtctggggtcaaaacattccttaggtgttttcccagtggacccacacatgttaacaactccttgttcgtatctgaacttttaatgcagtttaactatgaacaaagcaaacaagtacaagtacaaaccaatgaaaagatgatctcagagctaaactgtaaagagtcaccctagatcctctcctaataggcaaattaggctactcaggtacaaagaatgcaggaagtggggctggatatttcaactccaaatgggaagttcaagggtatttctaaaccttcaaatgtatttggaatgatattttaattacctaggactttttttttttttttttttttaagacagagtcttgctctgtcacctaggctggagtgcagtggcataatctctgctcactgcaacctttgcctcccgggttcaggtgatcctcctgcctcaccctcctgagtagctgggattacaggtgcccgccaccacacctggctactttttgtatttttagcagagactgggctttgccatgttggccaagctggtctcaaactcctggcctcaagtgatctgcctggcttcgccggaaggccaaggtttgaaggatcactcaaataccaaactgttcgagtcccaattgtgactgtgggaactgagccggcccctgcactgtacagccccaggcttgggagtcagctgctctgcgggactctgtgcagccagggtggacagtccagaggcaaggaggctcttggagggtgcatcccaaactctcaagctggcagccgggaaggcagtcctgcatgtcacagaaacactgggttctgggtgggaatctctgctgaagggactctgtccagagagggagctgagcctccttcatccactcatactctttcttgatggattccttcagggaacaaactggcttaaaacaaaaaaaaaaaagtcaaaggccctgggagcctgggataccagcactttgggaggcagaggcaggtggatcacaaggtcaggagttcaagaccggcctggccagtatggtgaaaccatgcctctactaaaaatacaaaaattagccgggcgtggtggcacgtgcctgtagtcccagctactcaggaggctgaggcaggagaatcccttgaacccaggaggtggaggttgcagtgagccgagatcgtgccactgtactccatcttggatgacagagcgagactccatctcaatttaaaaaaaaaaaaaaaggccatgctacatttttttaaagcattccaacagatgtttattattactaaaatgtccactttaacgtttttattattattagtatactttaagttttagggtacatgggcacaacgtgcaggtttgttacatatgtatacatgtgccatgttggtgtgctacacccattaactcgtcatttagcattaggtatatctcctaatgctatccctcccccctccccccaccccacaacagtccccagtgtgtgatgttccccttcctgtgtccatgtgttctcattgttcaattcccacctatgagtgagaacatgcagtgttggttttttgtccttgccatagttttctgagaatgatggtttctagcttcatccatgtccctacaaaggacatgaactcatccttttttatggctgcatagtattccatggtgtatatgtgccacattttcttaatctagtctatcattgttggacatttgggttggttccaagtctttgctattgtgaatagtgccacaataaacatacgtgtgcatgtgtctttgcagcagcatgatttatagtcctttgggtgtatacccagtaatgggatggctgggtcaaatggtatttctagttctagatccctgaggaatcgccacactgacttccacaatggttgaactagtttacagtcccaccaacagtgtaaaagtgttcgtatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcatcttttgagaagtgtttgttcatatccttcacccactttttgatggggttgtttttttcttgtaaatttgtttgagttcattgtagattctggatattagccctttgtcagatgagcaggttgtaaaaattttctccctttctgtaggttgcctgttcactccgatggtagtttcttttgctgtgcagaagctcttgagtttaattagatcccatttgtcaattatggcttttgttgccattgcttttggtgttttagacatgaagtacttgcccatgcctatgtcctgaatggtattgcctagggtttttatggttttaggtctaacatgtaggtctttaatccatcttgaattaattttttataaggtgtaaggaagggacccaatttcagctttctacatatggctagccagttttcccagcaccatttattaaatagggaatcctttcccccattgcttgtttttctcaggtttgtcaaagatcagacagttgtagatatgtggcattatttctgagggctctgttctgttccattggtctatatctctgtttggtaccagtaccatgctgttttggttactatagccttgtagtatagtttgaagtcaggtagcgtgatgcctccagctttgttcttttagcttaggattgacttggcaatgtgggctcttttttggttccatatgaattttaaagtagttttttccaattctgtgaagaaagtcattggtagcttgatggggatggcattgaatctataaattaccttgggcagtatggccattttcatgatattgattcttcctacccatgagcatggaatgttcttccatttctttgtatcctcctttatttccttgagcagtggtttgtagttctccttgaagaggtccttcacatcccttgtaagttggattcctaggtattgtattctctttgaagcaattgtgaatgggagttcactcatgatttggctctctgtttgttgttggtgtataagaatgcttgtgatttttgcacattgattttgtatcctgagactttgctgaagttgcttatcagcttaaggagattttgggctgagacagtggggttttctagatatacaatcatgtcatctgcaaacagggataatttgacttcctcttttcctaattgaatgccctttatttccttctcctgcctaattgccctggccagaacttccaaaactatgttgaataggagtggtgagagagggcatccctgtcttgtgccagttttcaaagggaatgcttccagtttttgtccattcggtatgatattggctgtgggtttgtcatagatagctcttattattttgagatacatcccatcaatacctaatttattgagagttttttagcatgaagcgttgttgaattttgtcaaaggccttttctgcatctattgagataatcatatggtttttgtctttggttctgtttatatgatggattatgttaattgatttttgtatgttgaaccagccttgcatcccagggatgaagcccacttgatcatggtggataagctttttgatgtgttgctggattcagtttgccagtattttattgaggatttttgcatcaatgttcatcaacgatattggtctaaaattatcttttttggttgtgtctctgcccggctttggtatcagaatgatgctggcctcataaaatgagttagggaggattccctctttttctattgattggaatagtttcagaaggaatgctaccagctcctccttgtacctctggtagaattcggctgtgaatccatctggtcctggactctttttggttggtaagctattaattattggctcaatttcagagcctgttattggtctattcagagattcaacttcttcctggtttagtcttgggagggtgtatgtgttgaggaatttatccatttcttctagattttctagtttatttgagtagaggtgtttatagtattctctgatggtagtttgtatttctgtgggatcattggtgatatcccctttgtcattttttattgcgtctatttgattcttctctcttttcttctttattagtcttgctagcggtctatcaattttgttgatcttttcaaaaaaccagctcctggattcattgattttttgaagggttttttgtgtctctatttccttcagttctgctctgatctgagttatttcttgccttctgctagcttttgaatgtgtttgctcttgcttctctagttctttcaattgtgatgttagggtgtcaattttagatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagtggttttgagtgagtttcttaatcctgagttctagtttgattgcactgtggtctgagagacagtttgttataatttctgttcttttacatttgctgaggagtgctttacttccaactatgtggtcaattttggaataggtgtggggtggtgctgaaaagaatgtatattctgttgatttggggtggagagttctgtagatgtctgttaggtccgctttgtgcagagctgagttcaattcctggatatccttgttaactttctgtctcattgatctgtgtaatgttgacaatggggtgttaaaatctcccattattattgtgtgtgagtctaagtctctttgtaggtcactaaggacttgctttatgaatctgggtgctcctgtattgggtgcatgtatatttaggagtgttagttcttcttgttgaattgatccctttaccattatgtaatggccttctttgtctcttttgatctttgttggtttaaagtctgttttatccgatactaggattgaaacccctgcctttttttgttttccgtttgcttggtagatcttcctccatccctttattttgagcctatgtgtgtctctgcacatgagattggtttcctgaatacagcacatggatgggtcttgactctttatccaatttgccagtctgtgccttttaattggagcatttagcccatttacatttaaggttagtattgttatgtgtgaatttgatcctgtcattatgatgttagctggttattttgctcgttagttgatgcagttttttcctagcctcgatggtctttacaatttggcatgtttttgcagtggctgttactggttattcctttccatgtttagtgcttccttcaggagctgttttacagcaggtctggtggtgacaaaaatctctcagcatttgcttgtctgtaatgtactttatttctccttcacttatgaagtttagtttggctggatatgaaattctggcttgaaaattcttttctttaagaatgttgaatattggccccactctcttctggcttgtagagtttctgccaagagatccgctgttagtctgatgggcttccctttgtgggtaacctgacctttctctctggctgcccttaacgttttttccttcatttcaactttggtgaatctgacaattatgtgtcttggagttctcttctcgaggagtatctttgtggcgttctctgtatttcctgaatttgaatgttggtctgccttgctagattggggaaattctcctggataatatcctgcagagtgttttccaacttggttccattctccccgtcactttcaggtacaccaatcagacgtagatttggtcttttcacatagtcccatatttcttggaggctttgttcctatctatctatctttttattcttttttctctaaaatcctctttatgcttcatttcattcatttcatcttccattgctgataccctttcttccagttgatcacatcggttactgaggcttgtgcatttgtcacattcttgtagtgtggttttcagctccatcaggtcctttaaggacttctctgcattggttattctagttatccattcgtctaattttttttcaaagtttttcacttctttgccattggtttgaacttcctcctttagctcagagtagtttgatcttctgaagccttcttctctcaactcgtcaaagtcattctccatccagctttgttccgttgctggtaaggagctgtgttcctttgcaggaggagaggtgctctggtttgtagagtttctggtttttctgctctgttttttccccatctttgtggttttatctacctttggtctttgatgatgctgacgtacagatgggtttttggtttggatgtcctttctgtttgttagttttccttctaacagtcaggaccctcagctgcaggtctgttggagtttactggaggtccactccagaccctgtttgcctgggtatcagcagcagtggctgcagaacagcggatattggtgaaccgcaaatgctgctgcctgatcgttcctctggaagttttgtctcagaggagtacccggctgtgtgaggtgtcagtctgctcctactggggggtgcctcccagttaggctactcaggggtcagggacacacttcaggaggcagtctgcccattctcagatctcaagctgtgtgctgggagaaccactactctcttcaaagctgtcagacagggacatttaagtctgtagaggttactgctgccttttgtttgtctgtgccctgcccccagaggtggagcctacagaggcaggcaggcctccttgagctgtagtgggctccaccccgttcgagcttccccgctgctttgtttacctactcaagcctgggcaatggtgggtgcccctcccccagcctcgctgccaccttgcagtttgatctcagactgctgtgctagcaatgagtgaggctccatgggcgtaggaccctccgagccaggtgtggggtataatctcctggtgtgccgtttgttatgcccattggaaaagtgcagtattagggtgggagtgacccgattttccaggtgctgtctgtcacccctttctttgactaggaaagggaattccctgaccccttgcgcttcccgggtgaggcgatgccttgtcctgcttcagctcttgcacagtgcgctgcacccactgtcctgcacccactgaccggcactccccagtgagatgaacctggtacctcagttggaaatgcagaaattacccgtcttctgcatcactcacgctgggagttgtagactggagctgttcctatttagccatcttggctccacccccccagccatgctacatttttatttgtcaacattgtggaaaagggtgtggaaggtgttctacttacaattccattctggacgctgaaaccgagctggtagcgaaggtctggtcttctgattaacacggtggtcaccggaggacatctcacgatattcagcttgactcgggactgattctttaagcccttaaacatgaataaagtacagtgggtatggtgaccactgaggcagacagaataaacaaaagcaggcagcaccaaaggcaaaagaagctgcactgagtcttccgaaggacccactgcctgcttgcctgcaggcctctggtgcctgggctggtacagtcactgctcggcttcacctacccagggctaagacgccacatgttgcagatggagccctcttagcccacgcacagatggggttcctgtgggcaatgccttccttttgggaagtgggctgggttcaagggatctgatcaaagtacttgtgcaactatgaggaagtatcagatgtcctttttggcttcaaagatgaaggaggcacactatttcccccagccaggagcaacatgagtgggaaatggacttttcttctgaaaggcaaactctagcaatgactcctcttctaacaaaggacatctaactcacagcaactggcctgattcatcatggctcttttctcttgtctctgatgctcctctttccccttctttctgccagttagagattttatagctgtcaacattcccacagcaaccagggactccaatcagtgtgtgcctccttgggagaatggggagggttgtaggatgggtgttgatggagaaggaagaggaagaaatacgacttgcagactgttgtttcatgatccctgatgacacacctctccctctaaattaaaatggagcgtagagggaaagctgatcttcgactataaaaaggaactagtttcagagactatgtagaaagcttccacctctgtgtggtctgagctgagctcaggctcctgctcctgtcccctgatcagactcacagcagtgacagaagccctggtgtgctcagaagcatctttagaaaaccatcacaaggctacacttgccctctgctgggtggtgggaaggtttgctcctgcaggcctgaccactgacttgtcagcttcaccctagaggagggtgccaggcaaaaggaactcagccctgaaacaaatgtccacttccagtctccccagggtgcctgctgtgcctcaacaaactcctcattgccacatggaggagaaggaatggctgatagcaggtgccttcccacccctttcaagtcatggtatgcaggaggatcatgtttgcatgctggggtaaacagaccacactgttgtagctgcaggccctgcagcccctggccctgctataagagctgaggcagcgggggtcatagccctcagtgggaagcacctgcccaactggactcccatctataaggccagctgcctgggaaaccgctcaagttcagccccaggcccactactccaaagggaactgtggggtgggtgggaggagaggtgggtaacttttcctgcaggagagaacagctaccagggaatgaggagggactcagggaaaaggcaagctctgttctatccaagcccacagtatcgctcagagacagcacctgctcagttcacaagtgagtgggtccagtttgcgccctctacgagtgaagtggaaagaggacctgtaaagaacagtgacaaatccaagaaaagcatgcatgaagggtgatcgtctgcctcttattctataaatagaattctgtaaattccacagccactactgctgtcactccttgaccagtctaccaaatctttttcagtgcgaggtcaggacttacatttcacattttaaagatgaagacatagacacagattgctttgtccaagggctctgtggggtcaggactggaactatggatccctgctcaggtaccctgcctggcagaggcgtgaaactggtgttagacaacttcactgcaaacagaatctgtagcaagagtgcttcttggagtggcagaaatgacctataccccttttgtatctgagttacaggatatgctttagattgagggagaggtaggggctattttgcctctggttatccagctttactatgcttggccagcaggtgtacaccaatggctcttaaaccccacacagcagcagcagcagcccctggccactttttagaagtgcagattctgggctctacccaagccccactgaatcagaaaacctaggggtgggacccaggaatctgtggatgacaaatctcccagatgattcaggtgcacgctcaattttgcgaacaactgttgtggactactactgcagaacaatgaatgacctcatctgcatccaggtggcttaatttctccatggatgattacacccaaagatgtcaatttactagtcacacctgcagccagtgtgctcagtgagagcaggcgctggcaagggtggggtgagggtgacatcttgtgggaaattttgtttgcccagtcactatacagctgacccctgttcagccatctgcatgtctatgtcatgcaggaacacccctaagatcactgctgcatcaaaacccaccctgatgatgaaactaattgaaccaaaatgactgtaactacctgtcattgaacactcactgttatctggcattaacctggaaaggacaggagctgtctcatttaatgtggctgtaattatttctatattatagaagaggaaactgaggctcagagattttaaatgactcactcacattcacacacagcaagattcaatcctatgtctgtccgcattcaaaacgcacagtatttctacaccataatgccccatatacacaaccagagagggtgtgtcttttgtgaataaggcttgctccacaaagacaacagggtcagccacagaacaaatctgtgtccccaaattccagccttgaattggggccatctttttagttcattttcctacgtggcaagagtttttcggggttcctggtcctcataatcccccaccccctggcttccccactgacttctgcttctagtttgtgctcctaatgtgtgaattttgatggaactcaatttccccgccgtcagcatctgctccccccgtgctctgaattcctctgctttctgcaggacttgagcctccccatggctgtcactcagcttgtggcctcgatgtaccatgcgacttagcattcacattcatgtggcatctcctggtggttttggaacatctccagggaactgctctggttaaggaaatgattccaaagcacagcaatggaatgagtgtgattctccctggggaaatgaacatctgtgaaggatccaggccttccatatgcggcagatcccatcgtccccatcgacaaagggagatgctctggccttctgctcctatcaataggaccagcacagcctggtgaagaggactcttgtggtgtcagaaaacctgaactcaagttttgtttctgctaccccaagcagtgggatctgaagccctttgctggcccttctcccacctcaatttcctcatcttcacaacaaatggtgaagctcactaatgtctctggcagtcctaatttcaatgattgcaccccctttaatgtgtttattcctaaatgtctttgcctttaacaccaaatctcaaccattatgcttaaacctattcctaaaatttaaagtgggcttcttttgtggggctaggaggtacggtggagagcagctcagacattcatgcagatatttttatctgctttgagtgcttcctcctttccatccacctaatcaataaatatttacgaatcacttgtcatgtgccaagaaatgtgttaggcactggagattcagggaagcgcaccctctccggggctggataagagacattatcagtactaagcacagggctctgagcccagagggggctggagtcccttcacccttttctctctaatcacacaccaggagaccaggaatttgtgggaaagaagagagatgaatgatgaagacaggagcatgttgttggaatctcaacccttcaggcaaagccacctgctttaaatgtttacgcctattaaccactgagattatttaggtatgcttgtgtgatacagaaaatgttacccaacataccgaaaagcaagagaatgactctattttctcaatgttgcctaaaaaattcatattgctctggtgggttctttccggttctttccttctctgtgaattgatttgggatgcctgatctgtccctcagtgaaaaattttctagattggggaaaatgtgttgcaagatgaagcttagagaaatagcaatttgaaataacgagaccatgcatttgctctgctgttcctaatcaatgtttcatgttgggtcccattaacttggatttctgagctgccattttattggaggtgccaattaaataaagggtcatttggtccccatgacaacagtggaacggtacagcaaattaagaaatctggtgggaggggaagcccagagaagaggggcgaagagagaaaagagaagccagaatggtctctatagcaacgggagagcagaaccatgatgctcctggggaagcaagggaagctgtgcgctattctaaaacagagcaaaaacccagagggcaggaccacagaggcaaaggcacagaaagaggcagcctgtaaaatgttccacccaccaataattatgccttgggaattaattatgacccaaaaaataaggtaggaagagtaaggcaagtcaatacctataattctactctagaaattgatttcctgtaacctggggggacaatagtcaaccagtattgaagtggccagatgcagaatgcacactttggatccctgttcctgaaagtgtagcctgcagactggtgatgccatccccgccgcaaagcctgccaaaaatgcagaattccaccctatacctgctgaatcagacctgcattctaacaagatccccaggtgattccaatcagtttgagaagcactgattcatcaggatgagagttgcttgtcaaagtcactgcaaagagcatggacatacactgaaacaaatttgaacacagccttgaagtggtccagatgctgctctgcagtggcccgaggggtgggggtagggcagtgtgcacatctgtccaggtgcaggcaaaaaggggtgtgttttctagagaattttaaaaaggtgatacgacccactgatgtcagtctgtatttggtactggtgattctggctgttatcagtggttacacctcccaccagccagggtggtccacggacggaccatcacatttccccattcaacaagcggcgcactgtggcagggaggaagttcagctgtgctctaatcggggtctgccctgctaagtacttcttcactatgggtggccacgaaagcactgcttttcttttcttactcttcatcttcatcagttacatctcttttatcaccactcggccttttaattttctggttctatagagattacatttatagacatcaaagttcagctcctcaaacaatccatttccccttaggaaactgtgcagacagagctccgtctgtactccagcaagctttgcttccaccttgatgctgtggcagctgcagagggagtcaggctgccctcatagcctcactgcttccctcctctggtccccacgcagataaggaaggagcgattcgcaggagggtggggactcactggccagctgggggccctgggcaagtctcctgtgcctttagagtctctgatggcccatctgtgcacctagcatctgctgtcccccttgtgggctgtcctgaggaggaaaggaggtgactccaggccatgagctggagtcttaagggcctcaggaagcgcggcttgttcctgcccaggccccatccccacctttacttaagtcctccccttgtctgagtctgttcttagtctgccatgacaaagtaccacagactaggtggcttataaacaacaggcatttatccctcacagttctggaggctggaagtctgagctcagcgtaccagcactgtcaggttctggcaagagccccttctgagttgcagatggccaacttctagcatcttcacataccaaaagagagcttgctggggtcccttttttaagggcactaatcccaaccatgagggctccaccctcctgctaatcacttcctaaaggctccacctccaaataacatcacattgggattagggtttcaatatgtatttggagggaacacaaatattactcaatactttacttaaccccctatccccgctcctcctccccaacccttctagactcagaccaactccccacaaaccatccctaaccagcttccctctctcatcgatttctctctcttgcatctgaactcctatgccgctcaggcagtttctcaacctcagcactacctacatttggggctggataactctgtgctgtggggctgtcctgtgcattgtaggatgtttgacagtatccctggcctctacccactggatgctggcagcaccttctcctccgtgacaacccaaacagtctccatacattttgggggatgaagatcacccctggctgagaagtactgccccatggtctggccttgggcctagcatttcacctgacaccctccctgggatgactctgtattggaggctgtatgaccacagacgattacatcatcttgctgtgcctcagcttcctagcttgtacaatgggtacaaaatagtacctgcccacagaatgctgccccgaaggctcagcaagtcagtccacacatattctcagagcatccagagcacagacacacagcactgagcactgtgagccataagtcctttcacttctcctcaaaccgaccaagctccctggggggcagggactgtgtccacggggcccctgggtcccacagcccctcagcagttctcatgcatgcacccaaggtgtttaataagcaacttgctcactggcaggagcgacttgtggtcctgcctccctagccccacccccccgcttgcctctccatgcaatcacagcaacaccagaccagccgttccgggccaggctcagaccccatctctccctgactcaacaccggcccctgtccatcaattcaagcagaaacttccaaacgccacttccctttctgctacctacctaggttttattccttcaaggtcaactttaaaatcacataaaattgtccatctaatcacttgtagcctctcacctttatgttggccgcagagcccttgcacgtctctaattatcctgcacatgcacactggcaagccagcttcctcagagcgcagctcagtgcctcacagaggcccaattaaacctttctgaatgaatatccatgttcaaagttgattctctaatcttacctttaacgtgtattaagcaagaggtagaatttatttaagtataagatataagaaaaagaaattaaaggaggccaaagaggactatttctttccagatgtgattatcttatgtgaaattagaatttactccatttcattaaaaacaaaaagtcaccatccatgtgtcctatacactcaccttcacctcccacccccacccccttagctgaggaggctggctttgtgatttttcttttgctcacaatgactatttgcacgaattaatccccttccttctccctctctctcacacatgcacatacgcacacagctatgttccagctaagtctttcaggaaacccctacaggaccccaaaaaacgctgtggaatctcagtctagctacagtaccgcagcacttggtgcagagctactggggtctacagatgccatcatggaggaggaacatcctggtcacactggccatgcattcagcaagtcccaatgtgctcaaaaaactccacatgaatgcttcatgtctaaagaaaatctcatttcttctcaagtattcacatttaattttcctttaagtagctcttcttagctttataagcatcagttcaggttgagcaggaagtatgctcaggtatgaaaaagcttccatggactggaagagagtttcctcctccttctggcaatgagcacatgtgagttgctttacccggggtctgagggaggacaaactcacctgcatcatagtcagggccactgggaaggaaaaagcactctcagatttgaagcatttctgacatttttgacagggatggtaaatcatgccaagtgtatctggctgactataagtgactgtctggattcccaagctgaggccatttctgttgaggctgagtctgggcttagtgggagaatgctgtgattgactagtgatgctgtgatggacatgctgctatcagaaagtagtgtcatgtgaaccaaatacacttcccctaatctaaattgatttcagggaagaatctgtaaacagtaacttgatggtaagcttcctgagtgcaagtccacgccttttgtgtttgtgtcttccttggtgcctgacactttgaatatgttcatatacattaatgactggatgggggtcacacttcacatcacttgaggtttaccacatcaactgatttttcccatattcaggtaccttaataatgctctggcaggtggacagaggcaggcccaccaggctggtgccattaatggacatgatctggtcaccgatattcagcttcccagatttctccgcagggccaccatgcatcatgttggcaatgatcacggtggggaggatggatccccagccagactccacaatcaccacacctaggatttctcctttctgcttctctatgaaaacctggaaggagaaaaacatttagaaaacctccatcagtgaccatctggggtaggtagaaatgaaagcctctcccccattcctgtcttgcctaaagaaagacacttccctggggacaccaacccagatgagttcctgtcttctcagcattccgcatatttggagtttttaagaaatgaattcacacaggtctacactcttttgtaattcactcgtttcacataagcaaacttgcctcagcacacaaccatgaggaccaccagttttttttttttttttttttttttttaatttcttcagtcctgtcctcagtggcaggggatgaggctctgtgggtgggtggtgtgttatggtttctagaaatagcttttcaaattccatgcgcaggttccccctcccacagtgcttccccaattcgctccgacatttaattttcttgagttaaaaataaataaacacacagaaacacttctctgcaaggaaaaagttgagaaaaaagaaaaagtgatgctgaagttatcacaaccaaaaggctgggtgtgcacacaggaagtgcatatcctggatacacagacttttcacaaccttcactggcagggcagagaagacaggggttgatgttggatacttgcactctggggaggcctgcagatatgccactaaaaggtaccacacctcttggaagcacccaacagagtgtgtatgtgtatttttggggggcttgacaaagtccccttcacaggttggtgtctgcttcccccagctgctgaagcttacagtcagccccttccctggagaactgtccttagctgaaagggagacacattctgttaaggttgaattgtgtccccccaaaatttgtatgttgaattaccaacccccagtgcctttgacttagattgtgactttatttggagataaggtcttagcagaggtaaccaattttaaatgaggtgattaatatggactctaatccaatattactcatgtccttatttaagaagaggaatggttgtctgtcatgggtatcaaaaaaaaaaagaggaaatttggacatagggacatgcatggagaaaggctgatgtgaagacacagcatgaagacagccatctacaagccagagaaaggcttggaacagattcttctctcacggctctcagaaggaaccaatgctaacaacaccttgcttttggacttctggccacaaggtctgtgagacaataggtttgtgttgttgaagtcacccagtccatggtactttgtgacaacagccctagtaaattcatataccccctgtccagccttggccaataaccggcatggggtacaaaggcttgccagctccctcgctccaaggtgagacaaatctgtcctgcaatatgtgccatggagcttccctctggacagaaggaagctcatgtccaagggaccacacccttacttggtgtcccaccaccaagcttcccacatcccttctgttctgaggcactctcccaacaaacctctgtgacaagaatccctgcctcaggctctgcttctggggaatctgacctaagacacctgacagaccccagtggatcaaatgatcactttctcattaaaagttctttttacctatgggatcaagtccaaacccctcagctggacttgcaggccctccagttctgacccagatctcaggcccatctatctcctttcctgtgcctacctcctgctctagccaaaccgtatttcctcattccctagacaaatgtggagctttctgatctccaggcttccaaccattccatagaccccaccctcggcttgcccctacaatccccagatcgccagaccagcttggatagcctcatcttcctacaggcattcctgaatagctcagtttgaagccacaggccatccccagagaagcacagcacctcttgtctgaaacttgagatcttctctgtttgtccaagtgtagttggttttgattagtgcctgtacctggcaccatcatttaactttttcagtgcccttacctagattgcagtgtttgtacaagcagagttcaggtcctatctgcctctgggacccacccaaaacttagctcaggatgaccaggagcagaggatgtgctgcctctctgtttacacctgtccacaatagcatttcatgacagggccccacagcagggagcgagagatgggggtgaacgacttcatgatgtcctgccaatacggcactcctcaccattgatctcccttcacttccgcggcagggtgccccactttccaagcccctgcccagctgacccagcctggagaacagcttcaggtaagtacccacatctttacagttttccgacttggagaagtggatcaggtcatcgttgtacatgtcctgggtattgagcaggtcactatactccttctggctgagatcttcggggttaatcccattggccctgaggaattcctggtatgccacgctaaatgcctgtccgatggactgtgcaatcagctgagcctggaacagcagccagagaggaaagatggtcagcagggcagtgcacctggtgagcggcctggcgcacttcccacctgaacaatggccctcctggagtctgaggaaaccctagacatcacgcctgctgggccagtggttctacgtggggctaccagtgcccaccaggggcaattttcagaaagactggggatgtttttgattatgacaatgatcataagggagctaccggcattcagcagacaggagtcagagatgctgaatatcctgccatgcaaaaaacagctcgatacagtgatgagtcattctataccctgcaccatcttcacagatccctctggacattcatgtgcatgcaatacttgtttacagttacctgagtccaggattcaactccaatttatacataaacacaaagactttgtatggctctaatacacatcgaacatttcaagaataataccgtctgaattgagagatgatgttattttgcttcattcagtacttcaccaggaggaaacttcatgactttggaaaatcaacatcagcgctgctgtgatatctgtgttgccgataaatcacatccctatcaacctgcacgtgtgctgtcatgcatggtgattatgcatgtgcttgtagatacatacatattatttggccctcaatttgaaatgtcaactggaaagtttatgatatcccactgcacactgcgttctcctacatccaagcttaatcaagtaggcataagcatctcactatctcattatgcctttcagaatggttgcgccagagcatttattaatacatattgtaatatggttttattttagtttgctttccacttatctttcctttatattatatttatggccacaatttgattattctgtgaaagatttttcaataggggaggttatattagctatgaatttcatttcaggatagtaatgggtcattaataagatatttattgtagaaagggagggttgggtctaacagagttgagaactctgactggtccaaccctgcattttccagttgaggagatggaggcccagagacacaaaggaacctctcaaattcacacagcttgcaggaggtggcactggcttctacactgggttttgatagcttttccctgcattaattaagcaacattattaatccagacagccaagagcaactgagcacttctcatgtggctatgctgcagtaaatgctatacaaggtatatgctatgaaaagtaaatgctatacaaggaccatcactgaatctgcatatcgattctatgacagctattagtatgactggtccacaatccttcacttggaatgcaagaggctctgcttcagaattcaaaacttttccaattttagaaaggtagcagggtgcaaatactgtacattgtgccataaccccctgacggtctggggaagtacacagagcacagtaacatttctgtggcaaaatctgtaagattcatggtaagctagacaaattctataaacggcctgccagcaggcaaggcaagtttatcagccacctgacttcaaaaatcccttttgtttctcagagctttctagactttggaactatggatctgtattagtgtccccactgggtagaacaggatatggaggttgaggggttaaactgcacacttcctgagaaggggctgggggctgaatccagagcccatcctcctgcccaccacactggaaggcttctctgtgaaattctgatgggcagaaaaagccaaaccagaaaatctctagagcggtgttttaaaaacacaattctaacctccactgctctttccccacctttcctaaaagcaccttattaacagcaaaatgggaactttccgtgtggctggctatgggaaaagaaatacttaacttttctcactgttagaatctgatgactttacaaatcacatcaagaactaccaccatctacctattgtaaaactggaaggagtaaggcattgcttttggcatcagagaggtacatgcagacaaactgaaaaatatatacctgggaatgtgaccagtcgacttcctgatcatcattagtggatgcccctggtgaatacactggctactgagatttatggaccactagccatgtgccacacatcaggctttaactgcaatatctatgagagtgccacagcagcctggtgagggaggtactatcgtcctgcagaagaggaacttgaggcttagtggctgcacagcttggatgaggaaggactcaagctcagcttgcccaattctggagccagcacactctggccctgctctagtgaaagcaaaggggtaagattctcaggtccactcttgcctacctcttgcttctccaatctttcctttcttccctgatggatccaagggtaccccaaggagaagaaacccctccctatgagctccagccagatggaggtagcagcggggcctacagggatcctcgatccctgtaacttcatcttttcgctggcctgcaggacacaggaggcttaaaagtccaaattttcactcttttggaactttctgagaacctcctaaaactcattttccccgtttgcatgttggcctcagctttacaggaacagtagggagaatggcaggcagaggtatttcaagctctctgttctcccagtgaccttgtcctgtgctgctttctagagaacaagaccaataaaagatggtgacagtaagtgttggcatctcctcctctctgtgcccacagccacgacagctctggttccccggagaaaaaagcaggatggctgctgacacctaacttccgagaggaaggcaatttctgcagctagacgaatgctgtactggagaagaagggcctctttgaaggaaccaaggctatcagacgccatcttctcttcccagatcaggactccgtgctccatgtgagaaacagagcctattcctctgtgtcaggaggaaaaatgagcacagtcaaaagcaatggccctcagggggtgggtgagttttctgctattaaaaattactatagggctgtggcctcccctgggaggcggcttctgaggactgctgaggcccaggatggtgcggggaggtaggggagcacctgggagcagcttagttcaggctgcagtttgcagcctggtggcctcactagcagcttgggttacaaccctgaaagtaggccaaatgacagaatggcttctgttgtaaacaaattttctctgttgactgcatcacccagagaaatggagcttaggaaccactggctttgtgccaggaaaaggagctggttttcctaaggactggggtgggcagtgctcctgctgtttgctggggagggacagggatgctaactttcctgtagcccagaggatggtcctggaccacaaagaactgtcctcccaaaatgccctcatgcttggacagacctgctcaaacccctacaggaggtgccaaattcttcctactcttcacctcatcccaaagtcgctaatagcttggcctcctttcccttcctcaaagggaaacgcagctagcccctgcctcagggccttcgcatttgctccttcctctttctcactttattcaggtctctgctccaaggtcacctcctcaagtgagggctttgttgatcaccctacctgacatagcccctgtccctccatcccctgaccctgttttatttgtctgtggagcactccccactacccaattttacattaagtatatttacctattgattttctgcctcctttcagcccttgcgatgagtaccctgtctgttttactcagccttatatctctagtgctggaacagtgcctgacacacagtacgtgcacaataaatacatgcatcatgtgtgatgaattagactgaatcaggttctgagaagtcaagagaacctaacccaaaaggagatcaaaggaagcaacccttacatcctcagactcgaagacgtggcagatcatcttgtactgccttttcccatcctgggatgggtgggacgcttccacgttctcctgggagttggagcgaggcatccgccggcgggccatcagcacaacgatgttcccaatgtccgcaatgtaggaaatggtcctcagagggtggtccatcattgtctcctggaggcaggaagagagggcgggtaagtccagctcagcatctaatgacctaagaaagcgcctgccaccttacagccagtcaagtatggttcgcatgcagggtgggctccagggctcactgcaaagcccatgctgagggatcaacggatacccacccaggccggagggcatttcccttagctaatcaagagcaggaaatgatctgtggcaggtgaaaagaaataagaaattccaaacagttgaatctcttgtggagaagtttaaaaaaaaaaaagacaaatcaaaatggcagggctgtttctgtttttgtgtgcgtgaatgtaagagattttaaataaaatttcttaaaagacaaatttgttcacattaatgaattctctgattaaaatttctgaaaatgctaaacgtcatccatgtcttaggggtgtttttgggctttaagaaagcaatcccaaaccccacccagcagcaggcactgtgaacaccaccttctagctcactggggcccagaatctagggacagctgctctacagacacatgcctgctctacagacacatgcatctctgagttacgatgtcactaagcttcaccctgggaaaggtggaagccagctgatacctgtgtgtcggcgttcagcactttgattctctgggtagaaatgaagagatccacttcagtcattggctgagattcgccttcaggagcctgagaagaaaaaatgcaccaagagaaagtttgaccacactaccctgacccagatgcagaaggagtaaggttagctcacacagaggcaccacgacacagtcaccagaacagcaatacagactctagggttaaactgccaaagctgaagttaccacacagaggatggacacatggacaagagttagcacctctaggttacagggaaaaatgcggaatccccttttcttcttcccctatagaagcagtaactcactgcagtagatttcactctttgaacgatgatggcaagtggccctctctgtaagggttttggagcccaacagattgaagaaataggccaaaaagctcataccaaaagaccttggggaagtcacttagaatttgcctctgcttgagctgataggagacaatgtttatagcagctgcaaatgaagccatttggatgcagttctggtaagagggtctttatgtttacatatcacccagcaacacagaagcagtcctgaagccaccccattaagaaagagccccaatgcctcaacgtcccaggagtagtagctcataagcacctagaagctccacaaccaaaaagcgcagtctggttcatttagggcttaactctgtacatgtgtggttattagcgagttttcttttttgcatccagcaatctgacaaatccacaaatcaagcataactataatcaaacagactcaagtccctgccacatcgatgctcctgaatgtttggaacttccatactactatacgattcattcagcgtctccaatctgctccctgtcgttcctctgaagtgaaatgactaatgagcaacagaaaacggccaccttcggcaactgagttttgagaaacgctggcttatggggcggttcaaaaagaaatctgaacaaaaacttgctggatgcagaaaacaaaaacacgaaaatataaaaaggtaaaacagaaacgaatgaaaagaacaggcataacaccaagctgatgaagttgtttgtactgcaccttcttcctgcttttggctaatttctgggccatctgcttagcatggaacaaacagagacaggagaatagttagaaagaatgtgtagagactcaaagtcaaaaagggaattgacaaactaatactgaatagtggcataaagcgtttctgtgggaggaggactggcttttaaaaatcccagtctaaagataatcaatgtcgtaattcagaatttagtatgtgggaagtggtgaagtgagacaaaggaaatgtgttgcagtgcttcttatacttaattgcaagtgatctttccaaataaccaagttttggttctgttaattttctttattgtacgcctggttttctatttcactgatttcagcatagatctttatttccttctactttctttgggtttaatttgctgacttctcagcttcctgagataaaaacttaaattatggcttttcaaactttattctgatatgcaaagctatgaatctccctctaagcattgctttggatgtattccacagatttttgtgtttcaatttaatcattgttccgttaaattttttttcaaatttccactgcaatttcttagaaccttggattatttggaattgtattattaattttgatacatttggggattttctagttatcttttcttttctttttttttttttctgagatggagttttgctcttgttgcccaggctggagtgcaatggcatgatcttggctcaccgcaacctctgcctcccaggatcaagagattctcctgcctcagcctcccgagtagctgggattataggcatgcgccaccacgcctggctagtttttgtattttttagtagagatggggtttctccatgttggccagcctggtctcaaatgatctcaggtgatccatctgcctcagcctcccaaagtgctgggattacaggcgcgagccaccgcgcctggcctctagttatctttttctgctgattttggaattaattccactgtggtcagagaacacagtctgtatgtcaatcttttgaaatatgctgaggcttagctctatggtccagcacatgactgcctttggtggatgtgtcatgtgcacttcaaaatatgcattccgtagttgttagggacagtgttcaatcaatgacaattaggtcaattaaggtggttaacagtattgttcaaaccttctatatacttgctggttctttaatctcttgttccatcatttattgagtgtgttaaaacctccagctgttatgtggatttgtctgtgtatcctgattctgtcaatctttatcttacagctatgttataaggtgcacacacaggtaggatggtatacctgcttggtaaattgatcctttcattgttctccctttttatctccagtaatacttcttgccttaaatttatgtaatattaatgtagtttacacctaactaaaaatggatgtaccattctcccttttgctcacaattaaaagacagcatagttgataaaagcagagcgtggggctggattgtctaaaaccaagtcctggctctgccacttactagctgtgcaactttgaggcaagccactgaacatctctgtgcctcagtttcttcatctgtaaagtgaagataaaaatagtatctacctcacagggatattttgaggacaaaatgaatacatgcaaagctcttcaaacagtgcctcatacattctaagcactatatttgtgtttgctgttatatgattataattgacctaggtcatgatgcaatttcttgccttttgctaagacttgctatttatacagatcttgtacaaataatggcaagtcaatggccaaactgcagacgctattgtggtaatgggattggggtggaggaagaactgctctctcatattcctgggtactcacctggtagaaaagctcctctgctctcagcagcacatctctgtttcattagtgactaaaatatgttgcctatactacctcattgtagagaaactggataagtcagccatccagacaccacatagcgaatctctggtacacccgggaaaccagggcaaccacactcccacacagatgccctgctgttcttactggtcgccatgagttcacagtgaatagtctgctctgaaaaagtttgaaggtagcaactctgtcatcctgactgctgcacattacagtgggaatagttctgcatctgagaagtgaccctatgctgatgttatgccatgccacaccacgaggattcccgtgtggaaccccagagtctggccagggatgttcggactggcatcagttataatctgcataactgacagctgggagatctttaatgtttgttttttacttctcctgaaatgatatggcagtaatataggaatttccattactttggatcccaaaccctaacagctgttggtcaaaattcttcaactctagggaaccgatttgaaataactctttcaaaaggaaataggttccaccatcactggagtacccaaattcttttttttttttttctgggactggtgttgaggaagaggatccaaaaggcaaactgagtttcatgaaaggtattctgaaactttttttttttgagacagagtctcgctctatcacccaggctagagtgcagtggtgccaactcagcttactgcaacctccgcctcccaggttcaagcaattctcgtgcctcagcctcctgagcagctgggattacaggcatgtgccaccacacccagctaatttttgtatttttcagtagcgacggggtttcaccatgttgaccaggctgatttcaaactcctgacctcaggtcatccacccgccttggcctcccatagtgctgggagtacaggcgtgagccactgtgcctggcccgaaacagtttttatgaagttaaaaatattctgtggatttagagtaataccatctttaaatcactcatgatatccaagtaccctgcaacaaattataatttaaaatttaaatataacatcacagaagatgggagagttggagccagaatgagaaattagggtagcagaaaggggtccaagagaaacataaggccagcatgcattttaaagccaggaatgacaacatctatttaaaccctcgtgtttcatgggattgatcatggtttaccacgtggcggggtgtagtgcaaaggacaaactgcagcaccccccacccccttactccatccacaatgtgtactgagtttctgccgctgttaacacactctagattagtcgtgccagggatgctcctgactgttctatcttttctctccccactgacatttactgagaacttgctatgtgccagaatccttcaaagtatttcacataaatcagtgtaaaagcttacaacacccctgtgagctactaccctgctagatggtaagccatgatcaatcccatgaaacacgaggtttaagtagatgttgtcatttctgcctatattatgttatcctcatttttcagaagagggaaatgtggcacagagaggctaattaacttgccccaggtcacacagctgtgaagtggcagaatagagattcaaactctggcaatctcactccattgtaaacccctagttgtgcaactggggcaagcatgtcatctgtaaacttctccatttgtctataccatggggttaacaacacctacctcacaatgttctctaccccatccattttgaggagtaaatgagattgagataatgcatgtgaagggcctaatactttactgatcatagatttcttcaactaagctgggaaatgctacaacttaggcaaagctataatgatagacattttacttctacaatgaaatcataattttgagaaaatcataaaagaatgaaaaaaatctgatctttgggacaggctagttaagatgaatatatgaatatttgataatgaatgcagcttgccaaaatgcatggaccacaagatacctatacaccatttgtaatctaatctaattgcattagcttcacaaatacaggaagaatggagacacaaacaccacactctgggtggatggacatgaagcagtctctgtggttcaggtagggctcagcaggccaccctatcttctggttgaagagcagagaatgaagtgggaatgagagtggaaggcaaggtggagatgcagtggagaacaaggaagacaaatgagctcattgtgctggcttccagtctggctttctctagaaaggggtaggcatgagtcccacgttgttaggggagagatgtgtttctatctacggcacattaaagactgacagcacataggacaaagctctctctagaagtttctcccaaaacatgttccagagaatactaccaatgacaggtatctatcacatggtaacaatgtattctgtgctcaaataagtatgggagctgctagttaaagtgaatgaaatcttcttagtgcaggacttctcagagccttgaagaggaagacacctgtagcaaatgtccgaaaaggaggtctattttcttgagcttatttgccagtggaactctattaatgacaagcacttagcctgactagaatgctacagggcacagtgggaggaaagatgcttcacacactggcgggtccacctttctctaaggcagtggttcccaaacgctggtgcagagcagaatctcctggagggtttgttaaaacacagactcctgggtgccaccttctgagtttctgactcagtaggtttggggttgggcctgaaaacctgtacttctaagaagtttgtaggcaatgctgatgctactggtccagggatcatgctttgagaaccagggctctaatgcaatcccctaaggtatatgggggctctctggaaggatattacttctcaaaaatgatgaccaacaaaggcagaatgaacacattagggagggaccaaagaccaaaacaaaacaaaaaaatgtttaatgacagatgtcttctaattctgctattgtgctcagatatgtcatctcttaaattgtggtagatggaaaagcctttaaatttcagagccctcagcttaccttgtatttttgttacctaacattctttttggcttgtttttactgcaagtttctcaagctcaagaactgtgtattggttaaatttattcctaaagggcctatcacaggagtctgcacagcaacagttggcatttggggccaaattcctttgtttcttttcacattaagtagaaaatacctggccaaaccgcagctccaaattctctctccatgtggcaaaggaatcttgtaaattttttgttaaattaagaaaacagtaattttcaaaaccccaagtccaaatccaataagcaatgttcaattttagtatacagttggtactacatgagtggcggacaccacaatcgacaaatggaagagaaattaaagactactttgaaatggaaacctaagcttcaaggtcagcgtctgttcagagataaagcaccacgaataacagggcgcgtggtgagcagttctcattcacatccagtcacatccatctggtcaaacaaacaatgtaggcagaggaagagagggacaaaacgggggtccctgcagggagtgagggaagaaggaggaatcagaaaacaaaggaggaaactacccccacctttgtttaggtgaaagtgccaagccagaaattactaatcagattggggttaaggacattgctaaatggattgcaaaataaatccacagagcttttctttctccttccttcctggacggacgctataaagtctgcagctttgctgtgctctacgtcctttctgtcaaggtggcctagaataacttgtcctgaaaggtcagtctctctttaggaaacagcgtggcaccatcttccttacagagcagtgtctcccaagcacatgtgggcacctggtgcaagctccttccacttgagcccagcccagcctgctcaggatcagcactctttgcccccagcttccctttgcattgatgaagtccgtgtacgctccctgacacagtcactttttggagagtgctgacttaaacaggcatctccatttacacttggaaaaggcttctagctggatataacgtcaaccaatctgataagcattttaatggatgtaaaaggaacatgaaacagaaaatatttaatgacaggcaacagttccttccaatgcatagatgcacattgtaaaatgatacttataagttataaatgaaatgtaaccatttaattttaccactctataatgaattcctcacgccagagtaatttgcttgtaaaaataaatctatgttttccaaatgcctattctgctctaggcaggtctaaaatgtatttataatcagaaagcctctatcttggttgttctgatcaacagagccatctaatttttgattcaaatgaactgtggaacttcgggataccaatcctttggaagctttgaagtaaaatctctgatttcttatgaggcagctggactttaaagaaggaataacaactctataggacaccactttggaaataagaaaatgtaattcacaatataattggcactgacgagctttggtacagggatgctgtgtaccccgaacattgctttacgttcaagtgatgtgccccgtgcccgctttttccctgtaaggccatctcagcactacctaagtgccataaggggactggaaaggcataaatgttctgtctgtaggagtccaaagctatcagagggctaataaacaaggtgtcccaaatgaaacctgaaccttaaaatgtttgaagccttgatggatagaacctagaaaaaactaacctcaaggcaacgtgcagttttcaacctcagaagtcttcagtactcctttgggggcagactgctgctttattctggaagatacgcctgaacgggctctgggtagcattccttgataggggctctttggcattttggtagagataaaatctttgttttgtggctctgccctggatgttatagggtcttgagcacacctggctctggcccagaaaatgcccccagtcatggtgacaagcagaggtgcccccactcatttccaaacacatcttatgaaggcagtccctgtctatcagagaccccaagtgaggcacaccaggcttttgtgcttccaccaaacctggggaagctaacagcaccattcacctggaagcccaggtggcatatctggtacccatggggcacgtggagtcagaactatgtctctatgtctctttgatttaaagttctctgctttatacaaaataggacgtgactttgcctgagaagcagcttgctctctctgagaggtttgtgggttgttgttttgaatgctgtgcctggaagacaactaaattaagatggagaagaccttggggaggcttgctggcacaatgtcactacttcgtggaaacaggaagacagtgaaagggaactaggccaagcttggatgggcagctccccaagaacatggtgatgttctatccgtagcattgtttagtctcaaagtcccaaaaggtatgaaggtcagactgtctccacggagttgtcctgttgggagccatggggcaagacacatctctttgggtagggggtggggcttcccctaaaagaactggaccttcccactgtccatcattctgggagaggctaattttagaagaagacaaacaccacagaaatgggccttatggcagcagggcctctgaggcacaggcaaggtttgtgtgccccagatgaagtggctgagtggatccctgacacacggaaggaactaaaaggtcctgtcagtaatcctgacactaggtctggcctagcagggttgtgacaacagtcactcttgaggcagttgcaaatcactcctccctggtttataaaaacatcgtagtcatgtcaaaagttacggcatgggctttactgtcctaggaggagttaagagaagggccagctctgagcttgggggagaagcattttctccaagtacagagaggtggtcagatcagtgggtgacacacagaggcccagcagcaggagcggcagtgagcagcctgaggaggaagccatgagagggacgtggggccattcacacagcatcctgggaactgcaggataactggacagctgagggttcaggcgcatcatatttacggtgttggtgatggtatgagctattcaccacatggcagagtctggacacgtgactaacgtaagaatcagcttgggcatgaggcccaaaccaactgcctctcctctgcaagcacctcttggaattgttggtcacttactgttcctttctacctctcaggcagaaggcagtggtcagaggtgttcgcatctgcaggcttcccctgcactctggtggcactcggcctctgacactgtcctctccttgggcacaccccacacactccctggcttgctttgtcattccctcattcatactgctgagcttgagaacaaggatctcactttatcagctactgtttttcctccctgccaagaccctgcacagctcttcatgcctaagtgctcaaggaataattttttctttgattgcgagatcaaggattctcagttactgcggtctacctgtccctctttctccttccacgttaccacacaaacaccagggtgcaacctgggagtgtgtgagagagaaggtatgaaatatggaatggctccttgagggaagaatccattttgaccagttgaaactggataaaacagactcttacaagttctaacctattccaacttgctggaaatacctggtcctggacttctaccatgatgctgtccctagggctctaggtgacagtggcctcaaggctcggggaggctgcccagtggttccaggtgctggtggcacaatggcatgtggatgacataaacacaccttaagtgttcctggagtcctggtttgcccatgattctaggtagttttggtatcgtggtggagattctagagctctgtgttgctgcatttattcatgggaataaaccagttctggatggttcaaactagttgtgaatgacttaaaccagataagagtggttcctcctggatcaaacaggctcgttccttttatgtcttgattaatgagattcaaacatgttatgattggctcaaactagtttaaactggattagccttgcactgaccttagactagccaggttagatttgatcaaagggttcattttccttgaagcaagcaagttcaatctagcttgaacaggatgggctggttcaaaagcaatgccacctagtttaaaccaactctgtaacatgaatgtttgccactgacctccagctgtcagtggaaatccagtggtacatgtcttgcacttgagacataatactcaaaacggcatccttcctcattacaccaacttttcaaaggttgtgatcatgagcacttcttctcaagactggccatttataacaacctaaatagatcatgtttgtatataaagactccagtagattttggaaatttttgttttgttagcaggcacatggataagcactgcctgtgtgatgtcatctcaaaccactctcctctaaactatatgtggagttgtggccagtgttgtagactgctccagtgcctacaccagccccctgtccctgttggagcacccagatgtcctcaccttgatcctgcttacggcttcctgggcctgcatcatgcgcacgtttttggaaggagttttgtctgagagcagctgagtggagccaaggtaattggcggcaaaaatgattccatcgatcaagtcttcggggtcgcagggtcccggaactgtaacacatagagccacagtgaggaagccatcctggggtggggcctgccaaccccctcaatggcacatctcccctctcccatgcctcactgctggcacaggtgaggcagagccaacctgctggtctgaggcatctctctgtgtctatctgcacccacacctcattttcaaatagaaggcacagtttctaaaatattttgcttctctaaaaccatttactatggaaagtgatgcaaatatttacttaaacatggaacataaaattcagcaataaaggatactgtttctcctgttagactgtgagctcttaggggacaaggaccatgtgacattcacctctgactctcttgtcttactgtcacccaggtggtatcaactagatatttgctggataaatgcttaagtaactagatggctgtctttttagaaaagctttttacagcaattcctattacttgcccccccccattcatatctcttcctccatttaatccataatggaagaaacaaatttatagatcagaaaaataggatatctgtttcagaatgtctggattcctgtaatggcttctgacctcaattgtgcaagacagataatgtgacctcaaagccacagtcccatgctgtcaatcttgttcacttacaggttataatgttcttggcctgtgcccacacatagacagattccaaggaaaatcaaattttctgttctattttaccagccttttaagtcaaacctgttttaaatattttaattgggggcacctgtttctaaccacaattacttgtaaaccctaactcgaaattaaaacgtgtctgtgattaatatataactgtataacagtctacttaaaaaggcattttaatctgcaattgaaacatacgtattttattttctttcttttttttttttgagacagggtctcactctctcgctaaggctggagtacagtggtgtgatctcggctcactgcaacctctgcctcccaggttcaagggatcctcccacctcagcctcccaagtggctgaaactacaggcactaccatgcccaactaatttttgtagtttttgtagagatggggttttgccatgttgcccaggctggtcttggactcctgggctcaagcaatttgcccgcctcagcctcccaaagtgctgagattacaggcatgaaccaccatgcctagccttgtgtattttatttgacttgactggtacatctgcagagactaaaatatacattttaacccactgttaaaacctcagggtcttaaattaggtaacttgtaatggaaacaatttgctttttcctcttggaaggctaatctgaaatgctttttatttttatccttaaacatcaagctcatcttgagtttacacagctgcttcctgtgctgaactacttatcagagtaaagatgtaaaataatctactcatttttctaaaactaaggtggtgcttgaaacagagaaattaaaagtgttttaggaaaggctttcacaaagcatctatgtagtaattaaataaggaagcctgttatttgtcttattctccatttttataagcaagactttgaagctaacactgtgagtggtacacagacaaatctgcctccactccacaccagtaattcacactctactcaacagccacaggggcccgctctgaatcttttatagatgtgagatggattcgggctatatatgatatacagtttcagttgtatagcagggaagcatacaaaataatatatgaacaggtctgaatccacattacactttatataaagtaaaagattgtcagttcttctatgataagttcctggtgatgcatttatagtgttatggaaacataatcattattgccaaccagatatgaagaagaacgatctcatctgggatatgaacttttaaaagtcttccatctattttttaaaaatcaatgttaaaagaaaacaaaaattaactaccttctctacgggacttctaacatcatatattctctgatttggcgctattcactgagaaggtccctttttgactacagtaagtgtgggtatggggatatgtttaaaagcaatccaaattatatttaaatgactgtagaaatgccaagcatccaagacacacaaatatcagacctaaacaccttttgagatatggtcttatgtcatttatcctttcaggaaattgaatataattgaatatcactgtcatcgcatcacacccagaaaaataaaagccccaatttcataagttcactttgagctcagggatagtatattcttacaaagttaaaaaaaattaaacccttaatgatcctatgtcagagaattgcaggttttcttttggcctttcggaacatggtttccctttagtgctgccttcggattgctctgtggatgagggagcacacatgtgacatcctcatactcaggctaatgctgagcctgaaaaatccctaggcctgggggatgaatatgaagacgggagctttcaaacttcagaaaacttcccagaatgctctcacagaatttcagggcctcacaaaaatgatgcaaataatttacgatgattcaagagagaaacctaagtaactaaaccaaaactgtgagcttgtcctgggctttgagcccaagggttcatgaaggtttatgagccctggtaaccctttcccaggcagtggaacacaatgactgtttacgcacaggatccaaagtccagacacaccctcagagagatgtctgggcgttctctggcctccagaaaagcctccttcaaggaaatggcgatgcacccaggtggaccctcagcatcacctctagccagagagtgagtgcctctttgtgaatgagaaatgatgcctgatttggtgccccatttggatggtacagtctccagctggagtgcagagcttggcggaactttggccccacctggccttagagtaggtgcccttgtgcagtgagtaacctgcacaaccatgtgtggcagccccacaaagacaccggtttccagagagaagtatggtgccagcctgccaattcatagcctgggtctgcactgccaactgtgggatcttgggcaagttaccctcttgatgcctcagttgtctcattataacatggggataataataaaactcacttcacaggattgaagtgaggattcaattagttattacatgggaggtgcttagaacagaacctggcagagtaagcatgcagtaactgttactattactagctcatccacgtaatagatgaaaattgctgggaaggtttttcttattaaaaaagaccaaaatttctgccttagttaatgttcattcccacttgaatttttctttttgaatgtatgaagtgcacagagacagaataaggagacttgggttttggatccagtgtgaccactgctaagctgcatgacactgggtaaagcccacagcttcgactccaatttcagagtcctcatccacataatgagcaaagacgtgaggaggatttctgagaggctcccagctatcattctttgagtctaagatcctaagactgctaacattgtgaataagtgactttgtggcctttcttcccttccattgtcttatatctcagtgcttcatatgccccaatgctaaaagattcatgaatgactcagtgctcagtattttcttttcagctcttaccttcaacgtaggttgggaatgaagccaagctttttcttgactgtaataaagacaaagaggtttcaaaaagagcaaagcataatgaaatatgaattaacacaatcatccatgcaacatgaaaaataaatacataatcagtggcagttaccaattattgatcatttttagttagagaaagtaaagtgcagataaacatgcatttattagtaaaggttacctaaaacccagaatagtccattcatattttagataatctagaaatcttacatttcacaatcagagaggtatttgccaactaaaaaacaatcccacagacaagtctctaacaacaataaaaagggcacaatttgtattcttaaggatctgcatttccatgtgaaaaactgattagtgaaagcaccaatgctatgattatagctgaaattaagaattctctcagagaaatttattttactctttgccacagtgatctctcactgtgctaaaaatgtgtgctagagtttttaaaaatctcttcatctcctactgatttattttagttgaaaaactccattatataaatcattattgtgtgttatctgaataagaacacaacaaaggagtaaattaaaaaccctggaatttcttttgcacctcagagcaaaggtcagcgttctcacagcactgttggaagcagagatgatgagctagacaccttttagagcctgactagatggcagcttaactgcctgctatcagaggagcaaaactcaccatacgttcctttcagaagcagatgtcctagatgtaacactgactgagataagagaaaaaaattcacccctgcttccaccagtagtagaatttgtagctagtgtgtctggaccagggtgatacaagcatcacaggagagtggagagctagtgttaaagacaagtccctaaaatgggcagaaggtaaggtttgcatggccaagaattccattgctgagaacctacccggttcttaggtgattatttaaatgcatgactttaagaggaaagatatctggcactgaatagctgttggataggctgacctgcatagagggaagactctggggtgcctggcaggctggatgaggaaagcgccctgggtgagtgttgggatgtcatggggagcaactccctaacctagcacttgacacagtgctctttccttggaggatgggaatggcaaagggatgataacttggttaatacttggacaacagtctaaaaatagtagttttaattgttttgtgaaaaattggggcagttgaagaaacctagttgtaagactccagctcaattcaggataatgacaattcaacactaatcacacaataatacattgtacagggcagcttttcagtaaacctgctgcatgtgtgctcactgggatgaaatggttctgcacaccaaagtgggtgggtttctagtgcatcaggaatgaaaagttactggctagtaatgcatttatgagaaaatgcacaccaaataaaagccaggatatgtggatagggggaaagagaactccagtttcagcagtgctttacgttaattttattttccacttacctaagtgagaagataggcccagttgagagccaacagccaaatctgtctaattcaggatggtttaaagaaaagaaaaaaaccctcataacttcatggtatgcagatggaagctagcatcttcataggggcctaaaacttttaagttattatttcccaaccatttccctacccttgtcccaagtaactatagcctggggtaatgagagtttgtttaatcagaattgcttagcctccaggtatatctaagaagtcaattcacattttcttgctctattttgatacttttctgaatgctagacagtgtccagattttagcagaagctacaaaagaattactttggtctatagctctaaaagctgcagttttattaagagctacaccaacatggcacatgtatacgtatgtaactaacctgcatgttgtgcacatgtaccctaaaacttgaagtataattaaaaaaattaaaaaaaagataagtttgaaaaaaataatttggcaaaataaagtttaccatctttaaaaaaaaagctgcaacagagggcatttggtacattcacttattctctatgcatgagctcatgactagctttcttagtctctggggtagtaaatttttttaaaaagagttttgtgaaatgaaagaatctctaattattacacacaaataggattttcatcatcatttctaaggatatatagaaacatgagccaagtcttgtaggaactgagaaactaacaaatttgccttattatatctaatgcataatcaaatgctgaatatttagatgtctggttagccctttatttcacatgtggactgagatgaacatcagttgatccttaactttcaagaataaataaataaagttgcatttaaaaagctaaaggctaagatctttggggtttgggtttgggggtcacacaaatcgactcgtgcagaacttggaggcacaattggacaactggaacaatgacagacaaggtaccttgtccatgtagtctgtgacctgcaaacactttctactccagcagtggcagatcttggcagttaagagcacgggttcccatgagttctggatttgaatcctggctgaccacttgtgagctctacaatctcaggtaagttattcaacctcttagctttttcaaccagcaaatgaggacagtgatacctacctcacagaattattttaagaattaaatgagacactatctgtgatttttctcagcccagttcctggaacattgtcaatgctcaagaaacgatagtgctcatgactgttatcatcagggcacctgtccttcttttcttcttactatttgttctcacccaaccatgtgatataagaatgaagcaaactgtggaacggtgggaacagcagaaactgtgcccttgtcacttgtgctcccaatggccaagtgtctgaggctcaagaccagaggagaccaaagtatatttctagtctaaattctaatgttggtgtcatttcagagaaggtctatgtttgtttgtttggtttaatatgaacagattaataaaaaatacttttcctttgtgtaaatatttaatggcaaatatatggtattcaagggtgccttaagggtaaattttaactaagactccctttaaaagcgatctgccactcagtttaaacagagatttctttttcattgcatttaacataaaattatcagcaaaatgagggaaaaggaaaccatcgttcatcatgtggtttacctctttaacacatctcctcagtgttgatgagagagcagctatatttagagtgagctgagcccacacacagattatggcgcagaccaacatttacctgatgttggctcattagcaggtgtgggtggcagttcactaggtgtaaaaggaccctgggtacgggggaaggcagtgtctcccctctggggctgccctttctcagacccagacacctcaatgggagaaagcagcatcttctcactgaaatgctccacataagcaaggcgaccacagaatttgttgtccaaaagggatactttagagctgcactgtctggcagtctgcagccacacgtggctatttaagttaattaaaatgggataaaatgaaaacttcagttcctcagttacactggccacatttccagggtttgacaggcacatgaggctaatgactaccatagtggacagagcagaagtggaacatttccagcaccgtggaaagttctcgcaggcggcactgcaccagcaagagagaagggcgctcataagatgggctgcctggacaacaggtgtgaactggaaccacaccctaggtaaactgggaatgtatggccactctattcttacgaaagatatctcatttgggcctgaaataaagggtatttaagaaactaacacatttcccaaagcacacagcaactgcaagcccatggcatcagcaggcatgtaacgccaggaggaaagatgctgtacgtcgagtttttggtgtctgaggtcaagtgctgttcaacagaatttcctgcagtgatgcaaatgctctgtaatccaccctgtccgagcacttgaaatgtggctactgtgcttgaggaaataaacttttcattttattcattaattaggcacctgcagccagtggctatcaaactggatgacatggctttaacaggtgaactgcacactggagaggagaaatcaggattgttctcaccagggtaatgtgggtcaggagcgctgtaggatgctgtattaggaagcacagaacagtattagagtaaagcaaaatggcccaatggctttggtaacaaaacagcaccctacctctttattagtggacgcttccacagggtcactggggtgaagagatgtgcttgatgactctgcacccaagggggaggagctgccaggagacggagactagaacacagcaagaggaaacacagtgagaacttgagagactcggcagacacttggctgggggaaaggggccgggagagagaagcaaagcagaacacaatcgaacagacactgcagtggggagaaaacctcttaaaaaggagctgccaactgtacataaaacacttgtggttttcaagctttctttttcaagtcctgccatgctttcaaaggagctttcatagctatgggccgtttttccccttaggccaaatgttgaaagaaaatacagaaaaggttgaaattaaaaaatcctaaatgaattgagctaaggatattacacaaacatgtttaaaacatttttttcttactgatgaagccaaatatttagggtaccgaatgtcttataaaattgcctgccccaaatgaaaaagtaaaaattaaaacacacatttttaaagaggtagctgggcctgattttgatggctagaaaccataccacctgtattttcctagtcaattcagatttcaaatattttgtctgatttagtctacaggctattgaaaattcagagacatttcagcattttaacatccaaacactaccctggatgctcttagaacagttcaaaaatcctttgtcaaacggtgtatcggaaaataaggcttagaaaaataggctcagggagaatggcctggttgggtgtggtattgcctgggctgatgggaccccagctccctgtgcaggcaggccctgctagacgtgtataggaagctcccaggtcagtgtacacagaaggtgctccataaacatcttctgaatggatgggcaaataaaacaagcaagcacagggatgggactgatacagacccggaaaacactccccagcctatagccaaacattgttgtgtgcttctgaaatcttgggagatgaaaggaatcctcaggtgagccacagagatgcttaagaattccacagcagggggcggcggagccaagatggccgaataggaacagctccagtctacagctcccagcgtgagcgacacagaagatgggtgatttctgcatttccatctgaggtactgggttcatctcactagggagtgccagacagtgggcgcaggtcagtgggtgcgcgcaccgtgcgccagccgaagcagggcgaggcatttcctcacttgggaagtgcaaggggtcagggagttccctttctgagtcaaagaaaggggtgacggacgcacctggaaaatcgggtcactcccacccgaatattgcgcttttcggaccggcttaaaaaaccgcgcaccacgagattatatcctgcacctggctcagagggtcctacgcccacggagtctcactgattgctagcacagcagtctgagatcaaactgcaaggcagcagcgaggctcggggaggggcgcccgccattgcccgggcttgcttaggtaaacaaagcagcctggaagctcgaactgggtggagcccaccacagctcaaggaggcctgcctgcctctgtaggctccacctctgggggcagggcacagacaaacaaaaggcagcagtagcctctgcagacttaaatgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacattaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgactttgacgagctgagagaagaaggcttcagacgatcaaattactctgagctacgggaggacattcaaaccaaaggcaaggaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcgatggaagatgaaatgaatgaaatgaagcgagaagggaagtttagagaaaaaaagaataaaaagaaatgagcaaagcctccaagaagtatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactccttgagaagagcaactccaagacacataattgtcagattcaccaaggttgaaatgaaggaaaaaatgttaagggcagccagagagaaaggtcgggttaccctcaaagggaagcccatcagactaacagtggatctctcagcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgaggctaggaagaaactgcatcaactaacgagcaaaatcaccagctaacatcataatgacaggatcaaattcacacataacaatattaactttaaatgtaaatggaccaaatgctccaattaaaagacacagactggcaaattggataaagagtcaagacccatcagtgtgctgtattcaggaaacccatctcacgtgcagagacacacataggctcaaaataaaaggatggaggaagatctaccaggcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacactttaataatgggagactttaacaccccactgtcaacattagacagatcaacgagacagaaagtcaacaaggatacccaggaattgaactcagctctgcaccaggtggacctaattgacatctacagaactctccaccccaaatcaacagaatatacatttttttcagcaccacaccacagctattccaaaattgaccacatacttggaagtaaagctctcctcagcaaatgtaaaagaacagacattataacaaactatctctcagaccacagtgctatcaaactagaactcaggattaagaatctcactcaaaaccgctcaactacatggaaactgaacaacctgctcctgaatgactactggatacataacgaaatgaaggcagaaataaagatgttctttgaaaccaacgagaacaaagacacaacataccagaatctctgggacgcactcaaagcagtgtgtagagggaaatttatagcactaaatgcccacaagagaaagcaggaaagatccaaaattgactccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaactgatagaccactagcaagactaataaagaaaaaaagagagaggaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaacagaccaataacgggagctgaaattgtggcaataatcaatagtttaccaaccaaaaagagtccaggaccagatggattcacagccaaattctaccagaggtacaaggaggaactggtaccattccttctgaaactattccaatcaagagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggatgtatttcaaaataataagagctatctatgacaaacccacagccaatatcataccgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaacaggaagtcaaattgtccctgtttgcagatgacatgattgtatatctagaaaaccccactgtctcagcccaaaatctccttaagctgataagcaacttcagcaaagtctcaggatacaaaatcaatgtgcaaaaatcacaagcattcttatacaccaacaacagacaaacagccaaatcatgagcgaactcccattcacaattgcttcaaagagaatacaatacctaggaatccaacttacaagggatatgaaggacctcttcaaggagaactacaaaccactgctcaaggaaataaaagaggatacaaacaaatggaagaacattccatgctcatgggtaggaagaatcaatatcgtgaaaatggtcatactgcccaaggtaatttacagattcaatgccatccccatcaagctaccaatgactttcttcacagaattggaaaaaactactttaaagttcatatggaaccaaaaaagagcccgcatcgccaaggcaatcctaagccaaaagaacaaagctggaggcatcacaatacctgacttcaaactatactacaaggctacagtaaccacaacagcatggtactggtaccaaaacagagatatagatcaatggaacagaacagagccctcagaaataacgccgcatgtctacaactatctgatctttgacaaacctgagaaaagcaagcaatggggaaaggattccctatttaataaatagtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtccaaaacaccaaaagcaatggcaacaaaagccaaaatggacaaatgggatctaattaaactaaagagcttctgcacagcaaaagaaactaccatcagagtgaacaggcaacctacaaaaatgggagaaaatttttgcaacctactcatctgacaaagggctaatattcagaatctacaatgaactcaaacaaatttacaagaaaaaaacaaacaacctcatcaaaaagtgggcaaaggacatgaatagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaatgggtgctggagaggatgtggagaaacaggaacacttttacactgttggtgggactgtaaactagttcaacccttgtggaagtcagtgtggcgattcctcagggatctagaactagaaataccatttgacccagccatcccattactgggtatatacccaaaggactataaatcatgctgctataaagacacatgcacacgtatgtttattgcggcattagtcgcaatagcaaagacttggaaccaacccaaatgtccaacaaatgatatactggattaagaaaatgtggcacatatacaccatggaatactatgcagccataaaaaatgatgagttcatgtcctttgtagggacatggatgaaattggaaatcatcattctcagtaaactatcgcaagaacaaaaaacaccgcatattctcactcataggtgggaattgaacaatgagatcgcatggacacaggaaggggaatatcacactctggggactgttgtggggtggggggaggggggagggatagcattgggagatatacctaatgctagatgccgagttagtgggtgcagcgcaccagcatggcacatgtatacatatgtaactaacctgcacaatgtgcacatgtaccctaaaacttaaagtataataaaaaaaaaattaagtcaaaaaaacaaaaaaacgaaacaaaaaaaaaaaaaaagaattccacagcaatggtcctctgagaggaaggctgcgctgcttcacagtctgttggcaatgtttgacaaaaggcataaaacacagagaaaaactaaacagagatgtattctctcaggaagtgtggggatgcgtggggaggtaagtcctgagcaaaggaagcaaaataaccctattgcttgcttgaacccatgtctgatctctcgggaccagcccccttgggggaaactgatgcacagagacatcagcaaaatattttcatggaaagggataatattgcacacagcaatggtgctggtgttggggctgagggggcacgctgatagacaagggggagcttggtgagcatagtgtgaaacaaacaaacaaaaaaatcttttccaaaaagtctgaattatggaaaatataaagggccacaaatgaacagaaagataatgcagtgaaattcattttaattcagatgaagaagttgtatgatcccagcctaatgctgtgaggcttgaatttgtttcttgtgatcccatacacctgattctaggcagggaggtcaggacaacgaacaaaccccttaaacattcacatgcagacatcagacactctgtggggaagccaagagggcaggcccagggtaacagctggcataaagaaccccagaccccacagcccctggctgcaataaagtagccccacatgccttcaagaagaaacacacacaacttttatttggcaccaaagagagctggtgggtacttgctgatttagctctctggctgactccaaattaatgtagtaaagtcttcatgagaatttaatgcctttaaatttccccaatctgaagagcttctttggatatgtacgattctattttttcccccaagtaattttctgtcacaaagattttaagggtctggcccccagggaaactggtgcagctggattttctttaattgcatggtttgagggctgtatcacaccttcattaaaaacaatcctccagagagtctcacatttcctatttctcaattgctctaaatcttctaaaaataaattctttacaacattatggggacctgatgatcttaggatgatgtaagaagacaggttatacagagagcaggggcatggaagagggaacccggaccccacagtaaagtgaggtgactgctgctgagtacccatatggaacagggggaggaggcacaaatgagcctgctgtgggcactgcccttgcagaggctctggctggacccacaccaacctcatcagggaccacttccctgcagaccccgggtgctcttgcctttggcacatgcttgagctcattcgagtttcctcctatttgcatgtgcaattaatgacctccacttagaaagttcaccctcattctttcctacattcaatgttcagctcaaaagcactcatcttgctgaagcttccgcagaccctattcacagtacattccttttctccacagccacgtgccatgctgtgtaatcatctgttcacgttatgccccttctcccccaagagctctcaggagatagggaccttgtcttgttcatgttcatcctccaactgcctcgccttgggtcttgtaaacagtaggcactcaataaatgtttactgaataaatggcttcagtttattcagctttacaatgttttccagcttgcataggaagcagatatgttacagatgcacccaatgctttcttcatttttcagtggtcaatggtaggcccttttctgacacagcatccctctagtgttgtgtgtagaatattcaacatgcagtttttttaaactgaaaaactttttttttttttgtagagacagggtctcactatgttgcccaggcaggtcttgaactcctgggctcaagcaatcctcctgcctcagcctccaaaaacactggggttacaggtgtgagccactgtggctggcctcaatttgcattttgaattcgagaaatagtctttgcctttgatgactgtcacctgggctccaaggacactcttgatgcagaaagctgtccccaaatgagagaggaccctgtctaatggaagcctaaaaatctccacaccattgcctaaatgtcaagggtggacaaacagcttcaaaacagacatggccgcgtgaagcctaaacaatggtgttagtgtttaactcatctcaaatgtctgctttacaagacctttgtccattacgtccaacttccaccttgatatactcttaaaaatggaggaaaaaaacagaaattacataatactattaactttcaaagaataatttggaggcaaaatttaggcaatgaaatgtgatagaaaaagtaaaattattgtcacatatatctctgtctggagactcacgccttctgggctactggatggatatccaattttaagcaaatgagacatgtgcttgtgagggtaggatgcaaatgcagggtcaggagttcacaaaggtaagggctgaacccggacgtctatctaggacacagtgcgcagagatgactcaccaacaactcccagttctacataattacaaggtctccttaagctaacaactcatcttctgcagaaaatgttctagcagattctctacagctaccatctaagttttaccaccacagctttgggattccacaaagcaaagctttcagcctcaagaccaggttcctaaatcccagacaagaaatgtatcatcctgtccattggcaatggagccagaagtgggtaaaggatataaaagtatcccaaggcaaagctgatcattcattttaattcttttttttttttgagacagagtttcactctttttgcccaggctggagtgcagtggtgcgatcttggctcactgcaacctctgcctcctgggttcaagtgattctcctgcctcagcctcccaagtagctgggactagaggtgcacaccaccacacccagctaatttttgtatttttggtagagatggggtttcatcgtgttggccaggctagtctcaaactcctgacctcaagtgatccgcccgccttggcctcccaaagtgctgggattacaggcatgaaccactgcccccggcctcattttaattctgactgaacatctctcttaggggcaaagacagcacttctcgtggtagcggggagacatacaaatagctcctggaactttcaggctgtttgaagggaagagaagcaccaccacaagtcattattatttatttgttccttcgacagacatctcagtgcctatctgtgttcctaacactgggccaagaaacaaagaggaaggagacctgttttcagagaatgggaggaggcagatatggaaaagcaggtccccagcaggtggccaggatgttgttctgtacagtggggacacagaggtagtggtcagttctgcaggaggggaggggtgtgcatcaggcaatgctttgtgggggaggtggtgcttcagctgaaccctgaacaccatgtggtcttcacagagtagtatgggacaggaaagcagaggaagatactggaaacacaggcagggaggaggaacagcacagctctggcaggtgagaaatgaggctgcggagccgggctgggactagcagctggagccccatggaggatagcacagggtgttaccaacagccacagctcagctcctactctctgccccgggagtagatattttttttttcttcttttcttttttttttcttttttgtgagtcactggcctgctcccctcattgaagaagcctaatactggcattcagaactatttcctgagttgaaccaaaagatctaaaggagtgagagattgagttaccactctcgccccttggagatctgcagaaagaaacttttacaagtaggaaaagtggataggatgataataagaatcccccaaagctggaggtaaaggcttcctgcctccttccaaatagatgatgaacaacattctattctagaaaggcctgaggactgaggcaggatctcagagagcagggccatgatgtggagaggaattcaaggatcctgacaaagttttggagaaattctagtcaagagacacacaaaaagtgagttctatgtgggccattcattcaatactgaaatgctgacagtgtccaaataaacccagatccctgcctccccccaaaaatgcctggtctttcaggggagacaaacctataagttacaaatacagggtgacttctgtaaacagtggtcactgtctcagttgctgcaggaaaacaaaagttttaatgtcacagaaagtcacaaatgagctgactacttgtaatgtgctaagtttgagtgtgttccctagaattcttgtgttagaaacttggtccccactgcagcagtgttgagaggcagaacttttgggaggtgactgggtcatgagagctctaccctcatgaatggattgatgcattcaaggattgatggattaatgggttattgagggaacgggttagttatcgtgagagtggagctgttttacaagtcagtttggctgtccctcgtgaacccccttgacaggtgatgtcctgcactgcggattccccactagcaagaaaacccttaccagaagcagcccctccaacttggacttcccagcctccagaattaaaagaaaacagactaagacacaacattagtgcctacctgaacagtcctccaccccaaacactagcatctacttatctggtccacatctttgtcaactggtcttctgttgactgttgggaccatctggcattacaaggcaaaaacaaaacaaaaacaaataatagcaaataaagtgcagaggtgcaaatattgcaaaaataaatagatggatagtagaactgcataaagttgaagaggggaaagttggagtctttctcaaaccagctgctgacaatggagaaactggcggggttgcactggttagagaaggagtgatgaatggaaagagtggtaacattagaggtgcttccaaagagaatgacaggaatatcaaataattaagaaaggctcttaagaaaactgagtcagtccttaaatatttttaatgaaatgtttctcttcatgattgagatgaccctttctgaacatgctacaaaagtcacatgtgatttgaaggttattttgtgtgattcactgactttttttgaaaaaaaaatataactaagatcaatactatgtcatataaaatcagtactacttctctgttctaagaattcgtgtacagttggaactacaacctagatgttgatagtcaaagagtaaactaaggttatatttatattttttagtattgctttcaaggtaaagttctaactgaatcacttcttacccatactttgagaatggtggtcatcatttcaaatgaatgaatgttcagcagctttttgaaggtacacatatgcagggattccttagagcacctccgctccagtggccgaagtgtggcatgatggctgccaagacgggcaaggggtggagaggccacctacactggctgggccagaaacccttctagtggaagagacacagaatcatgtcctgtcacagtgcttgggatttgaaaggctctggaataaagcttgttaataatcaacttcagcaaagtctcaggatacaaaatcaatgtgcaaaaatcacaagcattcttatacaccaataacaaacagagagccaaatcatgagtgaactcccattcacaattgcttcaaagagaatacaatacctaggaatccaacttacaagggatgtgaaagacctcttcaaggagaactacaaaccactgctcaatgaaataaaagaggacacaaacaaatggaagaacattccatgctgatggataggaagaatcaatatcatgaaaatggccatactgcccaaggtaatttatagattcaatgccaaccccatcaagctaccaatgactttcttcacagaattggaaaaaactactttaaagttcatatggaaccagaaaagcccgcattgccaagataatcctaagccaaaaggacaaagctggaggcatcacactacctgaattcaaactacactacaaggctacagtaaccaaaacagcatggtactggtaccaaaacagagatatagaccaatggaacagaacagagccctcagaaataataccacacatctacaaccatctgatctttgacaaacctgacaaaaacaagcaatggggaaaggattccctatttaataaatggtgctgaaaactggctagccatatgtagaaacctgaaactggatccctttcttacaccttatacaaaaattaattcaagatggattaaagacttaaatgttagacctaaaaccataaaaaccctagaagaaggcaacctacaaaaatgggagaaaattttcccaacctactcatctgacaaagggctaatattcagaatctacaatgaactcaaacaaatttacaagaaaaaagcaaacaaccccatcaaaaagtgggcgaaggacatgaacagacacttctcaaatgaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctagagaggatgtggagaaataggaacacttttacactgttggtgggactataaactagttcaacccttgtggaagtcagtgtggcgattcctcagggatctagaactagaaataccatttgatcctgccatcccattactgggtatatacccaaaggactataaatcatgctgctataaagacacatgcacacgtatgtttattgcagcactattcacaatagcaaagacttggaaccaacccaaatgtccatcaatgatagactggattgagaaaatgtggcacatatacaccatggaatactatgcagccataaaaaatgatgagttcatgtcctttgtaggacatggatgaaactggaaaccatcattctcagtaaactatcgcaaggacaaaaaaccaaacaccgcatattctcactcataggtgggaattgaacaatgagaacacatggacacaggaaggggaacatcacactctggggactgttgtggggtggggggagaggggagagatagctttaggagatatacctaatgctaaatgatgaattaatgggtgcagcacaccagcatggcacatgtatacatatgtaactaacctgcacatcgtgtacatgtaccctaaaacttaaagtataataataataaaatttttaaaaaaaagccctagaagataacctaggcaataccattcaggacataggcatgggcaaatacttcatgtctaaaacaccaaaagcaatggcaacaaaaaccaaaattgacaaatgggatctaattaaactaaagagcttctgcacagcaaaagaaactaccatcagagtgaacaggcaacctacagaatgggagaaaatttttgcaatccactcctctgacaaagggctaatatccagagtctacaaagaactcaaacaaatttacaagaaaaaagcaaacaaccccatcaaaaagtgggcaaaggatatgaacagacacatctcaaaagaagacatttatgtagccaaaagacacatgaaaaaatgctcaccatcactggccatcagagaaatgcaactcaaaaccacaatgagctaccatctcacaccagttagaatggcgatcactaaaaagtcaggaaacaacaggtgctagagaggatgtggagaaataggaacactcttacactgttggtgggactgtaaattagttcaaccattgtggaagtcagtgtggcgattcctcaaggatctagaactagaaataccatttgacccagccatcccattactgggtatatacccaaacgattataaatcatgctgctataaagacacatgcacacgtatgtttattgtggcactattcacaatagcaaagacttggaaccaacccaaatgtccaacaatgatagactggattaagaaaatgtggcacatacacaccatggaatactatgcagccataaaaaaggatgagttcatgtcctttgtagggacacgagtgaagctggaaaccatcattctcagcaaactatggcaaggacaaaaaaccaaacaccgcatgttctcactcataggtgggaattgaacaaagagaacacttagacataggaaggggaacatcacacactggggcctgtcatggggtggggggaggtggagggatagcattaggagagatacctaatgtaaatgatgagttaatgggtgcagcacaccaacgtggcgcatgtatacatatgtaacaaacctgcacattgtgcacatgtaccctagaacttaaagtattatttaaaaaaaaaaaaagaaaatcaatcaactcctaagacaatgggtttagtcctcaaagccaccattatctgctttcctatattaggctccattttgaaaagtatagtgcaattccagggaacacagttacatacatagttacatttcatttatcccttgaattttttttttttttttttgagatggagtcttgctttgttgccgaggctggagtgcagtggtgcgatctcagttcactgcaacctccgcctcccaggttcaagcgattctcctgcctcagcctcccgagtagctgggattaaaggcatccaccaccacacccagccaatttttgtatttttagtagagatggggtttcatcatgttggccaggatggtctcgaactcctgacctcaagtgatccaactgcctcagcctcccatagtgctgggattacaggcatgagccactgctgcgcccagtgccttgaaatgtttttaattttatattgtggcctaacaaggtaacttatgtttcaggatagggaggttattaaatgcttaaggcccagcgtctggcagatcagagtctggctaccactgatggctctgagcctgggcacgtcatccatcctctttgatacttcctgagaaatggggaaacagctagcacccacctcccgggttgccatgagtattaactggtgataatgcacactagtggtactttcagtgcctgggcaccggcaaagcattcaagtctttttatgatctgaacagttagaaaagttatttcagccctctgggagagtgctcacaaggacaacaaacacccacggggatgttttcttcatctcgtttccttccttattaaaattttattcacgggtaaaattgaaaagcaaaaaggctctataaaatcaaaccaagattctacattaattcataagctccaacactcttaatggtctaattggtaagaagagctcattactggctaaggctggggggtatatacaactgctgtgtgcaacttctggcatgtccactatctcccgaccaagacagtatttccaaatgtaagagttgagggtgatgctattatagtgattgatttacataagagaatcagggcatacgtatgcctctactgttaatttatagcatagttcacacacggccttggcacactgctgattaggacacctggtgaaataccccagcaagccctagccaactttaatgagttccaatacttgttggcctctttcctccaacgaaactcggcaacagaaattcatggtaatgaagggcaggagaacataattctttaaaaattacagagttttgccaaatccatctgagactcagttattcagtaatttcacgtatgtagaacgacacagagaacctgagaatcaggtgttgggtttttattctttaagtgactaagcagccaatatgctgcatgagactacagcaccaagagctcatgaacttcttcaccagacacctgtcattaagcacctatttaccctcatttaaaatgcaggtttaacaagccccgaacaagtcattcctcagttcaaaaatcttcagtcattcttttttgcttatagaacacattctagactctaccttggcacttaaggcactccaagggttggccttaattcttttactatttttttccctcttctacttcctattctctttcttcaatccaaactgaactactttctgttcccagcatatcacctgcgtttctgctcagcgtctttgtttatgctcctgtctgaactcctcacatacaggaagctccagcagtccaaccccatttcaaatagtacttttttcatacagccttcttagatctcttaagggaaaggaaagcccctcttgtaagaactatctgcatgcattgtgtttgtaccattcttaaggtgcctcactgtctcccttctattttataaagatataatgctacaggacagtaatcatattttaagtacaatattttaataagcaccacgaaggcaggatttatcattagcttacgtttcctctccaagtgcctcatacagagaccccataaaatatatagtaggagttcaataaatatgttgaataaatggaagcatgcatagacacccattttgtatcagaggaaaaggaagcaaaaaataggtttatatacagagtgggtctgaacacacgcagcattacttctcaaggtccactgtcctcaaatagctttgcacttacgcttactggtttatccagctttacctcttttctcacaccaatgtacattgtttccctcactgatccaagttgttttagattaaccttattccacattagaattgtttttaaaaaccccaaatatatgataagtttttttttcttgccccaagacatgtctgtgcttctaagaatcgaaactggttaagaaatccataattattcagtctcaatttaaactatattatcaaagcacatttgtatttctttaatgtggtgaagtagaaagttatcacggcattgtaggggcataattatgtcattaaaatgataatagcctgggcttaatgaactgttttatatatatatttataatggattcaagtaataccaatgaaacattttgagataaccatcagctaaaatattctaaccatttttgttctctcttttcccacaggcaaagccctcctgttcccagccccaagtcggttaaacccatgttaaatctataggttgaagacctggatcattcgaagcccagagccttgcacagcagcgatctgctccaacagagggtgatgtcatcatccgaggccacacaaataatgcatttctcaccatcaaaaagcttctgaagccatgttctcaaaggcaaaaaataaataaataaataaccaattaactacaccagtgtaagggtgaaacaagttcttatctgataaaactgacttataaacacaggttatctcttccccctttgaaacagcctcactgtatttaaatgaaatgcgctacaatttggaaaaatggagtctttcattcatttccacatttaagtccatccattccttgatggtgttcccacactcattcccagaccactggcccttagctctgtgggagagaaaaaccaaaaccacttttaattcctattaagagatatagctaagagcacaaggagatttgctgtaatagcacactacctgctaagaacagtcatagtgaccatttacagaaggcttactatgtgtgtcaggcactgtacaagggtacattatactcattacctcactgactagcaaagcagttcttacatgcaaggcactaatctccactcattttcattagcatcacagaagcacaaaacacaacacagagcatggaattggaggtacactgcccaaagtgactcatttattagaatgtggagaatcagaatgcaatgctgacggggagaaagcaaggagcacaacccctttccaagcaccttttctgagtggtcgagcagcctttgctctgtccttaccatcttggacttccaagccccaggcaaacctgattccactgcctcctgtctggggtaatgcacactccccctctctattcttgctgtactaactcctaccgtcaagggaaatgcagagaccaacttataacctgacaggatgagaaaaagaaaataaaaagcaaaacagcaaatgtgattttgaagcctaggatccacctacctctccttcgtgacactcaaatcggtacatccagaagttctccatctttccgggtgctgtttgggcagctgggccagctctagtgcctccacttgagagccgaggctaagtcctgacctcagtactcgtgtgagttgtttccagtgttgttagatacccgagtcaatcatgcaactggtaacaggagatgtgaccacctcccagggtgtccgaccctcacattaacccctcgctgcctgaatggtccaggcagtcatgcgtcactgctgggcatcagcagctgatgtttctgagaaggggctggcctaccccttctggcagcagcacctactatttctggagaaaataaactcggctctgaattgctaccagaaactttcacacaccccaaactctgctacgtttatagaacctgtgaaaaagcatccagctcatgtggaaggaacgggtgggagttgggggaaaagaggctctctcaggacctgcatcaggatgcacctgggcatgtggtgcgagcctggaggacactgaggccagctaggggccgcacctctaggcacgggaagtctcttcacctttaccgagggcctgagacagcctcatgctgcagtctgaataaggggtatggcaagccagcgacaccaacacagaaaagggctgcctccagggccaatacggtttgaaccaaaccaacagataatcctacattgggctcaagagctggactatatatgctggttcagaccagaccagagaaaggtcaagacaaacatggcagaactaagctggatggaggagctcttggaaacagaggcagcagtgtggttctgaaggcaggaggcagacagagagacctctgcagagagacgcccccagagctaatcagcctctcagtgatctgtggcgatggggaaggatgtggatgcatgaaaagcgctcatctgaatagatgactttagccttctctctcatcaaaccctttatcagacatgctgacaggtctctctgtgagcctacctgattggctaatgtgctatgataggaccaaaaggtagaaaaaaagagacacaaagggcctgtgaacaatccacagctggcaaatcctcccatgctagttgacagtttgctgtgctgtggacaagctctgcaggccaaagtgggaaacggggccagagagagggtgtcctcaggcactgccctctctctcctcattgttctggcatttctgaccactcttgttggcagtccgattgcacctactctaatccgaatcagtgggatgcaagtcccatagctgctagccaccattctagaaagccctttctaaatggtgagcactgcaggaggtatctcttcctactttacagcactgggcatctctcaaaacactttcttccgtctattaattatttaaagagagaaaatcttggggtgttgattctcaagagtccagactgaatattcctcaccatttaactctccctagcccatggtgcagccatttcccccattatcactcttgaaaattgcactggtttccatttatgaactgctcagaacaggctgggtgaagctgtttagagtgttcactgctgctgtgaaaagctgcaactttttcagttattactcagaaatgaccagcacacgtaagacttaaaatcactagtcagactcaaataaaactgccaggccttctggaaagttatagaaagcatctacccagtgtcttattggtacaaaagaacttagaattctttctctggctcttctgtttttattctttcttccctttcatgttcattctgcacctgaaacctacttaattattcaccaccatcttctccatgactcatcaataatggataacacctgcgatggaaaactcccccagcagcacaaaggcggttgagatggaagcatgaagaggaggatccacatgcctcacccaagggagaaaccaagcactgagatgccagcctgtctcaaggcctgcactctcctgtgcggctcccctacaccaccaagaccccttaactctgtgcttcccaaacattttgcaccatggcacacagggaaatgttaatatttgtacaatacactgggccacacagaggggacctggaggccacgatgaggctgcacaagggttgaagacaacgtgcccagtggcccaggtcactctccatccccaaagtccgagagtatcatcagcacactgcttgaaaagctctgccttaacttatgaaagggtctttacagcaaattcttttgacaatggcagtcccttggggataaagttaaactcctccttctgagcagtccaccatggacctgctctttcttcaggacaacacctcctcttttccatttccacagcctgccctagtcccagctttttctgacatagccccctgcaccatctctgtgctagctctcacacaccttcccttttacgccactttggtttcatcgtccatcggtcacttcgggatctgcaaatctgcctcatctcagccagacaacaaaacaaatgcagcccaggagttcggaatggttgacaaggtcagtgggagaggacaaggccagcagctgctctgccctaaatttgaagcccagtagctctttgctggcatggaacgatgacagataccaaatgtggaaggcagagttctcagatggctcccaatcatctccacctcctggtattcagcctcttgggtaatctcctccctggggagggagcacggctgagtgacttactctaagcaataaaatacagcaaaggtgataggatatcaccctgtgactgggttacaaaaaaccatgacttccatcttgctaccagactccatgaccttcttatcctgcatactttatgaagcaagatgccaagtgtcagacagcccatgtagcagagaactgaggacacctctggccaacagtcaactgggaactgaggccctcagcatcaatgcccatgggaagctgagtcctgccccacaagcatgtgagcttgagatgactgcaggccacctgaccccctgatggcagcctccaagagaccctaatggagagaaactgtgagatagtcaaggaaggttgttttatgccactaaattttggggaaatttgttacacagcaatagataattaagacactaaataaggattcagatgaaaggcttaagagcagaggaggcttgaaggtctcgcttggggcttgacaaaggactagcttagattgtacactctgcaccagcagagcctgtctgtgtcagtcagagcctctatctgtcattgctgtatccctggggtcttgcacagtgcgtgatctatagaaggatctaacaacgtttattgaatgagtggatgataaattgtaagatgcactttcaacttttgacctagaacagtagtcacaaactctctgtagttcactggcaaaataaggaacagcatagctttgaggccatatttcttattcctttatgtagctagtgttcaatgaaacacaaaggtatcagcagagaaacagctatgacagctcagcttaatcactttgcatggcagacggttgagaacacatttatacctctgataccatttgcttgtgtaagaagtttcccatccttttctgaggtctgcctggaaaacacactgggttccatttctgctgtcccagcagcgggtcctttggttctaaggttatgcttctgaataagcttctgggatgttgacttaaagggtatgccagccccatttttctaaacagtctggatcatataagaaaacaaagttggttttagagccaacactggaatgtatactcttctgcagcaggtaagggaaaatcggagataaggatgcctggagttttcttcctcttaacagcacaaatggagacagactggggctaactatcctagaaccacccttcttcccttccctaggaatacatcacattccagccaagaattgatccacttggggaaatagggttccaactgaacacatattaatcctaaattctgtctacttgatttcagatcccatttcaacttcatcccttgctaaccggatcctggaaaaattttgtctgttcagaactctgcaaggtgtaatcagcaagaggaaatctctcagttcagaataccttaacaagaatccttcacaaaaaatggcatcctttggcagcaagacagttcttttcgctcgcccttgtaagcttgacaacacaacagcaaggtcgacaggataagaggctctaacaagtcttaatgaattagcatgtgcacttgaccttggtcagtagtttcctagcaacggtccaaaaaaaaaaaaaatccatgtcggtggcatgctgaattcagggcagggagagggtaacatcaaggcaatcaaggccccagatgaagccatgaagctcctacaccctcactgcaacatttttcttgaaattaaaaaaaaaaagtggatgtaaaagtacacatgatcagggcaagagttcacaccaagcccttacttctcaggattttgacaatacctccatctcagcaggagagtggctggtttctgattaagaagcattagtgctgaaatggtttcctgcttcaaaatactttctccagtggtctctgaaatcaggagtagaatgccaataaaaggtaaatgttatctggaggggcggtgcatgttgccattatcactaattagcagtttagtttgatttaatcagaccaaccctggaaggaaaggctgacggtataatgctgcttaaggtggaagctgagaactagggtcgcctgagtgcctgaccaggatgggcagcccagtgggggatctgaatgctgaggacagcagaaaggaaacactagcctagagagggtgaggaagggctactaaaggccagccccctaattcagatcgccagtaaccaaccccaaatgttaagtgagctttgacttccaaatgtaactggcacaacaaacttgtgattcttgtttcacatttccatataggactcgatatctgcaaaaccattttctctcacagcttccctgggacataaacctgattaactcattttactgatgaggaaactgaaggctgggaggaaagcaggtgacaaactcaaggtaactgcagcagatcgactgtgagccaaatatttacatacgatggacactctgagcagcgcatctgtgtgacttgctctgagagagatacaggagaacgatgagacaccgacagtgaattacagaggcaacaggttaactcacgcaagaaaagcggaaaatgagatcctaaagagttgagtgttaaactctggtccacagcttaagctagcacttaccaattttgactgaatcttattaacacccgtgccaagacccaacctccagaggctctaatcaagaagtctggggccttgaaatctatgtttaaagagcgaagcccggactttatctaatcggaatgtgacctggatagaggcgagatccgcatgattacaagcatggggtagaggccagtccagagaagcataaagacatttagcatttttcattttaaagatgatcacatttatagccaaatcgcatttcataattctcccaggtcacaaaaagtctattttcagctattccttccgggtaaactggggccaaaatgttcagactgactccaattctccttcaatccattaccagacttgtttactcactttttggtgtcccacgggtagggtctgaccaagaggtcagctaggcatgtcaagctgaatgtctgttgtctcaatatgagaaacaacaggagaaaaactgcaagtggaactcttcaggggagtgaagtggcctgtgtctaaacagaaatcctcctctcttatcgccgctcttaagaaagcagtcagcgaagactgtgtttcaaaacaagtggactgagaaactacatttttggactcagaacatgttgccagttacacttgtaatggaagtatttttcattttaaagatgatcatgtttgtactcaaatcacatttcataactcccaggacaacatgggctccaggatacaactgggttacatatgaaattcaattatctatgatatatctgttcctctcccagcaccttcccttcttctccaatatggccccagtacacgtatcacagaaaatatgagtggctgggcatggtggctcatgcctgtaatatgacactttgagaggccaatgcttgaggccaggagtttgagaccagcctgggcaacataacaagactctgtctctacaaaacacacacacacacacacacacacacacacacacacacacacacacacactagctgggcatgatggtatgcacctgtagccctagctagtaggtaggttgaggcaggaggattccttgagcccaggagtgtgaggctgcagtgagctaggattgtatccttgcactctagcctcggtcacagagtgagattgtctctaaagagtgcatagtcggggcagaggacacaatttttctaaagactactgggcagtttattgagcatacacttattcagcaagcatgtcagacacccgaactgtggcctatgagctgcaactctgactagcaactgacaacaaaattctctctagctaaatcgtccatttatttccctgttgtttgtcccatcacttcttggcacagtttcacatatatactgtctggtgagacaatccatcaaaaagttgagaaagattcctcttgggagaggggtcaggcaaagtgaaaaaaattggagcccagagggttaaaaaagatcaatcttctccatcagtttcttttattccacagaacacacagtaactggaaaacgtgccttctggtgtgcagatcaccagacaagttttgctctggtgatttctagatggtgatggtctgatgtcagtgggggagacacctgccaggcaacacatcttgcctagagctgaaccgacaggtgaaactctaaagacaagctaaaataattggaggcaatacttccaatccaggtggtgagatcaaagcaaacattctcccatctctttttgtttttttttccttgattgaaatgaatcatttgttcttcaaatgggatttcagggtgaagccttttcattttaaaggtgtaccagtaaaatcattaaatctttaaaaaaattactccggttgcattaggttctcacagttcatagaaaaacgtctcattttgttgttgttattgacaactaaagtctcctagagcattattctccactgacagaaatgacactttactgtggattctaagttgcagaatgggccattaaatgcaccctggtaaaagaagacatctcaaaaacatttcatttttgaagtaaagaccatttacctacataagtatacaaacctgaggagaaatgaacgcatcacacttcacctcagcaagcatcactcccactgcagttagtattcctgctgctatccttcccacaaatgttctgtgctttccaaactaagcacactatcaagcccacagctcctgaactcttcagatttttcattgtcaagttgtaaattcacttaccaattagtgatcttcaccttaagtagtacagccccggccttgacctactttttatttctttactcttatgtgtgtcacataagccaaatgcaagtgtgtgtgcttaacacaaacaccgcaggaaattaaaaacttagtgcactcatcttaccatataacatagttaataaagcagttgtttcttagaaattgtgcacaaaatgtacagaagtgtttgcctttctctgtgtttccaggaaagcagtaacaatgagatggttcctttggtcagtgagtcatctctaaaggattcctactcttgcatatttttcaattaaagcaaagaaatacatgaatataattttaaaagtcaaacgatatcatgcagtttatggcaaaaattgaagtcttccctgtccctcccatgccatggtcccgctcttctaatctttttccctggaatttatttccatattcataaatagcatgtttatactgcctcaccttggtttttcaattttagatattatttcctggctctactataagatttacctctttcatgttacatgcaccctcatcctctcaatattacaatttctggttaatcaatattcagtgcttgtgttctgaagactatactcttccctgctgagctacaacgcatattattattgcatttcttgccaatataacaactgcttttactgaggtaaataatggaattgtttttccgtttgcttagtcttctatggactgatcaataatttatgccaagctctcctaaaaccatctaaaactcctggtggcacaaatttatcaggaaatctctcagttccactctttctagagactgcctaactggagccctctgagcggcaggccacatgggattggtggttggacttctgcatggttgtgatcctgggatctcctttcctgtcacctggagattctctctgctgcattcccaggttgggtcccccgtttcctggatcttgcatcttttttcttggtttatgctaccatgcaagaagagcaatcctctggtagtttcctgagaaagggtgcatatgaggtaaattttctgggaccatgcttgtctaaaaacacctttattgtaccttcaaactgaactgaagatagactggctgtaagtctcccagtttccagtattgcttgtgaaaagtccaacatcattgtgtttcctgatcattcttgtttttatttctctgaagcctgtaaaatcttctctttctccctcctgttctgaaacttctgtgagtcttttctatttcattattctagataggtacccagtagactcttttaatctggaagttcatgtgttctttggctccaggacatggtctttcataatttccccttctgttttatctttgttcctactactttccacctttttgccatacttgttttactgttttgaagagttcctcaattttgctgtcttgatttctccaagcgactttccatttgctttatgtctttgtctttcatgttagagatgttctttaaatgtctgatgatccttggctgttcactcatatttaagagtaaatccccaaaaagcctattggaagaccatgtacttatgatgcaagagccgtcactatggggtgatcaggtggaaagccaggtggtatactaggaaacccccaaacattagtatctgtagtattttctcttgggcctgttacctcagagaggaatacactcatctgttggggactagggatcctgagtgggttggattctaagcctgacaactaagagttgtaaggtattctccgggtctcactgcttagtgggccgtgtgttccccagggcaccttgtttccatttccaactcttgccatgtccccagtttcagtgctcctctggttcaccctttccttacagaagcctcccatcttctgcggggaggaggagtcgcctagcttcatgcattggagaaggcatcacaggaagtttaatgtctcctgtgacaggcttccaaataatcctcttctttttcagccatacccctcatatttctgccacctgaggtatctgtgtctctaattcttgggcctttgttggggggcgtctaccgcacacatcctcacaaacacttggcagaagagagaaaacagaaacctcatcagtgtgttagtcaggatggaccaggctgtgcggtgataacaaaccaccccaaaaatctctgtggcttaaaatgataaaggttgattcctctctcagagtacatgtcccaggaagccctacccattgtggtttcaggagacctgtgctgacaggcgcacagccatcttgtgaggctgctcccttaacataaggctttggggtttatttccactggggaagaaagcattgtcttagctgctcccgcttggaagcaacttcagggctcacgtttccctggccacgcttaacttctagaggatgaggaagtgcagtcttctccatgtttgaaaaaataagagaactggaaatcctggggcacactaactcctccatcacagccagttaccactagggtgttgccaaattttgttgtgctcatctgttgctgtttcctctgtcagtgtttgtgctttttattattttactgcaattctaggatggagcagagataaacgccatttcaagctgtacaccacaccacttaaagtagccaaaaccctccaacttacactgtgtgcttgctaacatcaatctccctgagtctactgtgactctgttctcgaatgattctgttgcctatagacagatcagtaggctgtggattttcagaactggtcttcaggccgggtgtggtggctcatgcctgtaatcccagtattttgggaggctgaagcaggtggatcacctgaggtcaggagttcaagaccagcctggccaatatggcaaaaccccgtctctactaaaaaatacaaaaattagatgggcatggtggcatgcacctgtagtcccagctacttgggaggctgagacaggagaattgcttgagcctgggaggcggaggttgcagtgagccaagatcgcaccactgcactccagcctgggcaacagagcaagactccatctaaaaaaaaagaaaaagaagaaaaaaaaaagaaaaggaggaggagccaagatggccgaataggaacagctccggtctacagctcccagcgagagcgacacagaagaagacgggtgatttctgcatttccatctgaggtactgggttcatctcactagggagtgccagacagtgggcgcaggtcagtgggtgcgcgcaccgtgcgcgagccaaagcagggcgaggcatttcctcacttgggaagtgcaaggggtcagggagttccctttctgagtcaaagaaaggggtgacggacacacctggaaaatcgggtcactcccacccgaatattgcgcttttcggaccggcttaaaaaaccgcgcaccacgagattatatcctgcacctggctcagagggtcctacgcccacggagtctcactgattgctagcacagcagtctgagatcaaactgcaaggcagcagcgaggctcggggaggggcgcccgccattgcccgggcttgcttaggtaaacaaagcagcctggaagctcgaactgggtggagcccaccacagctcaaggaggcctgcctgcctctgtaggctccacctctgggggcagggcacagacaaacaaaaggcagcagtagcctctgcagacttaaatgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacattaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgactttgacgagctgagagaagaaggcttcagacgatcaaattactctgagctacgggaggacattcaaaccaaaggcaaggaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcgatggaagatgaaatgaatgaaatgaagcgagaagggaagtttagagaaaaaaagaataaaaagaaatgagcaaagcctccaagaagtatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactccttgagaagagcaactccaagacacataattgtcagattcaccaaggttgaaatgaaggaaaaaatgttaagggcagccagagagaaaggtcgggttaccctcaaagggaagcccatcagactaacagtggatctctcagcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgaggctaggaagaaactgcatcaactaacgagcaaaatcaccagctaacatcataatgacaggatcaaattcacacataacaatattaactttaaatgtaaatggaccaaatgctccaattaaaagacacagactggcaaattggataaagagtcaagacccatcagtgtgctgtattcaggaaacccatctcacgtgcagagacacacataggctcaaaataaaaggatggaggaagatctaccaggcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacactttaataatgggagactttaacaccccactgtcaacattagacagatcaacgagacagaaagtcaacaaggatacccaggaattgaactcagctctgcaccaggtggacctaattgacatctacagaactctccaccccaaatcaacagaatatacatttttttcagcaccacaccacagctattccaaaattgaccacatacttggaagtaaagctctcctcagcaaatgtaaaagaacagacattataacaaactatctctcagaccacagtgctatcaaactagaactcaggattaagaatctcactcaaaaccgctcaactacatggaaactgaacaacctgctcctgaatgactactggatacataacgaaatgaaggcagaaataaagatgttctttgaaaccaacgagaacaaagacacaacataccagaatctctgggacgcactcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaactgatagaccgctagcaagactaataaagaaaaaaagagagaggaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaacagaccaataacgggagctgaaattgtggcaataatcaatagtttaccaaccaaaaagagtccaggaccagatggattcacagccaaattctaccagaggtacaaggaggaactggtaccattccttctgaaactattccaatcaagagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaacgaatccagcagcacatcaaaaagcttatacaccatgatcaagtgggcttcatccctgggatgcaaggctggttcaatatacgcaaatcaataaatgtaatccagcatataaacagagccaaagacaaaaaccacatgattatctcaatagatgaagaaaaggcctttgacaaaattcaacaacccttcatgctaaaaactctcaataaattaggtattgatgggatgtatttcaaaataataagagctatctatgacaaacccacagccaatatcataccgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccactgtctcagcccaaaatctccttaagctgataagcaacttcagcaaagtctcaggatacaaaatcaatgtataaaaatcacaagcattcttatacaccaataacagacaaacagagagccaaatcataagtgaactcccattcacaattgcttcacagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaaggcaatcctaagccaaaagaacaaagctggaggcatcacgctacctgacttcaaactatactacaaggctacagtcaccacaacagcatggtactggtaccaaaacagagatatagatcaatggaacagaacagagccctcagaaataacgccgcatatctacaactatctgatctttgacaaacctgagaaaaataagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtccaaaacaccaaaagcaatggcaacaaaagccaaaatggacaaatgggatctaattaaactaaagagcttctgcacagcaaaagaaactaccatcagagtgaacaggcaacctacaaaatgggagcaaattttcgcaacctactcatctgacaaagggctaatatccagaatctacaatgaactcaaacaaatttacaagaaaaaaccaaacaaccccatcaaaaagtggccgaaggacatgaacagacacttctcaaaagaagacatttatgcatccaaaaaacacatgaaaaaatgctcatcatcactggccatcagagaaatgcaaatcaaaaccacaatgagatacaatctcacaccagttagaatggcaatcactaaaaagtcaggaaacaacaggtgctggagaggatgtggagaaataggaacacttttacactgttggtggtactgtaaactagttcaaccattgtggaagtcagtgtggcgattcctcagggatctagaactagaaataccatttgacccagccatcccattactgggtatatacccagaggactataaatcatgctgctataaagacacatgcacacgtatgtttactgcggcattattcacaatagcaaagacttggaaccaacccaaatgtccaacaatgacagactggattaagaaaatgtggcacatatacaccatggaatactatgcagccataaaaaatgatgagttcatgtcctttgtagggacatggatgaaattggaaatcatcattctcagtaaactatcgcaagaacagaaaaccaaacaccgcatattctcactcataggcgggaattgaacaatgagatcacatggacacaggaaggggaatatcacactctggggactgtggtggggtgggggtaggggggagggatagcattgggagatatacctaatgctagatgacgagttagtgggtgcagcgcaccagcatggcacacgtatacatatgtaactaacctgcacaatgtgcacatgtaccctaaaacttaaagtataataaataaataaataaataaataaaaagaaaaaaagaaaagaaaagaaaaaggacaggttttcattatcaatatttttcaagaaggggattgggagatacttctcaggcatatatttagaaaagtgaaactccttactagaagaaaatcacataagtatttttttcaaatgtttagaacacagttattttctctcagtgctgagagagtgttcagtaaactcttatggattagcaatcccattttctctctatatacaactcaccagcaaacaaatgccagtttgctccaagaaaaaagcacttaagttctgggggaattaaaagtagtgttaaaaacagatttagcaattagcaacggtggctgacaaatggcaatacaggtttttttgtctccttttatttgcttcattatagtttgtgatcttgccattttgagaatgcaaatactcaaaattctgcttttgtaagaataccatttctccaggtctgctgaccataatcacagtgagatacctctttttgttaaaactttatctgtgctaataaaagatttagttaaatcttatatccacagcacttacatggggaaagtgcccagataatacattttttcctttaaatcagtagttctcaatctttcacatgcttacgaatctcagggaaagtttacaaaacaaaataaaataaaatgaaacaaccagatcactgagacccacatcaggtattctggtttggaaacgaagggcagtaacttgcatttctaataagtaccacccagacagacttcagatcacatggttttaaaacacctttccattttctataacagcatacatggagaactagtgttcagtaaatattttttgatgctgagatggaaatcaacagaatataatatcattatattctcagtagaccattaaagaggcagcaaaggaaggtctttcctataaatatggcatgacagattaaatacaacccacaaatagcttaaaaatgactgctggaatactttaaagcacaggttttcagtttcactttatattaactattcataacccagtgatccatattgatttcttagcatcaagctgattttctgacatggttggttcctaaagcatcatacaatgttctataattaatttcaccttttgaatgaaacagcatgcaagagaattaagttgttctcctagttcaaatgaataaaagccagcctctaaccctaccataggctgtactgtgggctcactgtgaggctgcaggggcaattggttaagcaggtcatttcaaggagctggtgcactggagaaagctgaaggaagaggccagcatctggaccaactgtgcctgcagctttttcctctggtggctttccaggtttctaaaaggatacagaagccagccttttgtcaactccctacttttgaaaacctgctctatttccacctcatttgcaaaatgcttgctgcaatccctcctagctgggaggaatctggagacagctggaggtcaaggagaattctacacgtgagtgcacttatttttcactaaatcagaagcctagaaaacaaagacaggacatgtctgagctcactgacccaatgctgtccccttgctggggagaatgaagttcccttccctactggtttccaacctttcctaatcggctaacagaaaatgctgactattccttaaagaggaggtgaatgctaccactctgacctgcgtagctctttatgtgtaagtaaaatgaacaaataccttacaataatggtttctcactccaaagatatatattgagaaatggcctggtgcaatcataaaatgcagaattaaatgaaattgaatataagctcttgacccttatcttactccaagatccatttttaaatgaaaggcttcaaaattattcaagagtatggaaagggagagtagaagcagagagaatctttatagcaaacgagtcagagcaaaggttagtcttcctgatatattctgaacagattgtgacacctaagcttgccatgttatcacatttcttaggtatttcaaaaatggaaaatgtcaatagtggcatcagttactttgtgtagctcttcacaatgaaacacaatttgctttaaaacagaatacatatcttttgtgaagtgggaaggataccctgataccaccagatgtgaaaaattaggcacctaccacaatgaggcatagggtgggtgaaaaaaactgcagagcctgggagtggtgtttcacatctgtaatcccagcactttgggaagccaaggcaggcagatcacctgaggttaggagttcaagcccagcctagccaacatggtgaaaccccactcctactaaaaatacaagattagttgggcatagtggatgcgcctgtcatcccagctactcaggagactgaggcaggaaaatcacttgaacctgggaggcggaggttgcagtgagccgagatcacaccattgcactccagcctgggcaaaaagagtgaaattctgtctcaaaaaaccaaaccaaaacaaaaaaaattgcagaaaccggccaggtgctgtggctcacatctgtaatcccagcacttggggaggccgaggtgagtggttcacttgtggccagcggttcgagaccagcctggccaacgttatgaaaccccgtctctactaaaaaatacaaaaattagctggacgtggtgacacctgcctgtaatcccagctacttgggagactgaggtagaattgcttgaacctgggaggcagaggttacggtgagcggagattgcatcactgcactccagcctgggtgacagagcaagactccgtcacaaaacaaaacaaaacaaataaacaaaactgcagaaacccctggcggaaaaaggcttggaaggctatcctccaaagagggcacactacccatcccagatcttcaagggattgatataaggcagttctcaaattgtcgtcctgggaccaggagcatcgcatgagaacttgttagtgacaacgttgaactttacctgagaaccagagaaacaaaatgaagaaatacccccaaccttttgtgttctgggaaactccttcttttctgacacagagcagggatagggatgctcctcttgttttcctatgacaaggccagacgcagaccctccacattcccattctttcttcacaaacgatcagctgaactgcttgctaaccaaactttggttaagtgtctctccttcctccaggtgcgtgaactttggccagcatacaaccactcctgagaaaacgctggtctcaggtggaaacattctctgatccacagcacattcaactcccacccttttcatgccactttcacataccctattctttctacttggctactcctccctataaaacaacttcccccttgtacctaactctagagacccttaaagatcttaaggtcagaggttctcatatggcaacagtccttcctccctaaaacgaaacagtatctttctcccctttgcaataatcctttccagtgaagtctctccttcctcaagcatggcttgttttttatttggcattagaaatacaaattctcgggccccactccatactttctgaatcagaaactggggggggggggggcggggggtggagggcgatgtacccaataatgcatttctcacaaggtctccaggcacagtgtgggaagcactgatttgaggccatcctgctaagaatctgatgagtgcattcaacactttaattctctcccgctggcgtttgacagtttaggtgcaagctgtttctgaggcttacggtggaaaagttcttagcgtccccacagactacttcccgtaaagtcactacccaagggcacacaaggccatggggcgccatcttccctcccaccgcgtggggccgaggaagcccaaacccgcacctacttacatctccgtccatcggcctctggtcgtcacagtccctggtggggctaatgtcctggcgcatgacccagatgggctctttgggctcgtcgggggtgtaaggcgaacggatggtcctggttttcacctcctcgatggcctccttgatgtccttgatggccagcgagatggcatcgcgcttctccttgctgtaccgctgccccgcctcgccgccgcccgcggggcccaccgcccgctgctgccccgccggcgcctgcagcccggggctgtcggggcgacccccggccggggtagggggacgctccaggtcctgctcggcctcaggcatgtcctcggctgccttgtcgaggctctgcgagctcatgctctgcttcacctcggccactatctggtcgatgtcctcctcctgctcgtagctgtccatgcgcgggtagggcgcgaactcggcctccttctcggggctgtcggactcgccgtcggagcgctcgtcgtaatggtgcagccgcgcgcccagggcctcctggcggtacgcggccgcctcgtcgcgctcctgctcgtagagccgcaggccgtcgcgtgcgtccagctcgggcgcgtcccctatctcctcgtacacgtgctcctggaggccgccgtagtcggcatagggctcggagtagggctcgtcctcaccgcggtggaagagccggtgcgtgtagacgtagcctgagtaggccgcattcatggcttcctcgtgctccagcgagtggaagtgcaggtggttgggcagcgcgcggcggtgcgtggcctcggcgtgctcggcctctgcctgctccgtgtactcctcggcctcgggccggtactgcacagcataggcgctctcgtcctcggggtcctgcgcgcgctccgcatcgtagccgtcgcgggccgcggcgatcacgtcgccctcggcggtgtccgtgtggttgtggaagccgctctccgtgctggctgagcgcgccaggcattccccgcgctcctcttcctcctggccgagctgggcgcggaggtcctcgagggctcgcccgcgctggtggcggcccacatagtgctgctgctgcggcggctgctgctgttcctcttccacctcggggtgctccaggtcggcctccaccgactcgttcacctccccacctgccgcctcgtcggtcacctccacctccgcagacccctccaagtggttcatggtgggagtcggaacggctaggagagaagctgggcccggctcactgcgctctcattttgctccactgggctggaaaaacaagaaggggagaggctgtcacgtggtgcaaacagtcgttatgagctgagtattcagataaccataaaaacaactgctattgattccttttagttctgggtcaattaaaaaaagactgcaaatttaagttcaatctgacagcacatacatagcacgcatcataatttgtaattacatatctacttgtttaattgcttattgcctttctccgttcccacccctcacactgagcgcctcaggaacgttttgttctccaccacgcatacgattcaggtcccatttctgatgcatctgaataaagagtactactaaattgaatgggccaactgacacattttccatctgctaacagataaatctctccaaattaaactaggatcctacaactttagaaatcactctttacatcaatttcaaagaaacataatcttgaacaccttttgaagccattctgagagaggctatcagccagcagtggggtcccgccccggttctgtcattactgactttgtgacctcaggcaagtggcttaattttctggacctccacggtgtgactggactcatttcctacatgcaggatgttaacagctattatatagggtaaaaaagactcggtggtcaagtaagtttggaaaatgctgagttacagttgacttttcattgttaatatccagaaggaggaagatgcaggacacagggtttccctaacttgtttgaccaggagacactttttcctagaggccaatgttacatagcagctggtttctaatagttaggcttccctattgcgcactcagcatccaggatacaaccaaccacggaagacaatattaggggaaaatatccaacacaatacaacaataaaaaataatgcaagtaaaaatacagtataacaacaatttatatagcatttatattgtattaggtattatgagaaatctagagatgatttacagtatatgggaggatgtgcatagatcatatgcaaatactataccattttataatggatttttatatccactggggtcctgaaaccaacccccatggataccaagggaggactatattcactttccccatgtaacctgaatctaaaattctaagattttatgagttgccattatagctagaactggataacaggtgtaattttttaaaaatatgggtaggtctctttctattttcagagaaacttgtagctcgagagaaagatttggtttcagtctctctcaattcttcttatcacaaaatagctttatggtataatctgtgcagtatatagaaatagacacaaagaatgtaaacaaccacaacaaaacaggcaggacccctatgattttgagatccctatggtaaataggctcaacagtatgtgtaaacttgctattatgttcttttggagagcctttcttacaaatggacacaatggatgggaagtgaactcttaaatatgataacagacaaccccaggaggaccagggacatctgatggactctctagtagtgagatgcattatattctactcaactccccatcacaaccacagcaatttccttcaagcattgatgaccatcccaataacaaaggagatcattttggagctaccaagtccacattcaagcagaagtatcatgtcttccccattctttgatggatccacccctgactgattctcgctagaagaaaagaatcacggtttacaagagatgaacaatctttattgcttcgctacttgacataagtcccacttgatacaaattagacccaacctcttttgaaaaattttgggctcctcccattaactcctgagaacagcgactgtggactaagtataagaaagtctccaaaagcaagtatgaatctcccttcaaaccttgatggatggttaaggctgtaaaccagcagcagggtggggtggggaatgattagaagctgttccacctcagatcatgaggcattagttagattttcataagagtgcatgacctagatcctttgcatgtgcagttcacaatagagttcatgctccaatactggtccatggcccagtggttggggacccctgctctaaacagaagcagcaagtgttgctgctacgggcctccagtggattataagaaacacaaaacaaatattcaattcaatacaacacatggacaagaacatcatacccaagttgccttcataaggactttctcaaaaagacaacagataaaccttcattaaatctacattgggttcttaaggtacaaatctaattctaataaacacaaagtgagcattcacagaaagggatagcaaacatatcacagactttcttgggttctgttacccagaggtgtcacagttgtgtgtggtcagcgtaagaaaaacagtaacaaaaaccacagaaagtacctgaatgaccaacaattcatgataaccatatgtggaactgaccaaaatgctgccttcagggaaaatggctgttctttagcttgatgaaaatctattgacatatgtattaaaaagaaattttagcttattctgggttaaaatcggtgaatggtgccctcttataacccatgtattgattcaaaggaaatggaacttccttgcgtgtatatacactaaactgtggtaaaggaagttctctggtggggcagggggtggtggaagatagtgttaatgtagttttggtacaatagatctttttgttcactaagtaccttctccttatacccccatccacagacctcacgggagtatttacacatacagtgtttgtattttacacaccatcatgtttccaagaatatgatttgggttgtggtattgcaacatgttaatgaataacagacattgactttgggggtttccctaggacaaaaaggcaattgtcaacttttaaggaaggagccgaagttgatgcttaggtttatccctacacacaagaggactgttctccatacgctggcaactttgggagtggtatttataaaaaacatttaagctgctttttaaaaatcctaggttattgtgggagtatattattggtacaaaatttttgaaaagcaatttggcaagatgaattaaattcttcaaaaggtaacataccttttgccccagtaattctacatatagaagtctaaaagaaaaaacttgaatgtggacaaaaatgtttctcacagtattttcttcaaaagcaaaaattttaaacaccaaatattaagcgctaatatttattaggtactgataagtacaatgctaatcatattagggttatattgtgatcagaaagatgtgggggttttctctctgggaagctccacctggagttcccataacacttcaactcagccagccacagctgaagaaatcacacctcctcaccttccctacccaccctcgctctcaaactgggttccctcctgtatttcccatatgggcaaatggtaccaccagccacccactgaatcatctccttcccttatctccctcctcaaactgatgccagagtccactgtcttaataactcttggatcagtcttgctgccactgctttgtcttggtctgtcttgactacctggttgtttccttgactctgatttatcagccccctccagtccatcctccccactgccagcctgatgatctttaaaaaatacaaatctgaatcccataaccctactcctcaaactcttcagtgattcccttctagggcacagtataaatgcttagctaactatgtcccaggtactactaggcattttccacgtgacacatttaaccttcacactagctaatgaagagtactgccattatcagctcttctgaaaatgaagaaacaagtgattagaaaggttaggtgattgtcccaggtcacacatctggtaagggaggccccctgacatttgatctttgcactctagctctggggtctgggctcttgagtcctattcctggccaacaaagaccttgggatgcttcacccctttagtccatctccacacttcatcccgcaccctgcattctaacagccaaagtcctggtgttggccctaactgccctccctattcatggcatattttaacctataacttttctttggtgaatctttcttgtcttccccaggccacattcatacttgatgaatgttaattaggtgccagcctccaggcacattcgaggcactggggcagaacagtgagcaagccagaggaggcttccctgctttcaggaagtccccattctagtgcactgggtcgggggtcagagggaaaaaagggcagacaataattatgtaagtaagtaaacaagataacttcatagggaaacattttatgaaggtaatacaaaacagagtaacgccatagaaaatgactgaggagaggacattatgtagatattattcaaagaatgagatatttgagttgaggtctgaataatcaagaaagaggtggccttgtgaagatctgagggcaagggctttgaggtgagaaaggatcagctgtgttcaaggacagaaataatgtttgtaggcaggtgtggcgtgagtaagggacagtgtgatgggcgatgaggacaaagagatggaaaggggctgagttgggcagggtctggtacatcatggtaaaggatgtggattttatttcaagtgtggtggcatgctactggggagtttaagcaggggattgataaggcccaactaagcctccctttgtgcccgctgtgctttttctctctctccctttccctttctctctccgtctcacacatactcacaccattttatacacacacacacacacacatatataaattatatatatatatatgtgtgtgtgtatatatataaaatttatcatggcttctatcattctgagtggtaattctttgtaagtatcaagtccttaagaaaaagatgttttgtcatgtatctttgattttctgatgccaagcacagagggtatacagaaggtggtaaaggaatttttagtaactgaaaaaggaaaaatctttatcccccacccctcccacccaatagttggggccttatagacttctagacattggcatgatcagcctttggagaagaactcatttcttctttctatcttaaatctttgctgcccttattcactcatgcaaactccttcaacttcttctaatgctttaagtgcctaaagaatgcaaatgattcaacattctcctgcatctgagtgtgttaatccaatgggcatttatcagacatgtaccagtcactgtgcaaggcaaaggggatgtaaaagtttctaaactatggtttagggcagacagctctgacagttatgatacctggtgataagtgcaaaatagaaatatactcaagatacaaaagcagcccagagttaaaacaatgacaacaattgtaacaccttgtgactcatattaagtgctgctgttcttatgggttctggatttcatgagctagtgagcatcctaagcaagcttaggaaagaagtgacatcatctaataaatgtccttgatgatgacccatgtgcctctggaggaagacagaggcaaatagaggaagagcggctgatggaagaaaatctctcttcctctacaaaaaagttggatgacctggaagacacatgcagaatagtcccctcctcagggacacctgcaaaacatgaagaaggggtgctgtggcatcctggctacaggatgagggtctccacgttaccagtggtgaagcacagatggctttctggtctatggttctagaatgttccacagcttgggtggaaaaggtgaacaaaaagagggaattccacttcagtgcaccatttagaaatagaatagttcatgattcagcagttgaatccaggtatctcataatgtgtagcagaggctcgtgttgatttgggattgatagaaggggaggctgtaaattactttagttgctctttccttaagcaatcattgatgagcatttccaataaactgtcccttttagcatattcagaagtagtgttagaagaagggtcagacataaggcaaatgcaatgtaaaaaagagcaaaaggcatcataccatcttaacacagagagaagtttgtgtacgtcagtgatagagaacaaagaagagcattacataatgataaagggttcaattcaacaagaaagcttagctatcatgtatgtgtatatatatatatgtatatatatatatatatatgtatatatatatatatatatatatatatatatatatagacacacacacacacacacacccaacattagagcacccagattcataaaacaagttcttctagacctatgaaaagacttagccatacaatagtagtaggggacttcaacaccccactaacagtgttagatcatcaaagcaaaaaactaacaaagaaattctggacttaaattctacatttgaccaattggacctaaaagacatctacggaatacttcacccattaaccacagactatacattcttctcaactgcatgcacatggaacatactccaagatcaaacacatgcttggccataaagcaagtctccatgaattcaaaaaaatcaaaattaaaatcataccagccatattcttggatcacaatggaataaaatagaaatcaataccaagaagatctctcaaaaccacacaattacatggaaattaagcaacttgctcctaaatgacttttgggtaaatgatgatattaactcagaaatcaaaacattctctgaaataaatgaaaagagagacacagataccaaaatctctgggatgcagcaaaagcagtgttaaaaggagagtttatagtgctaaatgcctacctcaaaaacttagaaagttctcaaattaacaatctaacatcacacctagaggaactagaaaaacaagaacaaactaaccccaaagctagcagaaaagaagaaataactaaaatcagagcaagaatgaagaaaattgagacccaaaaatctatacatagaatcagtgaagccaaaagttggttatttgaaaggataaacaagattaatagactgctacctaggtaaacaaagaaaaaaagaagatccaaataaatacaatcggaaatgacaaaagtgacattataaccaatcacacagaaatacaatagatactcacagactattatgaacacctctatacacacaaactagaaaatctagaggaaatggataaattcctggaaacacacactctccaaaaattgaatcagaaagaaattgaaaccttgaacaaaccaagttccaaaactgaatcagtaatacaaaaaaaaacaaaaacctaccaactgaaaaaaaaaaccctgtaacagatggattcacagctgaattctaccagatatgcaaagagctggtaccaattctactgaaactattacaaaaattatggagaagggactccctaactcattccacaaagccagccattatcctgataccaaaaacctggaaaagacacagtggaaaaagaaaactagagaccaatatccttgacaaacatagacacaaaaatcctcaaccaaataccagcaaactgaatccaacagcacatcaaaaagtgatccttgatcaagtaggcttcattgctgggatgcaaggttggttcaacatatgcaaatcaataaatgtggatcaccacataaacagaattgaaaaccaaaactatatgatcatctcaacagacttggaaaaagcttttgatgaaatccaacatcccttcatgataaaaagcccttaagaaagtaggcatcaaaggaacatacctcaaaataataagagccatctatgacaaaaccacagccaacatcatactaaatgggcaaaaactggaagcattacctttgagaactggaacaaggcaaggatgcccaccgtcatcacctattcagcatagttttggaggtcctaaccagagcaatcaggcaagagaaactaattaaaggcatcaaaatagggaaagaagaagtcaaaactctctcttttccctgacaatgtgattctatatctaaaaaaccctaaagactatgccaaaaggctcctagaactgataaataacttcagcaaactttcaggacatgacatcaatctacaaaaatcagtagcacatctatgcaccaataacgttcaacctgagagccaaatcaataactcaattccgtttcaaatacctgtgccccccaccccccaaaaatctaggaatacatctaagcaaagagaataacaatctctacaaggagaactataagacactgctaaaagaaatcatagatgacacaaacaaagggtaaaatggattgaaagaatcagtatcattgaaatggccatactacccaaagcaatttacagattcaatgttattcctatcaaactaccaacatcatttttcacagaactagagaaaactattctaaaatttatacggaaccacaaacgagcctgaatagcaatcctaagcaaaaagagcaaagccagaggtatcacattaccagacttcaaactatactataaggccacagggaccaaaacatcatggtacttgtacaaaaacagacacatagaggaatggaacagaatagagaattcggaaagaaagctacacacctacagccatctgatcttcagtcgaagtcaagaaaaataagcgacggggaaaggactccttgttcaataaatggtgctaggatagctgcctagtgatatgcagaagaatgaaaccagacccctattttccaccatgcaaaaaattaaggtggattgaagataaatgtaaaataccaaactataagacttctagaagaaaacctagaaaacatcatttggtcttggggacaccacatcagccttgggaaagaatttatgatgaagtcctcaaaagcaatagcaacaaacacaaagattgacaagtggaacataattaaattaaagagcttctgcacagcaaaagaaactaacaacagagtaaacagataacctatagaaagagcgaaaatatttgcaaactatacatctgataaaggtctaaaatccagaatctataaggaagttaaacagttgaacaagcaaaaaccaaataaccccattaaaacgaggaaaagacatgaacaaacacttctcaaaagaagacatacaagtggccaagaaacatatgaaaaaatgttcaatatcactaatcatcagagaattgcaagtcaaacccacaatgaagtagcacttcacccaatcagaatggctgttacaaaaactcaaacaacaacagatgccagtgaggctgtggagaaaagggaacatctatgcactgttgggtggaatgtaaattaggttagccactgtggaaagcagtttggagatttctcagagaactacaattcgacccagcaatcccactgctgggtatacatccaaaagtcaattgttctcggtagaatattgttctaccaaaaaggcacatgcacttgtatgttcatcacagcactattcaccatagcacagacatggaaccaacctaggtgctcatcaatggtgggctggataaagaaaatgtgggacatatacaccatacaccatggaatactatgcagccatgaaaaagagtgaaataatgtcctttgtagcaacatgcatgcagctggaggccattgtcctaagcaaagtaatgcaggaacagaaaaccaaacactacatgttctcacttacaagtgggagctaaacattgggtactcacggacataaagatggtaacaatagacagtggggactactagagtggggaaggacagaggagggtatgggttgaaaaattactgggtactatgctcagttttgagtgatagtatcagtcacatcccaaacctcagcatcatgcagtatacccagataacaaatctgtacatgtaccccctgaatctaaaagttgacattttaaaaaattgtgaaaaaaatgttaatataaatgacttgaacacatggtacatttattaatattattatttcctaaataaggctatgtagggttggaaaacaagcagttaagctacttttgatctattttgaaatgaagctgggtatagatcaattaatcaaacaacaaaacacaaatactgaactatgcataggccaatatatgtggtattttacttactatatttctagccctcacaacagtcccagtgggaattattatctgcattttctgattatgaagcagaagctcaggcagcttaaataacttgtccaaggtcacttagagctgaaaggggtggaggaggtagatctgcctggctctcactgtttgtgctcttcctattacattacactgagcccataaagtgatacaattgatttttttaaacaaacatctaaattggtgtaatcccttttagaatagtcaccttggctgactctatacttactctatacttacaagttccaagggcactgtgtttgctgaaaacactttggccactcctatattggaagtgatttcgaagttaatttttgggctttgaaactaccagcaaatcactttcaatattctataatcattttttgttatatctgattttttaccttaaagggtatcatccaggtaatatcatgctaatatcatgcaccttatttagaagatttggctgtgaacgctttttgatgttctccaaatatcaagtatatccctaaaagatgaagatgtgcatcaaaccaagattattaaaaagactctggcataagctctgaagttaattccaaaagatggctttaaaaattgctttggctagtggccacatctttaatataagccttcatcctcacagagaaaataaaaggacagaagccaattgggtgaatatatttatattattgtgtgatgactacagaatcaggttcattacttttatcccaccttgcagtctgtataatttttgctaacactaaccaggcaggaaaattaattcatccacttggattaattcagtagtgccaaccacaaagctctgatcacagcccagcctttgattaaagagaaaattttgaatttatgcagactttcttattgtctagcactttaacaatccaatcattcatttatcattctgattccaataaaatacatgaaataagcttaaggcaatcactgaaactcagaggggagatcttgcaaattttacagaaaactcaagagacagtctctggaaattaaagccaattaaaagtctatctgaatttttgtgaaatgccttggtataaaatcaaaaatacctacataattcataatttattgaaggttatacaaacttggtatttttattctgttacaatcccttttttatgctcctacacaacttcctttctactgttatctctattgctacactacactaagtgggggcgagggtattaaatcaccaggtacaatcaatctgtaccattttcacacacacacacacatacgtacacacacacacaacactacagtattaaggatagtaagtctctaaaatcagttaagctatgttagttttcagaggctcattaattcacactgccaaaggagatgaaaacagtgatatcaggcaaataacgaattgaacagtaattcattaaaatgtagtctttttttttgagaccacatcacttcaaatttactgctattgttatgtttacagattatttggctcattaaaagtcagttaacttgcctgtctctattctctcaagttttctgtagcttcttctagcatcttccttctccaaatttataccagaatatcagctgcaatcctaattatgaagcttcagattgaattcttgttcctgagcttctttgtattcatagatcaggaaagcagcaaagactatgctggtcataatcctcaaacatatttttggttatgcctcaaatctgctatgctagggctatactaaatgattaaaagcagccacattcaggaaggctcacttcctgacaattcagcttcacaactcccaaagaacaaaatccactaagcaactattaggtagcaacaatggagatgccttaaatttgaatttgatgagccagaaatcccataatgattcaaagcctcccaagacaatcaattctctaagttcagtcatgttagcaaaaagtgaacaggaaaagaaatataatgtggggaaaggcaaaaactattttttcttaaaaatgacaagtcgataatctggaaacccataatagttcattggccgtgttgatcagaatgtaaagagatatggtatctgcatttatactcttctagttcactaatttcattttggctcccaataagggaagatcagtaaaatccaaatgtggttttgaagatccacaacctttcagtcacctcaagggaagacatgagcttccagagaaaattctttttaatttgctttattaaaaataatgttcatcttcagattaaacagaccacctatagaataggagaaaatatttccaaattatgcctctgacaaaggactaatatccagaatccacaaggaactcaaacaactcaacaagaaaaaagcaaacaactcaattaaaaactgtgcaaatgacatgagcagacatttctcaaaagaagtacaagtggccaagaaacacatgaaaaaaatgttcacatcgttaatcatcatcttataccaatcagaatggctatcattaagtcaaaaaacaacacatgtaggcgtggatgtggagacaagcaaacacttatacactgttggtaggaatgtaaattaattcaatctatatggaaaacagtatggagagttctcaaagaactaaaaatagaactaccatttgacccagcaatcccattattggaaatctactcaaagaaaaagaaatcattatcatattaaaaagacacatgcacttatatgttcattgcagcactattcacaatagcaaagttatggaatcaacccaagtgtctatcaatggttgactggattaagaaaaaagttgtgtgtgtgtatatatatatatatatatatatacacacacacacacacacacacacacacatgcaacactatggaatactatgcagccataaaaaagaatgaaatcatattctttgtagcaacatggatagagctatagtcattattctaagtgaactaactcagaaacagaaaaccaaactcctcatgttctcacttacatgtggaagctaaacagtgggtacacacggatatgaagatggaaactatagataccagggactccaaaagaggagagggtggtaaaggtgacggttgaaaaccttacctatctggtacaatgttcactatttgcgtaatggatacaccagaagcccagtccccaccagtatgcagtatacccatgtaacaaacatacacatgtacaccctacatctaaaatataatttttttaaagtagtgttgatcttactgaagacagcatagggaagactgaggtgggagattatatcacataccacaccacttatcctccaaaaaaagtctgtattggttaaattttccaaagtctttcttctcagtcaccagccatagggttgcccctctatcctacatagtcgtgagtcttaatggttcatgtctctcccttctggatcatcacagtccagaaaaaaatgtaatgtgagtcacatatgtaattcaaaattttctagtatgcacattaaaatttttttaaaaagaaaattttaatattttatctaatatattcaaaatattatttcaacatatgatcaatataaaaattattattgagaaagtctacattcttttcttcctacaaggtcatcaaaatccatagtgtatcttacactagagcacatatcaatttggactagccccacttcgagtttgacagttacacatggctagtggctaccatgacagacaggacagttctagtccttccttctaagcctcctaaactctttcttttcttttgcagaataatttggctgtgtcagctcttccaaaagtgcgtaccatcaccctccttcatcaccctgttcaacaaagaaaagacccttcaattatcagaattttctctcttaaataataggacattatgaaccaagtcctacactgcctggtcctcagtctcccaaggggcctggctccattattcttccatccctcattccttacccctgtcctctaatttcaggtctcaatgggcccctcactgtcattgcacctgctccttcccctctccagcactccagccttgtcctcccttttgccttatgtgtcccacagacaatcctcagttgcatgaccacagctcacccactgcccctgcccttcagcactcatggcctctgtaggtaaatcagtaggagaagttgcccaaagatttcttagacaggcaatgaggctcaggtgaagccagggaaagtaaaaacagagagaactcttttctctcacttggaggaggagttggaagaggaaagagaaccctaggaactggggaatggagtaaaaggcaggaaagcatagtggttaagaatgcacactgagtcagacttcagactgaggttccaatctcagttccagcactcactggctatgtgaccttgggcaagtcacttaaccttactgtgcttcagttttctcttctcaatctggctcatactgcaagaattaaataagctaatgtagctctaagaacaagaatttaaaaatatacttgtcaacccatagattgcacaacacaaagagtgaaccctaatgtaaactatggacttcaggtgataatggtttatcaataggttcatcaattgtaacaaatgtaccactctggtaagagatgttgatagctggggaggttgtgtgtgtgtagcagagggggaagggggaatatgagtactctgtactttccattaaatttttctgtaaatctatgctgctatacaaaataaactgtatatgtatacattccattaattaaaatatacaagtgagactgcttcactttaacaaaactaaccttaactgaagcttaaaagacatgtaggtgggccacaagttggccactgtcctatcactggcccaattctaagacccaatgagtccaagtgtgggtggcaggaacctgactggcatgggaggtcgcttcccgaccacctggcacaaatatcgccctgtgacatctgtgtgtgttaactgctatctctggagcctcctgccaagcccgtccccacactctgggcttctggctcacaaagtgcctgctcatgcattgatagcactaggctcacatctgctgctgtgacttcccagcatgctgcaaccaagcctcattatttcagtgtgtgctttggtgagttgttgagtggctctgcttgcccacctcacagcagcctgcttcagtgtacaataccaaacctctttgaccttgtgttactcatacccatccacatccaactcaggaaaatcacacttctaagtagtcaagctgtttgcagcccttgatttgcaatcattaattcttacaacctttcttccatctataaaattggtccatgaagggtaatttgaaagtatccatcaaaattaccactcagaggaatttacgtatatactcatacttcatacataattgtgtgaaataacttaagtacaaggctatttaaatgactaatgcacagtttgtattcacaaaagaccaaaaacaactaaaatgcccatcattaggcaattggtaaaataaattatgttgtgtccttggatagaatcctatgatacacaaagaaggtgatctgtataacagatatagaaagaactgccctgatccattaaagctcagatcatcatgtaataaatattgctgtgtatgtatgatggaggggacaggatatatatgtattaaaatctctgaaatgataagtaagaaattaataacagtggctatttcttttggaggcagggaaggaatgagaacagtagattggggactgggatgggatagaggcttttaagcatattcctttttgtacattacgatgtttgaaccatgagcctattaaaaaaaccaaatacataataaaaataatgacccattctgcctactttatgggagtggttgttgctttgtaaacagtaaagtgcctgagaaaatttaccttcctgtcttgctgaggaagggctttgaggaagggctgatgagctgaatccctgcaaaacctttctgttcagctgctgaaggaattttctcaccacatttcaggtttcttgctgccatgttggtactcaacttctgtttactttaagccttgctattcaagagtgatgtctctgttcacaaattgcaggggtgggagtggtaaaaaggactctaagagttgttatacttttgttggaacttctagtccaggctgtggtcattcacatctgtgctccagaaattcaatactatcagttcactgatggatatgattctaaagtaacagaaatatagaactgaaagcgttggcaaagcccaacaagttctatattttacagagaagaaaaccaaggagtggagtgattgcatggcttgtccaaactcatgcatgtgttaatggagcactagagagcttgttgctgggtctctttctgcacctccttccactgtcccaccataatcccaatggattcatttacaaagaggacatgacatccaattatagaagaaagatctactaaacaaaagaaaataattacaacaagatgcttagaaaaataatgtcaaagcaagggaaagtaattcaaaatatgcaaacaacacaaagcaaatctgattcgtccaccttcttttctacctaaagaacacttgaatttccaatgttcagcatacacatgccctttctgaggagagggcaaggaggacctgccatttatatatggctatttggatacagagtgtggcagaactgagttcctgcccaccaaaaattgaagctcacccttcacaatacagcattggaactacatttataaactctccttgcgtctagctgggaccatggttagttctattcaaagacataaaagtggaagtgaggatgtcatttctgagctgggtcatctaaccaatgagtttgctttttccatgttctctttcactataaatgcggaggactccgagacccaaaagatatcagaatctccagaaggaagtatcctggatccctgaatcaaccacttggaggaaaactgtgttccaaccagaaatgacctgcattggattaccactgttaggaagttaagttttaatacaataagccaataaaattttggagttggtttatgttattctaaatcaatgcacaggaacatttcactgggacctgaaaatgagcctaactctcagctttaaaaaagaatcacaagtatcatgagaaaaatatccccttttcactgtttctgtttctcttctaggggctcttctaattcttctaggggttacttccataactctatacgatatatcacaatttattgacttaatttaggcaatatctattgacttcctactgtgaaagatgaggatatagctcacttaatttctccttttctctcccaatgtttaataattatatttttattcgttacatttgtaattttaaatactatttttataattagtatattgacttctttttccgtaaatgacacatcatctggtctttctactttatctttccccttctacctcccacctgctgtcaactacaattttactttttatatttgtcaaaataacatgtattttatcatctgccaacacaatcaacactctgatgcttttttcataggttgatttgaaatcctgaaactcaataaagaaccattacttgattatgactatgtaaataatgttcacctgtgtgccaaggaatcacctgcagattttgttaaaatgcagattctggctggtgggtcttgggtgaggcctgggattctgtatttcctctaagactctagctgatgctcctgcagctggtctgagatcacatggaagtagtttccagcattcagtggtgctaatgataagcctggtactaacctaactcctatcccttggtagttttttctctctggtacctttcaatatgtttttcttattctcagtgtttggaaatttttggaagatgaatcaaggtgttaatcattgtcctgtgcacttggtaggccactcaatctgaagagctgtgtctttcttcagctttggggaatattctattatttctgtgatcgttgcctccctctgcctcctgcccttttctctggttttactttgagactcctactggtcagatgtcagagcttctggaatgatcctctacttttcttatcttttctctgtttctatctcattctctttttgttgtatgctctgttctatttcctcatcttatttttccccaggccccctctattgaatttttggcaagcctatgtctaatctctaaaagctaaaagctctttcttttcctattatctgtttttgtatcacttttaaataaatattatgcctttttagagttctctgaacacattaatgagagctcttctttgtttgaagtgtcctggtttgcctttgcttcctctggctcacttttttctgtgtatcttggtctctctctttcatgttgctattttcccccacatatttggtgattctattcatacttaaaaataaaggattaggtagatggcgtgcagttttttgtttttttttttttgatgttgtacaagtaagtctgtttctcttcatttattctgtttcataatgtcacaatttactattgcttactcattctcttattcataatcattaggtcatttccacattttttcctatgcagtgtttcaatgaacctcctcatagattatatccttatgagtgagtacagttatttatatggaacccctaaaactgacaatgctagttgaaagcagtacacatgaaaaaacaagtttttattatggaaaatgtcaaatatatgagaaactagggagaatggtgtaatgattctccttatttgcttgagaggattaaagacatgatgatggccagtcttgattcctccacacgcctgttcatttgccccatcctcttgtattacgttgaagcaaatgtcagaaatctaataatttcatctgaacttgtacacattttctatagcggtaaaatatatataacataaattttaccacttgaactacctttaaatatacaattcagtggcattaagaacattcacataggctgggtgcagtagctcatgcctgtaatcccagcactttgggaggctgaggcgggcagattgatggaggtcaggagtttgagagcagcctggccaacatgaagaaaccccatctctactaaaaaaaaaaaaaaaaaaaaaaaaaattagacaggcgtgttcgcacacacctgtgatcccaattattcaggaggctgaggcagaagaattgcttgaattcaggaggctgaggttgcagtgaactgagatcgtgccactgcactccagtctgggtgacagagcaagactctgtctcaaaaaaaaaccacaaaaaaacaaaaaaaatttacatagcccaaacccctcctttatgtgatatatgcatgtagccaatctgcacgcctctcctgaatctaaaagaaaaaaaggcaaaaaagaacactcatgttgttatgcagtcatcaccactacgcactaagatatatatatatatgtatatatatatacatatatagtgtgacttctcccaaatcttagtaatttccccccatctccaaagaacttctatttctctacatgtgaccatcaacatatttttctttttttctgggtaggaagagggcaggaaacaaacattcctctctttctttcccaagttctgaaccaacaaagaaacatataggagtcacacaaatgtagattttaaaatatcgtctgaaaagctgaattggatgatgtgtctttagctctgcaatcaaactgtcttacgaatacttcacctctgcactaagtagatgatcccaccttttcactgggacagctgtcaaccatcacaggtgcacagcctgtctagggaagcctatatggctaggagcacatggggatccatcctcaattcaggcaaggagagctggaaaaagaggacccagatggcactggccaacagacccacttcctttcccaaattctctcacaatcctcttctggaaaggagggaaggagggtcggggagagaagtcaggaatattctttcaaaataagtcatgaggcagggaaatggggcttccctaacagatgttatcaatttatttaattgttgtcaatctggtaagtgatgttttaacttgaatttctctgaaaaccaataaggtggccctttttcacaagcttattggccactgcatttccctttctgtgaactgcctggttttctactgagttgttttttttttaaacacttgccaggaggctttttaacattaagggtattaactttttgtctgtcacattgttgcaaatgttttcccccagtgtatcatctgtcttttgactggctttatagtttctctttccatagagaaacttaaaagttttatttagtgatgccacttagcaaagatgaggactgttttgttgtgataaaacacaacagaatcttgggcacccatgtttatggaaaatcctacaaaagcccattgaaaaaggctggagccttgaaaaaaaaatgcactaaaagacttgctataatagtttttatctctttcccttggttgacaagggtaacctcactgaaacctattagtagttccccagttatccatgtttcatctggccacttgcatgggcaggaaattctaaaatcaatttaagcaatttggggagtgaatgaggtcacttcaaaatgattttaatctactgtgctaattgcacctaaaatgcctgcacacatttctccaaatttaaaattctaattacgggttgacatctttaaacatcttggtgatataccctggagggggtggaaaatctgtgctgattttccctactgcatctgtaggtgaaaggatttgctggcatcccaaatccatggaacttaataaggacagaaaggtacttagtgctttcctggccctaacaccctacttatttaggagatgagaactcaagtggctattccaactctctctaggagccatccccaacttcctttcctatagcctagtctggatcagtggtttgtgttactcatctgtgcctggcacacagtaggacctcaaacaagtttgctgaatgatgagttatttgaggttacacacataggtagtgtcaaaactgtcctgactcctgatccaagactctaaacttctataaactgcccagactttggagtcaaaaagattctacttagagtcctagctctggcacttacaagatgtgtttttatcagcaaggttattaacccttctggactgtcccttgatttctttgttcccttctgttctgtcttaagcccattccaatcgggctcccatcccttctgctccactgaatcagcttttgtctgggtcaccagtgagttccatattgcaatatcttgtagtcattttacttaactactgggcagcatttgatacagcctatcacacacttgttctcaaagcactcttctctccaggcttccaggccaccactttctcctgttgcttccccatctcattggctggtttctctttatccgtcagacctctcaacactggaggacccaggctcagtctttggactcaactgttaagtatctacactgtcctcccaggtgatcacatgaaggctcatggtttatctaccgtctatacaatggcaattctgaaatttacaatgacagctcaaactgttcccctgagctcctttagacataactgtgcctccttaatacttcaccatggatgtcaaattatcatgtgttaaaacagacttctgatttctcattctaaacctgttctttccactgtctgcctcatcattcttcttccagttgctcagacaaaaccttggcattatcttttaatcctttttttcataccctatatcaagtctgtcagcaactcttgttatttctactttcaaaatggatcaagaaccaactaaacactttttattccttccattgcaaccaccagcatcttttcttacctggaccatgtcaacagcttcctaatttgtcttgagatttccaaaatctcgccaaagtgtaagttagatcacgtatctccttgaatgatttctcatctcactctccctcgcacctctcacctcagcgtctacgctcctcctgtccttattttcacagtcgcattagcctccttgctactccatgaaatgacaatacctgctttgcactctcctttccctctgcctctactgatcttctctcagataattcactgggcttattcctgtctcttctgcatgtgtctgcttatatgtcaccttattagccgggggcagtggctgacacctgtaatcccagcactttaggaggctaagggtggcggatctactgaggtcaggagttcaagaccagcctggccaatgtggtgaaaccctgtctctactaaaaatacaaaaatatagccaggcatggtggtgtgtgcctgtaatcccagctacttgggaggctgaggcaggagaattgcttgaactcgggaggcggaggttgcagtgagctgagatcacgccattgcattccaacctgggcaacaggagcaaaactccatctcggcaacaacaacaacaacaacaacaacaacaacaacaaaagtcaccttataagacatgctccctgacaacttatctaaaatagtaatctccatcactatctgcttactttttcttcatagcactttttacctgatatattacatatttatttattgttggtctctctcccccaccatgactgtgtccctagtgtctggaatagtgtgtgatacttaagaagtgctcagtacatttttttttaaattatggtaagaacacttggcatgacagataccctcttaataaatttgtaactgtacaatagagtacagtattgctaagtgtaggcacaatgttgtatgatggatctctagaatttactcatcttgcacaaccaaaactttatacctgttgaatagaaacttcccattgtcccctcccctgcaacccctgacaaccactacctactctctgcttaggtacatttgactattttattatttatttagttattttagagacagggtctcgctctgtcactcaggctggactgcactggtgctatcatagctcactgcagtattgatctcctggctcaagcggttctcccacttcagccttccaagtagctggtaccacaggcatgaactaccgcacccggctaattttaaatttttttgtagagactgggtctcgccacattgcccaggttggtcttgaacttgaactttcggcctcaagaaatcctcccaacttggcttcccaaagtgttgggattacaagcatgagccaccacgctcagcctttgactattttagattccccatataggtgaaatcatacagtatttgtttttctgtgactagcttatttcacttagcataatgtcctataggttcacatgttgtcacgtatcacaggatttccttctttaaggctgaataacattccacgcatgtatatatcacattttatttatacagtcatctattaatggacatttaggttgtttctacaccttggctattgtgaataatgctacgataaatgttttgcaaatatttctttgagatcttgatttcaattcttttggtgagtttgactgagattgctggatcataaggcagttctatttttaattgttttagggacccccccccccattctgttttctatatcagccgaaccatttcacattcccaccaatagtatacaggggtttccaatttctccacatccttgccaggacttgttatttactggttttgttttgtttttgtttttgatagcggccatcctaacaggtatgaggtgatatctcattgtagttttgatttgcatttccttaatgattagtgatgttaagcatcttttcatatacccattgaccatctgtatgtcctcttaaaagaaatgtctattcaagttatttgctctcttttttgcatttttttttttttttggtttcttgctgtggagttgtaggtcagtaaatacttttgagtgaatgaatgaagaaatctctattttaaaagaactaaattaaattaatgtatgtaaagcagttaatggagcattagtatgctgtgaattactcaataagttagtaataaaaacctaggaaaaaaatgagagaaacatttgacagcaaaggttcccaataaaaagagtaaatacactatagaaaagcagtttatttcctcttgaattaataagtaatttattaaaactttaaaagtaatttattaaaattcaaaagtaatttatttcctcttgaaataataagcatgttatttttaattttctttttagtttcaattcagcatgtgtttgggactaaggtgaacaccaattcccttggaccatctgagttaataccttttttcttttaaaaattttacttttataaaaataattttttgaaaatagtttaaaaatatatctatttataaggaaactaataaacatgtccaaaattatataatttctaaaaattaatgactatgttcagagcagttttacgttctcaacaaaactgaacaaaatgtatggagttcccatatacatctcctcttccctaccctgcatacacttgcctcccccaccattaacatctcccaccagagtggtgcatttgttgcagtcaatgaaccaagactggcacatcgttataaaacaaagtccatcgtttacttgggagttcgcgcatgatgtacactctatgggtttgaacaaatatataatgacatgtatccaccattattgttccatacagaatagtttcactgccctggtttcttttacttagtaatgtgcatttaaaattcctccatgtctttctctgccttgagcgctcatttctttttagcactgaataatatttcattgtatggatgctccacagtttatttatccattcacctatcgaaggacatcttggttgcttcaaagttttggcaattatgaataaagctgctataaacatccacaagcaggttgtgtgtggacataagttttcaactcatttgggtaaatagcaaggagtgtgattgttagattgtgtgtatggtaagggtatttttagttttgttaagaaactgccaaaatgttttccaagcaaaattatagaattttaattatgtttaatgcccccttttattctcaaaagtgtccaagtgtgggtgataaatggtcactgtacttaaaaaggataatttctcctgaattacagaaggacagtatttcaccctagttgtatttcgttgaaccaaatcaaaatgaatcacaaatagcaattaatcttctgaagactactggggagagaagagagggcaagtgaaccagttctcgttttccttgcaggagaaatcagcacaatgaggttaagaggcttctgcaggccccagccagccagctgcagagtaagagtgcaatcaaaatcgctgcaaactccatttactgtgccatcctctcaagaccaaaatcttcctttattgtccaattagttagggttccttagtttctaagaacagcactcaatggatttaaaacagactggcaggcctgggaggggccgtggcccctaattggagggagcccctggcagttctttgagcctggactgcgggctgctggcagctggccctccacttccactccctgctgtgctgggatttcccccccccccccccggcctgtcctccacagcctgcactgcacttgtggctctgcttgctgttttggttccctactctggggcagagcaaggaaacctggaaaccattagaaagtaaagcattataggtctgaggaagtacttgattttgtaccctgctacctttccagaccgccactgatctggccccctgtacttaaagaagaaatagctctgggagcagtccctcagttgtgctgacataccaagtgcacaggctctaggctgagaaggtcatgccagtcaaaagcactgcaatagcatttcatgttcctgggactcttctatgcgcttaaatattatttaacccttataagaactctaggaactagttgttatattacccaccttcaatttaaggaggaggaaaccaaggaacagaaaggctgagtaactttcccagggtcacaaagcagataattggtggggttaggattttaacttgcatcatatgacctgttccagaatctggtcttaataatgaagccatgcatctctccaatttgctagcaatgtctgaaatttccctgcttaacctaatgggttaattggatcactctgccatcattgcttccattcaaaggagtattttgcacagtataaaaacaaattaatttggatccaaataatttgacataaattgtaggcctctcaaactcaatttccttctggataaaacaggcatagattcagtatccacatttgttgcaagaataaaattatgtttataaagtgtggagtgctcgtatcaagaaactgcgtagtaatactaccttctactactcttttttgttattattatttttaggctgaatttaaactttccttcctcaatatctatgaaaagagtttgcaaacagtacctgcatatgtaaggtaccattaagggatattttaaaaacacttcaaaagcatttgctcacatttcaacaatcagcatgcaaattacaagtcatgcttaaatatttcttatggcacattgcaaaggaccttcccctgtcactctttgatggctgagtttctgttactgaatatagctgaaagtaatacaaagtcaatttaaatattatctatcattcagaatggctttctaccaatttattatacatgcatataacatactcccatgcagtaagatgtctttagacaggttcatgataatataagaaaataagggaactaataaaataaaattcatgtgcagagctttctgttgaacatcccagccaatcctcactactcatacagacttttagtccatacctaaccttatacacagggtccttcattattttgcataatagggactcctcccacaaaagaatagccttactattgatattgaagacatatgatgactaaaacatataactaatttggtaacatactgaaagaatttaaattgcatgaattttaagagcttctacaacacatatgctcaaaatataccatttattttcagtctatagagaatgcttgttatctaggtagatggtttcaaggaaggatcccttcagtaaatataagtctccacccacccccctgcacccaccattctctacccagggagggccttggcccaccggttaaaatccaatgtatggttcttcaatgaagctagaagacactcttgggggttctgttcagcttatcagagttctaccttctctagaattgtttctccactatccacatgatcctaggacctgtttcttccccctggccttagccaattgactaggggtagacccctcacccagaataggtcatagttttctacagaaatttagaaatgggactaagagatttcaattctcatctgggctggtttcatgaatggaggaacaaaactaccttaggagttgtgacttagccagactaaacaaaatgggcttgatagatgatgtgctagccggcaaagaaaaattaaaatggagaaagaacggacagatgtgggagactgggacaaaaagccaaaaccaaaatcaaaacacacaaaaaacaagagctgcctagattcttgctggctttccagtccctcatatggccaggctgcacctctggttcttggaacctgtaagacacttcccaattctttatatcttgtccccattttctttcctctttaagctagcttgagttagtctctactacttgaaactgaaaattctagccaatataaacaagaacacaggatcacatcaggcagggagacacctgctaactcacggaagatgcttgcagatagtcataaagcgttggatttttttgttcttattatttatcacatgttcaatctgtctctccctctggattctaaacacgttgatgtcagagcctgagcctattctgctacaatttgtaaccgtcagggtgacttttaaaatgcacatatgtaagaagtcttctttactataaagtcatcacgcattcatgatgatgattttataatgtcctgaatcttctcattttggctcagatgtgaaatgactttgaatgcaaaaagaaagagtatttgaaaacaagatatttttgccaattaacttacaaatgaatgaccttcagtatatatgcttgtaaacatcatggaagatacaggtggaagtcacctcttcaaagaaagagggggtatttgaagagctacttctgctttagctagagggaaaacacttttttatttttcataagtttataaattttctaaagtatgacaaactttgaaattatacaagataaatttactttaaaaaattaggaattcagactgagaattcttcagtccttcagattgagaatgcaatctgaaaatgaggttgtcatttgtatttggggggtatcatttgtattttttggcctacattttatttcatcagcataaaaatcagcattttgcctttcaggctaacccatgaaactgtggaaatctgaaatccttctgatcagagcattcacaacagtagcagagcgagttattctgatgcggaggtcagtctacttcagtgctggggaaataactgccagagatatgttgtgggttgcttttcctgcccacagttccatttctgtaggaactgttcccactcagggactctgcctgagctgccatgatttaattagggaagaccaagaaaactggagggagtaagataaccaagagggcgctgccccctaatggcttccacggtcacagatccattcctagggtctggccatcctcttttctgagaggtctttctataggtgtgaccaattcctccttaactagaactagcttaagtaagttgcccatttctggggggagagatactttgcaaagattaattttatcatttttccatgttaaatacacatggtgggcaaaagaaaaaacatcataaactatgtttcttataatatataacattagggaataaatcttaaagtaaggagcaggagagagcaaatggtttagagttaaaagatataaacaataacttaggatctttaagaggctgctgaagctctttgtgcctcagtttcctgaagtgtcaatgaaggcaatgctgatatgcacccttctgacccacctactttatagagttactgcaatgataaaatgagatcacatatgtgaaaaagctacggcagtttaaaagtgttacgcatacatttaaaactacttctgttttgaaattattagggctaaatttagtattaagaaagttcctttttcacaggttatttcctgttgctagaagacacttatgaatcttgtaagtctttagattgagaatcaattgtcggagtacagagaccagtgaggaattaaattcagttgcttaagaacagggcaacccctcttctctcacgccctcaatattgttctctcatacaaaagaaatccagagggggacagtccaaggatggtactggagttttacaatactgttacggaacaactcagctctttccagctctccagtcagccatccttagagcttgactcccacatttccaagatggcagcctcagtgcctgccacgtgtctgtattccaggcaggcaacagggacagggcataggtaaagaaggtgcatttcagcagtcagcttcttttagagagcttccctagaatccccatctagtgacttccatttatatctcctcaaccagaaatgtgtcacactgaccacccctagctgcaaggaaaacttagaaccagggttgttgtttggctggacaccttgctaccccaaataaaatctgggttctcttagtaatgaagaaaggaagaatgcatattgaataggtctctcttacactagccactgaaaatgctgattactagaatttgaggcaattgtattaattgtccatttttaagatagtttaatgctagacatattggtgataccctaaaagaaccaaagccccactgccttggccagtgccatgacttcaaggctggaagaagatccaagctttccccatttcagtcaagtgctttactcagcagtctactccatgtctggtttccaacacaaccaccacctggggttcctaccaacccaagagatgggttcagtggtgtggtcagtggaaaatggcctccaaagatgtccacaccctgggtcccagaacttgtacagatgttaccttacattacaaagggattttgtagacctaattaagaggatgaatcttaaaatggggagattatcctggatcatctgggtggcccaacctaatcatgagtccttaaaaatggagaatcttttccaactgtgtcagagagatgggaccaaagaaagaggaaagattcaaaacatgaggaggacttggcacaatcccctctcctgctgctgacttggaagacgggagaaaggaacataaaccaagcaatgcaagcagctgggaatgaccctcagcccacagctgcatggaaatggaaacttcagtcctacaacctcagggacctacattttgccaacctgaatgagtaagaaaatggatcatcccttagatcctccagaaaggacagagccctgccgacgctttgcttttagctccatgggacctgtgtcagcttcccatctacagaaccttaagataataggtttttgttgttttatgtcactacgtttgtggtaatttgttacagcaacaataggaaactaatataagtgggttggcagaggctgcaagctcttccgaaatattcttcatagctttaagcaagctaataaatgaaatgtctccttacctgcacagaaacagtttctgacaaattaacggactggaggccattaaagggtaaaaggcaatagggtgctcaggaggtaagcaagaaaaaggaaaagatggggaaggactgaaaccctggaagagaaagaacatggttatgtgctgttggaggctgcctgcaccaatgccatttggtcacacatgccctcagggctggccatgttggacatgctctagattgaacactctgctcattaactggttgcaatgctcccctcctccccacaaagcccctttgttcttctctttgaggcaaacaagttcatttgacttcggatctcatctggagttgaagtagctgacatctactttgttacagaagcagctgctgaggcagcaggacagctgaagccctgaaatgcccggggtggtgggaaccagacctcttagagtaagagcaaaggccgggtagggctagtcttcatgatgggcatgcagggaaatcacagggacagactcaaatgtctacagggccacacagatgatgcaaatgagtgaagcaagccaggtagaagaaaaagcaatatatagtagttacagaacagcacaagcgccaacgccaaacaaatccaggggaaggccgttgcaggctctcactttgcaatctcatctctaaagcaaaggacagggcacattagtggatgtaaagagtgggctggctgtcagtcaccctgctagatgtgggttttggggaggagaggctgtagccttactgtcattctccaaacactaagcccatgcctgggacactataggtgcttagaacactgtttaagaatgtcgtagagaggatacacagccagccgaggcctctgcactttttgtcgtcttgccctctgccccactttcacccaaagttgtctcaaaacccacatatttcactttttgccacttcgatcctatgagtcaccaacttcacactctatcagaatcatgacatggcccatgaattttaactctcaagttcgtctacgacttctcaaaacccctcggcctcactggcctgtaggtgacctctcgtggtaaaagagggtaactgcacagtgaagaaccttttacatccgaaaaattcgattcatatcaattcaatcaatagttataaagtgtccgaggaagaagaaaaaataaaagtaggggacctttaaaacaaatcgtaactttttcaaaaaaggaatactttgaggtggatagaaacacggaaagaaggcttacattgggacagaggagatataattttctaattcatatttttctaacttatttcccaggattgctgaaaaattggaactgagttttccaatcatttagtacaggctttcgatcctaaagatatggcacagaatctggagtctggtatacataatatgtgcaaatttgaggcacatcatttaaagtttctgagactcagtttctacatctgaaaaatgggaataataccagttccacttaacttctatgattgttatgaggtctaaattagatgagatatgtacagtgttttctgtattggaccttataatcttttggttcatgatatattctcatcagtcctcatgcagcttgctttcatttatttagctgttttattataaactgtacttgtaactgtaaagtgttgtgcacatattaacttagggatgcagtgataaaaataataaacttgatggaaaattatgcaatttctttccatgatataaacatgagttagattgagttcttcttcctcctttccttttaaatgctctctggaatttttctcatcctctttctcaaatcaattcagtcatcctttattttatttttttacctcttctgtattcagtttgttcccatattattttataagtgcccttcaattaattcattaatgtaggttcttatttgaaataatacaaagagaaatcatgtattatggtagagggttggagcaaattacctttaagtcactcattcatccattcattctgtaaatatttagtgagcttctattatatggcattgtgataagcacgagggatataaagtgaataaaatgaacaaggtctttgccctcatggaacttaccctgaggagtttacaatagaaataattaaacatatcctgtgagctctgagaagtgctgtaaagagaataaacaagggtgaagatacaggagatgggagagtgagcatgtagttatctggggaaaagcattccatacaaagtgaacagcaagttctaaagtcctgaggtgggagcaaagaggagcatcatacagtcctctaccatgtgtaagtaatttattggacatctcatggatatatgtgtacagtctatcaatatgcatacatagatatgtataaacatagatatatgtataaatatataagtaaatatacataaaatacatacattatatgaatatcttaaaaccttatcaggagcgtgttaaaccttagctatgagaaaaaatagtattgacatatcctgccttcagataaagttcattaaacatatttttgggacaagaaaaaatctggaaaagtaatttaatggatactttttggatggccttggtgacagatttccaggaatgaggtcacggctgctttgttaacactgctatacattgtcacttgtaacagcatatgtagcttcacaacttaacatcaatattttaaaaagtaaaataatctggctgggcgcggtggctcatgcctctaatcccagcactttgggaggctgaggtgggcggaacatgaggtcaggagttcgagaccagcctgtccaacatggtgaaaccctgtctctactaaagatacaaaaaattagctgggcgtggtggcacacgcctgtaatcccagctactcgggaggctggggcaagagaatcgctttaacccgggaggcggaggttgcagtcagctgagatcatgccactgcactccagcctgggtgacagggtgagactccgcctcaaaaaaaaaaaaaagtaaaataatctgtttactttgtaaacattagcttatggaatttcaggaccaatctctttgttttctgtattttttctgccaatattacatgattttattacaaaagaagtctgggtgaacttttttattgctggaacgaaaatcctaattactctgtatcatggagtttgaaggcaaggagaaacaaggctgttgaaaggttccatgaaatctctatcagtgcaaaacctgtgtaccatgaaatggtaaatctgcaacatttcattttttcttctaatcttcgctgtacagacagttgcaggctttctctttctctacttcccttaattccataaaactttaatgcctactctgcagaaggcatggcatctatggtttgagatggaaagacacacaggaggggaagaactgacttgtgctgagaggccaacatgaaactgttcagagttttaaagacatatcacacagttcactatggacagaaacttggaggtggcagttcctgcagaagtgttgggaatatggctggaaagactgagaagaaagtatcctgaaagctttgaatatgacaatggaagaggctgtttacaaaattttcagccatcatgaggattttaaaaaggaaaaaatgaaatgatagcaccagtgtttgcctccaagatgatcttcacaagttgggtgattattacatttaggctgagcctagatatgtcctccaccttgcttgattcattgtgtttttctgttcaagtattagaaaacacgtaccacagagcgaatggagagtaatcagctaatggctcattatttatgtataaaatgaagatgtcctgcacgaaaatcaattcacattgagttcaaatgcacactcacattcatctctaagtaacttattcccccactacccccatggaggattttaacaaacccaagctgggaagatgaatttacaacccaatttgttcttttctccaaattgaaatatcaatgcatccaaagagagatttaaaatcaatgacacttctaaattcaacacagatacgctgtctagcatttcaagactagaacttattgttaaagtgagtactgtttatactgtttattctgtttcagagcaaaagctatacttaaaaaagttgagatccaattcattcatgtacaggaagctaccctgacaggtttcattgggttttaaaatcagagttgagtggtcgcttcaattttacagaaatggagtttataaaatgtaaaccctagagagactgatatttttcagagttaatttccttctaccctcaccttgctcatctctgcaaatgaaatggtgccctttcttgggcttttttttttttttttgatagggtcttactctgttgtccagactgaagtgcagtggcacaatctcagatcattgcagcctcaaccaccagggttgaagcaatcctcccacctaagcctcctgagtagctgggaatacaggcatgtgccactacactcggctaatttttgtattgtttttgtagagacagggtttctccatgttgcccacgttagtgttgaactcctgggctcaattgatctgcctgcctcggcttcccaaagtgctggcatgagccaccatgcccagctggcacttttcttttaatggaggtataacttagataccataaatgcacagatcttaaatgtacaatttgatgaatgtgtgtatgtgtgtgtgcgcttgtatacacatccttgtaagatataaaccatttccatcaccctagaaaattcctttttgccccttctcagccaatacttccccttacccctataggtaactgctattctcacttatatcatcagagattagatgtacttgttctgttcttgaacttcataaaaatctaatcttagagtatatactcttttgtgtctggctttattaactcaatataatgatttaaaattcacccatgtcattgtatctatcagtaactcagaatttttcactgttgagcagtatagcatggtatgaatatacttcaatttgttcatccattattttactgatgcacatttaggtcacttccagcacggacactgtttttgacagatttccatgggggttaagactgggatagatggacatagcaaatgatctgagaattctaagtttaggagccacagatcttttctacagactgttctacatactttacatcacaagttcctgccacaaatagaatatacctttctcacaccctataaagtatctgaatcaaaatgattaagcatccaattaaatatatttggttcagcgtggtgctaataaacacacaagtgtggactgaatcttatatggtcttattggtttttctggtgaaaagggctccatttccaggtcttagaaaacaacagagacccccttgagccatctcagcagggcatgcaattgagcacaaaggtgacagaaagtgtgtgtcacctggaaaaactcatccagattagaaactaagcccctagtatatcatgttcaacttgggtgaattgtaaagacattgaaaaaagcaacatattcaaatacctactgtttacagtgtcaataaaatgctacggaaatattaatggtaatagcatacattgattcttccataggacacatactatctttaatcctcacaacactaccaagtgagtattgttcttcccacagttcaggtgaagaagcagactcaggggcattaagtaaattaagagtaaattaaggtcatgtacttagtaagtaacagacccagaacttgatcctagggtgtcacattctaaagcccacccaattctccttacactaagacatctttatacaattagtaggcaccatatattctatacttgaagaagttagatataggtacaactaactcacttgtgatccattagtggtttttgatgatgagaactgcaaacctctaatatctccattccaaaatgatcagcacccagagaaactctagaagtttccagcggcacacaaggagcttaaatattatacaacaaagacctatgtgctcataagaacagctttcctcagtgcctccatgatacaccagtcaaaacatttcatcagttctaatttttttctaccttaaaaataagattattttgaatgagagattttgctactgcctctcaaataagcacacactttaaaaatagcaaagaacagcagatatttttagggtaaaaaaaaaacacacatggtgatgtcctcagattccaaagataagtctttttatgagagctttttctatttattttgattcagtagtaagaacacctgcagaaagatcagctctcttcacaagaccatttcttaagcattcatcgcagacataacagatgatagcatggagacagactaagctaagagagctggagcacaactgatgattcctacgtcccgcacgtgttctaagaaaacgacattcccataattcaggcattcaaaactaagtgaggcatggcagacaagagcattgcaacatcagaaagtcattttgcttggagacggtccaggtttcttccaaagagtagtagattatttaaccacagagataagttttaataacatttgtgcaatcatttttcaatgcatgggaggaaacaagctatagcattgggctgtttcacccagatttaaaacattccttagactgtgtggcgagggaatagaaggaatggataaccaggctggtggtgctagataccacacacccttcaccctcccttgtattctatttgactatatgagttttgaaggctggggctacataaaatgtcatttgtcctttttataagcatattttctgtgttatgtaaaatatccataaatataaatttaatgcctgcaagtattatctcatatgttgtgcagtaatttgtttaatcattggcaaaattcaaagaatgaatcatctcaatatagaaaagggtgcagagaaccagccatctatccttctatactggcatacttggtagtatatttggtatttaacaaacattttggcaaaatataaaaaaagttttatcaacttaacaagattcatcaaaatatttaatgcctttttaaaattaaaatgtctagaaataagtaactaaagtagaattttagcaatgagaaaggatacttcatggttgctttaatttacatctgttattactagtgagtggaacagtttttgagatgcatactagccatctgattttctctttaggaaactgtcatgtcctctgctcatttatccattgtggccttagtgttattcataagaattataataagctagttatataatgagaatattatccatttatctgttaaagtttgtttatgactcaggtgcctgttttaatctaaacctaaaactgatcaaccccaaaagaggaagcagttaagtggcaacaacaaagaaaaaaaacaaaaaccaaaccactttcatatttctagctcaaaacaaatagctacttaaacacaaaagcatttagaaattctccaacaagggactcacattcagtgaatgaagtctttcataggaacccttaaagcacagcaatgatataaacataatgaagagaaatctgttactatcacattgacatgcctccccactttatatcaagtggaaaatatcgaatcagttcaaatatatctggatctaaaacaaaatcaagtttcctttggtcagcaagaacaagccacagcatttacatctttgttcagtccacactaaagactgaagtcttggggacaagtataagaaggcagagagatcctggacacacctagactggaggaagtctgtggtcacacttgtgctggacagcctgtcggagtttacacaactgcagccaaagacaacttccactgcagtgagaattctgatgcccagggccagtttgtggcccagtgcagttgtactttattattctttgccaagggaccaatagttagcacttttagaaaaacacgagcctctgcattatttattccttagagataggggatgatgcccagtctcaacagttgctttggctctttaattatattgtaaaattaactgtgacaggttgttttatttcttttgtgtcaaccaaaagcacccatgggatacataatttggtgatcaaagccttaatttaggaaagttaagaaagattttaggaaacagactgatatctaatgtgcagaggcagcgtggaaaaggaaattagcaaacattcagctaaaatgttctcaagggcagggactcatagtaataatggagtcatttcaagcttgaaggaggttacctatgggagactgccagatcgcttcagggatcgctgcgtttcatcagcctaaaaatggagctgcctctagaatttctaggtcagcaaaagataaagaggagacactaaaatctaacaaaatgagaggctggcatgaaacatttataaggggttaagaatgctgtagatgaacaaattaggaggctatacaccaaatctagaatattgtatccacgatcatgaatactattattcataaaacatggacaaaggaggtgagacaatttgatatctaagtaaaatgcccataatcttcctgataaagcctgaactcacccaactccacaaagagaatctatggccaagtcttctcagggtcacatagctccttcagccatgacaaagtgtaggtgcttattaaatgggttctagtagataaataaagccttatcttcatccaggaagaaaattatttcatccattttcagtatcttcaaagcaagattttacacaacttcacctagaggtgaactcctggcaatgaagaacaatgaataacccaaaattcatcacagaatccataaacctagccttaggcaatagcttcttcctcctcctcacccgctccctcctgctgccctgttgcctgccatcagaaatgtttatgactccaagatgactgataacacctttcccttctttgaacacagatatcaatgagtggtcgaaaggtgagagagtgggcaacaagatggaaaggcagcagcaggcatttggcttggatggtttctgataatgcagtcactttgaatgttcaaaccagaagccataggctgcagaatggtttccttttgctttcgccttaagaaggtgcattctctcctgtttgccacaagcctcagtgctcccggttgtcttctattttgcctggtttaccctttactgatactccttttctggctgaagatatagattccattcttataaatgatgtatgtatgttgtgcttgaaatgtatattgtctaacttgtggcaggaatctttatatagcacaaaggtcacattcattaattgtgctgttcaaatcttccacaactttgatcatttcattttctgaggcatacatgttagaatctctgattataattatgaatttgtctatttctccttgtcattctattaaattttgcttactttgagagttcaagctcaagactttaatggctttctgatgaattattccttaaaattatctgtgcattaaagtctattttgcatggcagtaatgtggtttttattggctctcaatttttaaactgtcttcctgatttatctttttctacccctttgctttgtgttatttggctttgaaagtctcttataaatagcatggaggaatctccatcttctaacagatgttaaacattaaatctgttaataaattatacttatattgtgattactaattttattgcacccattattccattagtaatttctaattactatgtcttttctatgctcctgtttttcttctctcctgattactgttaggttcaataacttcttattcttgttttccaattaactgatatgaaagttagacatcattctgtttctattgttcttgtgactatcttaaattatatatatatacacacacacatacacacacacacacacatatatatatatatatatatacacattatatgtataacttttattttaggttcaggggtacatgtgcaggtttgttatgcaggtaaattcatgtcacaggggctcgttgtacagattatttcgtcacccagatgttatgcctagtacccaatagttactcttcctcctcccatcctccaccctcacagaccccagtgtctgttgttcccttctttgcatccatgagttctcatcatttagctcccaattacaagtggcaacatacagtatttgattttctgttcctgcattagtttgcaagattactttaaatttttacaactgactcaaagttaatatttctaccctctttcagaataaaaaaaggatcttagaaggctttaactccaattaccacctaccaccttccatgattgttatctagcaccttaattccatcttgctttttaacccccactcctcaaagtcattattattgtaattagtcaatatttgtttaaatgcaaccactaatttaccactttcttttcttactgttcattattaaaacccactccaatcctctgagttctatctcagtcttacagaaatacatcttgaccaattctttagtgagtattaataaaaagcaaattaaaaagtctttattacagtctccatctttaaaaaatatattctttctggggggtaggtttaaaatacatacagtgaggtgcataatgtgcatgcatttaaagggtttggctcaatgaatcttgcatatgtaagcacccatgcaaataccatccagatcaagatgataacatttccatcacactctcatgccccttctttgtcattactcactccactattcagacatttatccctattaatttagcctattttttgaattttatataaatggaatcctatggtgggtactctgtgtctgggttctttcactgaacatgtttgtgagactattgttgttatcacttttttctttcctatcactgtgtattccatgtcattatcattcttaaaataatactttaacagggcatagaattctgggtcgacggttattttttctcagattttgaagttgttattccaatgtgttttaggcttcactgttgttcagagaatgctgccagttgaactgctattcctttgatagcaatttgaccatttcctctggttatttatttttcccatttttggttctattaaaaatgttctattcatctttagtgttctaatacttccataggttatatcacagtgtgggtttgattttagcaatgctaaaagaattgatagaagtcaatgtgcttcatcaatccaacatacatctttccattgagacaatctcccccaagcatctgcatcactagagtagttttggcccccacaccagtataccaggacatggaaagagcttgatgggtggagtttctcaagtccccttcttgcgaaaggggcagcccttgaggaggtcagcaatatatggggattaagttttagctccctgcttgcccaggtttagtcacatcaactgcccctgcatgcgtggacattaacacaagggactctccaaatcaaacagctgccaaggccatgccttcagctttcttctctggttcttttgaactgccacttcttttttcatactttggtgatttctctttctttcttttgatctttattatgactttttaaaaagtatattttaaccaatttttctatttgaggttaaaggagactctgcatggactttgtccaccatgtttccagaatctaaatttgtttcactccttatctgccagatgcccatgcccacaccacacttagtggctcttaactaagagcaagagccctgaagttatggagacctggatttgaatcactgcttcactactggctagctttttgaagctggataggttatttaacttctctgaaccttggtttcttcatctccaaaaaggggatgatcaaaattcttacctcacagcattgttgtaaagatgaaatatgggaatgcatgtaaagtacttggcacagtacttcattaagcacttatcaataaaattcatatgggctgagaacccttatctgaaatgcttgagaccagcagtgtttgggatcttaaattttttcagattttgaatatttacattatacttaacagttgagcatccctaatccaaaaatccaaaatctaaaatgctccaatgagcacttcctttgagcatgacctctgagcatcatgtcagtcctcaaaaagttttagattttggagcatttcagatttaaaattaggaatgttcaacctgtattattaaacattgcacaacaactttattcaagttattaattcatctacctagggatcagatttatgtacaagttggtgccacacagacacagaaaaatatgtttcatgagaaggaagtaaactgaataataactaaatatgacaatagagattctacacatgtggaatatataatgttgctctttacaaataccactttacaaaaatcccatattctcataattttccagggtttggtgaaaatccttgaaagtcagaaagaaaatattaaagcaagagaagtgccagtgaataatgagataaaggcttgccccagaacgtaaatcaatgcatgtgcttctttcatccagaaacttgctgtaataaaaagatgaactaaatagtgtgttcagcaatgtagttggtttatatgatggtgcaagcattttaattcactgtagatcaggaaaaaacagcttactgactgggtggaggaacacactttgagtgatactgctttagggacattttagcactatcctaaaagtgataccattgttatgtaggaaggaaggtagcttggatgctgggggcctgagttaaacaataacatcaagtggagaacaaaataaatcatgctacataaccaaagaaagttcattacaaaccaatcaacatctgttagagttcagaagtacactggagtcctgactgtagttgatttggggtatagatggatctgccaaacctactccttatctacaggatttttttttttttttctgaaacagagactcactgtgttgcccaggctggactgcagtggtgccatctcgactcactgcaacttccgccttacaggttcaagcaattctccctgcctcagcctctcaagtagctgggattacaggtgcactgtgcctggctaatttttgtatttttcagtagagacagggtttcgtcacgttggccaggctggtcttgaactcctgacctcaggtgatccgcccatctcggtttcccaaagtactgggattacaggcatgagccactgcgccctgctgtctaggggattttttaaggtgactgtaattaccatcatcataatcatttctactatttgattgctagcagttttttttgatggggggaaggtgatacattttaattcattttttcattatttttccaaagaagcagcagttggactgacttggtgtactctcaaagtaggcctaataatattttccatgtacattcaaagtgaattagcttaattatcctgattttatcattatacaacgtatacgtgtaaagcattacacagtatcccacaaacatgtatgactattatgtgtcagttataatcaacaacaataacaaaagatacaaaagggattagcttgctacagtaaggccaaatcaaacatcagatttaattcacaagagaattataccttatagtataaatattactagtaccttcatatatcctagattttctttcttttcttttcttttttttttttgacatgaagtctccctctgtcgcccaggctggagtgcagtggcatgatctcggctcactgcaacctctgcctcctgggttcaattgattctcctgcctcagcctccccagtagctgggattacaggcacacgccaccaagcccagctaatttttgtatttttagtagagacagggttttgccatgttggccaggctggtcttgaactcctgacctcatgtgatcctcctgcctcagcttcccaaagtgctgggattacagacgtgagccactgtacccggcctgtatttctgctttaatcaatatttttaaaggttaatttaaggattaaaaaaaagaagaagaaaccaacaatacattatgtatggttagcctgctggaaagagaagaaagatctgcccaaatagaaaattttaactctgggcttaacaatacaatacaatgctcttttaaaatattgatttaaaaataaggaagttaaaaacaatttgacaaaacagtattggtagacctgaaaactacagaaaataattatttcaacattcactatcactatcaactccaaagctatggtttacaaaatttagcttgcttctttggaaatgactgtttttctaaatcttgaacagaatctagtcatctcaagatgcttaaaagccttcagctaagatttgctctgggcttctgcagcccattggctggggtaaactcgatcccttccacacacgagtctcaagtctgtcttatcccacaaatgtaaagtgacttaaatttggcaaagtacttaaaatctgaatcatatattttcacttttttggctataccattattaataaacttaagaaaaagaatatccctaaccaacttgtcactttaaaaataacttgctttccccatccctgcaaaatggactttgaaattaaaaagatttttctactaaatttctctacttttaccagcaacagagatatcttcaaaacttctcttccgaaatgactacaaataaaaagctgtcccagtatgagcacaactttcatcaagatccaatttaaggtttactttctagtctctgaaatataaaccttcctttgaattcaaaagcataaaagatgcctatgggttaatacacgggttgcatggctaccaaatcacggtggccatacaacccatatattaatctttctactccacctgacttgtattggtagagagtatattagctcatattattctcaatgtactgcttacttggttttaattttttttttttaatttgctagagacttgtctatccatcaagattcaaatcactctaaagaaaccaacccttctggctcaactgttttgcactttatggttcctgacactcagacagacagatgtttccaagacacgtgagagaacaggaggtctttacctttgccaagactgattatttccatagcactcactgacttttgtcagtgtaaagtctctgggataaagtgtcaagaaatacaagctacccactttgaaaacagtgcagtctctcctcaaggtcaagtctcagtaaattgtgcttggtggccttcatttgacagcaagagacccctttttccggtggtggtgatctattcccagtgaccaccataattacctccataaggtgcacataagatgcaactccccaaactccaaattcgagaagcaccttccaaagcattctctcctgacttctgtatttctaataagcacctctcggtttcaggatcacaggcttacagatgactgatggaactcatacccaaatgcagttaatctgaagagccctggaagagcaggggcaatttaatctctgcagcaatgctttgaaacccagtgacaactgtaatggctttaataccaaatgacaatctcctttcaagagctttatgaatattaatgtagtgatcacagagcaatatttaaaaacaaagagtatgtcttcattttcaactggaacatctctgaattataaaaggcccactttcgcctcattttcacaggttattttcacaggtgcatttcaataaggtaggctggacattgcttttacttttggggtgggaggtcacaaaatgacctccgtatgccttaactgacaaaagtgaaactcatgctgtcaatctgtcaatttttaaataaatctagtaaataactacccaatacatgctcagaaggggccagaattttggggagtaaagaagtaggagacatcacttcacacccattaggatggctattatctaaaaatcagaaaatagcaagtgttggcaaggctgtggagaaattggcacccttcctgcattgctggcaggaaagtaaaatgatgcagccacttggaagactgtatggctgtttctcagaaaaagtcaacacagaattaccatgtgatccagtaattccagcatgtacccaaaagagttgacagcagggactcaagcagatacttgtatatcagtgctcttagcagcattattcacaacagtcaaaaagtagaaacgacccaaatgggaaaagctcattttgaatgatagtacagtaatcctttcgaggtgtgtgaattatttctaatgtgaatttagtgaaaaagaggcagcacaatatgtaagaagagaaggcacatctttctttgttgctcctcatataagcaagggcataaagctaagagaagaaaatgttctaaaatactttttctagtcctgaagtaagaggcagaaaacaagacagattattcacctgcaaaaacctccaaacatctaaaatgtgaagtgctgtcaggtagagtcctgcactcatttgttatctgggatgccacctttccaaggaccctcctgttagccaggtgcctgtccgagcccaaaagccttggtgtaggtgcggaccccagcctccacatgccacagccagtgctgtgcctcagcaaaactgtgatggacctgagatttacatacacggctggtgagaggccttaggcagtccttaaatgccagcagtctccagcgagcccatcagctcctatgaccttaatcatctacgcaccagtgctcccgactgtgtccctgcatcacacctctccatggaacttcataccccaataggcagctgcctactggcagtcccacactgcccacaaatgagttcataatcttctactcccatcgcatttctcttccacattatattatttatcccaagaaatcccatttccaccatttcaaaagcagtgccatggcagctgtcaatggttcatcctcccctcttattctccgcgtccagtcaattgtccagtcctgtggctctacatcctccatgtcatgcaatccaccactcccctccatgtccacaatgtccactttcagctaggccttggcatgagtccttaccgttctcctcccctgtctttgcttttttctcagaatattctgcactctgcagccagagtgatctttctaaaatgcaaatggaatcacgtccctcctctgtttagaacgctttgatggcgtctacggctctcagagtgaggagcaagccctgaccgtggcctcaaggcctgcctgctcaggccccaccgaccaacccagtttcatctcttaccacgttcccacccctattcccagcttcagaactccctgccctgctcctgcacacatgcagggcccttgcctggccagcctccgctcattctccagaactcagccaaaaaatctagaaatcctttcctcaaagatccttcccttgactctcccaaactgaggtaggtctccgtgctgcatatccccatagcaacatacactcctgttttatagcacagattagggacatcatcaacaacattctcatgtggaggattgcctcccatgccctggtctggggtccctttgtcctgggtctgcagcccttcaccacgctgaccatcatgacattaacccagggtgctgtaggtgtctatttgtaggtgggtttctacacctgattgcaagtttcttgaaggcatgtactgggtcttttatctgccactccctggtatctggcatggggcctagtgcttattggtgcttggtaaatgctgtttgaataaaagatgatgaaaatgctctgatagtgactcttacaaatataaatctgatcatgtcacttttctgctcaatgatttcgcatctcagaatgaaattcaaagtccttttcatggccagtcaagctttgcatgatttggctcctggcttcctgtctgatctgctctcctaaaactctcctttctcaagcactccaagctcattctctcctcagagcctttgcacctgcggccctctccacatgaacccactgtccccgaggcgtcttcaatgctggctccccagctacatgcaggcctttcctcagctgtcccctacctgccccaccccacccaccatcacacacaactcccctgcttggctttatatttcttcagttattatctggcattatacacttgctgtttggtcacagtcggcctcaccctacttgtgtgtcagggctgtgagggctgaaactctgttcatgttatttcttcctgtatcccaactggcaccaattagatgtgcaacaaatatttcttgaatgaatggagaaatactcaaaactgaatggtctatacacttcagtactgtttgaatttttttttacaatgatcacttattataacaaaaacctgtagattctagtatagcattatatattcattcaacaagtatttgttgaattccgtagagcacagagaagcgatcaatcatttccacacagaagaaacaatgctagagcgagctcctgaaagatgggcagacacctgccagagagagaagggtgattcccacagagaaaactgcacccacaaaggggatggccaaggatgggagaggttcttcaaatgctaaggaaattcctgccgcccccaccgccatgcaacacagagtcattcatgtaactggaattcttttttttcctttctgtgaatttttttatttttttatttattattattttgtattatactttaagttctagggtacatgtccacaacgtgcaggtttgttacatatgtatacatgtgccatgttggtgtgctgcacccattaactcgtcatttacattaggtatatctcctaatgcaatccctcccccctccacaaccccacaacaggccccggtgtgtgatgtcccccttcctgtgtccaaatgttctcattgttcaacttcaagttttctacatttctcattaactttgaatcccaggtctgggcctcacgctctcatgtcagtctgactaatgcagggtttccagcagagctcaggcctgtcaggaggaggtgcaggccttcttcaaatggcactggggtccgggacatcctgtgggggactcccctcccctcagcacccaccctccaccttgagcatctctgcctccaagctcgttccccaggggtgtaggagagtgctgcctcccacaggtatgatgaggtgggagaaatgatgaaaactcttgggcttgtgttgagaatcccaggaatgttccagacttcatccccagaaaactcccatcaccactcccaaaaagtagagtcacaccttttgccaaaaatgcttaacaaacacagtaagtatgagaaatgacataggataaggtcagtctacacttccttgcagtatggactactaaactgcctgggtaggagacacaggaacgttttccacgtagagaagagcaacagaaagccacaagggcttcctgagaatgtcccccatgccctatgtagaatttctcatttctcaaagctcctaaccagagttggcctgtgatcacacttcaacaaacacagcaagggttgggggcacttcatgaaagatccagagttttctcttcactttaggatgcatcattctctcctttgaaaatttaaatttgagaagaaataacctagccaggcattctacattttatgacttaatctgttattcaaaatagaagagaactaattacatcttccatttaattactacaaaaatacagccagaatgcatgcattatatcacatttacgccaccatgaagagaaccaaccttcccccaggctttggttgcctctactggaactttaagtatttccgtgcttcttccagctcctctcattttcaaccagcaatggaagagatcatataaaaagtgtgaaactcattcatataaatcatttatgatgtggtcatctgagggtcttgataagcaaatccacatgttcaatggaaggtaacacagcacagtggtcaagaaagggaactgccatttaacaactgtgtgtacccagtgttctacgcctgggtcctcatgtctcaaactgtgacattaatggtatctacatggtagaattattgcaaagaataagagaaatgatgtggggaaaaagtttaggatagtgactggcatgagaaagtactcaaaaacagtggctctattacttccagctaagctttttagaggtatacgtgagccaggatataaaaactggactttccacaagagctgagtctttgcaagctgctaggtccccaaagtctggcagcagaaaaggatgctcaaagcaaaaagaggtgaaatgtgaaagaatgaatattgaacaattccttgttgcaaggctcacttagctatggaacaggcatccgctagggtttccgtttgacctcctgtggtgcttcttccctgaaaaggaaagttaacttggtcaccttcctagggaggctgcatttttcattcaggtgtggtttttcacacaccaacacacacaccccaccccacatcacatccctgaactgaaaaagtcttctaaaagaagtgattttcacgtaagtgaaagccaaacagaatttgccaaagctatttgagagagtgtgtgagaatgtcttgtatgtatttatttccatacattctagtgtacaggagggctattttgcctctcccctgcacccttcccttgatatatggagacatttttggttgtcacgtgtgagtgtgtgtgtgtgtgtgtgtgtgtgtgtgtgtgtgtgtgtgttactggcatctagtgagtagaagccaggaatgctactaaacattctacaatgtcccacacacaaagaattgtccagccccaaatgccaatggtgccgagactgagaaaccctcaaaaaaatatctacttctcttatgcatatggttgaaggtgactgaggcaacgttacacatttctactaacatgaagaaacagaaaactttgtctgcaagacttaacattcttcttgtgaaataaactctgttataggggtgaatgccaggcttaaaatggaaaaaaatttcttgccttcttctgcaataatactgattcaaaaatggcccaaaaacttgctagagttttttttttcctgcctaggcagatatgaacagcctgaattaagctccacaaataattaaatcaaattgccaggcatgtaatcttcattgtgggtgagtaacattgtaaattcttgttcccatgccaggtaggtcagaatcgaggcagagattttaaatgcattccaagacagagaatcagagaatattaatcagggatctaagaagcttgagaaggcacttaactcattgcttctccttctagcaaaagagaggtggtgcaggagtcatctggagcaatgagaacttgcccagagtttaggacctaaaggctactgaacacattttaataacagtcacttgctttatgcgatggaagtattcactttaatataaagtgtactgagtgccgactctgtgccaggcagtgatgacatgcatgagagtgagacacaacctccagtggctgaggatggagacatgtgcaagaaaagaatgacagtgtgattgcagaggccagctgcccagtgttcaaagattcccagagaaaatacaaagaagtcacaatctgggggagttaaggatctatttggatcctcatgatcatataggatcatatttgagacagctggtaatactgtaatatatcctttctcttgaattcaaagtgactctcccaaaatagtttgatcctctttaagcatctctttttctgatatttagagatttataaacagatataacatgatagaatgatcctctgaaaagggactaagtaaattattttgtactaggaaaaaacctaccttctaatcagtttgcagctttttcaaggaacttttggagacactttgagagaatagccccctttgtcttttttttgttacctctcacccaacaaacacattatatcttcactgttatgggctagattgtgtatctctctccccatataacatggtaagtgccatatacaaacatgaacaggctataaattaaataacatttcatccccacggcgattgattaccaaagcctatgattagaacttccattttccctcttggtttgtttgtgactatgttctgaagaaagaaattcaagttaataaatcaacaagaacaacgtcagcctaataagacaagtctattccggtttttatcacttcttacattgacaaagtaattctcccactctcagataggcgtggatggtggattctaatcccagctctcctttccttctctccaacgtgcatgttttccaaacccaagcctagggtgggatgtcaagcagaaacacaacttttattatcaactgctcacactgtacactgcacaatgaaggaaaaaatgttacctgttgaatgaatgcatgacaagggttgaaaatctttaaaaaactaaattataaaaataaccacattagagaaaaggagaaattgcccataacctcagcattagtcatctgtttcctgtgccagttctacaccgctgtatcataaaagtctatccagtatttttgatcctggcctttttatccatttaaataattatttactctataaaaatagccattaaaatgtatgttttctgagaacatttaatatgcatagggaaatgctttcaatataatgttaaataacaaatactaagtacaaaactaaataatatatgactctaatttttgagtgtgtatatatttgcacacacacacacatacatacacatagatggaaagatatataccaaaatattaacagtggtttcggatggtaggattactttttaaattattacttttctgaattttttgacatttctataacaaatatttatcattagacaatggaaaaagttctaaatatcatattaaatttttttctgtttctagtgttgataactattattttaatgctcatacaatattccattaaatggacatcactttttaacttaattctctcttgcaaggaaatgtaggccatttcccattttgggctattataactcatgctttgaacttctccctgtctccacatcctaactgctttatgtggaaaacgaggctgtcattgatttgacctctgccgactgctgcaatctcagggcagagctaagggcacaggcataggagtgggatgttctgatcagaatcctgctttaccactgcttcaatgcacaatcatgaaataaaacacaacagtggataacgagctcctgcacattgagggcagtccaagatagtgctgctagtgttattatctctttttaaaatttgatttattttttaaattctagggtacatgtataggatgtgcaggtttgttacataggtaaacgtgtgccatggtggtttactgcacctatcaacccatcacctaggtattaagcccagaatgcattagctatttttcctgatgctctcccaacgtgtgccgtcccccctgacaggccccagtgtgtgttttcccctccgtgtgtccatgtgttctcattgttcagctcccacttctaagtgaaaacatgcagtgtttggttttctgttcctgcgttagtttgctgaggataatggcttccagctgcatccatgcccctgcatctccctcactcctactccttccccagtcacctgaagctccagtcagaaggaattatttgaagctgaccaaatactagcccctgcagctatcactgccttcatgtgtattgttccctttctagaaaccccctctcacttcatctctactgtggccaactcacgcccacccagttcaagtacctatcctcttgtgatctttctagacctcttgtctgggctaggtgcctgtctttgggagtcctggagcccccagtacacacctccatctgagcatttgccacattttgtttgcctgtttatttccctctctcttccactaaactgaaaactcctccacatgagagctgtgatctccatcctgaatgcttatttaccacagggtttcataaacagtagatactaagctgttgggtgcctggatggctttttgccatgttactcatcttcaaaaaatatgacttttggtggttgcataatatttcactgttataggttttatgatttaactattttctttcctatgcagtcccttgttttggggtggggagaggtatttatagagaccatcccagtacataaatcttttttaagaatacaaaaaattagctgggtgtggtggtgtgcacctgtactcccagctgctcaggaggctgatgcagggtaatcgcttgaacccaggaggtagaggttgcaatgagctgagatcgcaccactgcactccagcctcgcgacagagcaagaccatctcaaaaaaaataaataaataaagaagaagaagaagaatacaatttggctgggcgcagtggctcctgcttgtaaccccagcactttgggaggccaaggtgggaggattgcttaagcccaagagtttgagaccagcctgggcaacaagctaatttaaaaattagctgggtgtggtggcaggcacctgtggtcccaggtacttgggagactgaggcaggaggatcacctgagcccaggagttcaaggctgcaatgagccatgattgtgctacaacactccagcctgggtgacagaatatgatcctgtctcaaaaatagtaaaataaaatacaatttacagcattgttgtatttacagaatacaattcacaaaattgttgactttgaacatcttaagattttgattttacattgccaaagtgtagggtgtgatatctttagattctagtcccagtcttttgtatttactgctgcggtactctaaatgaacccactaaatagctagtattcatgtcttcccctgcaaaacggtattcttgcgaagagcttcagcagtttctgacaatttccaagctgcagcgcctgggtccctggtgatgcacacatattactcttggaggggcctctgctggggtcctgtggaaaaggaagactcagctccatttccttggcattctgcctgcagaggccagacagctggctgtgaaatgggagttcctgaaactcagcatgatgacttagaaacagcactttgatatcattacattcctgttcagtgatatttcctctcctttaaccccagttatgacaccttctttgaaactttgccttattaggtaatacgaaattggtgatacacaaacatttttgtcctacaaaaatagtaatttatttatgtttgtatatgtgtgtgtacttatatacatatttatgtatcttcagataaatgtctaattaataaaacaagtcccctagatatatttaagacagacaggaaacttttacatgaagatggtgaacttcaaaacatggtgcatccccctggccttgcataggaatcacctgggtccataccgccctgacgagcaggcacagggatctgtattttgaaaaagttcccagaatagttctgagcatgcccaagtttgtgaactattacgacagagcctcattttgtcctatctctaatgcagtgattgcttctccaaccagtttcccctccttctgtggacctttcttcgcaaacaactttacttgcttcactccaggctgaaaattttggtcagcagaatagacttggattaataaattcacattaaaaaaaatcctctctatatatgcatagcctgccccataaagcaaatgaatgtactgatctctttttggaactctggagaaagagatcctgtgaggtttctagggaacaaatgtttaaacagcataagggtcctcctaattttttgtagttggtgtgctggttttgctcttattttaggtaatataaaaagcattcacaaaaactttacaagtagttttttgaaacatggatccatttattttctttcatagaaagtgaaaaagcagcaaaacaagcaaaaatactgcttcgtgataaataataagccaaaaagactatttgcaatattatggatagtggtcacctctggagacaggagggaagccaagtcagggtagagcagcacagggagactatgaaatgcccacggtctattcattactctgagtgtccagtgtatagaactttacacaattattattattgtgacagggtttcattctgtcgcctaggctggagtgcagtggtgcaatctcagctcattgcagcccctcaacctcctgggctcaagtgatcctcccacctcagcctcccaagtagctcagactacaggtgtgcaccacctctcctggctaatttttgtatttttttgtagcaatagggtttcaacatgttgcccaggctggttgcaaactcctgggctcaagcaatccactggcctcagcctcccaaagtactgggattacaggtgtgagccactgcacccggcccaattattactattattatttaagcataaaatattatcaatatcgtgaaaatggccatactgcccaaggtaatttatagattcaatgccatccccatcaagctaccaatgactttcttcacagaattggaaaaaactactttaaagttcatatggaaccaaaaaagagcctgcattgccaagtcaatcctaagccaacagaacaaagctggaggcgtcacgctacctgacttcaaactatactacaaggctacagtaaccaaaacagcatggtactggtaccaaaacagagatatagaccaatggaacagaacagagtcctcagaaataatgccgcatatctacaactatctgatctttgacaaacctgacaaaaacaagaaatagggaaagaattccctatttaataaatggtgctgggaaaattggctagccatatgtagaaagctgaaactggatcccttccttacaccttatacaaaaatcaattcaagatgaattaaagacttaaatcttagacctaaaaccataaaaaccctagaggaaaacctaggcaataccattcaggacataagcatgggcaaggacttcatgtctaaaacaccaaaggcaatggcaacaaaagccaaaattgacaaatgggatctaattaaactaaagagcttctacacagcaaaagaaattaccatcagagtgaacaggcaacctacagaataagagaaaatttttgcaagctactcatctgacaaagggctaatatccagaatctacaatgaactcaaacaaatttacaagaaaaaaacaaacaatcccaacaaaaagtgggtgaaggatatgaacagacacttctcaaaagaagacatttatgcagccaaaagacacatgaaaaaatgctcatcatcactggccatcagagaaatgcaaatcaaaaccacaatgagataccatctcacaccagttagaatggtgatcattaaaatgtcaggaaacaataggtgctggagaggatgtggagaaataggaacacttttacactgttggtgggactgtaaactagttcaaccattgtggaagtcagtgtggcgattcctcaggatctagaactagaaataccatttgacccagccatcccattactgggtatatactaaaggattacaaaacatgctgctataaagacacatgcacacttatgtttattgcggcactattcacaatagcaaagacttggaaccaacccaaatgtccaacaatgacagactggattaagaaaatgtggcacatatacaccatggaatactatgcagccataataaaggatgagttcatgtcttttgtagggacatggatgaagctggaaaccatcattctcagcaaactatcgcaaggacaaaaaaccaaacacctcatgttctcactcataggtaggaattgaacaatgagaacacatggacacaggaaggggaacatcacacaccggggcctgttgtggggtagggggagcggggagggatagcattaggagatatacctaatgttaaatgataagttaatgggtgcagcacaccaacatggcacatgtatacatatgtaacaaacctgcacgttgtgcacatgtaccctaaaacttaaagtataataaaaaaattatgcattatttgtgtgataaaatttactataaaatataaaatattgtttaattattaaaaataattttcaaatttttttatttttggagggatgataaaaatcttttaatttttattttttgatttcactttctaaaaattgacaatagttgcacatatctatggggtacatggtgatgttttgatatgtataaagtatagtgatcagatcagggtaattagcatatccatcatctcaaacatttatcatttctttgtgttgggaaaacagaatatcctccttctagctattggaaactatatattattgttaactatggtcatcctacaatggtatagaagactagaatttactcttccctatctagctgtaatttgtgaataattttattgagtaaataatcaacttggtctatgtgaagaaaatattgagtcatcatgagtagacagggtgcatagacatggcaacagctgtgatggtgacatgagactgagggaaaactaggaagctctggactggaccagccccacattatgggaaacccaggtggttttctgattttccattggcgacccactccagtacaccagcacacaaggggaacagtttccctcaagaccaccattgaatagatggccaagagagaaagctttggaaaggagactggagggtttacaatttaggaccatctgaacaaggcaagtaaagagttgtggtgggtcagctgtgagtgaagaaaccacaggagggaaatgttactcaaataaaattacttcaaaagaaatgcaatcatcactataaaaatctggtatcacttcatataaatggaatatgacaatgaaaaataaatacatatattagtatataaagaatgctcatcctttagccacttaaaatcatctggctaaccagtctgagaaaacctttttttaagagcttcatattttagatgataaaaacaaggcccagagaggtgaagggacttatctaaggtagcacagctggaattcacctgtctggacttcaccaccacaatgctcccagtgtggcagcaacccaggcaatcaccagcactggcccaactggagaaagcctatcatcccaagggaccctgcaaacactttcttctgtacctctcagctcacctaaaatgaaggaccctagattggctgtgttgaaggtaagtgtaaaaggagcctagaggcaaattagaaaacatcgatcttactttcttcctctaaagtgagaagttaaatcaaccaagccaaattaggacatcccagctgtagtggcaagggagcccttggcaaagcccaacacagcatgagaagcagactccaggccttttctgtgctcactgggaagccagccctttacactggagcacggatccaactgctaaagctgcttctatgtccccacagaccctgcctctccaagccacagcacagctggccacatggtggttttctttgtgagcatgcgctgataggtatgggaaggccagggcatctagggtcaagatttcaatcatcttttgaggctcaacttgcagaacatcctctgctgggggttctctgggtcttctcaccttcactcatttctcctctctaaataccaccctgaatttctggataaaaggggctttgaggtggcaatctggttgccacttaaaaacaatgttttacagactttaaattaaaaaatcacggtttctcaaaacaattttattcatactttacaaagattgagaaataaatgatctatctttgggaatgtcattatgtagaagggtggccagggaagatgtggcagattttacaggagtggggagccccctcccctggccaccaactggtgccatctctgctgttctccttctagtcttaacagtctagcttagcacacaaaatctgtctgcaacaatagtatgtctgcattttaacaattgcaattttatcacaacttcacaaattgtagggacagtgactctgcctttgtggacaccattgtacccagcaccatgttagcatatattaggcactgaactgttgttgaacagatggataagaaaccttgggttgtcaaaaactgcactacaggaagccattcttttactgagtaaaagagggttagtgaatgcagttccagcaacaaccaagttctatttcctacagaaatttcaacgagttttttttttaagataagtgagtacagcttaaaacaaaaaacccatacctcactgaggcacctctgcttgttaacatgtgactcaatatgaagggtctccccaacctttaactctcctgcatggagccagcatcagcaccctatactctacatactgcagccccactgtggtcacaatgtgcacagccacatgaggaatgcccctggcctgcaccgggagcagcacttttcttttccccctaagaatgttgctaatccccgagcaagatggggtcattgtcaacagaggctacataaaggacatgttcctcaaggtattggctctcatatattcatttgctttatgcggactttaactataggaggaatgtctgtatttttctgtttcattttttaaccagtccaattcctcatttacaatgaaggcaggagctacattttatattcatctatgtgagagtaaaatgatgctgttaccagccccattttattgctgaggactttgaggttataagaaattatgtaatttggccaaggtcacacagctagtaatggaaggggctggggaatcaaacccaggcagtctggattttaagccaatgttcttaagcatctcaccaaaaccgtcttggtgctcacaaagtggtaggtcacaataatgcatgttgccggattcctgtaaatatgttataattgaaataagatggaaagaggaaaacaagtgggtcaaggaagaggaaggagaggacagaaaagagaaaagccaatttggaaatagatctaatttgattcttgctcattttatcccatttgtcaaaagtcacttagccacaggagtggtttttatagctgtgcacacacctaactgtatcagtcagcctttgacccagagatgcggttatctgtagccccatatggatattttcctacttccttaaaaaaaatgtagctacatctggctgtggatacagttctcaaaatgcaagttctaatttaacaacagatgtttactgggcagcaaagacagccaagaacatgtgaggagatgggaagctgtggtctgtgtccttgaggaaatcattttaaatacctggatggcccactggtgctgttttgcttgccaaacgttattgattggttgcagctgccagaagccttctatcgaggattcggagcctgaatctgggcttaatgggtgagtgctgttgtccatgagcagtgtctgccaagggcacagaggatgggtggtttcagggttaacactgagtgggtatttaaatattaattcctttacttcagatcaagccctagcaaccttcatattgagcagagcttcactgcaccagcttttcctcaccctgcctgaactcaggacagaggacagacactgagaaaggaagatggactttgcctgaagggtaaaaatcaatattccaatggtcatgaccaaccctcctggcccgtgtcaacaaatcctattagcagtgattagtaccctattattctggcaaagccctaaatatctcctcatggtggtatgacattatctgattggctaggactcttagtgaagttcaaccacagcacagttattttttgctgtaggaaacttgctgacaggcttcctttgaaaaaccaaaagcgtgaaatgcttttcactccactgaacggtgttccacatgacacatactgattgagcctacagaatcctgtggctatataaagtaccttcagctccccactacataaacttcgcatatccctctccatgtcaccttggcagcttgacagggttgttctcaagcagctaaaatgaagacccattaggagctaaagagctatccctaaactgaatagctgaattgcttttgaaggcccctgatgggtattctgacctggatccatctttgccatgcctctgtgagcctctgatatcttatatcatttatagccagtcatttcctgagcagcaggggacacagatcaaagatggccccaatcagagataccatggatacaccccacaaacggcgtcatctccagacacccttttctggcattgtaatttactggtacatctgacctaaatcaaattcaggctcaatataggccacttaaatggtatcagtcaaagcaagggtgtcaaaatgcattttcccctcaccctgccctgcaatttcttcaccttgggattatatgtttgcatggccactactattatttctgttgcaagtgaaaagtaagagcagcccctgagattcactgataaaacatccttgacatttaccttagtgtattcagaaatattagctcactacatttctctgaaggtagaaaaaaaaagaagttctgcctcctttggaaaagtcacatagtacaaggggataaattattttgtgagggaaatatactgccttcaggtgtgtttgcgggggcagagagttgactacgtgaatcattcacacttcaagtactctcatattttgtcttttgaactttggtttcaggataagaaggcagagacatgactagcctagaacagtatcggcacacagtaggcactaaataactaatgagtgaaggaaggagtcttcaggaagaatattccccactgacaatgccctagggaataagcggggcatgggggaaggactattgcactgaggaagagcagatctgaattcaaatcccacctcagttacctcccagctatgtgaccccggtcaagtcacctcagctgctgagctgagttttagtctctttgagggtaatttgaggataaggacaagggcctggcttccctctgagacattttgtgagggcacactgtggaggctgaaggcactctgtaaaagagtgaccacagcccagtatggtctagtgggttgatagagtcccagatccaaggccaatgtgttaagtgtcctcatgggactgcaatagcttttcacaggcagctaaactgtgtgttgctgtgttgattcttccaaaaggtctgaagaccttttttagtgattaccaagttatttacacaaatttatttacacaatttacaattatttacttctcttctgaaaagagaagctacattttcagtcaatagatacacctattctaagtggctttgggcatctaaccgagcacttaacacatcaaagtgagtcataatttgttttctgatttaaatgatcagatacaaagtaagataaacaaacagtgggaggctcgctcataagtaagttccccttttaggcactccaggagtccaaacaaagaagtgaaatctcacactttcctacctgcttctactgcgggacgggtcgctttctccaccctggacaattagataatgagatagtgatgcaacagcctatcaaaccaaaccacagacaaaggaatgtgcaaactgggtattcttgcagattttaggcaagttgtctgctactctttcctctggctcaatattacttcccattccacctccccagtttcttctagcctggtacctgcttctgactctgtcaaaatgggggaaataccactgatttgtcctgcttgctcctttggcatcctctctgcttctaccctactggctttatcttcccattcaggctgttcccattttggtcccacttcaccagccccacccactcctggtggctcctccttctaatggggacttattcttccccattacttgctcatttcctgcctgagcttgtttgcccagttccttccgctatgaaagtgagaggagatccatcaagctggaagctgtcatgttcacatagaacaaatcctgtgtagactcactatgtatttgttgagtgagtggatgaatgaatgaaacaaatgaatgaagaaaaatacaaccagctttgtagggtaaatgcacttgtcagcaatcacttgagcatacccttagaatgatcctgtatggaagctgtatctgaatgtgtgttctgagctaaggaatctggtatggccaacccagagatctgttctttgtctatgaggaacatctgagcccccaggctgtcctgtggaacaggcgcagtacaggcgattgacccctgtgatttggattaaatgaattgccaggtggaggtcattagggggaaggtattaagtggaaatgctatatagactgcatgctgcttgcaagcagttgtggctttcccacccagtccaccaccactgttggttatctagtccagcccaccaccactggactctgtccgctctatgtgagcccctaaaaaaaccccaggtctcctttgctggctctcggtctcttcttcagccccttgaacctagtgccttccctattgaggttaataggggttcaacaccacaaccctgtacagaaatcctgagtgttcatagctgtgacaactgggacttatcttaaatctagtactgaaccacaaaattacctgtcagcaatcagacactgttcttaagaattctatcttaagctcctgtatctcaaatgattatactaaaatgatgttattagagctaactcaagaaaattatccagcaaatgaatgggatttaaaatgttaaaaatcatcttaaaagagatttctaattatacaattttaaaaattaccagagtttctaccctaaccatgccctgcatttcatgagaagccttagatagcagcagttttcatggctgacctcctctgccccaattagggatcttgtgatactgcggaatcattaaaagctctggctttgtagcatgcacgagccagctggggaaccccaggcaagtacttagcctcccaggcttctatctcttcatctcttgaatgtggataatggtacctaatgtgaaggcatgagatgaggattcaagggcgtaatccatgtaaagtgcttagcacagtgtccagcacatagtgagtgcagaataaatgccagccgttttctatgtgtaaatgcttttctatcaggcaactgaggaatggctaagattagtaatctctccagctgtgagccacactcccttcttgtgtgtttcaaaataaacttcatgtccctggctccagcttttctctcccaacttctgccagtgaaagaaaatattgattaatcccaaataaaaatataatgagatagatatgtatgtttccatccatatgtgtacatctccgtgtgtgtgtgtgtgtaaaagtatatttatcatactgtctcctctataagactgtgagttcctagagggtggtagtggatgaaaaaggttaacatttgttcaatgttttaagtgttttggctgtattaactcattttatcctcacattaagcctatgaagcagtcaacatatctatcctctattcactcaataaatgaagacataagtgatgtttactaatgtaccattataggctgtgtagtctgatggctaaggatgctcccagatcctttacttattagcagtatgaccttaggcaagttacttaacctctctgtgctccaacttctccacaggcaaaatgggaagaagaatcatgccacgtacaactattacaaagatgagctgatacacttagaacagtgccaagtacagagtaagcattcagtaaattatagcaaactttaacataggtccattttaaaaggggaaataatgccctttcaatgaagtgaaatccatcccactgattataaatacaaacaagcaaagcttatattcttgtaggaaaatgagaagggtcaaagtttgaatgacataaaaatccaaattactcttagagtaactaacaaaacaaaggaatgatcatttcattatgtccaggatgaattagtcataatttgcctaccatatccagagaaaacttctgattacttagcacaaacccatgaattatctcatttgggtataatgtgtctgtggacagattagagccagccaagcccacaagaatggaatgttgacttgcttattcatttattcacatttgttcactcaacaaacatgctgagcatctattatgtgacagacactgttcttggcactgggaacccagtagtgaacaaaacaaaggccctgcccttggggagctgacaatccttttaggtgatataaacagcaaacaaataaatacataatatgtcaggtagtgagaatgctatatctaattaggaaatttgcatttgaaaaattatctgctccttaaaatactaaaagcagaggagaaagacttaaagactaaaaaagttgctgaaccacaataatctgtaaggtgagtcaacttagctactgacccaaaacctctgccaggatcctctaaatgacaacagaagagatgataagaagagactgaggctcaaggaaaggggtgtgtgcccgcttccttcattcttgccagggccaaaggctggcctagcccaatgtgccctggagagaagggggatgcctcatgggccagacaaagctgtggctttgagtcccagcttctgcatctctcccttggcccaggggtaccatctgactccagctgtaggctcaggccacccaggtccccacaattcagtcctgacctgctgctggtgggatttctggagctctggtctaacatacagggcccagtgtccagatccccttgactgtttctgatctgtactcacggtatgaaaagtggactctctccctgttcataagacttatatcctaagcagtgactcatttctggtgatggaatttctatttattccctgtaccaaagcccatctgctcacctgctgagcattcctgtactcctaggacttgggaccatctgcctttctcctgcttatctcatccccaaaacccaaatccagcctctcatatggccctggggtgggctctgcgacctgctggcaacctgtcctggcatttttaagttgagccttattctagactgcccacctatgaatatgtttgcctcgtcacttcatgatggaacctgttgcaatgaccaattgtctggcccatggattttactctgctgtcatagaactcctgaacccttactgcagctgctcaacaggatttctgctggggcaagcagctagagccatcactcaacacccatccatacataataaccactataaaaacagatcagtatgcttctagggcttggcctttacagcaactaactctacgtgctgaatgttgtgtccagattgactattggcatctccttgccccttactgtatacaagcagctcagaatcagatctccctatattatgctgtgattgtttatacatctcttattatcagagtttctatttttttgatatgtatttgatgctgaacctgagggctagcacatcacggtctcaacacatatatttgttgagtgaccataactcaacaacggctggcctccagttgactgacctctgaggttttccttgattcagcccatacctgagctgaaatcatgataacctggcttttgggcaggggatttttaaagccaacctctttgtggaacattcttcattttctttctctagccacagtttggtgctctcatgaggacactgcttcccttgtaaaggtctcaaatggtggtggtttctttacacagcccttgttttcctggactaggaggaacagttggtgtcttccttaattcccaatgctgcttccagatcatcctctccttgttgcctaaaaaatgaactatatctgcattttctaagaactctgtagaggtgggaaatataagggaagacctggctgcccattacaactaacaaccccaaataagtactttttactagaatgaagccacttagctctctccttagtcaacaaaaaaattcagcctaaagtatgatgaagcaaagaaccaagagttccatatactttaaaaaatagtttggctgtatgtgcttctggtagagaccattgtcactaaaggtaattcaagaagaaaatatggtccattgatcagagtgtttagaattgtatattgttggttgataaatcttatatgctgttgtagtgaacatttttgtcctttttttgccactggcatccattcatcctacttcccacaagagctttttaaagcttcatccattcccagtctcaactcactatggttcaattgcctccccatcctccaaattcagtgatggagaacacaatagtggtccaaggtaatcaatgggtcacattcctttcatcacagtaattggttctgtgatgggcaggtgccccagagtctagaagacttccactggggcttccaggaaagagcctcattgtttatttgccactgtaagcaagaggacagcctatctgagaatgtggccaaactgaaagagaatccagagttggagagagaaaaactggagattggtgtcattggtgtatctgtaagccacacacttggactttcagttacatgagctgtggaagtcaaagatgtgtttgccacactgtttcatcttcctgagcacatgagaaaatgacatttctcggcatcccttgcaagtaggttcggtatatgagactgaagtctgtctaagaattatgagtagaagtgatgtaaaccacttccaagccctctccaaaaaacatccaataagattctccagtacttccccacgacccacctttggtagcagccatggagatgttccagaaaaaataaaagaatgtactgtgatattggcccggcgtggtggctcaagcctgtaatcccagcactttgggaggctgaggtagccggatcatttgaggtcagaagtttgcgaccagtttgacaaacatagtgaaaccccgtctctaccaaaaatacaaaaagttagctgggcatggtgttgggtgcctgtaatctcagctactcaggaggctgaggcaggagaatcgtttgaacccgggaggtggaggttgcagtgaattgagattgtgccatcgtactgcagcctgggtgacagaacaagactctgtctcaaaaaaaaaaaaaaaaaagaaagaaaaagaaagaaactgggtggtgggtgaggtaggtgaaagaagcagtgtcagggaagacctctttgtgggaatgacatttgaacagatacctgatatgcaaaggcaagcaaataatgaagctactggggagaaagaaagaacgttcccattagatgaaatatctagtgcaaaggccctcaggtaagaaaggggttggcatattggagaaacagaaaagggggcaatgtcattaaaaagcttattgacagtgggagaattaaagagctacaaatgaaacgcaacagacaatggtgccttggaccagagtggtagcagcagagatgggagagaaataggcaagttcatgatttttttttttaagaagcagcaaagacaaaacttgtttgttggttggaaatcaaggaaaagaaaaagggaggaaatcaatgatgtcccccaagtctttggttttagcaataacatggtgatgccatttaatcagttgtgaagatgagaaaaaaaaacagtttggagaggaaaataatcagcacttccattttttggacatgttaagtttgatctgcttgttaaagatccatgtggagatgtcaacatagacatcagagcttacaagtcagagcttagttcctctgcaccacaatgatgatcacgattatggcaactaatattaactgagtacgtatcatatggcaggcattatgctaggagctttacatagattatctcatttaatctcaccacatccctgtaactagtgcctccaatttacagatgaaattgaagctcatacttccttgccaacattaacaaggctactaagtaaataagcagtacagttctaccttatatagcatgagaccttgctctctataaggggcttgaggggaagaatagtatcttctcatgcttttttgtttgttttcgagacagggtctggctctgttgcctaggttggaatgcagtggcacaatctcagctcactgcaacctctgcctcccagaatcaagccatccttccacctcagcctcctgagtagctggaactacaggcacacaccaccatgcccagctaatttttgtaattttttttaaagatggggttttaccatgttgcccaggctggtctcaaactcctgggctcaagcgatccacctgccttggcctcccaaagtgctgggactataggcatgagccactgctcccggtgtgtctcattcttgatatcctcaaagcacttagcaaaatgctttgtacttagaagataatcaatcactgttgcttgattccattgctcatgggaaaagaccaaatgacgtgatgctaggcccagacagagaaggcatccactctaattcttctttctctgctctttccatgtaacaaggggtttctgacccatgggctccccttcctctctcacaaccacttaaagcactatacagagggatgtgtgcagtgtatcatgacaagatttggagcatgaaatcaccagaaacaaggaagggtgggggtctcagtacccagctttcattcagtatctcatttagcccatggttttctactgggtctttcaggttattggggtagtctttagtgtattaaagccaaaactcattctgtgccctgccccctcctcaattcagttagctttcaaaacaagctgaaatcgtgaaccggaagatctgagatcctgattgaatcagattcaaacaatttaaactgggattggcttttctatttctctctggccaaacattttaggtccatcttctacttgatgaaatagaaaaagaaaaatccaaaatactcactgtatattctacctgcaattttaagagaaatgatggtactgaattaaaggtgaagcccctcctgcttctctatggaggagcatgaggacttggtttggtagtggaagcacagcaggtggggctcatgccgctcctcctctgagctgctcttttcaccctccttcccaaaactcacccttgccagtcctttaagcctcagctccaatgacacctgcttcagcactcctgggatggtccacatgctcttcctctgagtttctatccctgtgctcattcctctcttcattttttaaaaataacaagatgtactatcaatgtttctccctccctcctagactatgagttcctcttggggtgggaacatgctttacctattttagaaaccccagggcttagcccagttcctggcagatccagcgaggttcaaataaatagctgttgaattgaatggtgaacagagtggcattgtgttaggcgaggaaacagtatcctgtggacatgggagactttggttctagtcctggctttgggccggctccttatgtgctgcagggtaagctccttaccctccctgggtctatttgttcatcagccaaaataatgaggctggaccagctcagctctggaggcctcacagcactggcactgagcaatctgtgtgtgcagatgggaaagcagctgagaataatgcattcacatgggctggctctcgaaggccttcaccattaatcacaattctccaatctgacaaaatccctccccaaacgatctcaaaaggatgctgcacacaatgaaggagaaataatcaccctcaatttccagaaagagaaccgtgctctaatgcccacgaattgtgtcagtctttttctggccatgtgcatacactgtgcttcccctggcttctcactcccagcttcgccagggtgggggtgggcaggggacatggctgggtacccagcaacagtgggtttctgcagacagctaaatggcatagagaatattctgcatgttttaatcttcagttctggttccaaactcaacttgaaaaccaaagtcctaagagaaagctaatggctttctgctgaaagttttctgccaagtgcaaatctgaatagacccgtgaagaaaatcctttcccactgttgccatgactccaagaggtcccccgtaccatggtcccaaactgtgggaggaggtgaaaaactgcatgtgatgcttccctcctgaagcagaggcaaggcagccgagggaggagagaggcactgcctatgaggccccatttttccaaatgctttcaaggcagaacttccgatgtgaggtcctgatgatgtccagttaactgcatttccccctctctccaggtgcctcttttccccttctctttagttctctgtcttttctgaatctagccttcccctgtggattcctgaatccacaatcaatacagagctcttccagtggaatagtagtttatactttcaaatacagatggttgacaaatattcctaaatgtcttaatgtataagatatccagtctcttcgattaagtacacatctgaaagccaagaaccatgtctgccacttcttctgaatgctcaacatagaagcttgtcaacaatatgaagggaaccaaaattcccttcaaagacagttgttaagttaaagacattgaaaatgcagggtaacactctgcctcagcctgtaaccacctgatggcagggcacgaatccttccttcctggagatggcacttctcggcccagaggaggcaccaagctggcaccagaggaatctgggaacagattttagcatcttccctcattttcccgccttttaaaacaccgcaactgttctctcttttgtcttgtcactatgtaggatttacagatccgttaaaatacttttaaagcaaggcccctaagccactgccttgagagagaaatgcttttgaaccgaggcctttcccatgtgataggtacagtgcatgttaataaacttttgcatgcttttcttttgttaatctgatttttgttttcagaaaagtgtctcagctaagaactttaaaaaaggggaaaaaaagtctgttttctcccctaaatatatctatccaacatcaacaaaccaggtcttcaagacatgctcgtttcctaagctgactttgataggatgggtgcttttactcacaaagattggtcctctccttacttatcattgctgaaatccatttaactgggttattatgttttcttgcttgtataataaaagtgattttttctacagatacattcatcattttcaataattagaaagtcatttacctaaattaccctcattagaatgctgaacaggaaattgaagtccctccatatcttatagtcataatattttacgatgtcttcattcttatggatcacaaagctcatggtttctgtaccaaaggaagtgctttctggaccagacagaagcagtggctctgcttgtgatcccagtgctttgggagcccaaggcaggaggcttgctgaaggccaggagtttgaagccagcctgggtaacatagtgaggcgctgtcgctacaaaacatttaaaaatcagcaggttgtcgtgttgagcacctgtattcctagcaacttgggaggctgagacgggtggatcccttgagccaggagttcaaagttaaagtgagctatgatcacgccactacattccagtctgggcaacagagcaagaccctatctctttaaaaataaataaagaaataaatagtggtttctgatgagatctgatggttttataaatgacagtctttcctatgctctcacgtgctcactcttctcttgtctgctaccatgtaagacatgcttgcttccccttccaccgtgattgtaagtttcctgaggcttccccagccatgcggaactctgagtcaactaaacctcttttctttattaaaacaaacaaacaaaaaaagaagtagtttcttatgtgagcttttcttcatatcattaggaataaaattgtcctgaacctgaaaactgaactataaacaagactcaatacattaataggaactgaggttttctgtatacataggaatgttatatcattttaccaaattaaatgacgtaaaatgataaaggcttctgcaacaaaacagtattataaaatgccatataagaaacttgctagtcattcaaatactgcagagtaattatcactgttagaagtggctttacagtgtctatacctcattctatcatatcttccgaagataatgcatttaaaatacaaagtcaaaagttgcatttctgttacatttttaaaatttgccctttgaaagtcaaacaacagactgtatttctttcttcttatcagaatatttggaggctgatataaatacacttgtgcttatctgtgtctagttatttataatctctaggaaacatgacatttttccttctagaattggtttttaaagcagcaaccacactatcatgcatatatgatacggggttgctttgacaggaaaaaggcaatgtgtcatatttcacttgcttagacctcctccaatcataactgaaaagatattcaaagaattataaccgtaagaattaccaaacaaccgtcaacaaggggctaaaagaacatgaagaagaccctgagggagtgagagctgaggttcatctgtaagcagaaaacagatgtaatatgtggctcaggaaattacaggaggctaaagttgccagcacatgcctgaagcacaagtattatttttatgcaccagtttagaaaacaatgaagcagaaaacaaagctttgaccatttgctgaaaggaagtttcaaatgaggtcaattctttcacattcccattgatgccaatgaaaatcaaagtagataagaggtccaggattaaaataaaattaagcaaatacacaaaatcacttttcaaaaaggaaaccttttattagcgtttttcatccctgaaagatttgttatttgtgaaatttgttcagtgaagctctcttaaatgactgcccttaaatgacttttgtgaccttgattactcaacttttacttaactttctatagattccaagttggactgaatgcatttttattacatttgcataacagcagaggcgttggatcttctggcgttagattccgtaggtcttctttatttatgctgggaacaagtcttggctctttcctcctcttgacttatcatatcgctgagttgggccacaggctctgggtcttcctgctggttctgtccaacttttccccttgtaaacaggctctgggaccatctatgtcatatcatggctgcagcaacagacaagagccatgctgctcaaacttcaatgtgcctaaaatcacgggggtagggggtgtctttaaaatgcagattatgatgcagtaggtttggatggggcccaagagtctgccaagtgtcgctgatgctgctgttctgcacagctcacttgagtgacaaggaaccaggttgtttaatcaagttcttgggccccagtctcctctggtgagccaacatgtcaaaccagctcttggacaaacaggacttcttatctatccaggttactatttcccatgaaacaggtgatcagaagaaaggtaaactaaggaatgtgaagagaatcagggagtgagggaaaggaaggatgacataagatttggatgacattatagaggaagggaggttgtggtgaatataatattcttgggtacaacatgattatatgattatgattggggattataataatatatagaaataacctgattgaggattcttggtgagaatatgaacaaaaccctaacaaaaaaggcacacgtgattgactgcccaaagagttctgaactactttccatccaacatttgtagttcttttctgatgagtagacattacccaagccaatcatacaacactttctggtgaagaagtggtggttaagaataatgttttggagtctgacaagaggtcagaatcctcttgttactgttactagtgttaggcaagttaccaaagctctctggacataaattttctcatctgtcaaatgagatattaacaactacaatgtagtggtatgaattaaatgagaaatgtggtatgaagtacttaatacaaagattggcacaaagtaaaccatcaattcatataaactattataaatattattaaaaacaaaatacaggttctacatacatgtattgttacagttcactttcaaggtgatgatactggcaacaaggagatgaaaaagtgaggctcaaataaactttatatgaaagctgcccgagtgcctgggtaatatctgtaatattgctgtctgaagcctaatgctaaacaccaagcagtcaataagtcaaagaaatacctgatatttaatattttcaatctcctttgacttatcttctagtttagtttccatgggaatctgtgcttaggggcaacatcaaaagcatactgaagaaaatccacctagttcccaatgtgtgccttcctgcttattaatggaattgtagttaatagaatggcacacacctctgagattgtctggtgccccctgctctccatggcttcggactatgtcacacttcaagaaatattctagcggatctctaactcatagcccattttatatccattattgtcaatctggctccacatctcccatgcagaaaagggtatgatcttcgtgataactgtttccttttgcattcaaggatagaatattttttatttgtgggttcatacatgatttttcagatgttcgaagttgctcaatctagctatatccacagtgaggctaaataccctggatctcttgggatggtagtaaacgatagtagcaggatgtctaaggaaacaccctgagggaactcaacaattatcctaattgcagtctgagggtagctctttcagtatctaagctctaagctctgaagagaccttcaggtcaggcacaccggttttcaaactgtgttctacagcaattcacgatcagtgatgcttcagaggggagggaaggctgaaccagtgagactctagacacccccacacaatcagagcaacttctttattgattgattgttttgtttttttgcatcccccccaccccttttgggagacaaggtctagttctgtcatccaggctggtgtgcagtggtgtgatcatagctcactgtaatctttaactctttggctcaagggatcttcccatttcagcctcccaagtagctagtactacaggcatgcagagccacaccctgctaatttttaaatttttctgtagagacagtctcggtatgttgcccatgctggcattgaactcctgggctcaagtaatcctcctgccttggtctcccaaacccctgagattataggtgtgagccactgtgcctggcactttttatctatttatatgttgggattctgctgatatttttcttttacccactgatatggaacttttattctttccaggcatctaaatcctttcatctgatttatctgtgtattcattatgatgagatttagctacaagtaaccaagacacaggctcatggcgaatgaacaagatatatgtttgtttctcttttatataaaaatccagattatggctagcataatagtgccagctatatgagagcagacagcttatccttgcatccaagctggagctgcagccatcacacccatgttccgagcatgttattaatagaaagaagggtgcacatcatcctttaagaagacaccccctctcctccacagatgttgcattctgtttacatttcattgactagtacttaggcaatcttccctattctggtgccacatatccaactaaatattgggaattctatacatctagaagcagagggcagatactaaaggacacgatctatcttctgttgcagtctatcttcagcccagtcaactggttgaaggcttggattatctgattttctgcataggtcttcctaaaactagcagattagaagtggatgtgaagacaccttgaaaagtgacagctgaaatggtagtggctactgaattacatgcagcagctcccagccatttagtgggggtgcaaatcaatatttacagtgcaacactgaccttggttatggaggaaaggttaaattatgtttggcacattctgcttgaggctgaagggactaatacattacagaaagattcccattgacatgggtaaaagttttaaaagacatttaaagttgcatgctttatcaactgagaaatctacttatttctccacatcctctccagcacctgttgtttcctgactttttaatgattgccattctaactggtgtgagatagtatctcattgtggttttgatttgcatttctctgatggccagtgatgataagcatgttttcacgtgtcttttggctgcataaatgtcttcttttgagaagtgtctgttcatgtccttctcccactttttgatggggttgtttttttcttgtaaatttgtttgagttcattgtagattctggatattagccctttgtcagatgggtaggttgcgaaaattgtctcccattttgtaggttgcctgttcactctgatggtagtttcttttgctgtgcagaagctctttagtttaattagatcccatttgtcaattttggcttttgctgccattgcttttggtgttttagacatgaagtccttgcccatgcctatgtcttgaatggtaatgcctaggttttcttctagggtttttatggttttaggtctaacgtttaagtctttaatccatcttgaattgatttttgtataagttgtaaggaagggatccagtttcagctttctacatatggctagccagttttcccagcaccatttattaaatagggaatcctttccgcattgcttgtttttctcaggtttgtcgaagataggaacacttttacactgttggtgggactgtaaactagttcaacccttgtggaagtcagtgtggcgattcctcagggatctagaactagaaataccatttggcccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcaccattctcagtaagctatcacaagaacaaaaaccaaacactgcaaattctcactcataggtgggaattgaacaatgagatcacatggacacaggaaggggaatatcacactctggggactgtggtggggtgggggcacgggggagggatagcattgggagatatacctaatgctaggtgacgagttagtgggtgcagcgcaccagcatggcacatgtatacatatgtaactaacctgcacaatgtgcacatgtaccctaaaacttaaagtataattaaaaagtaaaaaaattaaaaaaaaaaaagagaaatctacttgacacagcacacctcactccaggtgggcaggtaatgacaggtgtggtccttctgggtccccagtagactctttaaggtgggggtggtggtgataggaagcagagggaaggtggctctcctctaggtccctgcatcttgaacagaacctgtatctactgaatgaataaatagacaaggttgggggctcaagatccagctctgcctaagggcctacaagaggacaaggttcttgtaggaataggaagcaagatccacctgtggggagatggaaaaggtatccagactagccttgggcctggaatacaccaggaaatgggtttcaagttatagtccgccatgaaggaagattcttgaaagtccaaggatcaagctttctaacttgattttgttttcaagtgctttttttagtttatatttcattcattgttagggtatttttactgcattttataactgtctcaaagtatcttcaaaaattagtctaagccagtcacaaaaggacaaatattgtatgattccacctatatgaggaagctagagtagtcaaattcatagagcaaaaagtagaattggtggtagccaggggctgggaagagagggaaaggggaagttgtttaacgagtttggagtctcaaggttacaagatgaagagctctaaggtcagatagtgcagatggctgcacgacaatgtgagctgtgcacttaataatggctaaaatggtaaattttatattacatatatttaccgcaattttaaaaactagtctaaattttaattgcatatattagagaactgcatttcattccaactgtcaatatttgaaaaagtgttttagtcattgcctttaacaactttgcaaatactagaagtggttttaagcatttcttattactcattcacaatagtcagtgttccctctgggtcctcaatgggactgaggagttcccacaatgttctaggtgctgttcctaactgactcaccaaaccaatttcaaattgttcggtaaaacactctcacatactccctccaatgccaaaccactcaccagcacatttaaacaagcttgccaaagtttgataattcaaaaattagtaattcatcaacctagtatctactgaagtagggattatagaactttcaccaaaattctctgaaacagtggttctcaaagtgtggcccctggaccagtagcaccagcagtacccaggaatgtgttgaaagtgtgaattctcagacactatgcagacctcctgaatcacagccagaggtctgtgttttcccaagtcttctagaggattccgatgcagactaaagtgtgagaaccactactctaaggagtctatggctgccaaatgttaagaaccagcacattcgctcgaagggagaggacgatcaggaggccaaagtaagtttctttctggggcttcatgcgtttttacaagactgattcaaaacaagtcaaaggttcactttgcccggtagcgtttctgcaaatatctgatctgaatacagccctcatctcacacccagaaacatgaccaaagctgcccacactaacttgctgttttgtctaaggggagcagctgctatactcccttctttctaatctgttgcctccctggtaatgaccaggaagagaggctatttcaaaactgtgcctcccataaaaattgggactcctgttaactcccctctctctgccttcaaggaaatgcaaagaaggcagggagagcataggctgtggccaaaaacaatttccgctgactatggtgatggcgattctgcagaaacagcaccatggtttaggaccagatgaccttacttcaagtccagcttctgtctcttagtagctgtgtgaccccgaacctttgcttcctcatctgtaaaatgggagtggtatggtttttgtgagagtttgaaaagatgtaagcagaagctctttatgagaaagcagccccatggtgacagcccaagtctagctcaaccacttatcagctatgtgtaactttaggcgagtctcttcgtttttaaaatagggatgttggctgggtgtggtggctcacatctgtaacctcagctttgggagggaggtgggtggatcacctgaggtcaggagtttgagatcagcctggccaacatggtgaaaccctgtctctactaaaaatagaaaaattagctgagtgtggaggtacacacctgtaatcccagctactcggggggctgaggcaggagaatcgtttggacctgggaggtggaggttgcagtgagccaagatgtgtcactgcactcccgcctgggcaacagagaagacttcgtctcaaaaaataataataaataaataaataaataaataaataaaataaaataaaaaataaataaaatataaaaataaaatagggatgttaactcatcctccacctgggaggcttaaatgagataatataaataaacagcataacatacttgctaacacacaataaaaaattcacaaatgtttaatggtagtagtaataaagcttatagctatataactatcaggtatccctagtataattttagaatacaaaaagaaaagttgataatacaagagtatgtgcagcagattcacatattttaataacaaacaagatgcaggctattgagatcatttgtttattgtgaacaagatagaataattactttccaggaaaagtttcaaacacaagaagttaatctattccaaagccgaaagagccttaaactccctttttgatcaggaggtcagttttttatttctctcaacatagttgagatacaataaagataatattaattagtattcatgtaatagtaaacactcttttcaaactaatttcatatctatcatttgagagaaaatacaagaaaattgcctgaaatataggaagatatatttttagaagtctacatgaacttgtgctaaagaggatgtaaaaccattcccaccaccataacctgcctttgctgacttgaaggaccataaaactacttgttggcaactattaagtgggtaaattacatgaattctgacaaatccttgcagattagttgtcatagtgtagctaaatgtttcaagagatggcattaatctgttttgacaaagtttgctctctgcagagtaacagattcatagggactttaaactgatttaacaagagcatagaatgaaagagttggaaagattggaaccgagactgcctgtgacagaggtatctcctccatatttaaaaaaatgttcaaaaagcatcacattgcagtctcctttggcagtgcttgaatcaaacaatctcaatagacaggaacttacttttatttctgactcagaaacaaaactactttcccgaagagagtctactacattttcccctgtattccaaccccttctaataccaaacaatgctcaggctccatgggcaacctcaacttcctaaactcaaagatttttaaccagataactaccaagccacacaatgagtgacacacagaccatgctttgagagaaacatttactcagatgatttggtatagaaaaacaaccattcatacattcaaaagatatattttttaagcaccaactatgacaatggataaggcatataatttattaatcccttcttttttcatgtattctctttttgcaatttaaaaaagtgagatataattaacattccatcagattaaaccttttaaaatgtataattcagtggtttttagtatgatcacatggttttgcaaccatcaccactaactcaatccagcacatcttcatcacctccaaaagaaaacacatacctggcggggcgcggttgctcaagcctgtaatcccagcactttgggaggacgaggcgggcggatcatgaggtcaggagatcaagaccatcctgcctaacatggtgaaaccccgtctctactaaaaatacaaacaattagctgggcatggtggcagccgcctatagtcccagctacttgggaggctgaggcaggagaatggcatgaacctgggaggtggagcgtgcagtttgccaagatcgcgccactgcattccagcctgggtgacggagagagactctgtctcattaaaaaaaaagaagaagaagaagaaaaaagaaatcacagacctattagcagtcactctcattcttctatcttccaccccagcaaaaactaatctactttctgtctctatagcattcttcattcttgttatttttgagcacctacttggcaccaggcaccactttaggccctgggggagagattgggaaacaaaataggctatgagtctccccagtggagtttttattctagtgactgcctacatttcacaaaatgaaaaacattacatatttagaaatatagaaatacatgcaagaaaaagaatatgcttaatctggcaaacaaaaaaatacatacacacacatgaccatgaaaatatgcaaaacagagtcaatcatctttcttatcaaaagacttttggcagcaaatcaacatgtggaattttcccctttctttccttctcctggtcctctgggagggtagtaaggatgaaactaaatagctaaagagaaaaagacaagtgatgcatggctggaaccaggggcaaacgggacagttagctccagaagaatcaaaaggtgtcttctcatcttgcattcacatgccttatgccacaaaccaccatctgagcccaatcactggctgaagacctcagatttaaaaccaaaataataaatttctgacaaaggcaaaaccgtcatccaaaatggcaggttacaaccaaaacttctgagccccagtcaatgatacctttattttaggcagaacaggataatgcaatttcgctttgaatttttggaagaaagaatgtgtgtaaatcttagaagctcactgtaacaggctttgcaggctttgacctcttggatgtgaaatatcctgatcagctcacacttcaaaatttttgctgaagctcagacaatcactgctccaaagtgaccaatccctgctttttctgttataaacttgctataatccctaagagagatagtacaaaaagtacatggatattgccatatctttatacataaatacttcccaattttataaattcaaacataggtctacagctaaaagtaaatgaagaaagagaattagtgattaaagtgaatctgtgaaacagcttctttgtttggctctagtaggccataaggccaaagtgttttgggtaactagaataaccttataatttatcatccaaatgaaatactcttgagagtgaaagcaggcatcattaacaattatgctgagagagcagacataaacctggacagtgccagacaaatgggaatagacggacggtcaccctatgaacgaacatcatgccctctctaacagagaacggcctcttcagtctgccccagattctagagtctagaggagagatcagatactgcaatattacacagtagaaaatgctaactattacaaaaagagaatcacttatgattgttgtttaatattccccgggtaagctcaagtaagcttgaattctaaaagctttttaaaaacaaatctggaaacgctgtacaaagcagtgtatagtgaggacaagtctcaaatcagtaagtgtgagtataataggtcaaaagaagttgttagacagcgtttgtgggggggtgtgcacatgagtgtgggcacgcatgcacacacttgagggtaagtggagaggcacatgagtgtgggcacgcatatgagggtaagtggagaggcacacgggtgtgggcacgcatgcacacacatgagggtaagtggagaggcacatgagtgtgggcacacatgcacacacatgagggtaagtggagaggcacatgagtgtgggcacacatgcacacacttgagggtaagtggagaggcacatgagtgtgggcacacatatatgagagtaagtggagaggcaaatgagtgcgggcacacatgcacacacatgagggtaagtggagaggcacatgagtgtgggcacatgcacacatgagggtaacaggagaggcacacgagtgtgggcacacatgcacacacatgaggataagtggagaggcacacgggtgtgggcacacacatgagggtaagtggagaggcacatgagtgcgggcacacatgcacacatgagggtaagaggagaggcatatgagcatgggcacacatgcacgcacatgagggtaagtggagaggcacacgagtgtgggcacacatgcacacacatgagggtaagcggagaagcacatgggtgtgggcacacacatgagggtaagtggagaggcacatgagtgtgggcacacatgcacacatgagggtaagaggagaggcatatgagcatgggcacacatgtacgcacatgagggtaagaggagaggcacacgggtatgggcacacatgcacacacgtgagggtaagtggagaggcatgacaaggaaggaagaggttggaataatttcattcttttacaagaattaatgagaaattcttaaacatgccaattcggttatgactcacacaaaaacaatagctcacgactacaaaacataaaacagaatgatttggggggtaaaaacaagagttataacctttctcctgccctttaaaaatattttcaataaatcaaagccataactagtttttgccaaacagctcatatttatatagaattttacccctgtagagaatttttctctggaacaatgtttctgcacttgaacgatggtactaacctcctttacagtaaaaaaaaaaattatctcaggcctccccagagcaaactaaaaagaaattatgcataagattataaataccttgtttcaagctcttatacagctataaaatcaatataaatttataactgataataccaacaaacctacaaagccaataatctgccatgcaacatattgttgaaattagcttttcacaccatagcctggttcttccaagagtggcctccctagtctatggcatatcgtgtgatgactcaatgctccagccactctcttctattcaaactctacgtgcagcttttattgtcacaaatgttagcttacgttgtcatttggtcttggctgtaaggcatcatttataattagattcacctgtgccctttgagctgctgactattaagggaaagccatttgatgccaggcactaacagccacatgtcactgtagacactgaaacctcacagcagcatttgtggtcacccagagagtccagaacacgcttacattaaatttatttttaaatcatcaaactgaatttcactagttacaagttccatgaggtcacagatgtgggtttgttttattgactgtggtattcccagcacttagcagagtacctgtaaatagtaagcaatcaacatgtatttatccaatgaattaatgattgaattaatgcatggaaaattctcaaagaaaactcatgtaaacataagaaacacatccctggtccccagtctcctagaacctgaaggaagaatataggcagagtcctgccaacaggcttaacaagtgaatatacacacaaaaagaatccactctcatactcactagattttatacccaaatcactctgaaaagagcactagtatgcaagcaaatactgttcttcctcaagaatatcagtgcagccaaagagggctccttgccctctgtccattagcagagaattgcttttgataacgaaacccaactatggcaaatggcggtgcaatggagcaacagagaaggtagaggggcaagaagggaactagaatatgtgacattagcacctactgcaggccagcaggcgtggtgataggaacttgatatctgctgcctagtttgaacttcacaagaactttacgaggtaggctttattgtatcgcctacttttttacagagaaagaaactgatgctcagagaagttaaacaaggttgacacagtgagtgagggagctagcttttttttttttttttttttttttttttttgaaatggagtctcgctctgtcgcccaggctggagtgcagtggcacgatctcggctcactgcaagctctgcctcccaggttcacaccattctcctgcctcagcctcccgagtagctgggactacaggcgcccaccaccacgcccggctaatttttttgtatttttagtagagacagggtttcaccgtgttagccaggatggtctcaacctcctgacctcgtgatgcgcacgcctcggcctcccaaagtgctgggattacaggcttgagccaccgtgcctggccgggagctggctttttaaccttgccctctccagttaaagtctgtatactattctcaggccatgctgcttcctaaaagaagtgacacatggcaataagagggcaagaaagcaggtaataaaaaggcagatgaagacatttcctgtcctgcaggtaactggatacattaaaaaatacaatcatattgtcccatttatttctaagagatacagcagaagttcttttaaagaaacccccataattctggccagaattgtatttgcttcacaaatgagaagttcagcctttagtttgtctgttattatctctttgggttgaaagaagagaagcagcagtgtattcgtttgttctcacactgccaataaagacatacccaagactgggtaatatataaaggaaagaggtttaattgactctcagctcacatggctgagaaggcctcacggtcatggcagaagatgaaggaagagcaaagggatgtcttacatggtggcaggcaagagagcttgtgcagggaaactcccttttatcaaaccgtcagatcttgtgagacttattcactatcatgagaacagcatgggaaggacccgcccccatgattcaattacctcccaccaggtccctcccatgacacatgggaattatgcgaactacaattcaatacgagatttgggcggggacacagacaaaccatatcaagcagcatctaccattactgctaggactggcagattagcacatttacagtttttttaattcaagcttcctctaactttcaaagctaagctttaccctatgcactttgaataacacgctgtagtactcattcataaataaaaccacatattttcttacatttttcccaaatactttgtattaacttttgacttactaaagtaaaatattaatgggcaaaaaccagtccgtttgggccaataaatggctgatgggaggtaagactaactagtgtttagatccagctgtggctccagagtcagattacttgggctggaatctcagggttgtcttactggctgtttgataggtttcttaggttggttaagccttagtttccttatctataaaatgggagatattaccagtacctctctcagagggtctttgtgaaatcatgcatgtaaagcacttagctcagtgcctgtcacataataacagcaaaataaatgccagttattattattagattatgcctagaaaatattagcgctaacaaggtggcacaggatggaaacaagccacatctactatttttacactactctgatcacaatagattatcacgtttacttaattggaagtgcatgatactgtaaaatatcctacagctaattctttttatatgcagtggtattcccccaagaacacttagtcccatatttggcaaagaaatcacagaatcttcttaattacaatgatgaacactgttgactgcaaactcagtcataacatatagaagtgtttactaaggtggaaatggccacagtgataaactaatgcacccgtaccagattaggtacatcttaatccatctggtttactatttatttgattgaaaggaatttttgagtctataccatcatcaaattactcaaaaggaaagggggagtaggtgaagcagcagacctataacgaatattcactgttgttacccagatatgaaaaggcctaaaaggaaaattcaaagacaagaatgatggtagactgaggagggaagagggaccactgcttggataagccttattgaaggcacttgctcccaaaaaaacagtatttatgacatgctacttcaacataaaagagggcacaaaggaacatctgtaaatactgttgcctttaagaggcccccctttgagtccccttctccctcgaagtggtgataaagtcttagagggtaattatatgcaattatctaaagcaaactgaattaaagggcacccatactgagaagttggttttggtcacattcctatcaagtacactttcccaactttgagccctaattttctgatgtttccatcaacctctgtccctcctctgtagtaggtgtggcttttttccaccctgtgccgtcttgttagctttaatattttctagacataatctaataaccatcactggtatttaattatctcatattatgtgtaagtaggtgatatctaacatggtacataatctgcttttaacctaaaacatcagtttaaccaataactgtgtgctgtatatgtgacagactgggctaggcactataatgactacaaaaccaaattagatgtcaattctacttattcattaacacgatttttaaatgctcacactgattccttctgggcattgtacttgggaatggggtggggagaagatgctaaataaaagaatcataagattgtgaaacttttcaggatcaaaatggagtcacttatgtttaagaacctgacaaatagagccaggggaggacatgaagggagggttttcatgtgcaaatgcctaataaaaagagctatcataaaagaccctgaaaaaacacaactttgcacaaaggccatacacaaaatccttctgcaaggacatctgcccagcaacttcccatcagccttggactggtgctacctttgttactgatccttgtagccaagaatagttatctcaaaacaattatgtaattctcttacatttcctttaaaaacctttattttcctttacctccatgaatatgcacatggtttactatggcacatgtattcccattgcaatgcctaataccaaataaacattttcttttagagtccacctctctgctatttagattgatgaaaatgatatcagaaatgggatcaaagtgagctcacttcagacaaatgtgcagcccctagaattgagtgcagtaccaccagctaagccctttgcaatgtccatttctgtgagtcaccttttctgccctgctgagtctcctttcagattcttggtctccttccctttggtgagtttgttgttgttgttgttgttgtttgagacagggtctccctctgtcacccaggctggcgtgcagcggcacagtcataactcactgcaacctcaaattcccgggctcaagtgattctcccgccctggtctcctaaagtgctgagattacaggtatgagccaccacattggacctttggtgagtccttattgacttaacttgggatccgatctgattataaggccaccttaaataaagaaccttggggccaggtgcagtggctgatgcatgtaattccagcactttgggaggccaaagcaagaggatcacttgaggccaggagttcaagatcagcatgagaaacatagtgagactctgtctccacaaaaaaatttttttaattagctaagtgtggtggtccatgcctatagtcctagctgcttttgaggctgaggctggaggattacttgagcctaggagtttgagtctacagtgggctaggatcctgttactgcagtccagcctgggtgacagagtaacactctgtctctaaaaataaataaataaagtacattgtatccttcttgggactataaaagtatttttgttgttgttgttggggagtaagccctttctggtatacgaacaatgtccttctggtttgagtattctaggttccacagaatttacattttgtcaggttctgtatgcctagtttaatattttgcttgatcttcacacctgagttaaaatttttatgggcactctgattttggttttgttttggttttgttacatgtctgtcaatgatctgactcatttttcctttgcttttttctgaacatctcttgagagcaaaaaataaacattacaaatggtgggtgctacatggccaatgaaaaactactaaggcagtcaccatcatctaaaacactggtccaaactccctaatagaaattatcagattttctttgctctcaagagattaataagaaacagaatgagattctcaaacattaaggcatgccaggttctccaggactcctgccagctacaaggcttttcctcaggcacattttaaaatcaatggtcataatgtggatcattcaaactccccaagcttgttttttcttagaactgaattaaaaaatgcaatcaactatacagttaaaggtagagccttctaagttctttttttttttctttctactttgaatctgctgacttttctgctggtgttgaggtaaactcactgcttatgggatgccagttgaagttttttgttgttgttgttttaagtctggaagggctttcaaattaatggctttacaaatcacaacagcttcatggcaaccaacaatgtagacaccttttggaagtgtaaattcaggtttgtctaacaactgcttagactttcatatcaaacaggtcaaaatcttgagctcagagcagtaatataaggtatctctgtccgggataaaaattgctctgtctgacatgcagggaccagaaaaggaaaaaaaaaaaaaaaaaaacaaaaaaaaaacccaaaccggctaaaatgcttccctgctcacactgactagtcaggcaaaccagatcaacaaacaaaatatagtgttgttactaaaatattcaaacccactgggagactgtttttctgatgcaattcagccagtcctagctaaaacacaaatatttgaatatctaaccttaaactcatttgaaactgaaaaaagggggtggtgggaagttaaaagattttttaaaaaccaaactggtttattcaaaattttggtccgcactcttcattagattacccattggaacaaataaaatttagccatgggaacacgttccattttgtcagaaatataatttggatccaactgtcttatcaactaatcagtttctattgctatgttttacttcctcatgactaaaattctaaaaggaaagctataaggtatttatttgtgtgtgggtatgtgcattgtgtgttcacacatgttgtgtctacatggtaaaacctggcatagttggccataaatcacttaagtaattctattcagattggcttaatgagtgctatattaactatatagtaatgaactcaaatgctgtttagttcacattagttaagtaaataattaacaaataagctagttttaaatttgttgataaaataaaaattaaaatgtcttcagaattgttggcatccacttttgtctggttttgctaatcagatgggattatatttgtgtctctatatattttaaggtcatacaactataaatccaacctaaaaacagaacaatttttgtgtaattctttgataagtaagactaatattgttagtttaatgaaaacatctttatcatctgatttacccacaaaatacccatatatttaaggttcttatataggtgaactccagatattcacagactataaaaatggttaacagggatataacttaaaatgatgactagttttgtataatatctcagtttttataagtaatctaggtataatttttaaaaataaattagggaaatgtaagtgggataaacatttaaaaatgaacttttcctgtgatctgaaatcttaaagttatgttaaactaagtgatagatactcattaaatgtctgggtaaattcctaataaaatactaaaacataaattgctgaacataaattcaggattgttcttggattctcaaattttatacaaagactaaatatattgggtgtattaaacataaaaattatgttataggaaatgttgctaaaaattatgaaattgctctcatctttaaaatattgatgaggtgacagttcaaaacgttttgcttcctaggttttcactagaaattcaggttactaagagtttaaaattctaattaacataaaattatgtatacaaaatgtaccaaaaagatgtgttttggtgagaaaaattgtaagaaaaactatgttctttattgagaaaaaaagaataattttgtctaaattcagaggtcattaaaggttacttcaaaatatggatttaggaaggaagaagaaagaggatagaaatgaaccagtaagcaggagatacgtgaagaaagttataagtattaagatgtatttgtggtaaagcaggttaaaaagaaaagtgaataattttgtataagaaaatgttgtgtggtagatttttgtcctaacgtaaaatgactggttatttaagaaagaaaatgtataggataaaactaaaagtctagcctgttgtcgaacatctgtgtaagtcatgaaaggtttgtgaaggatgaatttatgaaaaaaatttgtgtgtgtgatcaagttggttataattagaaggaaattatttatgtctttctaaatattgagctttgatattaaaaatacactgctacataactaaaactttgatctccctgttagaacaacaaagttttcctgaagtactgatctgctcttagtaaaattgtaagaggttttgatttttaattctgaaatctgtttaacagccatcttctaagctgcaacttattcctgtttaatagtttctattcctgccacattttttttcctaagccatttaatttccctggtttaaggccggaaatgctatcttcttcatttaaatttctccaggtacagctttcctcttgaagcttttcaggttcttgtctcggaagttccacttttgctgtatcttgctgcacgagatttataggttatacatcattgccttaagctttttccccttgagaggatatatcttttgcttggctgaggtgataactctttcaactttttaaccagctcctgtaatttttttatctagctctaactctgttgacatggcctgacactgggatgttcctccttgaaggcctagaaaggcagttaccctccaacataatgtgatttctacatgggtctgaattgctccatgtaaccaggaaacttcccatgattttactaataaccacatattcccctgctcaagatatagttttcttgtttacatttctctataatacggtatacattcataatctttggacacacactcttcctgtgtctgattaaattcaagtatttttcatcaggtttgacttccaggttatttaaactgtcttcccgtaaggagaagcaatcacattgcaaaatatttttttttacctttttgttaactgacctaagacgtaaagattttgagttttatcaaaataatttcctttgtagtctttattaggtttttgattcttaaagtgagctttgaaagggttaaggtttttgtttgtttgctttttacatccatgtaactttctgtatagcttttgaagtttttgattatcactgtagttaaacgaataactattatttcatggtgacctgtgaccctgcttttatcaggtattctaaaccttttggcatctttgatgggcttccccagcatcaaaattctaaattaagtcttttttgacctagaattaactttgagactttctagtcaggcccgtggagagtatcaacggatgcttctctcatcttgtggagatattaaatgattaagctctatggtaaattgtatgagaaacattgtcaaatgataagtgatgctagaccttccttaaattacatttatgggtatgttatatatacaaatgttaaaaagtatgtaaattcatagaagtctaatatggtatcagtcataattttggttattatgttaaaatcttatatgctacagaaataaccaaattccttgtcaattgcaaattataataaacttccatcagatttttaactatagatattctaagtctctgtcatccaccattatgatacttttctaaaagcatttgcaatcagattcatggaaaagactaacaaatattcttaaatataggtttaaataactttaaggtcgatggactaaatgaaaatgtttcagagctctaatgaagaaactgatgaattcatgaaactactaatcaagatgaagcagaacaaaattaattacatgaaattaagtaactgataaaggtaatgtttgcatgacttttatttgaaatattgttagttctttaaatgttttgttttccagatttaagaaaattttctcttttaaggaaggctgggcttgttggttcacacttgtaatcccagcacgttggagggctgaggctggcagatcgcttgaggtcaggaattcaaaaccagcctggccaacatggtgaaaccccttctctatcaaaaaatacaaaaattagctgggcgtggtggtgtacacctgtagtcccagctactcgggaggctgagatgggagaattgcgtgaacccagaaagcagtggttgcagtgagccgagatcacgccactgcgttccggcctgggcgacagagtgagaccctggctcaaaaaataaaataagagacaatttttctcttaagccttctatagtttacagcaattttataaagtatatttttgtaaacaaatatggaagcatttgcttttttgccctactaattccttccaaaattcagaagctatctgtgagtgttcttatgacaatgcagttatttccataagttcaaaaagaattttctctgtctttataacaggatacaattggaaacattggttatactaccaaggctttgactggaatatcatatttgagaacgtgcttaaaatgcctggcttcaagggttcccagccttagagtgagtgagtaaaaatgccatttcatgatagaaaccataggtaaaatctgaagtatgccttgatctggcttcctagcctcaatagattttaaatctgagcttcctatgtcatcaatgtaaagataaaaggttatatttccaaggaaatgctataatacacctgttattagaatacagtcctgtgcattgttttcaagttcttattctccacctatagattagactagatcctgaattcttctagaatcctccaatctaactcttccatagaattattaaaaacagaagctgctctgttcctgaagtcctataagctgaaactaaataaattttaagggacaaatctcatgcctgatgtatgggccacagcaagcattcatcaaactgctcaataccataaacagagacattcggactgcaaaccaggacaagaaattgataactttatgctgtgggcagcttttccctagatgtcagaacaagacccaatataataatgagactctttccccccttaatgctacctttttcacttagcaggataatgacgtaattgcagtttcacaaccagtagcttcccctggtaacttaaccacctgatctaggagatcttttagtccacgcagtgagtgactgtagcaacaaccctaaggcaactgttgattactctctgctttaattcaacccaatcatagaataccagatggaaaaaaatcactctatatttcttgttgctctatattattggttaaataagaaaacacctgtgctattgctaataccatatgctgtaactggataaattcttctgggaaagttgagatccatatatacaaaataagaaaacaggccacagggttacaacatgtctcatctaattgcccatggtcatttgattgatgcaatacctttaagcctaggttcacggctcaaaaccatgcgaactgggattgtcatagtactattaattttactttgtattttcctttttaaactttgtacctgttacctgttaagtgtcttcagaagtacaacttctaacaggatgatactgacccagcactttgaaatgagagctaatgcctacagaacagataaaattgaacttaacaatgaactccaggtagacctatcctgaaaaacactccctccaaacctcccttgttgctcaaatgtagctaaaaggatcttgacactgactactagtcaccaatcacttccttctgatgtgggaccagattagaccacaccaggacaggtccattgcagcactgagggaaaatcaaaacccaaggatgactgatcagcaatgcttctggagaaagatcttggtcaaaaggggggaatgtgaaagttatcagaatcaaaatggagtcatattttaagatgtttaagaccctgacaagtggagctggggaaggccatgaagggagggacatgcacaaatgcctgataacaagaactatcacaaaagaatctgaaaacaatgcaaccttgcacaagggccattgtaaccttacacacacacacacatatacacataaaaagacttctgtgaggacatctgcccagcaactgcctgtccaacctcagactggtgccatccttgttgttgattcttgtagccaaggataatcatctcaaaacaactatataaccctcctcacttttcctttaagaatctttgtcttccttcacttccctgaatatgcacatagcttactatggcatgtgtgttcccactgcaatgcctattaccaaataaatatcattttcttttagagagtatacctctctgcttgctctttaggttgacaagattaatattgtagtggtgacttccataagctgaatatcacatggaggagaaaatatatactaccaacatggcatagtgtagaaactaggcaactatatttatcctggataatcaataatggcaaatctagtagaatgtgtgtatccagcctagatttgaccattaccaacaccaacaaatatttattgactattccctgtacacctccaccttaagagccagaaattcagtttaataaattcaccccagatcatgatacagatttgctgtaggcttaggaaattgttgagaatatgggaatgtcatggggaaaaaaaacgggaactacaccttcattctccccagatctctactcattcctactgttcagccagacaactgtcaacaccaaatttttgagatttatatctcattttttaaaaattgtggtaatatataatatgaaatttaccgatttaaccatatttagatatacaatggcattatgtacactcacactgttgtgcgactttccctccttttaaatcttactttcttgccaatcagaagatcaagtttgggtgtttatggacataaagctagcagtgctaaagttctggcctccccatgcttcatcatcaagcttaaacacacacacacagccctcctaggtagactaacctaagagcagcaaatacattttcttaaatctcaactttaattgcttggtaatgtatgcctggaatactgtgtaggaacagtaccatgactgaatagtgttgtttgcctcaggtgtgggatgggataatggcgccatgcaagttgcatatttatcatttccgagctagtcattttagtacaggtccatagaaattgaacacagctcaggcactctggtaaacacacacaatagacactaacttggtggaacatccccaggtcttctcagactcttcattggctccctacagaagccatgcattgacaccagtgacttttctaggaaccactcagcttctcttgactcaatttaattcactcaacatttagtgtgtttgcgcgatgcacaagagacactgttctagatgctggaatgattaaagtgtaagtagaataatttccaaccaactcaaagctcacaatatggaaggatgctaatgaaggcaagtacttgaataattgttctatgaggaaggatatgatactttccatggaaagagaccaatgaaacggaggtatgaagtaaatcaagatggcggccagtcatactcaaccaaggctgatgtggctatgaaaaatcagacggttatgacaagtagaatcagacaagggcaccaggtagggcagaaccagatagagacaaggagccatcatggctcaggccagaaaagaacccagcctgagagtgaattcactgaaacaaagagaggtgagggctcaagatttgtcataagaaattcttagcaatatattttcagcctttgtttttaaagatacattacatagaggaaaagggtaaaaacttgttagaggcagaagaaatggatttacatcgtaaccctgccccctactagctggggtatcttaggtctaagtctctcaacttttccaaacctcttatcttcaaaataaggacaatatctaccccatgggctgtgtgaaaagttaatggagatgcagtctgcagagcagctagtgaagtatttggcatatggcaggtacctaacatattttggttcttttcatttaagggggttctaagtagcattgtggactacaaaaccacatcagtcaactctgtttaatgaaacagagtatttgttattttgaggcaattgaaaggaaatttaagtccccactctcaaggaagttatctaggagtggagagaaggaaacagatatcttaaaaagccataataaaagaaattacattcatgaaaatgaccccataatatacagattactttgaaaacacactctgagtcattcatgaagactgacagaactatagaagcaactggaaaggtctttgtaaattagggaaggaaatatgagacacataaatactataaacacatttgctatttcggccctactatttactagctgtgtgaccttgtgcaaactgcttaacctctctgaatctctattccctcagccataaagaacaaatgaatctctctcctgcttatctcacatgggtgttttaaaactcaaagtatgcagatgggctctgccaactatcaagagccatacaaaggcagggcatcattattaccattgtctcaaagagcacacaaaaaatcagttattcagacacaggctccctccccaactcacttgtgcttggattgggaaaaacagagaagccaagttgaatttttccctgcttaaacaataaaacctgccttatgagaaagtttgagcataacacagagtcatgtcttaaattctggagtttcatgcatgtggtctaaattaattattcgcattgacagaggcagtcagactgcccccacatatgtaacagagatgcacatacacacacattatgttctgctgaatgacataaactgcaacttttccattccatgttcgcacagccagcattttctgataaaaataaaaatttgtattctcggtttctacgtgaaaagttacctgaaatctctagaacatgagggaacaaaagattcccaatacccaaaacaagcaattaaatactgaactgaaaacagtcttcccttaacatcttggtctcaaagccctgtctgtcttctggaaaactaggtccttgctcccagcattgcctcttcctccctcaccacgttagatctggcagttagtactggtagcttccaatttctcctgaggacggtctagtcgttttctttttttaattctcaaagccagggcaaagtctgaaataaattctagccgcattttccccctgcaaattggtattaccagtcttcagcaagaaaatgagaggatataaggtacacactaagctaggaaaatgggttgtggccagcatgccagtgaggttgagcttatccctagagactgatggtcagagagacagagtgccggccaggcatggtggctcacacctgtaatcccagcactttgggaggccgaggcaggcagatctgaggtcaggagttcaagaccagcctagccagcatggtgaaaccctgtctctactaaaatacaaaaattagctgggcatggtggcatgtgcctgtagtcctagctacttgggaggctgaggcaggagaattgcttgaacccgggaggcggaggttgcagtgagccgagatcgtaccactgcactccagcctgggcgacagagcgagactccatctcaaaaaaaacaaaacaaaactgagagacagagtgccacctcttccttctacagatagcaaggagaaacccaaggggtccgaaagtggctgcagggtcctttcccagtcatttaaattcactccatctctgcatggagatgccatggagggaggtgttacagtgtgcaggctcgggctggtgcggtcacacgaaggagctgcacagttggacgacagtgaagctccagaaatgaagcagcagcagcaaggcttgggtagcagcatgcggcggtcctgcatgtgggcttaaatccaaaggcccgggagctgagactgaacctgggctctgccttatattaactgtagcatggtgggcaagttacacaacctctcagtgcttcagtttcctgatctgtaaaatggagttggataggacttttggtaaaaatcagagattggcacaaagtaagcattcataaaatggtagctgttattatcaccagtgaagggaatttaactaaaaatacggaaacctaaaggtgctggctgcctggccatctagtcatcttgatgccagtgggatttcttaaagtgctagctccacaggtatcacttcatgtaagattacgtgaattatattaaatgtagcacaataatgacttcattaccttgttttctggtacttcaacaccactgaaattcctgccaaacctgtggcctctctgtggccctatgttgagtgatgtccaaccacctttccagtcaaccagcctagaaatccagagtaaaagcataaaagccaatgacaacttcttatccatggagaaactgtatggtgcagtggctgagtgcatggctcttgagtcagactgctccggttcaagtcctggcccatcacttattaactgtgggtctatgagcaagttatttattctctttgtgcctcagtttccacatctgtaaaacatgtacaataacagcttcacaatattcacaacagcagttgtgggatcaaataaattcatatatatatcaagtacttattaatagaacagttcctggcacaaggcactaagtgggtattggccatcattacaactcttctttatgaatataacagaaaaatacaagcgagtcaggctcagaagcctcctaaggcaaatgttttgtgatctttaatctgcttcctactagtgaataaaccatagcatttggcagaaataaagcagttaattggaacgcagtgttggctatgattagcaacaaaccatgttctcccgtcccagatggcaaactgataaatagcatagatgttgcctcccagtccatcagagccagaaggatcttaaagatcacctgatagtggccaccaaacctgaggagcatcaaaatcaactggggagctttccaaaaaacacagactccttaagcccagactctgaaattatctcaattggtctgggatgggccccaggaatctggggatgtcacccatatgtgagatctatggattaaatccattctcctcctgtcaaagatgataaaaataagaaccagcagaataagcccacttgccctatgactcacagtgtgtaagaggcagagcaaagctcaggtgtgccacacatctcctccagcaaaatcatctctagaaagtgaaacaaagaaatgaatcctacaccaagggcttaatctccaaaggtgattaaatatgagcatgtctgtgtctagttccttataggagcaggtaggtctggctaggtttcatgggttcttccattagcagagggaagtgctgttggaaaatgttcctggtctttgaagtcattcagtaacaagagcatctaaggccagtgcaaattaaatcaaagtctgtttttatacctttttattccaagtggctttttaatagagaccaagtcataagaaaaaaaaaagaaacaaagaaagaaaagaaaatctattggagaagtaaaggaggcatttgggaataaagggaaataaggccttatttgaacctacagagtcaccctcacgtcatctatgtcattgcagcctcgggccttgcaatgtgtctgtacttctgtacgtccaagaacaacttattcagagcctgtgaactaaattcctgtcaagctaaagatttttccctggaaattttggtagggatgattggtataatttcccaacttctcatgacaaacccttctgatgtttggaaagcagctcattatcagctgtggttttggcaatcacagcacatagaaacagcatgcattgtcttcatgattagcacaggcagcaacagaatctgcaagaatgacttcataattcaagtgtccacactcttggcagagctaggggtcctctccaaagactgtccaggggtcccactagaaagatctgacatgatctttggctcaaatggcaaaattgtacttgaaaactctggaaaacagcaagtttaagagcagctcataggcaccccacccaaaaacctacattatcaatctacagttgttttgaaacatggatcttgggggagagtgctgggagtctactgcgctttcatttactctggtttactgacctgaggctgcaatgaaatagataagggtgattctgcaggttcaaggagagcctcattttcctttattcccaaatggtgcctcctccacttctcctatagattttcttttttttctttttttttttaaagacttgctctctgttaaaaagcagaaaacttatggacgagtggtacttttagcttttgcatatcctcttctcaaagagggtttgatagaagacagctggggacaagcttgaagtcacagagggaagaagacgatttaaagcaggaagtggatgggtcaaagaaaatgctccccaacctcacaattttgcaagagctggccctgactagatctaattgttctttacaccaattgttctcaattttaatgcatataaaaaccagctcgggagggtgtgtaaaaatgcagattcctaaactccaaactttgggagtctggtttgggaggcttggggtggagtccaggaacccacattctaacaggctccctggccatgtggatgcacatatttgaccccaacactggagaacacagttgacactcttgaggatgttcaaaacaaaactggtggattgcttgttgcttttagctttatgaccttgagtaggtcatcttaacgtctaattctccctttgtgtgttgtaatacctctcttatcttgctgtaatacctctctgacatggatatacatgaggtaggtataagtgtatttttagaaatgtaaaagcaacataaaatttaaaacataaatcatcataatccatttttttccattttcattcatttttaacctatctttagaacatgctggcaaattgcttctgaggattccgaatatgaaataaaaagttcccagaggttcagattatgatactgtgcagtttgggacagctttcagtgaaaatcaaacagtctctaaatataataaagagcagcacgaatttacaatacagtgagttttaaataggcagccacactgcataagaccaacataaggatgggcagaaatatgcctaagattaaaacatcctacacacttacagagcaagtaatgttcattcttactgtgccaggcagtttgctcagacccaagcaagatcccaaatgaaaaacacattcaattttgaaacaaattttatagttacaaaaatttaattttcttctattattaattattaaagaaagtgcccacaaaacagcatttttctttgaaagcatgaggggctatgctcagtccctgctggtatcctcactaggtattgaatatagtcacctccaccatgactccacagagcttgggtgaggtgcccagcaggtcaaaatgactggtttctcactctcacctgaattagacctgcctcatttgaagacattcaaatatgtcctaattttagagggcaatccattgaagtcaagtttccaagaaattacatcagtctttgcaacaaatttacaatggcatgaccaaaacttggttcttgagcaagggttttaaaacaaagcatgatgatttacagttcaagttctcacaaatgcagagaaacccaggtgcaaaggtgagtttagatagacatcaacaataaattaaaagtgcatcaaattctctttctccactgtcaaactgagacatgtttttcctggtttttattcctattgaaaaggaaaaatagggcatgaccagcctttgttacagatatttaattgctaacaaccaacccacagcaacagcctgctaataggtttcttgcctccatagttccttcatggagctcacattccagagatctttggattttatctgtgcttaagataaattcaaattccttcctctgtcttatagggctctgcacaacatggtctttatttgggaccactttccccattcctagtacattggccacaaaagcctgtacctgtcttcaaacacatcgagcttgcaccactgttccttctggaatgttttcccaggactgctcctttttgacaatgggatctttgttcaaagtctgtatatttcactgagaccttcttgtcccacccagtttaatgtagctgtatgatcactctttgtcatgatgccctaattaattctctgcataggatttaactgcagctgatagttttattgaacatttacatttttgctcattattttcttcctcaaatgaaatacaagcttcacaggaagagggatcttgtctgaactgagcattgcagcatcccttgtccctagaactgttcctagcacataggaggcccaaaaagatttgctggctcggtgaatatggagaacactgaggttgcctgattaatgttcaatcttgaagaaatcttagggttcaagcattaattaggcttagagatatgccactcacagactcaattagtttaaatcactgtcctctgctgggctaatttagttaaaatatatctcaagcttttcatttgttctttgtaaaatttaatattaagcatattattagaaaagcattactaaaatttgaaacatattccaacgactttaagaggttttgactcaatgcacaaccatcaacttgaatatacaagagagcaacatatgtcactgggcttgagttcatcactgcctaaattactctctgttaataaattcagcagattaattcttaagcacattctttgggcagtatatccagtgctaccctgatggtccaaaaaggctttatctgagttacttgataaggggattaacttggatactgggggagactcaaacattaactaccatttaaatgtcattctaggtttaggaaaaagcaatttgttaagtacaggtcatgtcaaatttttgttcaagcctttagatgaggttactatttttctagaatcagctgctagattctaaatgtggttcacaagcttataaggtcagtgaagagcagcaagcatattggtgatagatgtggctatgctgaagacaaactgagcttcagccacaagcatggaccaaaaagtaaacagcagtgcctcagattttggccacaggggtctttctattgcatggaaataaactgtcttgttgttgttattgttgtttgtttgtttgtttgtttgtttttggcttttttttccccacaaatgtacattaggaactgttagtacttttaaaggatgatataaaagccaacgggggaatccattaaataaaattcaagtcagtattctccattttaatgtaatcactcttcccattaaaaatgaagagtcacatactcatcgtgtgtatcgcaatatacaagaataagaaagaactgtaagctaaactgcataaacaaacatctcctgaaaaatatggaatagaaaaaaacaaaacatgctgccccctttatctgtcaatgaatttctgagaagcacctggcacttttgtccatttatataaatttactctttaagacttggccaaatctcttggagagaatgaaatggaaacataagctttcaaaccctaagaaaagaaagaactattatgattttatgttcatgtcctaaggcacattgctatccacaaaagccaatggcatcttggcccatatttatttacctactaatgtcagccagtaagccctcaaacttataatcctgaggccagtgggagaagagtagcacctacagaaaaaaaaaaaaaacttggacaatttccgagttattattttaaataatacctttacttttgcagatttctacctcagtaattttggctgtcaatgcttaaaagtgccttccagtcactattcaaaaacctcatacaatgctgacctactctttattctgaaactaatgcactctgtgggcatttcttaaggcacttcaaaagcaggtcattagaaagaatataaacagaaacatgctacataataatttccaagaatatgggcactctaaatgtgagagagaagtttttaaatacccaaaaaattacactgttttttcaactgtgaagggttgcctttttgttgttgttgtcatcttatttgattgtcttgaggttcattatagttcaatgcagtaagattcaccctagggtttttatttctccttctctctctcagtcagatggtgaaaaatagttcttccattaactagatctctagagaatatatcctcccccagctggcttgcatgggaaggcagactttctaattttatagcaaaaaaggataatttgtgggtaggacatgctcactgagttcatctggaccagttcccaccctgactgtaggactcctctgatggtgtgtgtgtgccatctgggtgtcaatttgttgtgataacctaaacgactttcctgggtgacataacaagaaaccaagtggaaatagtgttaatgccatgaaacaaatacgatggctactcaaaaactctagaatcgaactttccctttctcaagaccaaattctctgtttaactccattatcctcagggactctctcccacacctaaagtaaccaagagagatcccagaacacagaaagaagcttgagaatgaaacacaaattggtcccacaactagaaaaaataagtctgaaattcctccctttgtagtcaccattaactatattaaaaggtgtgatgcaacggctaacaggcactggtgggggaatgagatacctgaacatggtagacacaccctaaggtgacccagtgaccctccctcctcctgtgtatgcttttgtgtaatccccttcctttgatggcaggtgtgacctgtgacttgtttctaatcaatagaatagaacaaagatgatgggaagtcacccccataactaccatataagacatggtttggtgggttggagtgagaggatcttcttgctggcttgatgaggtaagcagccacacagcaaagagctgtaggtagactcctgtctacagttagcagaaagctaagtcctcagtcatacagccacaaaaaatataatttctaccaacaaactaatgagcatgcaagtagcttcttccccagccaagcctcaagatgagaatgcagcccagggcagacaccttgattgtgaccctgacctgtgcccagactcttgccccatggaaactgtgagataaagaatgtgtattgttttaagctgctaaatttgtggtgatgtgttatgcagaaatagaagactaatacactatgagaagaaataaaggtcaaaagtctaatttaaactgcccatccttaaagtgaattggagccagtctatgtctggctggagagttctgggctaaccccgctctgaaaataatcacgggaagaaatattcagacagtgacaggcagagtcacctgagtgccatggcaaccattccaaagaatatctattagctttctagaggatctaggttctgcgatgaaaagcttattaaccagaagaacttcttaagcagataatgaaaaataatgggcatagtgacatgttctaaaatcttattatactatacaggaaacttctaagtagcttgacttaaaattcctaggagtgcagaacagtgagagacaatcaatttgtcttcatcttcctataaatcatgtttttgcaaataagtttctattaaatctccatacctgtgaactcatgtaatagttctggagtaaaagtgagttaaaaagaaagaatgcctaatatgaccttcttaaaggcattgttacagggctgtgatatttcatgtgttaatctcctcttatattaacccacaattatattttttaggcttttaacgatttcttcatatctttttatagaatgacaatttcaaaaattaaccacgtaagattccttgtagaaaactatacaaaaggtaacttcagaatatgtgacccctataataagggagctaaagtctgaattgaaaccaattataacttttaaacatatccaataaatgttcaggattccatcaatcttctccttaatttatccaatgccagcatcaagtatttaattaatgacaagattaatatttagaatatttaattctcaaattttaacttcacattatgattagacagctgatgttaatgttaactcatgcctgatattaaccattatatatgctacaggtttaaatactatctaaacttccttttagcactaatagttcatgattaacctcatttctgagcaatatttattaaatatctacaggcattaagaattcacatgaagtaaaaacaggcataatatctatgaaatgatgacaacaagttgcataagatgaagtcagaatccacattctgtgttatggtaaaatattgaagttccagaaatttccagagggacaaagcatggcaaaggtctggaaactgacagtccagattgacagtcagctgtgcttcaggcaagccaaaggtctagagcctgggagttcagtcgagttaggggatataaccatcagtcactcaacatattacatattcattgagcactgctatgtattgacccagttctagtgctggggttaccccagtaaatgagactatcagggtccctgctttccctgctcgcattctgtttaggggacaaataattaataagcaagcaaacaactgattaaggtaatttcagatagtggagagttaagtcaattcaaacgaacatattagtgaggtcctactcccggccacacagtgtccaggtgcttgaaatacattagcgaacaaagcagatatagattcccaacatcatggagatcacattctactagggaaaagagataatatcacaagtcataataagtattaacttatataccatgtaaaaaaggtaatatgtgctatattaaaaaaaaaaagcaggaaaaaggcgagtggaagtatgtatgtgaaggggcagtgggtcacaattcaaaatggggcagtcagggtaggcaccagtaagcaagtgacatcagagcagacttgaaggagggaaccaaaaatgcaaaggtgctaaagcaagactgagttcagcatggaggaacagaaagaagaatgactgggcataacgatcaggggacggggccagcaacatgggcagggaccagatcgcacagaattgagtcaacaggccaactttgatccctaattgctccccctctctgctacattgttatcctcttcctgtctatggactctgctcatcagtttcaaacacattctaatatcttctgtctttagaaaaccattccaccctcctggtcgccactgaatatctaccttccttctcagctacatttctccaaggaagggtccagatgtgctgcctctacctcctggccctcctatttaccctgaagtttactccaattggatcactccccaacacttctcttgaaggtcaccaatgatctccacatgtccaaatgcaaaggacacttgtccttaacttatcaggctctctgctcctctggcacacggctctctttctagaaacactcccctctctccatgacaataccaccatcctcattttctcctgtatctgtggcctttcttcagcttctcttcttaggagtaacccataaataaacataggtgttcatgtgaaaaaaatacgtgaaggctttggttaactgaaagctcattcatcagccctgatggccttggcccagggcaaatcacttagtctccaggggacactacagtcagtaaagaagatagagcctcagaacaagtgagacctgtcagggcttatgctttttaactgaatgaccttgagcaagacacatatctccaggactcagtcttctcacctgtaaaatagggatttttaacagcagccttgcaagactattattaagattaaacgatttatccttcccaagttctctggccaatgcctggtacttggtagatgctactctgctgttagtgtcctcctgaagctcagaaaaagcaccttttggctgatatccagaatctacaaagaacttaaacaaatttacaagaaaaaatcaaacaaccccatcaaaaagtgggcaaaggatatgaacagacacttctcaaaagaagacatttatgcagccaacagacacatgaaaaaatgctcatcatcactggccatcagagaaatgcaaatcaaaaccacaatgagataccatctcacaccagttagaatggcaatcattacaaagtcaggaaacaacaggtgctagagaggatgtggagaaatacgaacacttttacactgttggtgggactgtaaactagttcaaccattctggaagacagtgtggcgattcctcaaggatctaggactagaaataccatttgacccagccatcccattactgggtgtatatccaaaggattataaatcatgctgctataaagacacatgcatacgcatgtttattgcggcactattcacaatagcaaagacttggaaccaatccaaatgtccatcaatgatagactggattaagaaaatgtgacacatatgcaccatggaatactatgcagccacaaaaaaggatgagttcatgtcctttgtaggaacatggatgaagctggaaaccatcattctcagcaaactatctcaaggacagaaaaccaaatgccgcatgttctcactcatagatgggaattgaacaatgagaacacttggacacagggtggggaacatcacacactgggacctgtcgtggggttggggagggatagtattaggagatatacctaatgtaaatgatgagttaacgggtgcagcaaaccaacatggcacatgtatacatatgtaacaaacctgcatgttgtgcacatgtaccctagaacttaaagtataataaaaaataaaaataaaaaataaatacaataaaaaaatagaaaaaagaaaaagcaccttttctctgaataacacaggaaagaaaaataatattaaagggaagagaaagaaaagctatcattaaactgttctgggtggagtcactgttaatgacccacaaacaaattaactttctttgccttataaacccaaaattcttcagttggaaagagatttcaaacacattaaatctcttcaaatatctaattatcaacaggaagcaaatattaatcattactgaatgctccaacttccctcccccaaaggtgtcttatttactttttcctttattgagagagagtcagtacagggtaggagtgtattcctacagcctggatttaaatcctgcctcttctgcttctgagcttcgagactgtgtatggaggacctaagcttcctgtgctgcagtttcctcaactatataatatgagactaattatagtacttatgggattgttttagaaactaaacgacttaatatagatgtagtgtttacaacagttcctggtacaatgtaagctctcaacaaagatgaagatcacaacaataatgaccactactattattagttcaactacccttggggttctcacttcacacccattcagtgatttggaatcagatacatgaagtcacttgttcatacttatcattttgctgtatagaacaatccatattttaaaggaaatagatgtttttgggtattttctttccatttgcctctctggatctactgcctctcaattctgtgatccaaacgaatgatattctgtatcattgggcttcctcgtcctttcacttctggttgggttaagccaatgggacacattggcaggagataggagagaggcaggaaagtgaggtcagagtatcgattcctctagctccccccctgctgggtcatgatggtcatcagcctctcctacaggccacagctcctgccaggctgccctccctaacagctatagctactctgtgcagggtttgagaatcttccctccttttttttttttccaccagtaactgtgtcttttattttattttattttatttttatttttttattatttttttaaatctcttggccccttcaggcctacatagggttaaagctccccactgttgcaaacctcaggatgtctcacaatctcttgttgttttatgtagtcctgaacatatctttttaaagagtcgcttcattaaactcttctaaattacctgattctttcctgctggaacccagactgacacataggtcatgcttttcaacatacagccgtgcaaaacatgaaggaaaggtagcacctggaatactttctataagcagaaagcagcagttgagccagaaggctgagactctctcccaaagcactccacttcaaactcttttgtcattggagctgggtagctcacatggagggcaaagtgagggactctaatcttctcagtatttgccatcccaactgacctttcattcaggtaaatgttatttcctctgacaacttgaaggatgagaggacttgctggtactccatctctcaaatgatcaaagtttcctctccatctgcattcaatccactgagatatttgctaccatgcccttgagaacaagttcaaatacaagtttctctaatactactgctccttttctaagctggtctagcagaaccagagttaaaaggagcatcctgaagttctccctgttagcaaccaagccacagataatactcaatgctccaaggctgcagctcttaattataaccagaagcttaattttagaaggtgacaccagcatcagctttcagcttcacaatctgaactaatcattaattgcatctttaggtcaaactctgtaagaaagttattcagtaaatgagaagaggaagcagagcaagatggctgaatagaagccttcactgatcatcctccctgcaggaacaccaaattgaacaactatccacacaataaagcaccttcataagaaccaaaaatcagacgagcaatcaaaatatctggttataacttcatatcagtgaaagaggcactgaagagggtaggaaagacagtcttgaattgccaacaccacccctcctccatcccctggcaacgaccatgtggtgtggagagagaatctgagcttaggagagggagaacacagtgactgaagaactttgcattgaaactcagtgctgccttgttgcagcagaaagcaataccaggcagaactcaggtggcacccatggagggagcatttagaccagccctagccagaggggaattgcccattctggtcgttgcaacttgagttcctgcaagtcttgccactgcggattaaagtgttctgaggtcctaaataaacttgaaggaatgaaacatgcctataatatctggaaaacaagctcagaaaggcaaatctaagagtaattggcttaaaataggaggtagagagagagatagaggtagaaagtttattcaaagggataataacagagaacttcccaaacctagagaaagatatcaatattcaagtataagaaggtaaaaaacaccaaggagacttaacccaaataagactatctcaagacatataataatcaaactcccaaaggtcaagaataaagaaaggatcctaaaagcagcacgataaaagaaacaaacaacatacaatggaactctaatacatctggcagcagacttttcagtggaaacctcacaggccaggagagagtggcataacatatttaaagtgcagaaggaaaaaaaattattctagaatagcatatctggtgaaaatatccttcaaacatgagggagaaataaagatgttcctagacaaacaaaagctaagggatttcatcagcaccaggcctatcctataagaaatgataaagaaagtacttcagtctgaaagaaaagtatgctaatgaacaataagaaatcatctgaaggcacaaaactcactagtgatagtaagtgcacagaaaaacacagaatattataacattataattgtggtgtataagtatatcttgagtagaaagactaaaagataaactagtcaaaaaaactataacaacttttcaagacatagtacaataagatataaacagaaaagaaaaagtttaaaatcaggggatgaagttaaagcatacagttgttattacttttctctttacttgtttgtttatgcaattggtgttaagttgtgatcagtttaaaataatgagtgtattatctacaagcctcatggtaaccccaaatcaaaaaacataaaacatatacacacaaaaaaagcaagaaattaaaacacaccaccagataaaaataaccttcactaaaaggaagataggaaggaaagaccacaatacagccagaaaaaaacaacaaaatggtaggagtgagttcttacttatcaataataacatttaatgtaaatggacacaattcaataaaaaaacttagaatggctgaatggatgaaaaaaacaagacccaatgatctgttgcctaaaagaaatacacttcacctataaaaacacacacagactgaaaataaaggaatggaaaaagatactccatgtaaatggaaaccaaaaaaaagcaggagtagctatacttacatgagacaacatatatttcaagacaaaaactgtaagaggaaacaaaggtcactatataatgataaaggggtcaattcagcaagacaatataacaactgtaaatatatatgcacccaacactgaaaactctctgagacattggctaggcaaaaacttcttgagtaatattccacaagcacaggaaaccaaagcaaaaatggacaaatgtgatcacatcaagttaaaaagcttctgtacagcaaaggcaacaatcaacaaagtgaggagacaagccacagaatgagggaaaatatttgcaaactacccatatgatggcagataaataaccagagctaaaacaactctataggaaaaatatctaataatctggtttaaaaacaggcaaaggatctgacatttctcaaaagaagacatacaaatggcaaacaggtttatgaaaagatgctcaacatcactgattatcagataaatgtaagtgaaaactacaatgaggtagcatcccaccccagttaaaatgacttttatccaaaagacaggcaatagcaaatgctgctgaggatgtggacaaatgggaacccttatgtcctgttgaggggactgtaaattaatacagccactatggagaacagtttggaggttcctcaaaaaactaaaaatatacttaccatatgattcagcaattccactgctaggtatatactcccaaaaaggaaattggcatatcaaagagctatctgcactcccatgtttgttgcagcaccattcacaatagtcaagatctggaagcaacttacatgtccatcaacagatgaatggataaagaaaatacattctgtaatcacagcactttgggaggctgaggcgagctgatcactggagcccaggaatttgagaccagcctgggcaacacagtgaaaccccatctctacaaaaagtacaaaaatcctggacatggtggcatgtgtctgtagtcccaactacctgggaggcttaggtgggaggatcacctgagcctggagaagttgaggctgcaatgagccatgatggcaccactgcacccaagcctgggtgacagagtgagagcctgtctcaaaaaaagaagagagagagagagagagagagagagagggagggagggagggagggagggagggagggagggagagagaaagaaagaaggaaggaaagaaggaaggaaggaaggaaggaaggaaggaaggaaagaaagaaagaaagaaagaaagaaagaaagaaagaaagaaagaaagaaagaaagaaagaaaaatgtgatacatatacacagtggagtactattcagccatataaaagaatgagatcctaaatgaaatcctgtcatctgcaacagcagggatggcactggaggtatttacgttaagtgaaataagccagacacagaaagataaacttcacatgttctcacttttttctgggagataaaaattaaaaccatggaattcatagagatagagaatagaatgaaagctgcaagaggctgggaagggttggggaggatgaagtagggatgattaatggacacaaaaatatagttagatagaataaataagatctagtgtttgatagtacaacagggtgactacagtcaacaataatttattatgccttttaaagtaacaaagacactataattggattgtttgtaacagaaagaaaagatacatgcctgaggtgatggatagcccatttactgtgatgtaattatgactcattgtatggctgtatcaaaatatctcatgtaccccataaatatttataccactatgtacccataaaaattgaaaattaaaaattaaaaaatataaatccttgtaggctgctttagggataaaccattggctcaaataggtaaaacagatgaaatacgcttccataccgtggcacagcagacacaggctgagaagcagtttgaataacaagcacaacttctaatgcagagaagatgtacttgtcttgtataacagtttctgccagtttaatgtggacctaaaacacataaaagtgctataaaataatatcttcaaaactgtcatactttttaaaatgacaattatgaaaaataaatgttgaagttacattttaataggaaagctggatcatgcccaacactgggccagacaggagaaattctacatagaaaaaaggaaggcaggacatatgaaatagagaaaggaagaaaaatcatgaatgtgagataatgaattatgtgctacaacagctgacctcactgctcaaatatagcacataattcatgagtcatgacattaccatgaatgccttcttgcagaattcacaactgagcagcattggcaacctctgaatatggtgttgtttctttctttcaaaagacaacacatctgatgaacagtaattttatttactcaagagatatgttgctaaagagctgtatacagatttttgtacaggtaacatattttaaatgcactagggtgtctagctttatgaatgaaatgctcaagtgcatattttgtttttgtttttgtttttgtttttgttttgagatggagttttactctgtcatccaggctggattgcagtggcaaaacctcagctcaccgcaacatccgcctcctgggttcaagcaattctcctacctcagcttcccaagtagctgggattacaggcatgcgccaccatgcccagctaatttttgtatttttagtagagacggggtttcaccatgttggccaggctgatctcgaactccagacctcaggtgatctgtccacctcgacctcccaaagtgctgggattacaggtgtgagccatcaagtgcatactttataaagtgaataatacagcccttgccctgaccctctcttcatttatgtgtacaagattaaacagatggtttgtgtttgcatgcaggcatgtgcatgtttaaatagtttaaagaaccactcaggtatcaagtcagcaaatgaatcagaagtgattaaaaatcacataaaatttttactaagacaagataaagttggtgtctgtctaggcaagtatatgcaaaatctttttctttcagatgcctcagtgcccattcagaagattgatggaaaaaacatatgaggtgtatgtttttgaaattttgaattttgaaaatcaaatttttgaagattaaaatttcaaagttaaattttgaaaactaaaaattaaaaaatataaatccatgaagtcacatgaaaataacagaaatatatagacagggacagagcttctcaaaaaacagggtccatgccccattctcagggtccctaaaactataagagaatttatataggttttgatttttatgataacctaatcctcagctcccatcatgttcactaaattattatttagaaatagaaaaacttctattttacagagatagtttacagttaaaagacattttttcggcattattttcatccatctattctcaactgagttctgtggctcactgaagttgtattagtctatgtgaatttttctcttttaaaagggagttgtaatcctgttgtactgaatttgaatgggaaggatcaatatgaacttgtgaagcattttatcttactctgcccattaaattggcctagaaataatgagcaacctagtagtcccaatagattgaggtcattaaataccatttctcacttaaagaaactaagagaacctctcaggggaagtagctgattccaggtcaaaagtagaaaatataaaggatgaacctggaacatctcatcacaccagaagcaaaggagctatcaaagagcacaaggagtatgtcaaaaggaatcagggccacctttaataggctcctactgtccaaaatgaaatggattaaaatatatcaaatgtgcttaaattcacagtactaaagtcaatagtaacaataaaacttgcctttctcactggttaccccctggagggtgtgagcaaaccaactccttattttgaaaactggtaaataaaaagaaagaatcaaacatttactctgccttgctagtataaattatatgtcaagtaaccagagagttgacaagtgtttctccttatagaagtccagctaataaatgagggaatagtaaaatctgaatgtcatcatttttaaatcccaataaattaatacacttagaaaaagcacttatgaaataatattgccaaaaatcatctaaatggagtccattgaagcttctacatctgtctactaatttatataaaacacagagaacagagagcatatgaaatgacagtacaggggacaatcagcaaaacccagactaaactttagggataaagaacatcctacaggaaaaatcaaccattttttcctcaacaaataaattactaagggaaaagacagataacagaaaagattaataaaataagcgttatccaggtgtaatgcccatctattttgcatatgtacaactcctaaagccattacttacacacacactcacacattatatgtgcatatttaaacaaaaaatgttgctttaaaacttactaggaaacaatgacagttttagaatacagtgtcttatgattaggaaactataaaatagtgtgagccctcactcccgggaaataaagcaaatctggaaagcttaggacacgaatgctcatctggggcacaagtattccttgggagaagtttagaattgctgggagtcatataatttgcaaaagcttggttaataatacgttcacatttggaaaattaaaaaaattaatgtatataataatattacagagtcaacattttgactctgtaatattaataattatccatataataatattacagagtcaaccaaccaccagagcctatgctgaatgttatatatattacataacagccacaggaaaaggtattagtatccctatttctcagaagacagaaactgacctttccaaggctatatagctagtaaaaataaacatatacactcaccatctcaatacgttcagaaaaagcatttcacaaaactcaactcccattcataataaaaactctcaacaaactagaaatagaaggaaagttgatgaagagcatctgcaaaaaacctgtagctaacaccgcacttaatggtgaaagaccacttctctcatcatttcaattatttcaattcaatattggtggtcctagcccatgtaataaggaaagaggagaggggagaggggagaggggagaggggaaaggagagggagaaagagaaagagagagagagagaaagaaagaaagagaaagagagagagaaataaagttggtttcttcatttgcagatgacataatctgcagatgacataatctatgtagaaaataccgaggaatataccaaagtgataaaactaataactgagtttaacaaggtcacaagatacaacgtcaatatatgaaatgcaatgacattttaatatactagcaatgaacagctggaagttgaaattaaaaagaaaatactaaaaacgtgacatacttaggaaaaaaaacattgctgagagaaattaaggaagatctaaagaaatggaaagatataccatgttcatgggttggaaaattcagtattattaaggcatcaattatgccccaaatgatccatagattcaacataataccaatcaaaatcccagcagacttctctgtagaaactgacaagtagattataaaagttatatggaaatgctaaaatctgattctaaaatctacaagaaaatgcaaagttggaggactcatactacctgattacaaaacttagtataaagctacagtaatcaagacagtgtgatattaacacaggatagacatataaatcaaagaaacaaaatgaagtccagaaacagacccaccatatatggtaagatgattttcaacaaaactgttaaggtaattcaatatggaaatgataatcttttcaaaaaaggggtattagaactgaatattcatatgtgaaaaaaatcaatcgttctctctcactattcacaaaaattaacttaaaatgggccagagacttaaatttaagagctaaagctataaaagttccagaagaaaacatagcagaaaaatctttgtaactttgggctaggtgaagatttccttttattttttatttatttattttttgacagagtctctcgctctgtcatccaggctggagtgccgtggcgtgatctcggctcactgcaacttccgcctcccggattcaaccgattctcctgcttcagcctcccaagtagttgggactacaggcacacgccaccacacctggctaattttttgtattttagtagagatggggtttcaccatgttgcccaggcatgaagacttcttaaacaggacacaaaaaatgtacaaactataaaagcagaagttaataatttgcacatcaccaaaattaaaagcttccatcctttgaaagacagtgttaggaaaataagatgagtcattgactagagataatatttgcaaaacacctatgtgataaaagacttatacctggaatacataaacaacccttacaactcaataagatgacaaacaagccactgaaaatataaccaaaagatttaaacagatgctttagtacagaaaagatatgattggacaataagcccataaaaagacactcaacatcattagtcatcagggaaatgcaatgcattatctctaccacttaactagaatacctaaaactaaaaagcctgaaaattccaagtgttgacaaggatgcagaacaactggaaatctcataagttgctggtgggaaatcaaaatggaagaaccactttggaaaacagtttggcaatctagtggttaattttatgaattaaattggcagagccacagtgcccagatacttggtcaaatatcattctatatgtttttgtgaaagagagagagagagatagagagagatagagagaaataaagttggtttcttcatttgcagatgaaggtttttttttgaggagattaacatttaaatggtagactttgagtaaagcagattgcccactataatataagtgggcttcatacaatcagttgaaggcattacgagaacagactgactaccgcctgaacaagaaggaattctcccagcagactgcctttgaatttgaactgcaactcttccctgggtctccagccttccagcttgctctgtggattttggacttaccaaacctccacaatcacacgaaccaattccttcagctaaatcaaccagctgatctctatatatacatatatgtgtatacacacacacccccgccacaaacacacacacacacacacacacacccctcctcccccctccacacacagcctgttggttctgtttctctggagaactctgactactaatataggcagtttttaaatcaaattaaacaaatactctgcacttacatttgatccagcaatcctactcataagtgtttaccccctacaacccaaaattgtttgtgtagacaaaacaaatatatgtctacacaagctccccatgaagactttcttcacctgccgagtctcagtaactttgctgtcctcaaggtcaataacctcttttccacacctctctcctggcatacaatggggtcagagtcagtgacaatttggttgaaagaaatagaagtcacttaggcttaagtatatgtgaatttgctaacaaggacatggataatatatagaattcaagagcatgaagtgtagctgggcctcaggaagctttgggaccaagactggcacatctctcctcctcatggacccatgggctctcatttatgtttcttttcctctatgtctgcctcattcctctccctccttcttgtttcaggatacttctctatgcacatgagccaaacacggcccatgcagcccagccctgcctggactctatcactttataaagcttcacattcaaattctcaggataaagaatccgacggattcgtcttgaggtccattggctatggcttcagagctgatatcccaaagcccagtgcaggactagcttaggagacaactctatgggaaaggaatatggagcagagaagaaatgatcagtctcctggcctacaagaccctacctgggctgatccctgactgccatccttaataccattgtagtacccactgtctctcagcttcttgctattatccaaggactccaagcatgctcttgcctcaaggtctgtttttgtgtttgctgttccttttgcctagaaggctcttcccacaaatatatgcagggcttgttccctcacttcatcaggccttggttcaaatggccaggccttccttgaccactacaacccgatgtcacactctttgccattactctgctttatttttcctcagaacattgtaaaaacatgacatgatcatgtatatttacttattaatctgcttgctatctgtctttcccactagaatgtaaaattcatgagaataagaactgctatcttctctactgtatcaccagaactcttagtatcaggtacagaatagatgttccataaatgtttgttggatagagtattaattttacatgcctgttttacatgtctactaattgaatgaccaccaccacagtccatatatctccactgataatgtcccatggaggggcatttcctaccatgttcatgccagtattttgtactctttcaatgttgacactatttttctcatcccccaaaattcttctgttagttctcaataagtgatttaattaaattcctctttagcccattcacattctggcagctccatgaatggctttccccattcaaaaaacctaaatgctctcattacagagtcccatttgtaagaagccctacagagtcccagcaaacctgttcttctctttccaacttggccatgtctcagatgggaccccaagagcttaagcttctttgaactcacccacaaataactggtttgagtagagggagttggggatgtctgtggaaaactgtgaactcatgctggatggaaagccagggtcctaatggtgacaccccttggaagcagactttattctgtgagtagtggggggccactgatggtttctcagcaggagtaggtaataaaagatgtgcttcaagaagatgtctggtagcaatgggtagaatgatagtgacctgtgattattcagggtagaagatgattatggcctagatagggctctggaaacagagactgctgcagaaaaaaacatggtgggaagaatctatagaatttggaaagtgagtagaagtatgtgtggggatgggagtgggggactgggggtgggagaggtgtcagatgctgccaaggtgtcaagccagaagtcactggatagtttattaggatatccacgataatcctcaagatgacagtttaagatcgatgttggaagggaaaggagatactgagaaattagtcgaggggttgaataagtataacttgtatgttttttattacctccaaagcattttcatcttacttgatccttactggctcatgggataggtaagtaagaaaggctgtaactttgtccaagccacagaggccaacagaattgaggtcaatttctctaacatgattgaacaggaagctgtttagttatttgaaaacatcagttaaggcaagatctcataacaacatgacacaagcaaaacatttttctttcatttggccactcactgcctgaaccgagttatgtgtttggcaagttcaccactttgtgagtccaggttgggcgaggcaagatcgtctacctgaagtgagagaaaaaaagctagagacttgcttgcccagtttcccttgcagctagagaaaaggctgagggagaagtgagctctgccaaccaggcagcctgcacggaggcggactgggagcttacattatgaaagggaggggggagctcgtgctctcttcagcagtggcaggagaagggtggccttgtagctgcacactcgacacagaggtagctttgaggatggcagggccagcagctgcgattaaggtcctggcagacaggtcacgtggcatcgagagctccctagaggtggcactttctcgtcagaccagttctggggtttggtgttgggtgctgctccaggaagctcagccttcattcagactctccagttctcccaattctccagctgcccaatcacgtctctgcttagccagagtcattttctgttgctagtgtctaagaactctgactgatacaccttaaaaccataaatgttttgttttactttaaatatcacatggatagacatactcaccaatcttaacaccagttgaaagtaagtcctgtgacatataagcaaaatgaaaataggaaaagttttattttgataagcacccaggagtcattttctagatttattaaaactcatttataatatcaagtttttttatagaggcaggctacaaaatagtaaatatgctgtatttgttgcacccacaagaaaagaatatgcccaaatgttaacagccattatcttggggtagtgggtaatgaggaattactgatttcctccattctgctcatatacagttcaaaaattttctgccatgcatgtgtcattcttgtatgataaaatatttttaaaacatatagaaaacaggtctgttttcttctgtaattgtgctgatcgttacttttcatctctgttggagcattttaggagcaacttccttgccttggtctgatgttctcagaagggatttgcagagagtaacactccaggtttctctactcccaccccactcccaccctactcctcaacatccaccccttctggagagcttcggaggaagtcctagacaagcctggcttcaagccttccttgctctttttcacctctgtctgcccacagaagggggcattctggtctgctctcctgcaggtaagttaccaggcaagaactgtccccctgcaccagggctgagagcatgagtgacactaattccaggcagtctttagtggccacacatctaagccacagtttccaactggctttattaataacagagctccatttgtctcttgcattttatttctcatttggttcctaaaatgggaggggaattgaagaaggtaatatagacacacccaggcaccaaaggaactgtgattaacactattttcttaggcctctcagtgccctccatgaataagtcctgagacacaggggaacgcaggctgctgaatggattttcaattgcctataaccctggggagaaaacgctcaagccccagtatgctgccaatactgcctgcattttcccttttcactgccttgttgggaagtgcatcattgcttaatattcaggaactccctaccaggattcagtgccttaataacagcaatataaaacctcgattatctaataaaatatcccagactggaccctgaggtttcattagtggcaagacattttattgggattatagctttttgttgttgttgttcagaaagcagacactgttcaagcctggaaagcttattcattgatgttaaccttttccttcacaaaatatatgaaaagaaagcaaatcatggactctcaaatctgcagttctacctctgctattttattattccttacctccttcagataaagtatctaagtctcagaagtcattactcttaaattcaagccataaaaacacacccatcttcctaagagtttatcagcattttgcaaagtagctggatacagcaagtactttaaaagccacagtaaagtgcaagccgacttccaaatcttacacataattgctatctgacagctttcagggtagacaacaaccaaagtcaagtttcctgactatattttcctctaacttattaagttattattcaaggtcacaaaacaacagcttaggatatgcatgccattaaacagaaagcaaacctcatcaaacacataactcttaaaagttgcttccttagtgcgccagaatgtatgctatagaaatataaagacatgagcacacaaagacagaataatactattgagtatttaaaagtcttcagctaaaatgttttcaacagcactgttttctaggaaatcaaacaaaaggtgcttaatgaacagtgaaactgtgataagtcctttttaataaaataggcagactgttgactggggttttggtgggtggtctgtgggggataggaacatggggttgataaagacaggccttaaaggcaggactgcatgactggcaagctttggctgttgctgcctaggttgggccatgctgcagccgcccccaccactgcactctctggatcagaactggaaggtacctcgatatctttgcttatagcattggacagatgaagggctggttacctgtcaggaagtgaagagcgtggttaagagtcctctatgctaggttgtcacagtcaccagctactagactcttggctacaacatttctcaccaagagcagtgtccttggggaaaaactaaacagggatgagaaaggggttaggaataaaactctctcctagagaccaggtcagaatacataatgggtttaacttcgcaataaagtgacaaggtgcacttgaataagccaccctgatacacggaaagcactgggcacagaagtaactttcccattgaatcaggagttgatcccataaaccttactattagccaagtttacatttatgaacattttacacacactactcagttatatattaaagacaaaaattgataaaatacttatactttggtaagccatagagccaattctcttttcaacctagttgttcatttcaccagtgggcaaaaatcattatttttaaaggtttccaatttaagagcacagaccacccagctattatagagctctatagtttagccctcgaaggtgagtcccagatgcagttcagggatggtctgaacctttgaacaagggcaaatccaagcactctaactcctggttccctgctctatccctcatccatgccaccttttttaagcatccatatggattagtgaatctcatttccaaatctatgcttggttagcataatctctcatccagaactcccctttgaatttgagatcctatatctaagggcccacctccattcctccctgcaggtctcacagacaccttaaagtcaatgtcttatctgtttccctttcacgctcccaaacgagtcattgttcatcttccactccttatttcagtaactggaactccatccctccagaagcacaaaacagaacctgggagtcatccttgattcttgctatttcctcacctcccatatccaacctatccccaagtcctgatgactttacctgctgaatatctttccagtctgtccatttctctccagccttctgccagcaacattccaaaccatcacctccctcttgaagctctataatagcttcttagtggctatcactttccatcttgtaaaatgcacgtaagagtgtcttctcttttgccccttttccaatcaaagatcctagaaaagcacaaatctgatcatgtctttcctttacttgaaatgcaaaaatggcatcccattattctcagaataaagaacaaatccctaaggcagcctggagctcctgcctgaccagaccctggctcagtctccagccagctaacccacactgtctgcttcagacacaccctctcccttctgcccagagtcacttaccccctagagtcactttcccactggccccacaggaccaggtcttcctgccacatgctagtaccctcacttctccatggcacttatcggtgggtgatgacacatgtgtggttttgtgcaagtgcctgtctcctgtgcttaactctaaagccccctgaagagaagggctccatgtgctctgctcccatccacccccggggccttgcatggggctgacacacagttgatacagtgcgaacacatgtagaatgcacagcactcacatcacagtgagtaaggcccaactcggacagcatcatcctcttgccaaacaagagtcagtttttcagggcctcagagggtctggaggaataactcatctctccccttaacaaatctccccagtatgatgtctgggcttaaaagtgggggtagggtggggaaagtattctgttaatgtggtttttaaagatagtgacagccggttggcatcctttaaacatctgattaatggaatatattaaagtaataataaagattttaactgctacagctttaatccaaactgagaaaatgtctaagaaatgagaaagcaggaatgctctctcccactgcctcctcccccatgaataaacaggaagatgagagacagagttacaggcagtgtggtatactggttatatgtgcacacactctggactctggctagctgcattcaaattctggctctgtcacctactggctgtgctatcttgggcaagtcacttaacctctctgcttcagtgtcctcatctgcaaaatgaggataacaacagcatgccttatagtgttgttgtgaggattaaatgagttaatgtaggttaagtgctttgagcaatgtcttatgctgcttatagtaagcaatacacaaacatttgccatgttattgttacttggtgttttaaagatgtttaacagcattctggctaaaagtgttatgttttggttagaatggaactcaatgtttaaaatgaagatgttaaaattaaaacgtgtactgtcttgttttgttatacacgaaactatttttaatgaaaatagtctgaatgcttaaccttgttgaactcagataaaacaaacaaaatatctgttagtgaatggttgttggcttcttaacagagtgtgacaaaaaccttcctcaaatatgcacgaataacctgaattcagtatacctgttcagtatccagtgaattcagaagcatatgcctcatttccctttgatagataaagtaacaaaatcacattcagttaactgagctggacaacaaaatcagaaggaaattaacaaaaataaatcactgcattaaaacagagcatgtatacatacatctatccttgaattgtgaagaatatatgctcagattacaccaaacagaaaggtacttattataaaaacagttgactaaaatgtctccaactaaacacatgcccatccctatgacgaaatagtttcactcctaaatatatactgaagaaatacaaagacagaaagacatatataacattgttcatagtagttttgtttataatagccaaaaactgaaaataacctagatttctatcaataggagaatggataaacaaattgttgtatgtttatacaactgaataccatatagcaatgagaatgaacaaactactgatacgtgtaataacatgtatgtatcttacagatattttgtaaagtcgaagaatctggaccaaaaaaaatgtatatatggttctctttatatgaagtttaagaatcatcaaaaatgatcaataatgacagaagcagcaatcgtggttacctctggggagcacaggcacagaatgggagggagcgtgagaggatctcagtgagtgctggcaatgttctagatcttgatctgggtggtggttacacaggtttatacagatgtaaaattcatcaagctgtacacttaaagatttgtgtagtttatacactttactgtatgtgttttacttctattataaaacaatcttcccgaccagtaatttaaataatgactgactgtatttttttttttcttgagactgagtttcactcttgttgcccaggctagagtgtaatggtgtgatctaggctcactgcaacctccgcctcctgggttcaagcgattctcctgccttagcctcccaagtagctgggattccaggcacccaccaccatgcccagctaatttttgtatttttagtagagacggggtttcgccatgttggccaggctggtctcaaactcctgacctcaggtgatccacctgcctgggcctcccagagcgctgagattaccggcgtgagccaccacgcctggtctctgactgtactttaacaaaattgactgccaattgattactttgtgtgttgttgaagagttggcagagtgctccacccacatacacaccaaaccaaatattaagtctcccacaaaagtcacatgttgaagcccaaacccccaatgtgactgcatttgaagacagggcctacaaagaagtaattaaggttacatgaactcatatggatggggccctaatccaacatgactggtgttctttttagaagaagagacaccagggatgtacacacagagaaaaggccacgtgaggacacagcaagagggcagccacctgccagccaaagagaaaggcttcaggagaaaccagacctgctaacaccttgatcttggacttctagccaccagaactgggagaaaataaacgtctgttgtttaagccacccagtctatggtatttgttatggcagcctcaacagactaatataccaggtaaagaaagctccaagagaaacttcaggaactagacacaggccctctggtttttatggaacccaggtgttgatatctgactctcgctgggagaaatctaagggctagtcagagtgagcagggcaaaataggggtacagggagggggatatgttgggagcaaaaggcatgtctactgccaaccaaataagtgtgtgtgtgtttcctctggtcacaatgtggctgcacagaagcagcctgtctaagctggaggaagtgaagtttaaaatgagacaactgtcacttagccacaaagacagtaaaaaagaaataaaagaagaaaggatctgcaaaacaaccagaaaataagtaaccaaagggcagtagtaaatccttatctgtcaataataaccttgaatataaattaattaaattttccaattaaaagacatagagtggctgaatggatttcaaaaacaagaccctggctgggcgcagtggctcatgcctgtgatcccagcattttgggaggccaaggcgggtggatcataaggtcaggagatggagaccattctggctaacacagtgaaatgaaaccctgtctctactaaaaatacaaaaaattagctgggtgtggtggtatgcgcgcctgtagtcctagctacttgggaggctgagggaggagaattgctagaacccgggagatgaaggttgcagtgagctgagattgcaccgctacactccagcctgggtgacagagtgagactccaactcaggaaaacaaaaacaagcaaaaaaaaaacaaaaaaacaagactctgtgttggctacaagaaactcacttcacctataaagacatgcatagactgaaagtgaaggaatggaaaaatatattccatgcaaatggaaactaaaaaagagcaggagtagttatacctatgttagagaaagtagattattttaaagttaagaatggcttaaagacaaaaaaaaggccattatataatgataaagtggccagtacagcaagaggatataacaattctaaatatatatgcactcaacaccagggcacccaaatatataaagcaaatattcatagacctaaagggagaggttgactacaatacaataatagcagaagagttcaacacccccactttcagcagtgaacagatcatccagacagtaaatcaacagagaaacatcagagttaagctgcactctaggccaaatggacctaacaaacatttacagaacgttccatccaacagctacagaatacacattttcctcaacaccacatgaagtattttccaggatagaccacatgttaagtcacaaaacaaatcttaaatttaaaaaatcagtcatatcaataatcttttctgatcacaatggaacaaaactagaaatcaataacagaaggaactttggaaagtatgcaaaatcatggaaattaaacaacatgctactgaataataaatgagtcaatgaagaaacgtaaatagaaacttaaaaattccttgagacaaatgaaaatggaaatagaacataccaaaacctacgggatacagcaaaagcagttctaagagggaagtttagaccaggtgtggtggctcacacctgtaatcccagcactttgggaggccgaggcaggtggatcacttgaggtgaggagtttgagaccagcctgacgaacatggagaaaccctgtctctagtaaaagccaggcatctcccgtgtagccgggcgcatgcctgcatgcctgtaatcctggctacatgggaagctgaggcaggagaaatgctggaatctgggaggcagttgcggtgagccgagatcacaccattgcactccagcctcggcaacgagagcgaaactccatctcaaaaaaaaaaaaaaaaaaaaagagggaagtttatagtaataaatgtctatatcaaaaaagtagaaagatctcaaataagcaagccacctcaaggaactagaaaaataggaactaaacccaaaattagtacaagaaaagaaataacaaatatctgagcagaaataaacaaatccttagctagacttactaagaaaaagagagagaagatcaggtgcggtggctcattcctgtaatcccgacactttgggaggctgaggtgggaggatcgcttgagaccaggagttcaaagtttcagggagctaggatcactccaggaatactccagttaggagcactccagccttggtgacagagcaagaccctgtctcaaaagaaagcaaagaaagaaaagaaaagaatagaaaacctgaatagaccaataataagtaatgagattgaagcagtaataaaatgtcccccatcaaggaaaagcccaggaactgatggctccaccactaaattctacataacatttaaagaagaactaataccgattcttcaaaaactattccaaaacattgaagagaagggaatacttccaaaatcattctacaaggccagtattaccttaatactaaaaccacacaaggatacaacgaccaaaaagaaaactacaggccaatattcctaatgaatatagatgcaataatcttcaaccgaacactagtaaaccaaatccaaaaacacattaaaaagttcattcatcatgatcaagtgggattcatcccaggggtgaaaggatggttcaatataggcaaatcaattaacatgatacgtcacattaacagaatcaagggtaaaaaccgtatgatcattttaatagatacagaagaagtgtttgataaaatgtaacatccttgatgataaaaatgctcaacaaattaggtacagaaggaatatatttcaacacaacatgacaaaggccacgtatgacaaacccacagctaacatcatgctgaatgggaaaatgtttaaagcttctcctctaagatctggaaaaatataagaaagtccattttcaccactcttattcaacatcatgctggaagtcctagctagagcaattagtcaaagaaataaagggcatccacattgggaaggaagaagtcatattgcccctactggcagatatgaatatatatacacatatatacacatatgtatgtgtgtatatatatatgtatattctcaaagatctccccaaaaactattagaatgagtaagtaaattcaggaaagttgtagtatacaaaatcaacatggaaaattagtagcatttctatataccaataacaaactattcgaaaaaaaatcaagaaagcaaatccatttacaatagctacaaaataataaattacctaggtctaaattttagcaaggatgtaaaagatctctacaatgaaaactataaaacactgatgaaagaaatagaagacacaaatgaatgaaaagatatctcatgttcataaattggaagaattaatatcattaaaatgactgtatctacagatccaacacaatccctatagaaacacccatggcattcttcacagaaatagaaaaacaatcctaaaattcatatggaaccacaaaagactccaagtaaccaaagcgatcttgagaaaaagaactaagctagaacaaaattacagttagataggaggaataagttctgttacattagcagggtgattacagctaatagcaaggtattatatattttaagataagtagaaaagaggatcttgaaagttatcgccacaaagaaatcataaaagtttcagtgactgacatgctaactactctgatttgatgattatacaatgtgcacatgtattaaagcctcacactgtatcccatacatgtacaatttttatgtgtcaattttaacaacattaataaaaataacacaactttaacactactacacacttagcagaatacctcaagctaaacaaatggtaggaaaccaggtgctatcaccaacgtggaaccaactacgattctcataaactgctgttgggagtataaattggacaaagtagtccccactttggaaaaccggcaatatctctaaagctaaatgtatacctgttctatgaccccacaattccattcctgagtatataccctacagaaatcagtgtatatgtaaaccaaaataaacatataataatattcacagtaaaacaaccctaatgtccttcaacaaaagaattgataaactcagtatattcacacaatggattaaacagcaaaaaaggaatgaatcatgaattaatctctacaatattaaacaagaagtcagatgcaaaaggctacatactatatgattccacgcagatgaagttaagaacaggcaaaactgctctatggtgacagaggtcagagtagtggttacctttctgaaagtggttgatattgactgactgagaaggcatatgagggagcctcccaggggccagaaaatgttctatgtcttgattcaagtgctagttatatagtttttcagatatgtgaaaatttagcaagctctacgcttgatatttctgtttcttcactattcaagttacatcgcaatttaaaaacatcaaatattagatgagaatttgagttatttattatcacattggatgtattatgtgactagtagtcaaacttttcaccacttaagaataaccgggagatctttttttttttttttttgagacggagtctcgctctgtcgcccaggccggactgcggactgcagtggcgctgtcttggctcactgcaagctccgcttcccgggttcacgccattctcctgcctcagcctcccgagtagctgggactacaggcgcccgccaccgcgcccggctaattttttgtatttttagtagagacggggtttcaccgtgttagccaggatggtctcgatctcctgacctcatgatccacccgcctcggcctcccaaggtgctgggattacaggcgtgagccaccgcgcccggcctaaccgggagatctaagagacctgcctaaaattttattcccatggggaagagaagacaagtctgttaagtgggtagaaagaagctgtaagagaagaacaagagatgatggctatttgcatcccattgagtccagcccattcaataaatgtgttatatatagaaggcagtggattttgcttgagattccttgaacaacaaatagtgttttctgagcctgccagttattacttaggtttctgtttactattcagttccaaagattaactctgatgtgatgacatgggaaccatggttcacactgacatcagcagtttattgacctgtgtctagtgttaatatccaaaaacattgtgaaagacagaagtccccctgcttagcccaatgagatcaacattagccactggctgacattatccaactaatgattacaacagactgtaactattcattctgactaacatagcactttgctagataatacttagattggctaattaccaactattaagcctattttttatgaagttataggaatatacttacatatatatgcatatgtgtgtatacatatatatttaaacattttactactttagctttactttagattctactctagcttttattttgggtgactcctggtttaacgtgacaaatttaccaccttaataccatcaattatatatttttaatcttttcctcttcttttcctcttaaagagtataaaggtatacatcaggtataaatccacagagaatggaagagagaatattcacaaacaaaagattacaacacatttttctttgagatgactgaactgtagaaccccagggatgcaggcctaccaaaggatggggtggagaaggctctggaaacaggaggttcactgatccagaacagcaggatccccagccctctgctccacaccacacacatgtatcactaggagccagcagctacttctcaggaaaaagactggaatgtggagattcccagtggaacaacctaatagctcccttggttaccctgtagagaggcctgctgatggacaatgttgtcctactcaagtcctttctctctttctttctttctttctttctttctttctttctttctttctttctttctttctttctttctctctctctttctctctctctctttctttctttctttctttctttctttctttctttctttctttctttctttctgtgtttctctgtctctctttctctctttctttctctctttccctctctctttctttctttctttcctttttgagacagagacttgctttgtcacccaggctgccacgatcttggctcactgcaacctccacctcctgggttcaagcaattctcctacctcagcctcctgagtagctgggattacaggcgtgcaccaccatgcccagctaattttttttttttttcagttaagacagggtttcaccatgttggccaagttggtctcaaactcctgacctcaggtgatccacctgccttggcctcctaaaatgctaggattacaggcatgagccactgcacctgtcctcaagtccctactttcaatgtgctttcccacccaacagccagcacctatggctctttttgggagggctgcacttgcttcaccctttcatgtcaagagccagaaatacctgagaatttatgtccccacccaacagaccccctctcttaactgaagactgacaggtatggagtatgaaacaccaaccccatagattcaggcagggacaactctgaggctgacttacactccagagctcccccaccccacacaggatcaggctgaagcccctctttgcagtattttgtttgaatgagagcatacccttacttgacttcttccccttcccttcccagtttttcctaggagcatctccttaatagagcagcacatatacacacaaaccctcttcttggtgtctgcttctgaggattctgacctaagacatctgcaaagcacaccaacttatacagaccttctggccagcttcagtgtcacagtcctacatatgaaaagacaatcaacgataagcagactgtgctaaaaacctccagcagggaagggagtgatcaacataaacaaaaagatgtaaacactgtaattccccaagtgggagaagcaggagatgtgataggagagggaaaaattaaactcagaaagagtaaaagattcactgtacagatatcataataaatgacacctgaatcatccactttcatatgcacattctctctacttcatcaaggggagccacattccacatgagaagctgcagacgggttgataattgcctacccatcacatcaccatgcagtcctctctaagcctgccctctccacatcaccccatcgcctctgcatccatccactaaaggtaattttgaaaacagtctttgcactgccagtaagtaccatgttgtgtttcacagggagcagcttagacataatagcaaacaaaatcctgagcctctcatcctccactcttccccaagcaggtttcaaatacctcacatgacttaaatgtataatgatatgcacttttaacactggcttaaaattctgtctttaggactagacatcatctaccatagcagtaacaatttatgtcaagtcaaagtatactttataatttattttacatgtgtcatggatctctcttccaggttatggaaaattaatatattttggcaggctaaaatacttaagcactcaacagaaagctgacttaattgttcctttccttaacaaattttaataaggagtagatactgttagtgattttggtcccaagcttttaatatatttatttcttcccaccccttaactacatacccacgtgcacacacttacacacaatccttattatagagtaacatattgatcatagactatgtggaataccacaaacagccctgccataattccagcatacagtttctgtccattttgagaagaaatgtcaatttacatatgttataataattccacttccaagtctatacttattaagaagaaaaacaggaggtatgttcaaggctttgctcttagagagatgtgcatgattcctcaatacatggtagggaaatacaaagataaagtacattctatgaggtcctctttatttatagtcaaatgcatggagttctggcccccatgttaaattttggggaaagcatatcaccaagggctgctggcagctgaggcatgaaacacttcagccggttcagagttccctatagtggcaggatacccaagggagcaaagctaaacatctggccactttagttatcatctaacaagcgcttttcatgctgaaatgttggttttgtttgtctgtttgcttttcctctctgtcctccctgacattcttttccttttatggttaataacagaggggggaaatactttaaggcaagaatctcaaagccttatatttaatcacaaaatcttaactcaatcattcccaaagctttactagagaataggtggaatttcctttaaagatgaaaaaacaggaaacatacaaaagcaacagatttttaatcctgatttactcaataaatatttcttgggcatatagaatatacatgtggggggcatactatacatatgctattatctttctcagtgttaagggagatgaaaaaatgagtgtgtgggtgggtgcatattttgaaaggacaagagagatggaaaagatgagcatgagctgctggaatccagagtggtacaaagcactgtgagagtttagatcaggggtcagtaaactgaggtccgtgggacaaatccatcccactgcctgtttgtgtactgccttggagctgagaatgttttttatgtttttagatggttgcaaaaagttaaatgagaaatcaacattttgtgaagcaaaaatgatatgaaatttgaattttagcatccataaacaaactttggttgaaatacagtcacactaataggtttacatattgtgtacagttgcttttgcactacaagggcagagtggaggagttgtggcagagaccatatggcccacaaaacctatttactactagccctaaacagagaaagtttgtcaacttctggtttagaggaaagagacactagctattagaactaggtagggagtcactttcgttcaatgtcatgatgaaggaagtgagacatctaccttacttttctgtaccctttcatattttatttgaccccagcggccctgtgcaggaagagatgggaagggcaggtttcatcatttccccttttgtagctggagaagctgaggctcagaccaacctggagacttgttcactgttgatggctaattatggcagcactgtattccagctcattctgagtccttgccaccccacagggccaagaatggagagatgtcggtgcaacagtactatggtctgaatgtggttcatccccacaaaattcatgttgacatttaatccccaatgtggcagtattgggaggtgcatgggtcatggggggtgaatctcttatgaacagatgaatgtcctcctgcagtgatgaatgagttctcactcttgcaaggatggaatagtttcctagacagtggattgttaaaaagaatctggcttccttggtttttctctcctttcctctttcaccatgttatctcttcgcacacactcgctgtctttccactttccactatgagtggaagcagcatgagacccttaccagatgcagctgcctggtcttaaactctccagccaccagaattgtgagccaaataaacttcttttctttgtaagttacccagcctcaggtactctgttatagcaacactgaatggactaagacaaacagtaacacacacacacacacacacacacacacacacacagacatcccaagtaggatgaaggcatcataaacaagagagtcaagatggggcagtggggatgggaagctactgctgggcccagaggacagaatagactccaggaccagcaactgtctgggcccattcctgtgcctagacctgaggcaaatcccctttgtcctgttttgtagccactgaggaacctctgagaacctcaaagtccaatctgcaatataagttctctcctgatgtggttatgaagagtaaattaggtcattatgagaagtaaatgagttagctgtgtacagtacttagcgcaatgcctgacactttgtaacttgtttttagtcactggatggggaatctgctgagcttttaaaaaaggaatttatgtgtactttgatagctagcctgccataaagaacacaatcatacctgaacataagattaggttaagctttcatatgacctaatactatggaaacatttcatctgtagaacaaattctagctcctttaggagagaactcttccaggtactagctcagggaaaaatgattcttatattttcaagttatttggaagggaagtgggcgtagaaactattttcacatctgggaagaaataatattaggttaaaatttagaattaagtaatttaactaaacatccagaactctagaggctaagagacagcagctaggaagaggggcaggaagagtgaaggacaggaaagaatcgtgaggaaccagctcagcaaggaggttgtggcccagtgacttgacacggtccccacaacccaagaaagccacagatctaagaacaaatctattcttcttactccactttcccttttccacactaatgtaatttcttcttttggaaacaaaatgtctactcaaaaataaagtttctctctgtgattactgcatcatttgtccataccaccaaatatccaaatatgctaacaattcaaaaaacgaaaaaacaacttttgacatgaaattatttcatactataagaaaataaacactcttctgataaatgtaatacaatacagcagtgttttctaaactgcatattagggttcaccaatgcagagattacttcagtgggttggcaaacatacagaacagaagagaataggataggaagcatcagggtggattacacataataaaggacaagtattgttgagtgaaacttgtttcagtgatgtatgtgtgtgtgtatatgtgtttacacacattcatctatgttgctagcctatcatctaaattgtgttctcaccaggaatcatggccaaaagtgtgtaaaagccactgcaacagaatgcaacccactttagtaaagtccagtataaaagtccaaattcactgaatagccaatgtagggggtaattattcttgttaagtggaatttccttaaatgactctaagctcgtcctctgcttttaaaatatgctacaatttacaagaaaaaggaatttatacatactttggcaattatccttctttaaaataaagtgtgcctgttaataaatgcagaattgatctcgagatacaaaatttatcaatagtcagaaacataacgattacattatttggaatggtggccaattaattccattaggaaataaatcattgctgtatttgctgtatttttcatacaaattgtatgctaattaatccacatggaacagaagaggaggctgaaaaggaaacttagtgtgtagggattggttttgccaccataccttgacaacctcctgtgatcactttacatatacaaaaagatgagattctgtcctccaaaatgtgtatttcagaaaagagaaagttgccttatgtataaatgcttacaaagtctcccatattgtggggtattctcttaattaccttcttctgaatgccaaaaaccctgttacctccaagataacagaaattgaaagccatgtaattcactaatgctggatgtgacggcaactgattttaaagagagaaaccatgaaaaaacatattacctggtaagactgcagatttcatgaaaaggagttgtgtgtttcagaggttacttaagaactatttggagaagatagccggaaataaactcaatcaacacaagatagggatacttctgaaggctatgcaattgaaagaagataaatgactgaatgaatacagagtaaaggaggccatgattttaacaccaattgaagtaaatattcctgggaaggagctttacaattgcttgtcttggatgtctttacacaagacatacagaagtgctgggttgcagagatcataaatatactcctttaggaagaaaggataaaacaaacgttcttacattaagtgaatgagcacacagggtttggaataaagtttgtggtggtagcatcatacagaaactcaagaagtactatatctcaaaaaagttagatagaaatgaacatgacaaaagtggcctaatcatgacaaagactctaaagtcaaaaaagtatgtgaagtatttgaataaatgatttcataaaatgtgagaatggaaggatgtcatatttctaaattaataattttatataatgtgacttcaattatatgaaagtaaactaataaattaaacataagtagatacttcactctttgcctatattcctagaatatgcatattcaagttgacataaagtctttttataaacgctcttgttggaaaactgagggccaccctataacagagcgtatcttacacatgagcatatatagtactctgcacctcagataactgagggtggccaatagttggcttgtgagtgaacagaactgcaggcagttgtcacaatacattaaaatccctaaattaaaataactgccatcaaaccaattattatctgttaaaaattctttatgatacctctgtgctgtgttaaacaggggtcccatgtccacttctgagttcagctatagctgtatcgacagtctccaaatacactgacagtttcccacttccacctggctctgcctctctgcttctctgctcaagagctttctttggtgtctctggagcttgctcaggctaatcttagcagccctaaagtactgaagatttaatatccctagggaaatggtggataaagaccccactttctccactgcttggtggacaatcctaatgtgcagtctatataatgccagcagagccaagcctcagctgcccaccgtggtaacctgctcattaactcacctcttaatgggctttcttccctctcctgtgtcattttctccattctctcacttgtgcttcttgaggttgtctctcagataaactattctgaactcaagtcctcatctcagggtctgcatgcataaactgctttagcatcctatggcaattctgtgtcctgtttgaaaaacagctacctatctgcagaaatcaaggtaaacgagctttaccctcattctttacacctgagttacttaaatctttggaaatttctcatcaattcctctccgtaagtatttgataaacccttactaatgcagagagtcagtctgtgttatagagtatacccagatgaacaaaacaaagttctagcctcaaggatcttatacttgagaatggaacatgaaacaaggaagaagaaaagagagcaatatttaaagaagattcaggacacagaagagatgtaagttccaaggagcagaactacttccagctgactagtatttcatcactacccagacagaatcacgctttgttttctgatgtgatctcggctcactgcaacctctgcctcccaggttcaagcaattctcctgcctcagcctcccaaatagctgggactacaagcatgcgccaccatgcccggctaattcttgtatttttagtagagacagcatttcgccatgttggccaggctgctctcgaactcctgacctcaagtgatctgcctgcctcagcctcccaaagtgctgggattacaggcatgattgttttctaacttaaatacatttgattgaggatattcatctttatataaacccagtactgattcataggtcagcccaaatacagtagatggtaatacagccttatgggcaaacaattgaaaatgaaaggcaaagcattttattgtgaattccctaagtgactgctccaggtaaaccaaggaaaccaataaggtttccctgctgtcccttgaggatgccaaacatgttcttatccagccttttcatttttgatatcctctctgcctagaagacccttcccccaaatatctgcagggctcactacttcacatctttcagctctttctgcttaaggtcttccctgaccatactatataaactaatgtcaccccccacccacccactatcatcagtccattgctctctctcttttattcttcgtcatagcacttaccacctggcatattatgtaattacttatttatttatttttaatctccttccactaaaagttctgtgatattaaggacatgcctccccccaccccatattccttgcacctagaatagtttctggcccagagaaagtgttcaatgagtgtatgttgaaggaatgaataaatttcatcattaaaacctcaaaatcaccactcattacagttgaagttccataaactcacctggaatcatgacataatcccataactcaaggatctaaagggttcacaatcattttgtgaaaaatgtggggtttttaaaaataaagcttcaatgtatatatcaggtatgaataaatagttttaatgctatcataaacttgcacaggccataaaaggcaactcattcgatgtccattgtgtaagaatgaaatcctgaaatttaaaattttagatactgttgctagcttacttaaaaaaagtttattcatgtattcatgtgacaaatgtatattgaatgcatatgatgggtatggtattgggcgaggtgctatatttgatttttcttttgaaaactgactttacatgtacgtcactgtaaaaccatattctaccattacagatagaaaaagctcatcctttaaaaaaacacttacatttttccccattgttttactataaacttcttaaaatttagctcagatctctgagagagaatatttacaggaaatacaagtggagtcttttatttggataattttaaaggtaaacattctcctctttttactgcatttaagggaatgaagaaccactgtatttagtgagattaaatgctcactatacaaaaattacttaagtagttgtcaaactccaattatatagcgttaattggtttcactacaaattcctgcttttcaaacacatgaggtcctcatggttgggtaatgatcttttattcactcctaattgactcactgctctgtttccacaatgcccacaagtctttgtcattctactcctggcttcaacctgcccacctctctttgacctcacttaaaagactgtggccaaattcctttctttccacctcaaaattcctatgcttctgtctcaaaagaatccttcctttgctttcatctagtatcctcccatcttcttgaagacttaattccctcaattgagcctctcccttacattttcaatctctttttccctcaatggattgttctcctcagcttataaagcaggctcaagtcttcctatactaaaaataccactttccctctactacaccattgttgtgatatatcatactctctctccttctcttttatctcccaacttattgaaaatgaagtctgttttcactgctttccatttcccttcccccacgcctcccttcaacccttgcccctggctgccacttccacctaccacaaagacaatcaaggaaatccaagagtcaaatccaatggctttgccttggttgcaccgtcacccatggggtgtgctgtgtgagtgacaggggctctcctcaccccttccagcttccatgacactgtaccacttcacttccatcatttttctccaattgccccttgtttaacgtggttcctgtcctcttctttctctttcccctccaacatacagacatccctcaaggatcctatccttacttttgcttcttctttcttcattttctttatcagtgattcctgggatatgaaaatcgctcctaagcagatgacctacaaatctcctggtagctctaacctccctctgtattctagtcccttaacttggacaagcctgtcatgctcaaaaagaaacttctctcctcttccttatcctctgttatatcttctttctgaaaatgacccaactgctctctcagctaagcctgacaatgatcttttggcctcccttttcccttcctcactttccagtgactgttcaagctcctcagataattcccgcacaccacctcttaggtgtgttcccttcttgcctcccactgcctctttccatctttcccctactttgacaatagagtctatctggtctccctcctgccagccttttcccatgtcattccatccaacataatactacaaaagtattgccccaaagcacagttctgatactgtcaatctttctcctcacaaatcttctatagttccccagtccttactgaacaaaatccacactccttagcttggcgtacaagttgctccaccaccttgaacaaacctctctttcttgctttatccctcattacatctcttggcattcctagcgcttcagccaaagcacaccatttttttgtttcctgtgtaggcatacaccttccactgccaggcctgtgctacactgttcctcccccaagcatgcccttccttctctgccaacccaaatgccaccttaatcacagctcaaatgctatatcccatgtaaccttccctaattcttccatcagaagtcactttgtaccctgtgaactcccacagctctgcaggaatactgctttttcagcacttaatcatttttcactatttttacagttagtaacatatttcctcttttctccttctagatcatgatccacctctggccaggatctaagacttagcattctttgaacctccaacccttctcaacattccctgtcccctatccaaaggtacagtggatctgagatgcgggaggcaattaacaaatgtttgcaaattaattattgtaacccagagagttaacttcagattttacggcttgaaattctctcaattttagcaacaattacttcttctttctaggataaaagtcctatctccccaaggtactacagttaattccttttggccccagaggtcaattttcaaatatctcttacccctaagtcttccgaaacaaacaaacacaataacaacaaaacaaaacaaaacaacaacaacaaaaaaccttaagaggctcaataatggaagagaaaagcactgatgctactttaagtgaaggaaaggcatccatgcacaaaaaatggcttgctgcaggccacagcaaaaggtaccaccatttattagagctgtctcattaaccttataccagtccgatctttagaaaagccagatattgcatttttaaaactatcagcctgggcagcatagcgagactctatctctgaaaaaaataaacaaatatctgggtgtggtgccatgtgcctattgtcccagctactcaggaggctgaggcaggaggattgcttgagctaggagtttgaggctgcagtgagctatgatcacactactgcactccagcctgggcgacagaggaagatcctgtctcaaaaagacaaataaaaataaaaatgatcacatttacattagaaaagaactgattcctgagtcatcgattttgctgctgtgtaattcctctttctctaaacagggtatttacctggtaattcctcatattattaaactttcttgtgagacatttacatccctggtcttacttgcaaatataaaggatgatgacttttttttaaaccaaaatctcttagaatggcttttaaattccctaagtacttttctcagaaagacatttggcataacaaataagagagtaaagaactaagattcaaaattcatttttataaatctatccttaaatcttggatgacagccaacaaccaacctcacattaaaatcttagaaggcttgacttgaagaacatggggaaatttactttacatagacagcttcaagagcaccttgtctatatatcattaaataagatacatgggaagaaaaaaaagcatatgtggatagccctagttttattattttcacaacgatatcatgcaatctttgcccataaaagaaagcaaaacaaaaattttaaaaaagaaaaataaatctctggtgccaacatgttgtatatttacttgtgtagccatgactgctacgggcttttcgaagagaaccgggcagccagtttggattccgacaatgcagtagaatttaaggtgttatgactaaaacatgtcctaagcagattaagctagtcatacaacattttaataaagaagtgtcgagatattaagtgtaaagtgcactcattcctatgaataccgcaggagaaacataggtgagggggaatcacactgccctggatacacatgaatatgccatctccctgcctacctctacccaaccctacctacacacacctatctttaccacgcagagacaattaaacagccatagactctggatgcatttctgtgtccttgttcccactgggtgagttgttgccagcctgacatttttccaaattccctactagtgggctctatcaggtaggaaagcagggactttactgacctgggaccccatcgctgtgggtctcaggagatttcagtttccaaatgatacacggcaccacctagctattgtgacagctgggagagtggatgtcaccagcagtagaaataaagtatcctgtttcctgaggaaaacgccctggctgtgtgatgctgaccaagtgggcaccaaacatttctccgtgtgatatttttcttctttttaaaagaccgccccccgccccaccgcatctctctatacgtatacacctccagagttcattctaaaagaaccaacacaaagaccatccatcctctagccataaggttttcagtgcttaaatgtggaaggagaaggtctagctagcattgaaagttgtggggacaggaagaggaatctgatcattcaacatccttctccttctggtcagacaagagaaaaacaatagaaactgcacagtcagggagtacaagacccttatggaacaggtgctaaggagagaagtagtatcacaggatggaaggccccttcaaaaccaggtacattagcaagcccagaatgtgtaacggttatcctatttccctgccatgtgcctcaaagcaacatgctcacttccacatccccatgtcatgaggccagaggaaggggaagcgagaatccctacactgggccatccacacgcaggagcagaacagacactgtgctcagagttgcagggtcaaaataacaaacactgtcccacagtcttagccggtgacatcaagtaagggcagcggcagatctctggatttggggcgcagtttggggaacgtggatgcaaccacacgcgtacacacacatatacaggattttacaaaccggcccctatcccactgcctccctccacacttcacacaccaagtgcatcctgcccacctcaccgtttccatcatcacattctttctccaggagagtcagccgagagatgagggggtcctagcggggattcctggaaatgtcaccccccaacacctccgtccgccaccccatcccctctgctgtaccttttacacacacactctcacacactcactcctgccatgactgtcatcaggcccgcctgctgcgcccgaagcccggcatctcagcgggcaccggaccccaggcgtctcgctcgcaacgccgccttcccccgcctcgctagctgatggttccaggcactgcctcctggatgtcgcctgctgcctccgctcctccgcactattgttccaggcagcccctctcgcgtccgggggcgccctttggcgaggacccgggctccgtcgggggccgcatcagcgccgggcaccccttctcacccacccctccctggctgtggtaccttgcctgacagctgggtccgcgggcccgcgggagcaggcggcgctagtgacagcgctggtgccaagcctgggaataaagctccgctccagccgctgctgcctccagcgccaccatcttctcccgccgcagctgccgccgccgccgccgccgccgggaccgcagccgccctcgcccagctccggctccgcagccgctgctcggaccc

SEQ ID NO: 917 - DNA, 774653 bp, Homo sapiens
ttatttttcaatattttttcttttattgataaaaactacacaaaagctaattgataattaatttaaaaagcaatgttacacattatcttgtgtttagaaatttgtcagcttggcagtttcattcattgagcccatggtcatatctctcttatagccttagtccacatgagaatgattctgctggtcttctcattcggagatcttcatggctctctcaggcatcctacacagtgagggctgccaatgggacaaaacaaaattccttctatcatgtaccatatatggcatttgtcatgaagggtcattcacccagacttattgggttttccagtagttttgtcaaactttgtggtcaactttctccgtggtccgtggtaaagcacattttcttttggtacaacataagctttaatgctcatgttttgtattagaaacttgaccaggaaagaaaaaaattaaaacaaacaaaacaagaacaaacagcatttttaaagaaaaaataaatgaaagcaatttaaataaaatctgtgagaattacacacacctaaagaggaaaacggttgtttccctagcttcccacccacccctgtttatttgctcccctgtggttctccagcccaggaaccatgcagtgtagaaaaatcaaatatacaaacaaacctatatgtagctagggtgaaatctatttttataagaacttgacactcttactatttacatccgggagcatttttgtttgttttatgttttaaagcaaagaaagttctgcagtcctcccggtaatgctgcaggtgcattcgctgccctcttcaagcagtttttttttctctttttcttttctctatgccataaatgttttaacaggaacgatgagcttgctcgattgcgcgattgtggacacccattctcctttaagatgaaggccctccctcccccccatggagctccccagtgaggagttggcttcagcgttagtttgcaattctctctaggtagatggccggtgctgccgacctggcgatggtggcgatgaagctgtggtctcggcccagctccaggccggggctttcgtcctgctctggagacactgtctcatagcccttggtgacatggagtggctggtgggcctggcagtacccgatcacaggctggtcatagctgtaatatggcaagggcttcatgtggtgtggcatctggatatgagaaatagaaagatgggtggattataaaattgctttggaaagataggacagcactcatcaggttgtatttttgttctctttcatgctgtttcaagtcatcagctacaaattcaactacaaataaacattaacaaaatgatgattactatttaactcaatattgttttgtcagcatattatgtgtatagactttgtacataaaacagtatctttcaacttttcattgctctagctagctagctagccattgcaataacagaaagttagaaacaacctaaatgcccagggaattttaaaattgattatgtagatcctacatttgaatgtagatcttaacaatataggggaggatctatctgttgtaatacggcaagatatggtactaagtagaaaaataattaaggtgcaaaagaatgtatggtatgatctgttttgtgtaaataaatatatttacacttttatttatatatataaacatatatgtaactttttatttgatacctatacacaattgaaatctttactatcatcatgtgtaacttttatttagttttaaaaaataatcacaatttcctatagattaattctaacactctatcacatatcaatactggaccaaagaactctggaatcatgggagaaggcacatctttatgttcataatatgtaatgttattattggttttcaaggtaacaagccaaatatgtgtctaatgttagcgtaacagacctgaataatggtctgcagaaattcatttaatataaaaagcagaaaatatcagttataataattttgaattttggtggagcttttaattaagccataaatttctgataaagataaatatattccaaatttaggaaaaagcaaatgatacttgcttacttgttgttctcatgctagaatatttctcatacttgcgagttacaatttgacactcttgatgaacaatccacagatgagaaaagtgcaaaggctccattgccctgtaaggttagatgttgtggcaggttttaaactattgactctcagctctaagttcccttctgtggttgcttttaggatgctgaggtttggactttgcaaaccacatatctgttttatttgtggtttcctgttaggctttgccaatggagggagatggcaagacttggcagggagagggaattgctcccattgttggtttcctgttttgtttcttcctcctccaggaatttatcctaatggcatgtcttcattctggctatatcaatttattcccacagcagcaggtgctgcctctttgtagtatttccaacatttgcagtatatccaacatttgatctcatcaagccctcctcagagacaccagcactagcaccagagagatttgaggttcatcaccacaaagcttctcctccaagcttttaagtcttaatgatcttcctttcgttccctcagccctgtaagttgtaggggtggtagctacttcctaacattgctgtttctgtgataccacagcaatatcttagcctttgcataaacttggttaataactctatatccagttagcattctttctaaaatttctttcttaaaataactgatattttgtcagtctcccgactggactatgtttgaatccttctgtatctaaaagtgcagaaattaagttgttttgattttataatttactagagttaaccaccagaggtcttatggctccctatactgcagggagttaaccagtcttaaatataattcagcaaacttatttttagatgtcattcgtctgtttactatgcaagttcctcaaatgctcttaaaactagctctagtattttcttgctggtatttttattaatgtgattaatacaacgttgacacaaattccctctctattcttatgagaattatgtttttaacacctctctgcttattaaggggaaagtcacctcctcacagtttttaagtcttagattaaagcaatgttttctatgcgcaaatgcaactcattagtaggttatgaaatcaattttgtgaatccaaataagcatttaaaaaattaaattagctagaatagaaagtatcagagtataaagataagttgttcataagagttttgttttaaatttatgtatgtgcatatcaatgtgtgtactgggacacattttgaagtttgaaaattgggaatcatggtagaccatgtttttgaaaaaatacttgatcaaagcacatattcagattacaatttattttacagtgactggcaatagcctagataaattcccattctgtttttactattcacttctattaacttgtataattcactgtttttcacaatgagttggaaaattaaatcaatatgtaatgctttgtttctgatttgttgttgttttacctctaaaggaaggtaaaaactattttcaggaagtcttttacaaaatagtaacaagagtatttctcatcaaacaagctattgataaaatcttgaatatgccattctattctgtaaaaaggagaattgcaaaaaatacatactaggtcagagttgtgattgatagtgatattttaaaaattggaccttaatttctgtgctgacagagagagctaggaacagactgtaaagtgacatggccgaattactagatactaaataaaagttagctctaatctccctcaccccaagtctattgttttgttttgtttttattatatcttattcaatgagacctctttcaatcagtacaggttcagacgtaaaatgtttgccagcgggacctattttaggaaacctcataggatttttcagggtgtcagattcctggagatatgtgggattggtgccatgggtcacttatactccaagaaagcatcgaaatgtaagaagacactttgtgctgacatttcagtgggaagaatgctttcaaaagggatttcctaagagtaatacagcccattcgtactctcttgttaactggtgaagtaacataatttgaaaatcacataaaaattcagcaaattatttccaaatggaaacaacattcactgattatagaacatttattctacactttaacttaaatacatgactaattttctacaaattagccaaattactaaaagacatcaacatgaacattaaacatgggttgtggttttgttcaccgtcttgtagctctgtcaatggtcttcacaaagaagagatacttgaattcacaaacatgtatagaacagtgaatgtgagatgaaatcagggccttagggatctttttgcacaaccaggtgaatctacagatgaaaataagtagctcataagtgaacattgttgaatttgcaatgtttacttaaagccttttaatttaaactatagtgggagataacaatttcatagctaagaaatcatggtatttgtctttgaattaagttgacttaaaagtcaagggacctgcattaactgcaaagctttacgtttacatattacaccatttctgaactgagaaaatttgttttgctattacaattgcagtttatttttttacagcacttaaaagagggctcatgtcattttctctattgtaattgaggcaggcttaaaacctcttggagagtaaaaaccattgtaaagttccctcctgcacagcagaccaatagcaagaattcaaaagccaagtgcattggcaagctttgaaagagtatctgaaatatttgctcttttactcttcaagtgtattctatagggcactatgtaatcaactgaattcgtggtttctgaggagctcagaggctgaggtcttgtactttacagtaatagtgtacagtacattaaccacctgggtccctgtgtgtgtcattgtttcctttccagtagtcaaaacaaagtattcttaagttttgcttaattcagatttggtatttttgtaaatgtgttctcagagcctctccaaatggttctgtgttccatcagctctctgatgagctccactctatagcacagcagaacaacactatttaaagatgtcctcgttagaacacttgactgctcattgactgcattggaagctgcactttatttacagataatggatgtggagcacagaatttaaaaatcacatagagaaatatattctactattctgaaattctgctgtttgctactctgaagtatatgagcactttaacataaatcacattaaattgttctttcattcagggatagtttaaatctgaagtaggttgtgaaagggaggaaccattatgactaattataagtcactttaatcctcttgagtttcaagtaactcctctgaaaatagggataataatgacaactcattgacctctataaatttcagaagatgctgaaagtattccctgatactgaacaaagaaggaatacactgaagggccatagtcacactctggttttactcaacactgacagtgtctttcttgaaaggtgacatgtcttttgtcttacagtttccatttagagagatgctagcacatgatggctcatagattggctcattaacaagcccttcagtcctattttctgtgctaagaagctaagaaacttttgtgtatgttctggttttctaaaaacatcatttattgttcagctcgagtatttttttcttcaaatacaatgaagaagttaaaagtgacacatttttttcaattataggggttcatagtgttagtaattcaaaaagagaagttagggagagagcgtatttttcaatgttgggaggcagggtaattatagaggactatgtggagtttcacaatctgaaaattgattcaaatcccataattctaaatctaccataattatatttaaagtgagaaatgaacatgtctgtatagtaaatgtgagagcaatgtgaaatggactcttgatatatatgattgtgaaaggcttttgaagttcagttttgttatgagcatgaaattccgatattgtgaccctcttttctcaaaggtattagcattagttgtaagtcgcttaagagtcggatcattttaaaattaccatggactatcattggtcttatttgttaacttttcacgaacattgttcacatttcagcatgagttctttcaattgaagtcataaaaagttgattttcaattttctaaatgacatttcatctctaattttcagaattaaaggatagtgtctaactactcagggcatttaaaaagtaccactatataaatccagataaagaattcaatgcagttgaattgcttaatgaagatagacacttcacttattgaaagtaaaattaattttaaaatgaatgtccatagctaaatgaatatataacttagctgttattctactggctatattagtatgtgacaagaatggacaaggaataagtacatgtaaacaagtttgggtactggtttttttcaagaacttttattaaactgatagaacctcaactcatttaacttagacaaaagggaaatttaattggctcatagaatacaagaaaggatataatggctaaactaaaggatgagcaaagatagcactgagtattaggaacaactgaacctaggaacacaatgtcatcagcatcctctcagggtcctgtcaatcaaacatgcctgatagtttcagcatgttatcttcatatcctggctgccaaatggcttcctgcacctgacagacatgtaagtgtgaaagctcccaagttttacgtattccacttatggtagattacattatggctacagttatttctagcacccctcaccaataggtgaggtgtctacttccctttgcctagaatacaggctggccttgtaacttctcttgaccactataacacagtgacagtgacattatgtgagttccaggagcctaacctatctagccattgccctgtgaacgtgcttagattattttgccagaggatggaggctatgtggaatgactggcatcttagaccagccagtctctgcagcactcacgggagctcatcacaagcacatgtgcacaacagcaaagtccgcaaaagaccctagatatgtagaattgctcagctaagcctagctcatattgccaacctccacagactcaaatatatgttttctgttgttagccaatcagctttggtgtgatttgttatacagtaaaaccagtagagcagcttccattaccaaaaaggactatatcatgtggtccctggtaccactttcattaatacatgaaaagatcttgattattttatcttagtagtctatccctgaccattttactatacttacaatgttcaatatttatatagattaagttgaatcaacttctcagttctggtcatggggaggaagttttgcaaagataagacagctcccagacaactaaaaattgattattctgatgactagaaaacttattttacaacactattttgagaaagtaccttaagctcaaaagttaactgttctgtattaagatggaaatttgagtcctgatctgtgattactaactccaatttcccatcccaatgttttgtaaaatgaagtgtttttagttttttcgtgtttcttttttcatcaccaaaccaaaactcttagaaacttctgcaagacagagaggacaatatactaaacaaaaaatgttctagcatatcgttcgatgcagctatagaaaaaactggagaaaaattatttgcaaaactatgaatctctcactagcatggtgtatccagggctggtaaagaaggagaaaaatgcagagttttgagcagttccctgaacctgtgtaaaatgagagagagcactggagttataggaagaaaaggagcctcagccttactcacagggttcacgttatagaatattaaggaaagcaagggcatatctgaacccagaaactcacattctatttgtaaactaaaattaaactaagccctccaaactgactgaacagaccttcttttggcccaggggacctagaaaaaaactgagttcctggccatggcaaaacaggaggtcagacatgcctcattatacccactccctggggaagtttaaacacaattgaccagcattaatgttaaaaaagctatcataagactgaaagagcagatgctttgtggcaataagataccaaattataggcaagacctaaggccatgccaggcaaggattaagtcatgcacccctacagatcattttgacccagtatgctgtggtttgctctcacagcctgactctagcacagtatcacatgataattggtagacttctttatcttaacttaaacattcctttttatgaacttcaagtttttagacatagctttgttccttcaatcatttgcaaattaaagaatctctgaatccatctatgacctgtaagccctggcttccgtatattctgacttttttgggccaaaccaatgaatgacctccatgtattgattcatgagtttgcctgtaacgtttgcttccctaaattgtataaaacagagttgcattctgactgcctagtgaccacttactcaaggcttcttgggtttatcttttctccaggctgtgctctctcatattgaattagaataaacctctttgaacaatttaaaagagtttgatttgttctatcatcatatttaaagaaggtaattcttcaagtgacttcctaaaacaaaatctctctccctactgttttatttcttgttcatctgccttcacctgtagcagttttttctttccccaatgtcatagtcaactggttcattcatcaaaccaaacctctctttaaatggaggcccatgcaatctctgagctcctaatatttgatatacacaaaaatctccctccctaaagagaagctataatagagaaaaatctgcagaaataagaaaaattccagaattcgaaagaagacgaggaaggcaagatttactaaaaatgaatgaaaatagaaacaatttaaaatgtattctcattgaactccctcatctaaaacgttgctcagatacttagatatttgctgaatgaaagaacaataatcataccctttctttattttgttttgaagatggaataaataataaatctaaaaaataatctaatttatggaataattcattaaatttattaacatttattttagaaaatcttaaaaggaaaacaagaagacagtggtgcaaattgatgcctcatttccatttcttttcttatgggctaaaatgtgtatagcagattgagcacgcaaaatgtacaatactcaacacactagatgttggctttttacactgattggactattgggacaattttaaactttcattttgacaaaaatttctctatagcatttgtttgtcttgtcctgttgttatttagaggtgggaacatgtactatttgtgtactcaacagttatccaaattttaacttttaagtcagtcaggggataagagaacaaagatccatttccatctttattgctctcctaccaggatttgttgtctatgaggtgcccagagagttgattaagttaatgaatgaggtactagccatctttgaagttagctttgactccattaactgggaagcttattacattagcagcactcgcagtattcagtgaggttttaggctaatgagctggattaattagctggtattaatttctaaaggctttccttcggtagctctggcctctaaattagaacgagtaaagtctccccaatagtgcattgtaagcaaacaacctgtttaagtgaatctacataaatttgcctccaaagtacttactacaaaatagagatgatagaatttccaatcacataactttctcctttgtgaaaaaaataattgtagaagttttaatgacatacagaagacaagtttctcctaaaacggaaaacagtgattattacttgggcacaaattccctccaggaaaattaaaaccatgcaaaagtaaacaaacagaaacaaatcctatcagcctatacaacaggatcaatttaagatatgtttgttttaatcccttctcagaaatttgaaaaaggaaatgaaagcaggaatgccagtactaagaaggtgtaatcggcattacagagttttccattcaagttcacttgcagtttctccaatatttagagtagcctatttcagtttccatatgaatttgtgtagtcttcaatttggatctatataaaaccatttctagtgcccttaacttgttttacttaagaacatgcatcttgcctgagaaggatgcaactgatttgcttgccttttgcagattttgaacatatattcacttcgtgaccctcccaatgcctccaatctgacagtacagtgggcattcagtaaaacccaggaaattagttaacaaatgtaaaagtgaaatgaaattcacatgtaagtgaagtgattgaatttctttctatcctgtacctctgtaaagcagaattgcatatcccatggtaaaagtttagaacctacagactgacacagaaggaagaaaactgcagaggacatacacatgcttgatacagtgaaatgattaccatgagtctaatagagtacaaatgtaacttcttggaagactggctggtcttcatgaaaagaggcattgagatgtatttttaattacaaaaaggggagaagcccatttagaaaatgcaattaaaatttttattctgattgaatatattttggaacaacatggcagaatgactcacaaataatactggtctcatattttaaataaaatgtgtaaaggtctaggttaatacctggatccctgccatagagtgtatgctattaaggagtaattatatgaaagtgaatttgccataatagttcatttatttatgtattcatttcattattcacatggtaaatatttatcacagaggttggcaaacgttttctataaagggtcaatagtaaacattttagacttgcaacccatacagtctctaccataactactgcagtctgtaacaaccactcaagtctgcctttatcatgagagaataggcttgaacaaaacataaatgaatgaacatgactgtttccataaaactttacaaacagtgacttgggatttcatttaatcttcatgtgttaaaaaatatttattttcatttgatttttttgtttctaaccattaaaaaaactaaaatcatttaggttgtgggccaattttctgagagttaggccttgtgctaggagctgggtatataaagaagaataaagtaagggtgctgtactcaaggagtttattaagaactgacagaatgagacaaacctaattccacttccctgtggtttagactgcataatacaaatcagtaaagccgaggtagaaaagcactcccagctggcaggcactgcagatttcactgtgaagatccaggtcttctctagaataaagctctcagtgcatcccagacaatgagctggactcacgtaaccttggtacttggaagtcagacttgaaccttcagttgggagtgctgaagttactattcaggtcatttagatcaaacatgatctggcaggataaaagcccactgaccttttagagacgatcttacagggacactcttaagccagcaaacctgcccctgggtgtatgatggcttataactcaaggcctgggagaactttggtgattttgtaaaaggggtcaggttcacgagttatctaatcataaacaatgttttttttccagctattgtatatgtgtgtgtgtgtgtatgtagaagtcaaaaataagacttcgttgtatttctcaatttcaccaagccttttcctcctgtacttggacttttgtattcactattctctttgcctgggatctccttcccctccaaccccatttttctgcaatgggcttgagtttcagcgtaaatgtcatgcttctagaggggccttctctaaccacctgtttaaaatgtcaccccacgctgattcacatatgtaaaccatttcctgtttcaattccttgtttattttcttcatagcatttttttaaatgttaaatattcttaatgatgctcatgtttctcctttgctaatagtttaccccaaagtaagcttcacgatgtcagaaaacttctatgacaagtttgctgctgtgtgtagaatgcttcaataaatatgtgctataagaatgtatgaatttgagagatatttattagagaattgagttgtatttggaagaagtttacctctaaagctgtgagcgtctcactttccttttcctttctgtacgatctcccacccattcttactttcaaattaaaacaggacatctagaatcacaggccaccgttttcagtctacaaatatttgcatacctggcactgtgaggaaagctaaagatattagaatgactaaagctgtccataaccttaaggaacctgtagtctaatatggaatacaaagataagcagatttttgtaatgtaatttcatttgtggtgaaatgccatattggagatgtgtgaaaagtggcaaggaaggaaagaagagggaaggagatgactatcaggtggtttctgagccaaagaatgggtgcttatgaagtcagcaagagatagactgctggtacgtgtagcttccatatacagacagcacgtctgctactgctaccctggtagctggccacatatgtacaataaacagcctactacccaggttgtacacatcaaaaagctactcattgtcaaatctcggtgtatccaattcacccacaacttgcccttgtatagaatggaacacgcttgatcactttagccattatcctcaccttccagcccaacactgacttagcgttttgcaaaaaaaatcatctctaccttctaatgagcagtaaaaactaaccataggcctgggatgtgtaaggacaggtcatgaatttggctgctttctcagctgctgctgaaaaacaaaacaacccctgccaccccgattcagaagccaagaggagtcatttgagatttcttcagccatccgaaatgcctttagagcagtggttctcagtcctggctgcaactttgacaaatctgtagtgattttaaaaacacttgtctggtccctatcccagatcaattaaatcaaaatttctagggtatggcccaggccacactatgtttagaaagcatccctggtgattcaaatgtgcaacctaggttgacaacaccgcttaatgttaaatttaggttgcttttgcctaaagatgtaggcccagcagggcgtacacagtatgatttaactaattccctatgcctgccgggagattgcttgactcaaaacaaagcaggctgcttcccaatcaaaaaccaccaaatgcggtgcacacctgtgttttttgagcctccaactaaactttcttttttcttaagctcattaccactaattattctgtatcaccaatttgagcctcttcacttggccctatttatatccttgctggtgattaaactgctatcctcttagttaccatcaatttggttatgtatatattctattcttttgtctaaagttaggtgcaattcagttgggtaagtttaacagccatcattatacacatgttttctaaatagctacttgtaggtgaatttaccttgcagtgatggcaaagtgcccataaatgttcagtcagctggagaactcctttggccaaacactttcacaatctatttcttttctttttgtaagtaatttaatttactgagatggtagtaatagcccattccactttgcactatagggaagaaaggatatttttatctacttaaaagctaataaggactctcactgttgaaaaatattcaaacctcccaattatttccatcaagcgataaatttaaaggaaaagaaaaagaattaaaaccccaaagtgttagcaaataagcaataatgacaaggagacacttaggggaggatcattaaatttatctctgctttaaagcaacctgatgctcaaatattaatatgtagggggactacaaaaggatgtcctctgacactggaaataataagcattgtcacataattcatgaaattcgccatttgttgtagtaaatcataggaggagatgatctgtatgtgtgagactacagagaatagcttgcaaaagctgttctcaaatcgtccactcactcacccccaactacagccgctacccatgccaaagatcacagggcttatttacttggctctaactgttataccatgctccagtatgtaccctcatggtcacatgcttgcacttctccatcactacagagcattacctttacagactacctccattagctcctatttcagaatgaagctaaattgaatatccagattgtttgacatactccaggggagttagataaattcaccacgctgtactttgttatttttcctggccatcacccagaatataagctcttctgggcatctagacctcctccacaccatttctataatattatttttgtttttctttgccctaatcttttttctgcttttcctaccaaaaattctaccctcacctctcaaactctgatttcattactaactacccttcaccccaaactacttcaatgaatgtgtgtcgctttctctgctgtgtattatgatttaattttatgtggcttctatatggaaactcaaagtgccatttgtaaggacagcagataatttgtatttatcattctgaaaacatgaaaaggctccatgattgttttaactcatcatgcagcaaaactcattgatttagactaattaagtaggacaggtgtggtgactcatgcctgaattgctagcactttggaaggcctaggtgggaggattgcttgaggccaggaatttgagaccagcctgggcaacatggtgggaacatggctctacacaccacagtataactctttaatgaaagccataaattacatagcattttaaaaaacagtgtttatgtcatgtgaagcaggaagtttgtgtttaaataacataacatcaacaagctactagtgtcttttcacttctatccccttgatgggtagagtttatgtaatatgactgacggaaaagagagaactaactggttgtgcaagtagagtctcagaagattgaggagaataaaacaaatgatagaatggcattctcttcctttctatcgcctaggattgaggaggtaggaagtgatgaaaaggtttacaaaagattttgtgacacattgaacataaaaggtggcatatatttactagggaatttattctcccctattccaggaaaaaaaacagtgctctcataccctttgtctagttagtggcattaacactctttgcactgtggactgaatatttgtgtttctccaaaatttattttttaaagccttcatctcaaatgtggttgtatttggcaatggggcctctaaggaagtaattaaagttaaatgaggtcacaaggtgggttcctgatctgctagaattagtgtcttcatgaaaagaaataacagagagctctctctctgtacttggacaaaaacagtcatgtgagcacacagtctgtggtcacccacaacctaagagaagagttctcagagtgaaacctaccttaatagcaccttaatcttggacttccggcttccagaactgtaaggagcaaatttatgttgtttaagccacctagcctatgcagatgagttaggacgatccaaacatatgaatagagattttggtcctgtgaagtggagtgctgctccaagaaatagctaaaaatgtaggcatggttttggatctgggtcatgggtagaggccagaagagtttagaggtacatgctagaaaaatactaggttgtcatgaagagtttgttggtagaaatatagaagaagttaaagttaattctggtgcggaatcacaaataaagaagagggttagagggtattctgtacattgtagcatgtttagaaacaccccttgcctctacccactagatgtattatatatattctttttagagaagatataaacaatcataaacagaatggtggtagaggtatggatgataaaggtcattctggtcaggtctcagacagaagttaggagcagatgattggtcactggagtctttgtaaaaagaactcagttgaatgtgttgtagtgtttagaggaagaaaaattgttagtgatgaaactgaatatttagctaaggagatttctaagcaaaatattgcaagtgaatcctggattctcctgactgcctatagtaaaacaatgagatgcaagacatgaattgaagaagaaattattaatcagaaagaaaccagaacttaaagatttggagaattctcagcccatgcatattgcaaaaaagaaaaaaagagaaagcatgttctaaagagaacaataaggctgtgactggaccattacttgataaagtgattaagaattatataaactgaggcagggcgcagtggctcacgcctgtaatcccagtactttggaaggccaaggcgggcagatcacgtggtcaggagatcgagaccatcctggctaacacggtgaaaccctgtctctactaaaaatgcaaaaaattagctgggcgtggtggcgggcgcctatagtcccagctactccggaggctgaggcaggagactggcatgaacccgggaggcggagcttgcagtgagccgtgatagaactactacactccagcctgggcgacagagctagactcagtctcaaaacaaaacaaaaaaaacaaacaaaaaattatataaactgaaacactgccagtttgaactaagggagacagagaaagtgggaaagaatgaagaagactgctgaacttcttggatcccaccaggagaggactatagagctatccagctgccaatgtaagttttccttctagaaaagggaagaaaaaggaaggatgacccaaaggctcttcagagaccatctgggctgcccctcccaccataggtccaggggaaaagactgattgctccttggtttcaacaagccaggctgtttctgcctggagccttgggggcaggaccccagcctggaaaattgtggaagtggagctgtcgcctaaagtcatggatgtggagtcaccacccaagttggtccagaaaatggaccaccacccatgtaggactggaaagtcaggaattgagccaaaaaagattatttttgagacttaatatctaaaggagtttgccttgtagtggaattttttgggacccatcacaacttcctttctttcatttctctctgttagaataggtcgtctattctatgcatgtcacagcatgatactttggaagcacgtaatttgtgtagtttctcagttcacagctagagagaaattttgcatcaggatgaactatacacttccattctcacctatatctgatttaagtgatattatttgagagtttggagtttatacaggaaaaagttaatgttttgggggatgcttggatgaaataaatttattttgcatgcaaacagaacgtaaagttttggggaagaggagcagaatattatgtgtcctaaccctcagtatggctacatttggagatagggcctctaaggtagtaactaaggctaaatgaggtcataaagttggaaaactgatccactagaattagtgcccttaacaagatgagatgctagagagttctttttctccctttttctctttccccatgtgtacaaaggagaggtcatgtgagcacacttgagatcactactgtctactagccaaaataaggggcctcagaatgaagccttccttgctatcaccttaagcttggacttctggcctccaggactgtgaaataagcctctgttgtttaagccaacccatctgtggtatttcattctgagagcctgagcctgctaacataggcaccatcaccatggcctggtaaggctttgtatgaagatatgtggatgatgtcacaatgatggaggaaatgtagctgcagctgatgaagcattttgtgagaaagtattgttagttcttctgcaggtgtccaaaaacatttcttgaaagagagatgagtgaaattctgcaatttaataattgagtggtggctttagtggaatttatctaatttatagactctggactgagaggaagaccacaaggatcattatattagcttcctccagatactgggatctttctccagagaaagtacctctgaatttagggaagagcctacagaagcatgatcatttatcctttcttgaacatcttccttctttctccattacatagtacagatctttataacatttaaatgaggctggaactgggagggggttatacatgtggcgaattgttcctttcttgtgctaagttacatttaacatacaattgaaatccaaactggagccatttatatatatttaggctctatttctcatggtatccaactggggaccacggcattaatacattttcttaagatcctctaaggtgcagttctccttgtctttctatgttatcccaaaggaccacgactactgaaatggagtccaggcaactctaaattaatccatgtctttggattgcatattggctaaccttttaccccttcagttcttttaactgcccttctctgccctgcattgtgcccaaggaggcttgttctatgactagattccttcatcaagttctcttgctgtctggctgattcatttctgtaagtaagaggcacccagtgccaataggagaggtagtatttatttcttgctaatcattcctgccttgctacagttctgaagtaactggtttctgctacagcagtagttgtcaacctgtggcaattttcctcctagggaatttttagcagtgtctggagacatttttggttgtggagattgaggtctactggcatctagtgggtacaggcaaggggtgtttctaaacatgctacaatgtgcagaataccctgttacccccaaggaaaaaagaactatctgatctaaaatgtcaaaagtgcagctgctgagaaaccctaggctataaatatagatcttgctagatgagccctctagacaagccctccttcacagctacagctcctacctagatctgataaccctgcatcttcactttatctcttcaggcctagtggagtggtaagagattcctgttgtttctgtttgaatttttcaccaccctttgcagatcctccccttaacactactcctatttctacaaaattccctctattaaattctctttttattcaaagttttgagtgtgcagtatttctttctggcattctgactgacatgtaatttaggtgcacatgcagcaatttatatggacgtttaacatcatcttaatttgtgtattacattagaggtgaaatgacaaacttctttcatctgtactaattgctaacatttattgagtgatgtctctgtgtcacccatctttatgagtgctttatgtgaattgaaaactcatttagtgttcacagcaatgctataattcgggtagtaataggattcccatttaaaaaatggtaaaattgaggcacaggtgtgaaatgacttgcccaagatcacatactgaaagtggttcttaagacttgtgctcaaatactatctcgtgtagatactctgccttcagaaataaaccactctataatatctaaagctacagttggctgtagtttatcatccaagtgtgaatcacaaacagattttcagggtagcattcaaggcaagtcttgatggcaatccatgctcccactctgcatagcatttcattttctctttcttttacttctcttccttaacttctttcctcctgtcctgcttccctttttctcttcctttgttcttcttttatttttacatgcctcttcacatctactcttgcctatttttgcaaaatgcaggtttgtctctggcacctaaatgttaaaatggactgagttctgtcttttgagtcagaatgacacgcaaaccatcagcagcagaaagaatctataaaatattaattaagcctattcctgggatttaatgaaatgttaggcataaaatcatttaaacattaattttctaagtgccagtcccttgaaatgacaatataagccaatttcataagaaatttgtgacataattgattgattcttaaagactatactcaggaaacagaaaaagcaggttttaatttatgtgcatattatatagagatagaatcttttttaaaagacaaagtgatataatttatgtaaggcctttggtttgaaaatataaaatgttgctatttgaaagtaatagcttctcttctctaagaaattatgacaatagaggaaaagtatattggtttctttacatgcaacaattctaagaatggtaacttcttctatctatttttcacaacaaatacacacaacacttaatatcaaaagcttagtctggccaacactgtgataaattgatgcattggtggatgagtgaaattagattttttctttagaataaatattggcttttcattaggtcaatccagagtttaaagcatgcaaaagaactacccaggaagtgacggtttcttcaaagaggtataaatactctttctagagatacacaaattatccatgcttggggaaaacatttttttccccaatttctatggctaattgagagaaagcacaacataaatgtcctaaatttatatatggaaagagttaggactggaagtttatgattgtaaattcaaagagctcttctattttttcctcttataggtacaaatatatcctcaaaaattaggaaaataaaaaatcccttattatttatggcaactttctccaaatatctttcatgcagtacgagaacaaagatattctcactaggcattgcggagacttcactgaaattaggatctgattcctcctgcatgaaaccggtaaatatttctgaatgatttggagagattaattgcttttttcattatttgtaggctatagaatgtgctggggacatgctatattgaaattcacataaaactgacacaaagaaatgtcttttcttgatgtacacatcactctagttagtgttacaaagaggtttgaacaaagataccaaacgaagcatcttgtggcacagtttaagaaatgactcaactttctttgagggcctcctcataatcactaaatagttttaggaacagtggggctataaagaatgtatttcatttcatgaccataaaaagaggcaggtgaaggtcattaacatcttcataggactagaaggaacgttctgctcccttggtttcataaactgccaccactatttaaggaactcctatttacttagacttaatctaccctgaaaaacacacagaaaagtgatctctaatgattccactatgttcttattcccaatcacatgtaggactagaaaaatgtcctgataaataaaatgaagaaattaatttggaagatatttaaggcctgcttttgccttagtctgtgttttctgtgaacacaaacttctctattgggagtagttgacagtgataatataagctaagctgggaaaataattaaatgaatttcggatttgagacgtctctaaataaaagctcacttgcaactgaaaaaaaaacaaaaataataacgaaaacaataatatggttgttaaaatcctatgctaagtgtgtccaatgttctttatcacattggtccacctactgtaattcacctgacttaggattttattagaaatgcaaactctcatgtctgacgccaacatactgaattcgtatcggcattttaacaggaccccccagatgactcgtatttatattaaagtttgtgaagcactgctttacagatcagttgtttcacggaaattatctaccagaatggaaattgtatttttcataggaaaaatagaagccctatgtttctgccatgcctagataaaaaagtgcattataacaaaaaataatacctttttttcagaatgctgagaagtcacagcagcaatagcatcaactataaacttcttagaaatataaatcatttatccccatcccagacctactcgatcaaacctctgggcttgggcccaggaatctgtttgagcaggcctgacattattctgatgcatactgttgcttttagagtgggagatgaagactcaccagatgtagtcaatcagtctgaaagtcaattgactagttaccaaataaaagggaaatgtaagtttcaaaaaggggcttagatggaaaatggacttttttcatgaacaatgccaagttttaaaggattaataatataatacatgtgaaatagatcatggttgctatattttctgcaatgtcataaatccttgtctttcaaaactcatacaaaatattagctccttcggtaaactcatttcttaataacagtaactttttgctgttctgaactcccatctccatcatctgtattgaccatgtggtgatttttactttccaaaaattgttaccagggaccacagaggaactgctttctggagtagtgtaatgttctggagggtaaggtttgtgtcttgtacctatgtaacccccagccacctatatctgcaacacagttgatatcaaatatgtgttctctatttaaatgtttgttaatgttttaatttcgggatgaaaaggccagtatttttgcttgtttctttctggtttggaggtcattttaattctttttaaaagatgagtaactacctgtaaaatacattgagatctcttgattaaaagtaaaagctatgtaaaatacatctccttttacatattcagcattttttaaaaaccaccagcaaagtcacagaaggtcttctaccccccagtagtacaattgaaacatctgacataacataaaatatgtctccattttcatgcatttaaatttctaattgtttctcgatcccttggagagcttttctaggtcaactaagtactcacactgtgctacatgttccaagagttcaagttagccttttctctgtaatcctcaaaaaacagaatgctaccacatgctcctcatttatacaatcgttagaaaagatcctaagaataatttgattatttgactgtcaaatgcaagcccttacagttgtagatgtctgtttaatgatgttattcctagctccttaacatttaatatttgcctcttcttgtactttagtttctaatccagatttaatcctgaaaaaaactttttacaaggtaacgaattgttgaaaatacagtgacacaatcactgattcctcactttcaattcaaagaaatgattaaaggaagaaaaagatgaagggagagccacaggagttggaatcgctgtatcagctcttcggaaacagtatcaagtcccattcatgtcccatgaccttagagggtttcggtgagatttaatgcagcaggaatgagatagaagaaagaaaacaatggctgactcagaactactccatctgatttagataagattgaagcaaaatcccatgaaaatgaccttgtttgtaagaatgaggaatggaggtgaggtgggacagtagcaagggctccaggaggaacccctttaaccactgagctcccaccacttttttaagtagctgcctggaggagctgaggctgagcactgcctttgcttcgggctttggctaaaacacttgcctgaagcagcaagaagactgcgtgctgtacctcaaattcttgccaggtgaacagaaaaaaaaaaaaaaaagaaaaagaaaagaagaacatcagtttaagtctggcctggaaggcacatcaaaggcagaggtgaacctaaactgcaggcagaagatctttctcctcacatacccaagggactggtcccttcctttgcctctaatgctgtagaattcttgattcaacagccccttcaaccaacctcacatcctggaggactctaactctatgtgacgatgaggagtttgagggacacctacccaggtgatttttgaggaaagctgcagtccagcgtttctcttatcaaaaagagagggataataaaccaaaatagacatcaaaacatagggagtaggtatgacacaaatgccaagatttaagggaattatgtaagaatggtgttatggaccgaatgttgtatctccctaaatttctatgttgagatcgtaacacccaattcgatggtattaagaagtaagacctttgggaggtaattagatcataagagtggagctctcatcatgggaccagtgccattatcaaagaaacccggagagctctctgactctactcttttccaccaaatgcagacacattgagaagacggccatctatgaaccaagagggaggacatcagatcagccaccatttcgatcttgaacttcccaggctccagaaatgtgagaaataattttttttaattaaagccacccagtctagggtactttttgttatagcagcctgaacagactaagaaaaattaaatgggaaagaagtagtgataggcaaagagaataggaaactgagcaatgtctaaataaaagttggtagtctagtactaaaataatagaaaataaatgttgaaagggacaaatatgttttaaaaatcataacctagttgtaaaactgaacatgacagtctcaatttgaccaacctttggacagatattttttttggcctataagcccctgacctccatttaaaggggcattaacttagaaaacttacaatttgaatttctttctccactcctttgaggtacagtagtgcccacttattcacatttttcctttctagggattcagttactctcagtatagtacaataagacattttgagaaagagactgcagttgtataacttttattacggtctgttgttatagttgttttattttattagtaattattgttgttaatctcttattgtgactaatttataaattaaactttatcataggtatggaatatataggaaaaacatactatatatagagtttgggtctactaccatatcaccctgtatgcgcctgatctcatctgatctcaaaagctaagcagggtagggcctgtttagtacttggatgggagtctggtactatctatggtttcattcacgaattgaaggtcttgcatgtatcccccaaggataaggagtactattgtgtgccttttccctaactcttgccaattttacaaaccaggaatatctttctcaaggacctgggagacatctctttgaaatgtaatcatcaggaataatggcgcctctatcttccagtctctggggaatgataggagcctaatttccataagccccaagtagcaaacccagatggcctaatcacatttatcattctccaccataatggcctccagtagtttttcactagctcagtccagggcttacacacttttctgcctttgcttccagcaaagttctgtttaatttttctctcttattgcagtagtcttaaataaactctttcttgccatttaactttattcagtacaattcttctttgacaaaactcataacatttcagtgaaagctagtatattatgcagtatatatgtgaaaaagtaaaatcacacatttttcattatgatttcatatagtaaagtgatgtcatttatcattctagaagttgaatttaaagaaaaatgttaattttagataaagtgattcaaagcaaaggaacaactaaaaataaaaaataaataataaattattaaaattccccttaaattaatttaaaaataaatttaaaatttcctaagatgtaatctttacacagaaaaacacattaataaaatatataaaatcaaaaagattttaggaagaagtaaacaaatagaaatctaaagagaaattgaacaattcctcaaagtttttggcattttttttttttaccatgtagacaaaattacgaataatggtagcagaggtttgatcctggaatcaataaattttatttacctggtataacatatttccagaattcttaaattccgttaatgataaatacatcttcaattgagataattatagctgtttgagaaaaaaatatatagcggatctttgaacaatgtgcggatgaaagacaccacagtcaaaatccatatatatcttttgactacccgaaaacttagctactaatagcctacttttgactggaggttttagcaagaacatagtcaatatatattttgtatattatatgcattatatgctgtattcttacaataaagtaagctaaagaaaagggaactttttttttttttatttttagtttttagatggagtcttgctctgtggccaggctggagtgcagtggtgcaatcttggctcactgcaacttccaacttctgactccccggttcaagcaattctcctgcctcaacctccctagtagctgggattacaggcacgtgccaccactcccagataatttttgtatttttagtagagaaggggtttcaccatgttggccagtgtggtctcaatctcctgacctcgtgatctgcctgccttggcctcacaaagtgctgggattacaggcatgagccaccgtgcccagccaataaaagagaacattattaagaaaatttaaaaaagacaaaatatatttagtattcattaagtgaaaatggattatgataaagagcttcatccttattatcttcacattgagtaggctaaggaggaggaacatgaggaagggttggtcttgctgtctcaggggtgacagaggcagaaaaggtagaggaggtggaaggagaggcaggagagtcaggcacattccgtgtaactttatggaaacacatcataatttctgtctgacatttttgctttctaatttctctaaaaacatttctatagagtaccaatatttttgccactgtttgcgtaagtttcagtacttgtatcataggagtgttcacgtagtaaacaaagtcaaagttagtcttaaataattgaaatccttttgccagattgtctaatgtaaatttgttttctggcattgcttcttctatgtcttcttccgtagcaggtactggttcaaaagcactcatctccataaagttgtcttcttttaattcctctagtgtggtgtctcttagctctcgaatttctccaagatacatatcttgaaaccctcccctgactttttgcatatccattatctcttcatgatttctttgattggctctatcataaatcttatgaattcattcacaacatttagacattgtttcttccagcaggcatttattgttttgggcttgatggcttttgcaattttttctgtaagtagcatgacattttcaatggtgtaatccttccagactttcataatgttcaatcatggttatcttccacaacattggcaatcctttctatatagtaccatgtgtaatgagtctgaaaggtccttatgatcccctgatctagagattgaatcagaaatgcatttgagggcaagtagaccatgtagatgcctttggtgctgaactcatgaggctctgggcagccaggggcattgttcaatatcaaaagaactctaaagggcaattatatactggaaaggtattttttgacaatagggacaaatcatcaatagaatcaatttaaaaaaagagttcttgttgtaaaacagaccttcctgttttacaagcaaaagactggcagctggtgtttatcttttaccatcaaggctcaggagttagcagctttatagataagtgcagtcctggtcataaatctgactacatttgcacgaaacagtggagttagcctatcccttcctatgttaaatcttggtgctcatttctctctcttttttttaaatttatttttttattatactttaagttttagggtacatgtgcatattgtgcaggttagttacatatgtatacatgtgccatgctggtgcgctgcacccactaactcgtcatctagcattaggtatgtctcccaatgctatccctcccgcctccccccaccccacaacagtccccagagtgtgatattccccttcctgtgtccatatgatcttattgttcacttcccgcctatgagtgacaatatgcggtgtttggttttttgttcttgcagtagtttactgagaatgatgatttccaatttcatccatgtccctacaaaggacatgaactcatcattttttatggctgcatagtattccacggtgtatatgtcccacattttcttaatccagtctatcattgttggacatttgggttggttccaagtctttgctgttgtgaataatgccgcaataaacatacatgtgcatgtgtctttatagcagcatgatttataatcctttgggtatatacccagtaatgggatggctgggtcaaatggtatttccagttccagatccctgaggaatcgccacactgacttccacaatggttgaactagtttacagtcccaccaacagtgtaaaagtgttcctatttctccacatcctctccagcacctgttgtttcctgacttttgaaagattgccattctaactggtgtgagatggtatctcattgtggttttgatttgcatttctctgatggccagtgatgatgagcattttttcatgtgttttttggctgcataaatgtcttcttttgagaagtgtctgttcatgacctttgcccactttttgatagggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaatgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatacgcggcattatttctgagggctctgttctgttccattgatctatatctctgttttggtaccagtaccatgctgttttggttactgtagccttgcagtatagtttgaagtcagggagtgtgatgcatccagctttgttcttttggcttaggattgacttggccatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttcctggagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgcacattgattttgtatcctgagactttgctgaagttgcttatcagcttaaggagattatgggctgagacaatggggttttctagatatacaatcatgtcgtctgcaaacagggacaatttgacttcctcttttcctaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatgcctaatttattgagagtttttagcatgaagggttgttgaattttgtcaaaggctttttctgcatctattgagataatcatgtggtttttgtctttggctctgtttatatgctggattacatttattgatttgcgtctattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctgggttagtcttgggagagtgtatgtgtcgaggaatttatccatttcttgtagattttctagtttatttgcgtagaggtgtttgtagtattctctgatggtagtttgtatttctgtgggatcggtggtgatatcccctttatcattttttactgcatccatttgattcttctctctttttttctttattagtcttgctagcggtctatcaattttgttgatcctttcaaaaaaccagctcctggattcattaattttttgaagggttttttgtgtctctatttccttcagttctgctctgagtttagttatttcttgccttctgctagcttttgaatgtgtttgctcttgcttttctagttcttttaattgtgatgttagggtgtcaattttggatctttcctgctttcttttgtgggcatttagtgctataaatttccctttacacactgctttgaatgcatcccagagattctggtatgttgtgtctttgttttcgttggtttcaaagaacatccttatttgtgccttcatttcgttatgtacccagtagtcattcaggagcaggttgttcagtttccatgtagttgagtggttttgagtgagattcttaatcctgagttctagtttgattgcactgtggtctgagagatagtttgttataatttctgttcttttacatttgctgaggagagctttacttccaagtatgtggtcatgtttggaataggtgtggtgtggtgctgaaaaaaatgtatattgtgttgatttggggtggagagttctgtagatgtctattaggtctgcttggtgcagagctgagttcaattcctgggtatccttgttgactttctgtctcattgatctgtctaatgttgacagtggggtgttaaagtctcccattattaatgtatgggagtctaagtctctttgtaggtcgctcaggacttgctttatgaatctgggtgctcctgtattgggtgcatatatatttaggatagttagctcttcttgttgaattgatccctttaccatcatgtaatggccttcactgtctcttttgatctttgttggtttaaagtctgttttatcagagactaggattgcaacccctgcctttttttgttttccattggcttggtagatcttcctccatccttttattttgagcctatatgtgtctctgcacgtgagatgggtttcctgaatacagcacactgatgggtcttgactctttatccaatttgccagtctgtgtcttttaattggagcatttagtccagttacatttaaagataatattgttttgtgtgaatttgatcttatcattatgatgttagctggttattttgctcgttagttgatgcagtttcttcctagtcttgatggtctttacattttggcatgattttgcagcggctggtaccggttgttcctttccatgtttagtgcttccttcaggagctcttgtaaggcaggcctggtggtgacaaaatctctcagcatttgcttgtctgtaaagtattttatttctccttcacttatgaagcttagtttggctggatatgcaattctgggttgaaaattcttttctttatgaatgttgaatattggcccccactctcttctggcttgcagggtttctgccgagagatccgctgttagtctgatgggcttccctttgagggtaacccgacctttctctctggctgcccttaacattttttccttcatttcaactttggtgaatctgacaattattgtcttggagttgctcttctcgaggagtatctttgtgttgttctctgtatttcctgaatctgaacattggcttgccttgctagattggggaagttctcctggataatctcctgcagagtgttttccaacttggttccattctccccatcactttcaggtacaccaatcagacgtagatttggtcttttcacatagtcccatatttcttggaggctttgctcatttctttttattctttttcctctaaaccccttctcgcttcatttcattcatttcatcttccattgctgatacccttttttccagttgatcgcatcggctcctgaggcttctgcattcttcacgtagttctcgagccttggttttcagctccatcacctcctttaagcacttctctgtattggttattctagtaatacattcttctaaatttttttcaaagttttcaacttctttgcctttggtttcaatgtcctcccgtagctcagagtaatttgattgtctgaagtcttcttctctcagcttgtcaaagtcattctccatccagctttgttccgttgctggtgaggaactgcgttcctttggaggaggagaggtgctctgcttttcagagtttccagtttttctgttctgttttttccccgtctttgtggtttttatctacttttggtctttgatgatggtgatgtacagatgggtttgtggtgtggatgtcctttctgtttgttagttttccttctaacagagaggaccctcagctgcaggtctgttggaataccctgccgtgtgaggtgtcagtgtgcccgtgcttgggggtgcctcccagttaggctgttctggggtcagggacccacttgaggaggcagtctgcccattctcagatctccagctgcatgctgggagaaccacagctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaatcaagcctgttcaatggcgggcacccctcccccagcctggctgccgccttgcagtttgatctcagactgctgtgctagcaatcagcgagactccgtgggcgtaggaccctccgagccaggtgtggcatataatcttgtggtgggccccttttttaagcccgtctgaaaagcgcagtattcgggtgggagtgacccgattttccaggtgcggtgcatcacccctttctttgactcagaaagggaactccgtgaccccttgcgcttcccaagtgaggcaatgcctcgccctgcttcggctcgcgcatggtgcgcgcacccactgacctgcgcccactgtctggcactcccaatgagattaacccggtacctcagatggaaatgcagaaatcacccgtcctctgcgtcgctcacgctgggagctatagaccggagctgttcctattctcatttctcttattgataaatttcctttgtggcatttctattttttttcctgaagaggacacttttttatctgcattaaaaatctattcaggtaaatattttttctcctcaatggttttcacaaattgtatctgaaaactcatctgctgcctcttgatcatcagaagctgcttctgctgttatattatcttgacatttttttaaagccaaacctctttctaaaattgtcaaaccatcctttgctgacattaaatactcaggctttagatctttcaccttccttttgctttaagttgtcatagaatgacttcattttttcctcaaattatattagagtccatatgtatgcctttcttatagctatcttgcacccgcataaaagctccactttaaataaaagataaaatggtattttgcaacacatgtaagatttacgggcctgctgatgttgctgcagcgatggcttcacaaatttcctttcctttttttacagtggtccttacactggattcatttatcttgaaatgtcaggcaactacagctacagatctaaatctacagtacatatcaagcaattcagctttttcttgtaattttatgacttttctttgcttgggagaagttccagtataactagtggtgctttctttggggtcccatgatgttatttaaggtttacgatattgcactaaacatgttttaagcaaatattcacaacacttgagctcactgcaatagcaacaggaggtgactatgaattattacagcagtacagtaataaattgctgttggtaattttaagcagttatgatttaatactgcatctttacatttgtttacattttttaaactgcaaatgatgccctgcacgggtctgtgcttttttgcttacattttgatacctgttaactttttctgatttttttctatattttacagtttgcattttcaaatcgtcacaaatctccaatttttcaacatatttattgaagaaatccacatataagtggatccacacagttaaacctgtgttgtttaagggtcaactgtttaacacctacaagtacattacattgattttaaattagttacgtattttagaaaatttaaatcgctattggggaagtaatttaaattatagagtgttctttagaattaatcaaataccatataacaaattgttgaagcttttattcaaagattgtagatttcttaaaaattccttttaatctttattcttgttcagccatatatatatatataaagctgaacacacacaccttagagatacacatgcttaggtgcaggaagttgcagtacaagaatattcagacaagcattagttacaaaattatcagagttaattaatattgggaagaattcatattccaccaacattgaatgaataaatatatcacattattttcctcactaccatgactcctaccccatagtaagcagtaagctaaatgttgtgttttcatcaggttacgttggtgatatctgggaatccacctttccatacatgaaaacaatgccaattttaaattaaaggcaaataatggttggaaaagtcatttgtgttttatttagtatatttttaaaaactttttttaatggtaaaatatacataacataaaatgtaccattttaatcgtgtttaagtgttcagttttgtggtgtgaaatacatttacattgttgtgccacatcatgaccatctacctccagaactcttcatctcaaactgaaactctgtacctattaaggcgtaactccccgtattctccctccctggcccatggcaaacgcctatttagtgtaaattttgaattaacatgctaatgtgaaaagtttctctgaaactaaacaaggaaattaattgatttaatcctgaattaaaactaattccgggtaaaactcaggttactgaatttatgaatttcacaataccatttggcatccctatttcccgtacaaaccttttgctccacttggatatttcttgcaagtactttgcttatctgagatcagacaagtaaaaaagaaattcagcagtgccgtatattttaattgcaatgttaattctgcacatttcagagtaagatgggagaagaatgtgtatgatttgacagtataaaatactcataataaaactgcttggtaatatccagatgattcattagtaaaaatgtagaactggagggttaagaaaatgtttgaatgttaaacagagttgctacttgaattttctatgttttattgtgaaagtgagaaaacataaataattatttttggaaaattatttttaaatgttgtattttgagctaaaacaatccccaaattcatgatatattaatatttatctgttttaatgttcagtggtggctgtaattgtattacacacacaaaaaggaagcataggtaccactagattaatgtttttgagaaagaatccaatttcttttattaaatacattattcagataaataaatcatagtacattaagcgatgctttataatcctatgcatactttgaaaaatattatggaaaagcatgcttaatatcatgagaaaatgttcatatatatagtcaaatgggtgcaagattgctataagaaaggcatacatatggactctaattactatgctaccattaaaataatttgaacacacacaagtacatgtctacatatacatagatatattatacatagatatatgaatgctgtgtttttctcactgggtgataagattaagctgatacttagatttctcttttgtttcccacataaagtaaataaatgcaatattttcaaactaaagtatcctatgtaatttcacttaagttgtatttactatggggcaccactgattttgaaatgatcaatgtaatgttctctttatttcatgcatgaatagcttcctaagttcttattaatatcatttttacacatctgaacacctttataaaataccgtaactgtgctggccagtaatgttgtcaagattgaattctttttgtatggttttttatttatttgttttcacaaaaatgaaatactaaatataccttaaaggaaactaactgttcagcccagcatgtagtgaatgctttgatcatagaagcagttattttacacaaaattaattcagttcgaatagagattcacaataaactgagtggcagattgcacttcagaatgtatcacaccaatttaggactttcattttatccaaatttcatatggaaaactttctatagttgtcactcttataatatgactgtatgaacattgaatctagtctgcaataaactattaagatgtgagtcctccaaagatatcttgctacaccgatcttgaagaaggaagtacaaacaattaatttaaaatgctgctattgtgtttgtattggcatttgcaattgaatagtctgcataaaatttaggaatgaagactttaataactgatttgcagtacttgtattgagaaaataattttctcaaatgtgggactacagttctgctcctcaagtaaaagcccatgaaacaagatctgataaaattaataataagaaggattaagcaaaatagagcatcaacttataacagtgtactttataatcttatacatgtatttattaaactagctcaggagcacttccagtaaaggcacatttaatgagagtgaattttagttgagatagaaaagcagatcatatgggtacgtcagtctctaatcaactttttagtggtaatccaggaaggatcttcaatttaacttggaaggtgtttctagtgtttagattttctcctagtaatttaacctgaacatatgtttgtaatagctttcttcataaaaggccataagtagggtaagtagctagatagtatatgttaagatattaaaataagacttttttcacccttctcatatttgtataattaatatgttgccaatatttagtggaaaataaaattgattttgatgtatgagaagcttaacaatccatatttaaacttatagcatggctttaagccatcatgttcttggctttatttataaagatgggtattttaaaagacaaggatcagccagacctgcagagttgcccaaggaagaaaatgccttgtgtgtaggccgaccacaaacaaaatgagccatgggtagaaatatctgcagcaaaaggtaatcaattgcacttgacggacttctgaacaatatgcaatttaactcaatgatacctagctgctcctatctttttaatagcttgtgaattcagaagacataagttacatgagtatcttggcaaactacattttcacattttcaaccctcacctcaacttcagcttcatctgggaactttgccataattgataggaaaagaagtacaaattcttttccattcatagagcaatttataaagaaagtctctagcctatcttcccaaatgaaccatgaacgattaaaaataaggcacacttacagcaatattttccaattgatcaatttaagtttgaaaatggcggagattgtattggttaagaatatttataacagatagaacaaagcaaaaaataaaaataaaaaacccacaaatgatgaataggcaaattggtcccccaagactcctaacatttttttaacagtatttttatcttttcagttcttatatagcaattctttcattgtcatagaactctaaaaaaacagtagttataattgaattaataagaattatgaatataatatatgccatgaagctctttgaaggagttgtctgattcaattttctgctaccttttacctacattaacaaacagaggaagaaaaccaaaacaaagctaagagcagagaggtaatttggttttaaaaatatctgtgggaggtacagatgcattcagacaacttcctccacttctttgattcctgctttctaagtggttccctttcaatttgtttatattgtgtcaacaagttagaagattgcagaaaaaaaaaatgcatcattttcttggttgacaaaccaaaaatagttcatttaaagaatacagaaggaactggaatttcatattgctttccttgctgtttcttttctttgtgctaataatagcatcaaaaataaagcccccaagtcagcaagtttttgacactctgattggctgaacacaatgaaaagctgtttgttaggcacaaaatttacctacattttttttttcaatttccagcaatggtcaggtgacttgtggaacatgagggatatctaagggaagtacataaggatgccctaaggaaaattcccactttgttattaatatctggagaaagacaatacatgtggcaagggaaatgaaaggactgtgttcatgtcataaaggaaagagtaatctgttagaaaatacatctctaatggaaaaaagagaaaggatgtggaaaataaaaatgatctgggaaacatgttgattgtgtgggaaaagattactccagaaataatttagaatgcacaattggcataaggagatttggatttgcattataaatatatagcctgctattactggcaacttcctggtcataattattttcatctcttttctttttattgatatatagagcctgctctgcataatctcatacattgtgttctgatactttatacatttccagatgtcaacattatcagatggtaagcccattgtctactaaggtcaatacaaaatatttaataactgggtgttcagctcaaaatggagagtggaggttaaaaacagggaaaggaaaaaagaaaggaagttttatgaagttaggaaaattttttttttttagtgttttggttaaattgaaaaaatattttctattttgtgaggattattatagggaaaactttgtggttcagtggggagttttgcattgactacagcacacttattcgggttgattcttatcccatgggacttgttttgcaactatgaaaagaaattcttatctaaaaacaatatagatattctgacagatagaggttcacttgattttcttttctgtccaaggaaaaagccagtttctgtcagttcatctcaccagtcctttaggcaaatttgtgctcctttgacttctctgagccaattagaatatctgcctggcaccctcattatgaattaagtaaaatctttaacatgaattgctttatgtctgtatgatattaatgattttttactttgaaatattttatttaacaaagttaatatatgtaaaaacaattagaaccttctctggtaggaaaagatgaatgaatgttactgttgttactattgttgttaggagacagcattcttgattcttagtgctctgatacaatcatgattaaactgaagaaggtcagtctgtagtaggagaaccaagtaaataaatagttccagtagaatgtgttaacatatgtaattgaggtaagtacaaggtctaatagaaacataaatagaacagcaattgactatgccttagcggttgagaggggacaacatctgagagttagacaagaaaaggagtcacatagtcacattatttgccctagatatccgtcttgaataaccattatcagaaattgtaaaattatgagcagaatcaaggcaaaggcagagagtgaataagctttcttttactcaatcagaacaaaaataagctttaacacaaggtcacgtttactcgtactaggaagtcagcaaagatacagagtgtaatgctctctatttaacctgtgtagacttagcagaggctgagattaatgatagccaaggaaaaataagagagataatttcagaataagtgcaaggaagtttataatgcaagtttaagcttagatcaaaatttaatggtgactttttaaaggtaatcataagagagaaaagtaatagcacaatcttgtaggactgtgtgtctttgttcagtgtccttttatatctattctatcaatgtgatttcagaaagaagaccctgtgaatttttaggggggaggaagtagtaacactattttatagttaaggactcaaacatagagaagtttttatattaaaatctgtgataataatgataaatgtttttgtgtctatggggtttatagtttccaaaatgatttctggatgcagtgtttcctttaattccctaaccactggtggaaaaaggttttattttctacattgtacagatgagaaagctgagtcttagagacataaaacttacactgagttaaacagctaatgcttggcaccctgcttctctggttgtgcatgctgtgctttttctattacaaaatgattcttagtaaaaaaaggaaccctatactttagagatgctaagttccagcccacgctgcactcacactccctacctcaaagggagcactctcaagtggggttgccaccacctggaaaggatgcctgctttgttttcttcacaccaaggcaccttatgtgctagcagtggcagtgatgaaagggaatacaaacagcagggagaacacaggaaaaaatggccaagtaggtgatatttaccttcagaattctccacttccatgttccataccactgctgtccctcgcagcctcttgacctcaccacccacctctgctctagtgacctctctcttttcccaaaacaatcaacttcaaagagtaactcgaacaccatgcgttgtatgacaggacttctttggagggcttctggcttgataaatacatgaattaagaggaaaattcaaaaacataatgagggtttgtttctgaggtcctgtggcaccagccacatacctttttataataggttgtatttgtttgtttgtttacttagtgtgaacatatttcttctggtcaaacctactccatggttcccgctccccatttattcttgagtctgtttcacaatcatggaaagactctgtatcatgagggaggagtgttaatctggaataaccaaattccaggttttcaagcttctagataaaggtttcaaagagatggaagtcacagagaacaaaggcatggtgtcttcccattttattattttttccatatttcctgggtgggagataactgagtcttttttactttagggaaattatcagcactcttcttttttatctctagctctccttctatttcacttttagatgggttggtcctgtcttgcagtccccaggacaacgggttgcttgtttggatgagttgcctgaggtgtgtgtcgttacaggacagttctactgtgggaattggataaatgttccctcttgttcattccttctcttagattcccttcatcttttcaccactgtctgagatctttcctagcatcagagattttggtttacttttagaattaccaaagcagtttttcccagacttaatgaagaggataccacaaggttaagcctagtccactacacttctgttctaggactatgagttaaagttcaaactaataatgagacagtcattggttctgctttgtcagtacggtggtatggggatatggtgcaggatcttcatggattgcctctatttctgagggatttttttttgcctctgaataaagaaagaaacatattaggagttctaaattttcagttggaaagatcttgattaggaactaattctctctggactcctactgcctaggttggaatctcagcttcttacctttctagcagtatgatcttgggccagcctcagtttcttcctctttaaaatgaggaaaatggaaactatttcagaaagtactttggggtttaaataagaaaaacatgtaaaatcctaatagtgtttgacacatagtagcacttgataagcattagctattaataaaataattcccattgctatttctcgtggatagcattagagcatctgaatttggggaacagtatcttgtagtgttacttaattggatagacccccccccaccacctcagtgaaatttaacaggcaaaatgtcagtatcttccagttgatgtaaatctactctttgatcaaatttgatataatttcactgtttctgccatagaaacaatctaatatcagacttggcatgtttctctactagaaaacatgatgtaggcaatgatgctgtctgactgaatcccacagcaggttgtattagtcactgaatactaagctgttatagtggaagaatgtgtttccatatttcactttaaacatggaaaacatggtccacagaaggtatgtttccagttacatgataagctaggatgatggttacaatgataaagaggtaatttactggggctataacactggctgttactttgatggcttcacaggatccagaatggacattctcttgaatcttgctgtgacataaggctacttcttcttaagtgaaaactaaagacagaaaatgatagaaccacagggcattagagctggaagtgatccaggcatgtggcttgccaaaaccctaacgtgactcaaagacaggtggaaaaggcttcacagagcaccttaccatcctctactgagattatttcaataatattgggaaccatcatttatctgaagacacttgctccaacattcccatgtagatttgtagatttgaaactcagtgaaaggcattttgactataaaattagaatgtaagtttcatacataattatgagatgatttatcagagaatttagaggaaaaaatccaagaacttcacttagatactgagaaacaacaaggaagacaagggactcgagtatttaggaaagaaatggcacacctctacttgagcataaatattcggagagcaataaatctcatcctactccatttacaggacaaggggaaacacagtaaatgcttcagaattatacacaaaactttcttaagctgtgagaaccagttaaagacaatttcagtacttattataacctcatatggagaaatgccacagtgcaaactggtgacagaatcgacatgtagaactacattctacagatatacagcagataggctgcaggtttcagaggtatacttacttattttgccaacagtatttgtcacaggaaatcaagtcaaaacattgtaataagctagtttccaatatgaaatagactttcaaaccccagagaatttttgaggaaaagcaaaatgaaaaaccagacaaaaaattcttaactagcttagcctatcacccactcatgtttttgtatcagatctgggtcataaatttcattactttccagttttctccattatattgttccatttcagaaagaaagtcagctcttatttatctaagcatgcaaacctggaggcaggcagaatacttaaaatataaatgcccatagttagagaaatagagtttttctagtcctaaaaaagagagcttacagagtaagaaaagacgatcatatacatggcttttggtacaatactttacctgtagtataattatgtttcagaatttaaaaaatgttaagtcggcttaaaaacaacaaaataaccattaaaaaaaccttcactgtttaagatgaaagtcataggctgccactttacacattaagttaaataccaacccccagagaccaggaatataataaaatggaggaaagtggttatagaaggctaatgttccactctaggaatcatctacctgacacatctttcatgcaaaacactctgctgggaactatggtaatccaaagatagaaggatatacatcaattcctgaagagtttgtagtatattaggaaggcgtgtgtgtgtatcacattcaatcatatactgatggcacaaggtaagttatattaattcttctagtaacaatcagagaataaagtgtgtgatgcaagagaagctgctttatgggtagtaatgttgctcctgctaatgatcaattctctgttgaatactagatgaagaccctcttatagacttgtagaattctttgtgccactctccctacttcagtacatttttcctgtaaatgccaggcgctaaggactttcaactccttctctcctcaacttagaaaattagcttgtatctggttacttcctgcactgtggcttggaagcacattcaaagcagtaaactggagcgagatcactcttgcattgcttaatgtccactgtcctgaaaaccatcgtttcatatattttccctgggtttttggttgttaggggtggagggtgaatcctgtctctgttactttgtcttgatggaaagtggaagtcttcactgattcttttctactactactctgaaaatattacacacttgccagtgagaaaaatcaaggctttagcagtattaaataacttcctgaaagtcacatagaacttggaattacaggttaatattttccctcaagtctttaggcaagtagacccaggggtaccttgaatgaggtgaatagtgtaacctatttatactctaggttttacagaaaacactcatctcttggtgttgtcaatattgttcattgttccttgacctttcccagtatcagagtgtttagataccaagggtgtgggtcatgggttagcaaacaaatgcctctggctattcaatgacagagttgagtagatgggacatagattttcttggccacaaatcctaaaatattcactctttggccaattactgaaatcgtttatcaacttccaaagcaaaagaatcaagtatttttttttcagactgactttgttctatctactttaagataagtaggattttgattaattatttgtggacaatatctaggcatcaaagagctacattgtatttttatatgagaagccccctggtaataatgtagaactttctcctcttcactgtgctctcggtaagttaagttttgagggctaccaggaaaaagcgcaaaagagggaacacaggatatggtagatgaagagtcagtgattcacaggttgccagcctttgcaaagtgtcttccatttcatcataattgggcacattttgcccaccagtatgaacttataaacagtgaattgagatccaggaggcaaagtgctgatttcagataaaactcagacctctgagaaacaaacacctgtgttgctgtaagcctgtaagaaggtcacaaatacaattcgtatgatctagggaatacagtattagtgggacagtaattgcttctatgggacacagaaaagatttctaagacttcaaaatactggtgcaacaatgtcccacttacattttggagaatatttttctgtgtgtctctaatagtaatctgtataagccaaaactgggctagggaagtccaaccaggaactaagaattgtaaaagcggttgtcagtctcctgagccacatcccacatggagcgaagatttgattttatggaatgattgatgagcagttcatatgtaggccagaggtgagtttacttcagagtaaccagagattactatgtaagcttatagcttattgaatcagaccttgttagattacctgattgtttcttatactcagaagagagaaggagctgtgtccttagatcggagataacaaatatctgcattagtatgaaaggaagttatgtgtcagagaggaaagaaagtgaaccttaggaaaaacaaaggattgggtataccactacagtccctaaatactgctatatgactaatcggctttaccagatattccagctattttgttatagttgtgaacaatagttttttctttctttcaaaatttcacttattactggtataggcaaacatttgcacctcttctatattctatctagacttaattgaattgctttattaattctatatgctttttattgattttactaaccaggcacctataccattttcaaaaagcaataattttatctgttttcctagtatttacatttttttgtttattttcttcttattccagagcagggtttttcaaacttgacattagtgacatttttcactggctaattctttgctatggtgtactgtcttgtacttttgtgggatgtgtagcaccatcacaaactgtacccaccagagccagtagcatcaatcccccaagtcagacaatgaaactgaccctacttattgccataggtccctctagagggccaacatttttctgattaagaaccacagttgtagaaaaattaagatttaaatgctaaatttaaacaatagtgtgtagacactgatagaagaatatcttaatctaagggtggctgtaacttcactaaaagctataaagaaaaatattaccagattttatgcaaataaagatacttctgtatggcagatagtaagctaaagtaaaaatacctttaacatagacggcagatatgacatgctcaataccgagagatttactaacaataatattaaagtggacaaaatatatgaataggcaatgatcagcaaacatagaaaaaggtgcccgaatccacaaataaccaaagaaattaaattaatgaaaagtgtgttttgtactttaaaaatcatttttaattgacaaatacaaatttcatatacttattgtgtacaatatcttgttttgaaatatatatgtagttcatctttcatgtctgtgagttctatatccatgaatttaaccaactttatataagacaattaacaaaaagtctatactgaacatgtaaagattttttactgtcattatttcctaaataaaacattgtaatgactatatacacagaatttacattgtgtaggtgttaataatctggtgagtatttaaaatatgagagcactacatatataccatatgcatatacatgtatatgcatatatacatgtgcatatatatgcacacacacacatacacacacactacattttctttatccatccattgatggacacaggttgactccatctcttggctattatgaataacatttcaatgaacatgatgggaatgtagctatatcttctacatactgatgtcgtttcctttggatactcattttatgaggccaacattaccctgacaccaaagccagatcagggcactatcagaaaagaaaagtgaagggaggagccaagatggccaaataggaacagctcctgtctacagctcccagcgtgagcgacgcagaagacgggtgatttctgcatttccatctgaggtaccgggttcatctcattgggagtgccagacagtgggcgcaggtcagtgggtgcgcgcaccatgtgcgagccgaagcagggcgaggcattgcctcacttgggaagcgcaaggggtcacggagttccctttctgagtcaaagaaaggggtgatgtactgcacctggaaaatcgggtcactcccacccgaatactgcgcttttcagacaggcttaaaaaaacggcacaccacaagattatatcccgcacatggctcgcagggtcctacgcccacagagcctcgctgattgctagcacagcagtctgagatcaaactgcaaggcggcagccaggctgggggaggggtgcccgccattgaacaggcttgattaggtaaacaaagcagccaggaagctccaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagctgtggttctcccagcatgcagctggagatctgagaatgggcagactgcctcctcaagtgggtccctgaccccagaacaccctaactgggaggcacccccaagcacgggcacactgacacctcacacggcagggtattccaacagacctgcagctgagggtcctctctgttagaaggaaaactaacaaacagaaaggacatccacaccaaaatcccatctgtgcatcaccatcatcaaagaccaaaagtagataaaaaccacaaagacagggaaaaaacagaacagaaaaactggaaactctgaaaagcagagcacctctcctcctccaaaggaacgcagttcctcaccatcaacagaacgaatgactttgacaagctgagtgaagaaggcagacgcctcaggagctgattcgatcaactggaagaaagggtatcagcaatggaagatgaaatgaagcgagaagggaagtttagagaaaaaagaataaaaagaaatgagcaaagcctccaagaaatatgggactatgtgaaaagaccaaatctacatctgattggagtacctgaaagtgatggggagaatgcaaacaagttggaaaacactctgcaggatattatccaggagaacttccccaatctagcaaggcaggccaacgttcagattcaggaaatacagagaatgccacaaagatactcctcgagaagagctactccaatacacacaattgtcagattcaccaaagttgaaatgaaggaaaaaatgttaagggcagccagagagaaaggtcgggttaccctcaaagggaagcccatcagacaaacagcggatctctcagcagaaaccctacaagccagaagagagtgggggccaatattcaacattcttaaagaaaagaattttcaacccagaattgcatatccagccaaactaagcttcataagcgaatgagaaatgaaatactttacagacaagcaaatgctgagagattttgtcaccaccaggcctgccctaaaagagctcctgaagaaagcactaaacatggaaaggaacaaccggtatcagctgctgcaaaatcatgccaaaatgtaaagaccatcgagactaggaagaaactgcatcaactaaccagcaaaagagcgagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatgggggaagatctaccaagccaatggaaaacaaaaaaaggcaggggttgcaatcctagtctctgataaaacagactttaaaccaacaaagatcaaaagagacagtgaaggccattacatgatggtaaagggatcaattcaacaagaagagctaactatcctaaatatatatgcacccaatacaggagcatccagattcataaagcaagtcctgagtgacctacaaagagacttagactcccacacattaacaccccactgtcaacattagacagatcaatgagacagaaagtcaacaaggatacccaggaattgaactcagctctgcagcaagcagacctaatagacatctactgaactctccacaccaaatcaacacaatatacatttttttcagcaccgcaccacacctattccaaaattgaccacatacttggaagtaaagctctcctcagaaaatgtaaaagagcagagattataacaaactatctctcagaccacagtgcaattaaaatagaactcaggattaagaatctcactcaaaaccactcaactacatggaaactgaacaacctgctcctgaatgactactgggtacataacgaaatgaaggcacaaataaggatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcacagcagaactgaaggaaatagagacacaaaaaacccttcaaaaaattaatgaatccaggagctggttttttgaaaggatcaacaaaattgatagaccgctagcaagactaataaagaagaaaagagagaagaatcaaatagatgcaataaaaaatgataaaggggatatcaccaccgatcccacagaaatacaaactaccatcagagaatactacaaacacctctacgcaaataaactagaaaatctacaagaaatggatacattcgtggacacatgcactctcccaagactaaaccaggaagaagttgaatctctgaatagaccaataacaggagctgaaattgtggcaataatcaatagcttaccaaccaaaaagagtccaggaccagatggattcacagccgaattctaccagaggtataaggaggagctggtaccattccttctgaaactattccaatcaatagaaaaagagggaatcctccctaactcattttatgaggccagcatcattctgataccaaagcctggcagagacacaaccaaaaaagagaaatttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatataaccagaaccaaagacaaaaaccacatgattatctcaatagatgcagaaaaggcctttgacaaaattcaacaacccttcatgctaaaaactctcaataaattaggtattgatgggacgtatctcaaaataataagagctatctatgacaaacccacagctaatatcatactgaatgggcaaaaactgcaagcattccctttgaaaactggcacaagacagggatgccctctctcaccactcctattcaacatagtgttggaagttctggccagggtaattaggcaggagaaggaaataaagggtattcaattaggaaaagaggaagtcaaattgtccctgtttgcggatgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgagaaggacctcttcaaggagaactacaaaccactgctcaaggaaataaaagaggatacaaacaaatggaagaacattccatgctcgtgggtaggaagaatcaatatcgtgaaaatggtcatactgcccaaggtaatttacagattcaatgccatccccctcaagctaccaatgcctttcttcacagaattggaaaaaactactttaaagttcatatggaaccaaaaaagagcccgcatcgccaagtcaatcctaagccaaaagaacaaagctggaggcatcacactccctgacttcaaactatactacaaggcgacagtgaccaaaacagcatggtactggtaccaaaacagagatatagatcaatggaacagaacagagccctcagaaatagtgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccatttaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagaaaatgcaaatgaaaaccacaatgagataccatcaatgctcatcatcactggccatcagagaaatgcaaatgaaaaccacaatgagataccatctcacaccagttagaatggcaatcattaaaaaggcaggaaacaacaggtgctggagcggatgtggagaaataggaacacttttacactgttggtgggactgtaaactagttcgaccattgtggaagtcggtgtggcgattcctcagggatctggaactggaaataccatttgacccagccatcccattactgggtatatacccaaatgcctataaatcattgctgctataaagacacatgcacacatatgtttattgcagcattattcacaatagcaaagacttggaaccaacccaaatgtccaacaatgatagactggattaagaaaatgtggcacatatacaccatggaatactatgcagccataaaaaatgatgagttcacgtcctttgtagggacatggatgaaattggaaatcatcattctcagtaaactatcgcaagaacaaaaaaccaaacagcgcatattctcactcataggtgggaattgaacaatgagatcacatggacacaggaaggagaatatcacactctggggactgttgtggtgtggggggagggggaagggatagcattaggagatatacctaatgctagatgatgagttagtgggtgcagtgcaccagcatggcacatatatacatatgtgactaacctgcacaatgtgcacatgtaccctaaaacttaaagtataataaaaaaaaaagaaaagtacaggttaacatccctggtgaacatgtatgaaaaatcctcagcaaaatatcagcaaactaaattcaatagcacattaaaaggatcattcaccacgatcaaatgagatttatgcctaggaagcaatgatgtgtcaacataccaaaatgtataaatgtgatatgccacattaacacaatgaaggacaaacaccataagatcatctcaatagatgcagaaatgcattggacaaaattcaacatcttttcatggtaaagactcttgagaaattagatatagaaggaatgtacctaaacagaataaaggcagtatatggcaaccccattgctaacatcatattcaacggtgaaaagtggaaagcttttcctctaaaaccaggaacaagacaaggatgcccactattgccacttttattcaatacagtattgaaagtcctagcccgagcaattaggcaagggaaaagaataaaagtcatctaaactggagaggaataaattgaattgtccctattgtcagacgacatgatcttatatacaaaaaatcctaaagactccaccaaaaaaaaaaaaaactgttagaataaataaagtaagtaaagttgtaggatataacagcaaaatacacaaatctctagcatttatatatactaacaacaaactacacaaataagaaatcaagaaaactattccatttacaatatctacaagatagtcttaggaaaaaatttaaccagtgaggtaaaagatctatatactgaaaacaaaaataattgataaaataaatggaaagggccacaaattaatggaaacatatcctgtgttcatggattggaagaatggaaaccggaaaaatgtctatactactacaaatgattcaatgtaatccctatcaacattccaatggcatttttcacataataggaaacagaattgtacaatttatatggaaccctagaagatcccaaagatccaaaatatcttggtccaaaagaacaaagctggaggtatcatactacctgacttccttcaaagtatactacaaagctatactaatcaaaacagcacaatactggtattaaaaacagacacataggatagagaactcagaaatacatccacatatttacagtcaattggtttttgacaaagggaccaagaattcacgatggagaaaggacacgctcatcaataaatagtgttggggctattggatattcatttgcagaaaaatgaaattagattcttttcttataccatacccaaaaataaactcaaaattgattgaaaacttaaatgtaggacctgatactataaaacaagtagtagaaaacaggggataagctccatgagattggtctgggtaatgatttatttttattttttgcatatgaacaaaaaagtatgggtaactaaagcaaaaatagacaaatggtattatatcaatctaaaaaacttctgcatagccagggacagagtgaagggacaatctccaggataaaagtatttgcaaaccacttatatcatcaagggttaatatccaaaatatataaggaactcaaaccactcaatagcaaaaaacaaatgacctgattttaaaaatgggcaaagaatctgaatagacatttctcaaaataagacaaacaaatagccaattaatatatgcaaaaatgcccaacattactgatcatcagggaaatgcaaatttaaaccaaaatgagatattactttacacctggtaaaatggctattataagaaagacaaaaaagtacattttggcgaggttgtggagaaaagcaaacccttgtacgctgttgatgggaatgtaaatcagtatagccaatgtgtaaaaggatatagaggtttctcaaaaaattaaatataaaactaacagatgattcggcaataccgctactgggtacatatccaaaggaaataaaatcagtgaaaagctttttaaagagtaattttttaaagagtatttgaagaaaagagttaacatggcatgtctacaaatgctatcctcataagatcctgcctacaagttacaagggttaacacttggctggcatctgggaacttggatattgtgaaggtttccttcaccataactaataacagtggttcacggtccctgaaacatctgtacaaacaatatgttttatgctatgccaaaaacctgattttcctgtggaagtctgaaatttgaatatgtgctggatagagggtacctacatgactagcacgcaacaaaaacttgaagactgagtctctagtgagcttttcttgtagacatttcccatgtgttgtcacaactcattgcttgaggaattaagcactttctgtgttactctgggacagcctcttgatagcttgcacctggtttcctacaaagttactccgagtgctgtttttctttgctttgtgccattttgctgcagtaagttggacctgtgagtgtgactacatgctgagtcctccaagtcttcctactaaacctggagatggtcttgggcacccctgacacagagtgataatacctttgttgaagatattatgtagaaacaggcattctattgtattctgagattttttaatttgttatttctcaagaatcctttgggactatgtatcaaaacttgttatatgtctaccttttgatttgataattgcgttgcttgaaattttatttgaaaacatgagaacacacatacacacacacagcttctcagtgttattcataaacagaaaacactggagattattcaccatacaggactggataaataagttatgacacatctaagtatcagccatattctgtcctgatttttggtgtatctattttaaccggctgatgccctttttcatgccctgttaaaatattttatcatttccactgggtacatctgtacaagatactatgcatactatacatatgcatagtatcttgtacatatatatactatatatatagtaaatatatagtataaaaaatatatatttatacatatatttgatatacattgatgtatatataaaacaatgatatatcatgttttatatatatatcattgttttataacaatatatatatcatgttttatatatatatcattgttttataacaaattattaaacagacaagcacttctcaaactgctcaaagtttgatttgttaatagatttttttaaagcctgccacaagataatttaggtgaatatagaaaatcatatcactaaatagcagaactttgacaattttctaaatatttgagttgcctgtcatttatgataaaaatgaataggcacccattgtcataaagcgggagattgactatgacctttgttttattttttattttttggcctgacaaagcccgttcttctcaaaacctcttgaaaagctacttaaacttttaatgaagattgaagcctcatggagacaggaatcaaggcccttaacctctttgtttagaggttggatggtctataattttaatgagtggagaatatcctaatgaaattccacttgtgggaaaaagccctaaaaaattgtgtacaaacatcccaattgagatggccaggggaaaggtacatttacttatgatggaaccaaaattgtgttggcatcaatttgtctgccacagccagtgaaaagcaagggataatgggataaaccattgatttttaaaagaaaaaactacttaaataaactatcattttatataaaggtgacaaaagaggttctgaaatattcaggggctcaagtaacatatatttaaacatattgaagatttgctgtagtgacaaagagttagtacaatcagaaatttaggacatacatcatgtagatcaaacctactgaaaatatattaaattctccttctaccagtgagaacaaggaagcatatacttaattgagtgttcatttaaattaatgtttttagggcaattcataatgatcttttctttagtttaatgctaaaccagagttgagatttaagatactaatgacgcataccatgtatgaagcagtatgttaaaccatcacgcatccaccagaaagaaaacccacttctaagtgccttgaaggtagttcctcttacttccccttactgcagacctccataaaacaaacaaacaaacaaacaaacacctcacatcctgactttggggagtagccttcctctttcccttagaggtgctgttttcccttaggcacaagctctaataaatctttctctatctctgttattgtggtctcacctgatttctatctcgaaggaccacaagaaccctaggcttacagttccaggggttgggacctgatattgttgggggccagtactcagcctattacagctacaatcaacgaaactaagatgcacgtacagaacaaggcaaaatattgaaagcagaatacaaaacttagaaacatatttaagcacaataagaattcagttttcaatgaggttgatatttcaaatgagtgggaaagggctttattaaacaaataactaggcactcagaaaaaggaaaagtggaacctaccttaaactgtaaaattagaagatgtcattttgaacatcttaaaccagatgcatatatgaaaaataaaaccggcccgtgcggtggctcacacctgtaatctcagcactttgggagtctgaggatggtggatcacttgaggtcaggagttcgagaccagcctaaccaacgtggtgaaaccccgtctctactaaaaatacaaaattagcagggcgtggtagcgcacgcctgtaatcccagctacttggaaggctgatgaaggagaatttcttgaacccagctggcggaggttgcaatgagccaagatcacgtcattgcactccagcctggacaacaagaggaaaaccccgtctcaaaacattttttttaaaaagaaaaaaaacatatttataaatgaataacagttgaacatttttataaacttgaaataaatatattacaaagtaatactgaaaagagaagttaaaaatgtgcataaaatttaaaatctacattttagaatggtgataagatattgtaaaaattcaaaagaaaatgacagtttatcaatctaccagcttatatgtattataatgacatatagccgattaggatttttaatatatattggtacttagaaaagataaatgtcttaatagaaaaatgcacaaagaacctgaaaatgaatttcataaataaaaaaataccaatgacttataaacttatggccatataaaaattcactggcagacagagaaatatcaattaaaaattaatgagacatcaacaaattatcagtgaagaaaatttaaaaacatttttgtaacatgcactgtaggcgaagtgtgatcaaataaaataggctgcttctacattcatgggtgtgtgttaactgctacaaacctaccccaatatggaactaaataccctacttagtcatttcacaattctacttcatggaattgattcaaagaaaataatgaacactgtttgactatgggaatagtcactgaaatattataaagtacgacaaattttcaactgcaaggacaagttaagtgaattgtggtatgccctcattgtttagcatggcacaaatactgaatattttatagtgaagaaacagatagttgtaagtaaatatgttcccagaatatgcattataaacattcattttatatatatatatatatgtatatacgtatatatatatatatacatatatatatacgtatatacatatatatatatacatatatatatacatatatatatatatacatatatatatatataggcaaagttatacaattaaatcaactttggggatttgtgtttgccataatcatgattttctatttagttttattttcattatttctttattttattattattattttgagactaagtctcactctgttgcccaggctggagtgcaacggtgcgatctcagctcatcgcaacctctgcctcccaggttcaagagattcttctgcctcagcctcccgagtagttgggattacaggcatgtgcctccacacctgactaacttttatatttttagtagagacaggatttcaccatgttggtctccaactcctgacctcgtgatccgcctgccccagcctcccaaagtgctgggattacaggtgtgagccaccgcacccggcctattttcttttcttctttacttttctttcttttctttcctttctttcctttcctttctttctttctttctttctttttctttttctttccttccttcccttctttcttttctttctgtctcttttctctctccttccttccttcctcttttcttttctttcttgttttgctcttgttgcccaggctggagtgcaagtggcacaatctcaactcactgcaacctccacctcctgggttcaagggattctcctgcctcagccttactcagtagcagggattacaggcgcccgccacgacgccaggctaattttgtatttttagtagagacaggatttcatcatgttggtcaggctggtctcgaactcctgacttcgtgatccgcctgccttgacctcccaaagtgctggagtgagccaccgcagctggcctattttcattatttcttacttattcatgtattttcttttactttcatttaaaaattacctataatgttcattcattgctttttcacaataaaaatattttccaactgcattgaaaatatatatacattgattttgggaaaaaaaaaaagaatacatagacctataaaggagagacaggaactacctgaaatccaatcatgccgaaagaaacacaatcacaattttgggggttgtcttttatttattgatgcaaatatataatttatcctattttcaaatatgcaaaactactgttaacattttttatcttttagcacacttttattttcttaaaggtaaaaaccagtattctgaagtccacttccaaattcctagaactggtgtaggatgattctagaatatgccattacttgcccaaataaggtggaatgttgtctggccaggccactttcctgcaacacattccatcaggaaactcagaaacaacaggaactgctgagcattttctgctgaactttttttttcagttcaactcagaaaatagatggcaatcttcccattttaaaaagatgttttcctccatttcttttccattttagcagagacagtaaagaattcaaattatatcatatctctgtcctccacaccagctgtgttttgtgtttgtcagatgcttagagtgattttcaaacagctgggttttctcaaccatattttaccccaattatctttctccatgatcttcaaagctatttcaaacgatttttcccctgattcaatacacatgtttatagtataaaaaaaaatttagaaaatagacaagaaaatgatgaagaaaatcagtcagctataatgacaccaaccagtgataaataacattaacatccttttatcagtggtcagtctcctgtacatacacatacatgcaatcctattgtacattttgtgttgtaagctttacaccttataaaatagctttaatggtttccatttttattcagtatttttctaagtgtggactttgatgtttgcagtccctcactcccactcgccccctccccagtgttcccttatcagttatgtcagctccttcttttaagtgctcaggactaaaaccatggactcttccatgactcttcattttcataaactacatccaattctcagaaaatcctagtaactttactggggggaaaaattgtaacctacatacttcctacccttcccctgctaatccctcagccaggcaatcactaattcttgtcttgtctatgagagcaatttctcttcttccattcttgcctcccctacctttggttaaatgtaagtcagaccatgcactcttctgcttagtgtctgccatgccataccatcaccctgaaaataaaaaccaaatacaaaccttggcctacaagaacctggacgagtggcctttgctgccttcctgatgtatttcttttctctgctttctcatgtggatccagccacagttacttgcttaataatccttggacatgctgagcttgcttttgagtgtctttggacattctgttttttctggatgttagacctttcccaagatagcttcatggtacctttcctcactttatacagttcctattcaaacctcatagactcctgccctgaccaacctataaaaaaaattcatcagctgtgacttgttctccattctgctttacatttcttcatagcatgtatcaccagctgatattatgttccatattgatttactcattttattttctacatcccctactagaatgtaaatgaaatgaagacagagatattttcagtttttgttaatcactatattcccaacatcttgaaaatgagtggcacttcacactcactcactaactgatgaacaattctcctttaattgaacagtttttgttttttcttgtaagtgacaattccaattcttgattacgtcttaagggtaaattctaaaaagcaaattatttttaaaatttgaacattttctaagattatcctcaataacagatttttctaatttatgcttccaccaaaagaatataacctaatttcaccaaaaggatataaaatagaataactgttttcttataatcttatcacactgagttttattatttttgctcttatgtttttgatttgcttgtaagaataggtgcttgttttagcatattagctattattgataaaattgttttgagatcatttatgtaaacagcctgctgcatagtgaggtattaatacaggttaatgaataaacaaaaaatgtctaaatatgttccttttgccaagaagtcttaaaatctatagaaattatattccaaatataaaagtctatggtttttaacctgctgtaacttaacttccttatttagtttctatttgttttactaaaatattaaagttcctgcttcagtaggattattggccccttaatgaaaaggtgctttgaaatcattggctaaacaataaaagcatggagattacctgtgaatgtgctttctcaaggaattaaaatttaagaggtttagttctagttattacacaacattacacactatcttaccattgacacatactgtgggttattctgagaaataccatactattcaatagcacacctggtgatattgtaaccactggttaaaaaaaaagttaataactagattcactgaaaacaaatcagatgtttggatgtgactaattgaaatatagaaaggaaaatgaaaagtccttattctaaccaagtcccctcaccccaccctgtgcagcaccacactttagcctcctccttaccttttaccagccatgaaccctggaatttccatagttaacttctttctgttaaggctttgctgcaaaaggttattactaacatgcttaaatatagagttcctgacataggcacccaatgaatatgttttcaagagtgcatgaattaatcttagcagagaaaaaataaacattagcaccctgtaggtcttttgcctttgtattttatccaattatgtagttgctacaaagcagcttgcagaggcttgaaggtccaagatggatgaataggcattttgaagaggaaagtgtgagcaaggacaaaacaacattggctggggactcttgggaggaaatcaagctgtctgagaattcagaggtggcagccagaccatcgcctctactctacattgcaagcttagctaaggccattcatctgatggaaaaacctattccctttggctctcatttcagtcaggaggtctaccttgtttctgccatgtacatgtcagcaggtgagtgtgtttatgtaaaatgcaagggttagcataagagagttgtaaacaccaaaagggctgacttcatgtatgtatgacttgtgcacccatctttagaagggtcccatgtttgctctatgaaataatttttgaacaaagtcatctcatttttattttacctgtcctgaacaacagaaggcagccaattagaatccaaattctcaagagccgaaagcaagccttcaagtaggaagattagaaatttgcagggatgaaggataggaaaacatgtaaaactgaatttctttcctagatcttactcattgcttttattatgtaataggtttactcctttacttttcttatgttaagccccttttccatactcccattatactaaatatgtttcctaagaattgtatttcaaacactgagtttatttttttcctggagcaataaaacattaaaataacttatactccttttgatagatggagttatttgaacttcataaagcactaagaaaaatttatagggtaactgaataataaacacagctagtggaagcctttgaggtctggaaggaggaatgaaacaatgcatgcttcctcctaccccatatatctaatccaattttcagatctaggatccattctagtcacttaaacaccacataaacttctttgatgtttaattatattatgtatatgcctggcactatagaagaactgacagaatgaaaacttcattgagtgttttcctggccactaaccaatgaaatgctctctgagaaggaatagtggttaacaaatgctgataggtgtaatggccctggcagtaaattctccattcttaagagagtgttgggaaggcctgagagtggcagcttgctaaactgtggtttaaattgactgggaatacttgctaagattgaaatgagatttaataggctcagcatgggtttgataagagcctgtattaccaagagacacttaattcagtataattattggctttaggttatagatgggttgcttccagccccaacactttcctatgaaggagactgttacaaataagctctttctttctttctttctttcttttctttctttatttctttttctttctctttttctcctcctcctcctcctctccctccttctcctcctcctctccctccccctcctcctctccctcccccccctcctcctccttattcttcctcttgcattaaggcagcttttatgtgccttagtaaagatgatattaatatttaattatcattagtggccacactgaatttatacattgaaataggatttttccaagtcagattgtgagaacgtttgcccattttctctaaaaaaaagactcctcaaccaatatggtgaaaccctgtctctactaaaaatacaaaaaattagctggcatggtggtgggcacccgtaatcccagctacttgggagactgaggcaggacaatcgcttgaacccaggaggtggaggttccagtgagccaagatcaccccattgcactctaccctgggcaacaagagcgaaactctgtctcaaaaaaataaaaattcctcagctccactaaaggaggaatacatgtatatgtgtatatatttcatttggaaaggtatacccaggaaatcaccccactggggaattgtttataggaatgatttttctttacataaatcatcaggagtggtataatcttgcttctgtcagacaaggaccatctttcatcaaatgtctcataagatgtcttttatcagccctgcacttgcttgactttgtctaatgtcagagaaatataaaagcccaagtctgaagacaatttcatgacaggagatccccaagacacagagtataaaaatatttattgctactttgttcttatgtgatattctttctgtttctatttcattttttaaaaatatataatttatgtattttaggtgcaaactaaattcatgcgaacagtaaaaaaaaataatctcagacagtacaaaatgatgaagtaggccaagttaacttttggtacatttttttcttttgagttttgtattaggactgattgataggctttaggttttattatctctgcagaggtgggatgaggcagattcaaaggatgttattgtttcaataaacctttttaagaatagttttagattcacacaaagattgtgaagatactacatagagttcccgtattgcacacccaatttcacgtattcttaccatcttacattactaatgcactggtattacattgccacaactatgaaccaatttggcaattattaagtaaagttcatttatattttcttagtctttatctaattttattttcctgttcctggatcccacattatgtttagcttttatatctccttatccccctctgggctctgactgtgtctcagactttccttacttttgatgactttgaacgttttgaggagtcctggtcaagtatttttcaacatgccctcaattgggatttttcttatcttgttctcatgactataatgaggttacagtttttggtaaaataccattttcatccaatctatttattatttcaatttgtttattttaaatttgaaaaatagaaaaaagcttatataataagatataaagaaagaataactttttacagctgtgaaatgtgtttgcgttttaagccaagtgttacaacaagagagttaaaatgcttaaagaagtttacaaagtaaaagaattgtagtaagctaaggttaatttattattgaagaaaaaagctattggctgtttgtattctttaacatgagtatctattttgtaacaatgtacacttgactctccttatccatggttctgcatctgcggattcaaacaaccatggatcaaaaatattaaaaaaataaattaattaaaagacaagaataaaaaatatcaagagcaaaagatacaatatgacaaatatttacatagaattcatgttgtattaggtattataagtaattggagattatttgaagtttatgagaggaggggtgtaggttatatgtaaatactaccccattttatataagggacttgagtatccctgaattttggtatcctcaggagtcttggagccaaccacccacagatacaaagggatgactgtaataacaatagcaatactaaaatggcttcaagatacacacacacatacacacacacacacacacacacacacacaaaagcataccccatacatatgtaaagttattaactgtaataattattaactgcaataaactgaacaaaaaatgaaataaaacaaataaaagaatatatgcatttgcatttgtatgtactttggaaggacacataagaaactaataacaaaggtccctgctgttggagaggtgtggcggggtggagatgagaagcggagacgtgtgtgggagagagcttcactgtgcttgttctaaaaatgttctgcctttcgaaacacaggacaattgtatctattaaaaataagaaaagaaataaataagaaaagaaataaaatttgtgaaaagtattatttgaatgagtcagtgactcttcacacaaaaagattatagctgatgggcccactgaaacttagactaaatctgtgaattaggtagatgtttcttgctcgccagtgtcagaaaactaacccaaagaggttactttggttaacgggtgactgtgttgctcacgtgatagggaggggcctggctccaagcctgccagaagcgagatattcaagtttaatgagaacgtcctgcatttgtctctccactgtgctgctctatgaaagtctgcagggctggaagtatggctgatatcagctgaaagagatgatgaaattaattaatatctatcaactggaatgactggatacctggaatggcttaaggcaggatctgacaaatagtgctatgcaaagttagtaatcaaaggcaaagtcatagttgtagtaataataatacaagcttttattattagctgatttgtatgattggattgttttgaagactgcaaaaagtttgaatcccacaaaaatattgagactgggcaatatcagattgctttctgaaggcaagcattaaacgtagcagagaaaaactgattttgcaggtaacataaagtaaatatgtgtcagagatgaatagaatgacatggaataatgtaaaacaaaacataaaggaatacaaatatagagaaatgaatttgtatattttgaatatgttagcttccaccaataactggggggtgggctcttctaaaactttctgaaattgattttattatcttccccttttttttctctaaaaatacacttctaaattttattttgtttctcagttattactattattaattttgagatggggaggtattggaattccttagactcatgtctctatttaatcctcccagattagcagatacaacctgggggagatcaaattcacaagtctgtactgtatcctccctgctttcctgtgtttacctggagaaggtgaccttgctggtatcagacagaatctgatacagaaagattgtttgtatgcaaaggggttaaaggacttagagacaagaagcaagaagtgttttagtatagaccattagaagaccctgtctcacaggatgcaggaaactttcagaactaaggtcccctagtgcccactggctgctttgactatgcatctcaccgacatctgaagtataattattgacccctgtcctaacacaatgatcttgagctgactgctcatcacaagtatccaaatatctactcaacggaactgaaagtagaagaagaaaataatagtcatgaaagctatgctttacaagcagtccaggaaagcagatattcacacctatcatttatgatggaatcataatctatagaagtggaacatggaatctgtatttttatttattttttatttttttattttttttggaatctgtatttttaaaaaagactccaatgtaactctaataatcagccactattacatattttcttaataattagttcccagatgtttcataacctggatcaaccttactgaattttataaacttcagctgatgacactattcagaaagctcctcgagcctaccttgtttcctcttccttctcctttctcatgacgtgcaagtgggttatctgaacactgcttttacttagaggtaaagagtttttttttttttttttttttttttttttttttttttttttttggtgcttaagaacatgctttctcatataaaagccaaataagaaaaataaatggcttttcatgtttgcgggaagtgtacatgcagagtattgcagtctatagagtcaaagatacagtcctgtaattgtgctctgggtgttcaggttaagccagattgttctattgaatcttaaaattttgatattaacaacagatgcatttgcaaggtcagaagaaatctaaagaatgaagttggccttactctctgaagaatgcatggattcaaactgagaggagggagaaagaaagataatttcacatggagagaacagcctgaaaaccatgagtgccaggagtgcatgcagttgtttttagtatcaatgaatcaagaaattgcatgcttgataattaattttaatatatggcaggaagtgatatgtcatgggtaatatgaaagattataaatttgatttaggttgttgctaagttggaggtttcactggtatattcaagttggtatgattattaaggaagtaaaagacaaaacaatgaaacctgtgcaaagtgaagttggggtgagcatgtaggagatagagcaatgaacattttcgagttatgaggctggaaaatgaatgagtagtacctcacttagtcctcacaaaaatactagttatttttaaatgaaataatggcttcagaaagattaggaaacttattcaaggtcacacagctagtaaattggtgagattgcattctgtaattccattcttggcaccagaagttctgggagcagtcagaattgcagccagagaatgaggctatgcccatatatgactactcaacttccctgaaactgccttggaaaacttcctttagtatcattttaaaatgaaaagtgctttaaaatatgcttaaatggtctttgaacaagagatatttttaacgatcctatcaaatttgcgttaacgaatctgggctgcagagtaatgtcttcttgcttaagatatgccatgttagtacctttcctgtgaaaagattggttttcttctccagggaagaggaattgtgttatttagcataaagcatatcataattcatataagataatcatgttggacataacactaaggggtttcatgctcttttaaactatgaatgaataaaaatccagttcaagttctttaaaaagtaaagaggatacagatggcaatagaagcatggcagttgtagtttgtagcttttagtgaagaaaaagaaaaacaaaagctacagtgaattagtcgttgtaatatacatttaagctggtgacatatttgttttcccctaaagataagtattatctcaaaaataataagacagagtaaattgactattgtttaatctaaatgttttctttatacgtattctgaaaacatggtgttttattgatttgctgtgttcccttagtgggtgaataatatggtggaatttacctaataggacataatctctcataataacaaatttctgttcaatagagctgcaagcagaaaaaaaataataaagtgcatgaaagctatgctcttcccacaaccagggctgaacacattactaaactcaatgtctcaactaaaatggtctctcaaactcctaagattcctcctggagtgagcaaatgcttgtataaaaactattacacattgaaagaactgtggttaccagccttctctttttcaattcctcacaaatagaatactgatgctttgcaaattctcactctatgtctaattaatatttaaggtcaatattaattgaccaattgtttatccaatccaattaatatttaaggtcatgtcttgatcatgacatgatcaagttcactcatatatcaccccacccacacatgcagacacatgcacacaaacataaaagcagcaatacatgtttcctactaatattattcaaaaaaaccagttaatcctaaaaataaaattattaaagttacaaactgaaataatcacataaactacctaaactttaaaggttaaaagttgaggtatattaaatactagtaaaaccagtttgattagttttactagtaaagtcagttttaatagttttactagtaaagttatactagttttactagtttatatgttgtcctaaataattgtcgacatggtatggaacaaagaaaagagcagaacaattattgaaataagaatattgcagcaagtaatattccgtgtctaaaactccatattactttcccgacaaatgaggtttgattaaaataaaataactaaaataaagctaaatctatccctgtataattaggaataaggtaaaggtaaacaatcataatagcagtcagtatttattgccatgttattatgtgccttatatatattatatcatagaatgtttttaaaaatatatgagacagatgttaatatttttctcattatacagatgaggaaactgaatcatggagaagttacattatttgtctacagtcataaaaatagtacgcatacttcccaaatcagaagacataagtaggaagtaaaatgtggtcaaaatagcaaaacatagcaaaagaaacctagaaactaagaaagagcaaggaaacattctataattaaaaactgaccatttgggtctggaatatagactaacaaaccatatcttaacatgctgttgataggtgaagtacttaatatattgacagatttctcacttcataatatttttgaaaatatctatttcaagataattttgaataaaattggaaatcaaagactttgccacacacaacagtaatacttgcttactttctccactcttcttaaaactgattcatcttctagattgttactctcagcctaccagtgcaatcagatctttcattgagaaaatagataatgccacagggaatttgctcatatttcagcagtagatctaaaattctattttcatgtacactcatccttccttcctcaagttttaacagccctattgtgaaaggtgaaaccacctactttttgctttttcaggaatcccagcccatctgtacaaccactgtgtgatctgagtcttcagccactgtacctccttggcatgctgccatgttctaataatgcccatcatagcaacaatggcagctacaagaaaccttgctggatcccacatgttcttacagatatccacccccagttctcttttcctttaataaaatttcttaaataaatttaaaaaggaaactacatgtagtctaattcttcaactcccattctgtttagtccaagcttttggtcatgcaactatgatgaaattgttatttatcattaaatgtaattgatggtttctaagttctcatgttgcatgactactctttcagtctttgttggataatctactttgtccatttcgctgctttatagtgccattcctcaggtctccaccttgggacttactttcttctcattttacattccgtccctaggctttctaactttcactacatcaaattagaagaataagactcaaggctagattaggtcctggactaaagcaatgttagtaggattagagaataatggagtgtttaaaaattgttccaggacactatggaagtaggagtgaaggcaaaacaagaatctaagataaatcactgttttccttttggtcataatttctgagagctgtatcgctagaagaaatttgcgataaaaaaatgatggattcagttttagatatgttgttaatcttgaaggaattagatagcactaaccaactatgtataattgttttagtgggttttgcctatagagaattacttacaacacatcatcaatgatcataaaaattaattaagaggctgaaactctcttcccattaaaaataatagagaagtatgcttaagcatcaagctggtaatactgataatatgcatttatattttaatactataaaaaactgtgaatagtgttattgcactaataaaatccaaaatcattgaggcgcaaaagtagctagaagcagttacagcatctgaattctccatttcatttcacccgttctctggaggctgtgaaaattagggcaaactggtaggacatcacctaatgcatctgaaattctttttttgcattgaaattaaactggttatatgttctgatgtaaaattatgagttatttcaggatactgtgcaagggtctatattccactgatcctataagtacaaaacataagtagaagacactgatgaacacaaaaccataagagggagagtgcttttgagcagtctgtgaccaggttaagaaaaaaagagttattccttcagcaaaatgtggcatataatgtgtgatatagcaaaacaaagccaaaacttttatggatgtacatacctaagaagagatgataatgctttatttaaatgtatcccaaaacctagcttcaacaacttgagaaaaaaatcataaaaagtgatttaaaaatgcatatgtctggctcccttcaatccagttggaattaaaatagaagaaagattgagtgcatccctgggtattatgtacacttgaggacagatgtctagtttattttcctcctgagttctaataaaattactatatttttaaaagagaaaagccatcatttctaaaacatcacaagaaatctaaaggcacactcctgggcgtaaaaatgtacaaaaccagcttgattgaagaccccagacaccaaattcatttcaaggaaaataaggaaacagggtaaaataaaaataaccaatatcaacactgctggcaatgcctggcatggagcatttcctttgacttctctggctttttattaaatgctttggtattaactgtacagtagaaaataatgcattaatacactcagcaaatgcttatcccagcagggggaatgaaaaattgtgttttttttcccaaatgtcaacattcccaccttattaaggtgagccataaagaaaatacagcagtcttgccaaaatggaaggcaaagagaaactcaccagtgagacacctctctctccctgttcctcctggggcatcctcattgcatcatatagtacctgacgtatgttggaacagagtccaattacttctttagagggatactaagaaagttaatctatgtttgttttggaaaatagtggaactgaataaatgtttattgaatcaataaaaataaaacaaaccaaattgggcccatgaaaatatttagtaaaattttatagaaaaaatatgatattccagagtcgaacagagatcctatctctggaaaatatttactcaagaaaatccatttcttttttgaacagcacgtgccttgtgctctcaaaatcagtcatataaattatgaacttaataaaattagagctaaaaacaagagatactaaggcctgaaatgatggggaaaatgtgttgactaagaaaaaagcagaaatacaaagacagctagatattataataaaggaagataagtaaatgaaaatattctagcgaaaacagaaataaacataaaagaaaatccaactaagaatgtattagctatcaaaaagaggacaagagagtaaaaagaaaaaatttgtgtttcctaaagaaaaaactagtaatgttaatgaatcacaataaaagaaataatagaaaacaaacaagatgaactttatttagatgaagaaaaccctgaactttcagaggcaaaaagctcattatattccaagtgagctaaaccaacatgtaaaaaaacactgccactctgaggaacaaaaaataaaatacgctaaccagaactggcttagcaaatgtagaaatcaaggacaaaggagaaattagttaatactttgcagaaaatataaataagatcaagccactcagaagtgagagacaaactatgtggtgaaaggaggttgtacctctaagtctgactaacttcagagattgagtttatttattatttatttatttattattacatacctgcccattggcctaaggggatttgaaataagatggtcagtattgttgaactctttctccagtcaagactttacccatataaaagtaataaaattatttcagttatttatgaagcaataaaaaacaatgcgcacaaaacctttctaaaatgttgaaaaaataatatactttaaggtagtatttaaaaataatgcattatgtccaaaaacactacaggtaaaactagtaacacagaaaatgagagaagcagatattagacaaaataaaaagggttaatttcatcattttacattgaacagaaagaaaagatcacatattaatcttgatgccatgattacatatagaaatatgttgatatcaattgagtatattgtcaaattcaactaatattttgaataaaaattgaaggttactttctattacaaagaataaaattagcaataaagattaccttatatcccatctactttcaataattagtaaaaatgaatttgcataaaaagcaatcagccatgaatacataatcatgtagaaatcatgaacacatacaatgagacaaacctttgttactcattatttatacctaacacacacatacaaacacattaaaacagtgagttattcctctgagtatacaagcaaaattacatttttattaatgcagtaaggataagtcatttgttggagagcatttagttaattatcaagaaaatatttagttcaatcctgacaatttctgtatcaaaataatttccacgtgaatcacagcattatatgtaatagaataaaaaatttgacaaaccacaataaatatttgtaagtgttcttccgttcattgagaatgagagtcaagttcttcaacaacaataaacaaaataaaagcataagagaggggattcactgattgttttagtgatatacacattaagtcttctagatatcaaaaaataaaagtcaaagagcagagaaaatgttggagaatgtttgccatgtatatgttacaaatattgttaaatttagataaaatagcacttaaaaataaaacataagaacatgcatgtattactttctataatacatgatgcatgtcttgttgttttaataaataacattataaaccattcaacttcaactcatttaacccatacagaaaggctgacttcagtgacagagagaaatttgtgctcacatgtgtcctgtccacaggacatccacctgggtaatctgattcttatctttcattgtctttgagatattttaaaactctttaagttgtagatatctcatagtaacataaaaataattcctatctatagacatgcaaatcgtgtcttgtctggtagaggttcaatagacttttttcaacaatctattaatatctccaatggaaagcgtgtttgcctccgtttgtataatctttcaatattcctgatctataaatgtgtgtgtgttttgcattctctttcgactggttgtataatttgcttggttcactcataaatgcatgaatggaatacaatttttaacttgtgtttgtatctgcataattgtcatagaatgcatataaatatgttctccttcaggtgttttcatgttcaaccaatgaattatagccatttaataaattcttattttgagtagcacatatacactcaatttattaaatgagtcagcaggctactttattttgaatattgcttatgtgtataacactaaggaaagagtaggcagacaagagcaaggcatgatatctgtcctagaggaagagagaatctcattagggccttaactatattttatgtatgtattatttgtatatatttggctgtttgtggatatttgcataataagcaaccagttaatactgatttgaaacaccgcaaaggagtgttagcaatctttcatgggattccagaggcagataaagatgactgatcataggaaatatctaatggtaggactgtaattgggagtgaatttgacagtccatcaagaatgaatagagtttgagtgaaagcacaggatggaactcttttcaattagagaagcaatgggaacaaaagtaatcaggacagatttcacagcatacatctagtgaccatcaaatgacacttcaaatgtaccaaattcttccaattggggtactgcttatttattatttactttatttttaaattttactaagcatttataatgttctgggcaactttttcaagtgctgggatacggcgatagaacgtaaagacctagagctcagtctcatagttcatgctctagtaagatagataaggggtaaaatattttcatttaatgctaaatgtgattaaagttagaatggaaggaaataaagaggattaaaaaggaaagaaacataatctgctttacatttctaaaatagtcttctatatgctgggtggagaactgggctgccaagagtacaagttaaagcagagaggacagttaagaggctattcaaatagcctaagctagagataatggctggttgaaatattctgacagtagtcagagtgcagggaaatggtgtgattcaggatatattctgaatagagagggaattgatatactgacgaattggatgtaatggagaaagaaaagtattacaaatgatttctaactacttgactcgagcaattgtggggatggagttgtcatttactgaaatggaaatgattaaagcagatgcggaagtgaggatatctgggggtgatagctatggaagcaagtaaaaaagtccattttgtatccatttagggtaagatgatggatagacagctaaatagagatgtcaagtagactactgaatatactaaagtgctaagaaaaaggcagagctaaaaatgtaaatggggacatatacattgtgtttaaattcatgagaccgaatgaggtcacttagggagagagtgcaaaggtcgagctgcagaaggtttggaactgagcctggagcactaaaacactaagaggttagtcaaagggaaagtgctggaaaagaaaaatgagaaggaacaagcactaagacaggaggcaaaacaagagattatggagttgcagtctgtaagagcagaaattattttacaaaagacgtatttaatttttctgaatatatttttacaaaccacaaaagcctgaacattgggtttgctaacacgaagtaactgatgaccttgataaaatagtttcttggaattgaatgaatagaattacacatagaataatagttcaggagacaatgaaaaataaggaaggcgagattgtatatgagcgagtattttccataagatttgctacaaagaggaccacagaaatgtcatggtaactgtgcagaaacattttttcttaataatgaatatatcagatcattatcaaatacaatttttaatgagacaaagaatttaacaaagctaaaggtaaggattataggaaagccaagaagtagcttaatagagtaggaaagaatttagggctaggaatgagaaacagctggttttgaagctaggcatcatggcatatcagctgtgtaatcttaaataggttatataaacccttatatatgatctagttttgcataaaaggaaaaaaataataaagcttgacactattaagggcaacactgaggtactccctaaggatttaaggatttggaaagtaggagaatcaattgtctttgaaatataaattgctacatagaaaaaatacatatatatgcaaagagtggattttgaaatttatctgtaagtgacaggatagctaaaaagccagaaggatttaggactactttaaatgaacgacattaagctacttaaggaaaaaataataaaaacactttgtgccattcagaagaaaggtttggtcagccataaaagcagaaataaaaggaaagtcaccaggaaatatgggcatcacactgattcaagtactatacagcagagtgtacattaaccatcctctcaaaatatcttcatctcctaaggaaagcccatctctggaataaaaataactgtaaagttctgtagccaaagggatggagatttccatttgtggagggaaactcatcacaatcatgagagtggcttccagccatctcagacaggcacattaagctttgattcagacagttctcttgttttgtttccaagctcacaagccacccttgtgcacgtccttctcgtgaagagaatgtgctgatgtaatggacttttgagtatttctctctcctgagaccgttagttctcatggtaaatcaataaagtggtttctgattttgacttggcttcttctcatagtgttagactgcagaggagataatgtgctggccacactgaagttaagtatttccagtccctatgacattattttccattgtaaaataatgaacagaaagttggtgtatggtacagctctgtggacattttagatagcaaggttagtctctcaggacctaattatttctgagcacatgaagagaaagatttggggtctttaaagagaagggtcaaacgccaggggcctttgcagacaaatttcctaatggttgtttaatatgttattcagtagatatgcattgatggttactaagcgtttgagtcccccttaaaaccaaagcacaacatgctacactgtttcctgtgaatgcaactcagatttaatctgaggaccatatggatgctggaaactacacataatgatgactctatcttaatgaattgacatgtatttcatagcattgaaacatttcttatctgattctgagaatgtgcaattcaaattgaccaaacttcaggttcatgtagtaaagatgtatatgaggataataaaaacagtcaacttatttcttaaattgtgtttaaggtcaatatattgagtactgataagattacaaatacattgctttagtttgaggcaatgccaatacctatcaagatactacgtgcttatggttgttttcctctttcccatcatgtctgattttaaagctatttcttctagggaactagatggttataataatattattgctaggaatcagaattttaattttccacagttactgtttctaaaaaccattgtctggtttgggaagacaatagatgaaatgaaataataattttcaaaatacacaagaaaagtcatttgcttttactcttgggaaatagtgatggaataaaagatgtattgcctatgttgaaaaagtattgcttagcgtaagtgtttacacactgattatgcatttaatgaaagacagaatcatttatttggtcacttctttgttactatcaatttttgaaatagaattatctcctgtgaatttcactttaacattgaatgatgtgagggtaagtgattgcctgattgcctaagcatgccgtttagggcactactgggttctctaaagagttgctgcttcctccaaaattgcagtaaagtaggaaagctcttaaaacttcaagaggaaaaggcttcctccataattgcatcttatttgggccggaatcctatatgtgtagtgtctaaaaatgaagcaataatatgaagtggaagcaatatcactgtaatgcacatttcaaagagactcagtgctaattctcttgacttcatgtgctttgaagtgttcagagaatgaaatggtgacacttgtaacgaaagcaaaaaattccttttcaagtgttagtgtaatgctgccctttgagaaaggataagagaaatgtgtataggttcattagaaagttaacagtttcttaccacagctgttaagttgtgggtgacatgaatgctaggtacaactaaatttttctttgtgtttttagaaacagttagatctttgtttctttacttgaaaaggcactttaattaatgtgagctcatatgagcacagtgtgcctcctcacagtagctaaaaacagattcatcttctgtctcccagcttcttttcactcagtagctgtacaaaagcctagcacgaaactcattaattaccccaatccacctttacagtcttcttagccattcccatctttaatcctggctgtacatttttctttaatctctgatccctaataactaatcagaaattaggccttgacatccttctgtaatttcataccatgaaatatcttatattcttccctaaatcatctgctttgagtagcctagctctgtcattattctagctgtgacccttcccatgtgaccaggggtatggaaccaagggaatgtccctattcaaaacctgtggtgtccttcaagtccacagtcttagacatcaggatttgcattttctgctcaaatgttcccaaagtctgcttccacttgaggctggccactctggagattggccacacagacttaagacataacccaagagcaactgttggctgggtaatgagataattataggcagaatttaatcttagttgagggtgtccatacacatgtgtataaggctcctcgagtgcaggaagaactagaagtaggaaaaaaaggggaggagatgcaaggtaagtgtatccatttgtactcttgttctaacccacaaatacaaagggctcccttgcctaaggattcggtttaatcctactcttagctatctttattgatcattttatttcatggagaagctgcttacttatgaccccagagctcttataatctgcaccacatctaatctctaattacatactgtcatgtaattgccttggattggttagggcttcccctcactctctgtaataacatgtaaaatggatttatttttactgcttaatacattgctgtgcataaattactcagtgcatttttgttaaataaatgtatgtggaggacaaggcttatatttaaattaatatgcttccctcttcaattttctttgggatgttgatattatttatgtgccttcagaatgtacaagcaatgtattctggtgttttagcagcttcttgctcttctctcccctaaagtgtgagacctctgccttgcattttaattcatcagggttgtggaaatcataaccgtcacttagacattttgaccaaatttattctcgaaataatagaattatggagagtgaagaaacatgcatggacatttagtttaatccacctttttctttggcagtattccacaacatctttgacagatgatcaaagactaattgcccatccaattaaccttagactaccaacagggtgtattacagaactctgagcatctttaacatgactgatttataaaatgaaccttccccaacagaaaaaaaacacctcatcattttacatgtcagaagtaacagtaacctgattaccagggctactatttttttcacaggagaatcttagcaactccagattcttccatatctatagtgtaagatgttacattttccttaccatcatcaaagtattcacagttcaataaaactataaaatcttatctttaagccagttgtttgtactctacttttatccttaataactatatgccttttctttaaatatctacacttttttaatctggttattagcaccaatgaaacacttttaaacctttttcaccttctgatattttatttttttaatccctgtgaagtagtggaagaataagactagaaagacattttatccctgcctacctttttgctgtgtaaaataagttgtctatgtgtggcagtgtgtgcgtgtgtgtgtgtgtgtgtgtgtgtgtgtgtgtttctgcactagtgacccagggagcataacagtgaaatggaagtagaatatttgcatcttttagtttctgaaattttaagattttatatttatattaaaattaaagtctttgtctcaaaattttaaattaccattaattatcatcaaaatgtctttaaaacaataatgttataaattaacactggaaaaacaagaaatggggagattgtgcttattttaaaaaggtaaaaatttctatattaaacaatttaaagtagagcaggtgagacattggtaaaatgcacacaatgttaattccagtttgtctttcagatccaaaaatagctgttattatttatctctgacctaataaagaaaatatgaaaatataaacaatgccatgcttcaaattatggtcatttttcaaaattatacaggttttctgtggttacaacttagcataattggatttgaattactaatcaattacttactcttaagaatatttgtgtttgctcttacaaagttaatgatgatttacctcctgtcttgttttaaggtgatgctgctagtagagattgcctttctttaattttatttgtaattttgaaatactaagtcatggctaacaatataatgaattctgagtgtatctatatatgtgaatgtatgtgtgcatatgtgtgtgtgtgaaatgaacaaagacacaaacatgtatagtgaatataataaatacatatagactttgcaactacaggatactatttgtaaatttgatatttctgctctgtagcttcattggtgtgtgtgcgtgtgcacacgctcgcatttgtgttttgaaaataacatgtctccatggacatcatattgttgactctgtgttctacaccacctggtattgctttggttctttatctaattttgatactcacttaaatggtttctccctaatgtttcctgattactctagctttgggttgattctccgtttaattctatagcacatataattccaaacacccaaccatcagcctataaaaagatgtatccctagatatctgattattcaatatttcaacatttgctgtaatgacttgaaatggtttactccaaatccataaactaaattgaaaccatggtgtaatgaatatgttcacacaccagtgaaaatgttggtatcagggagaaagaatattagaacactaatatctcagatcaacccctcttatgggatcctactgttgtcactaacctctttcccatccttaatgagaatttagctttttttaaaaaaaattgtatgtttatatttttgtgcagaaggaaatataatctatatttgacgcaatgtagtgtttttgtgttctgcatacccacatacccttttggggttactaaatgttaaataatgtgataattggtgtcctaaaagcagtatcttctccagaaatcatcaatacattgttatactgattgttaaaaatattttaccaatttttatgaagatgccggatacactggaaacccatgagttttttccatgtaaagtaatttaatgtaggctcctactttctgaacattcactctataatacactggcaggaacaaattagttttgatacttagagatgtctgtattttattttatcttatttgccttgtttagcatgtctgagtttcctatcaccaatttgattctaagcaatttggaagtttgtcgtaggcttctttgtatccttagcgagcctagaatatgttgaatataaagcaggtgcctttcacatgtattcagattgattaaaagatcacacacacatacacacagacacataaacataagtacttctctggccaccaagtgaactgcacatgctgtgatttcctgaagtctattttctaacacacagtttcagtgcatcctcgaagggctttttttttttttttttttttttgtctacactgcttaatagggtagagatgactaatactctttaggtcctaggtaaatatttcttgaggatgaatgaatatttttatcttttctattagagtttgcattttctcaacacatatccagtttattaaagaaagattgttaaaatgagcttatctccatacctagagattgaatctaaataacattctgatttccataacttgtcatgttaaccatagcttgtgggtcaaggtagtaacattaattaaaagccagcgatgacatttctaacgtacctaaaaacttctaaaacaaagagaactataagtttatagatatgaatgatgacagctagattagggtgcaaggtttgcagaggaaagctgtggaggactaggaaaagtcaatgaatggaacatgctgactcgtgtaacccaggaactacaggacccagaggaattatgctaccaaattgtccatgttgagaaggagagtatggcacactagacacacttttgcactattagcaaaactggaaagttagaaagtagaacatgctactttggtgggaagagtgatgttgaattgtttaaagcttgcaatgactgttagctatttacatggaactgtgcgtgaaatacaaatctggaacttgggtgagtgattatggttggaaatacaggtttgggagttatttgacataaaataatggttgaaaccatgaaagtaaatgacctctgcaagggagtgatcataaagggtgaagagttttattttaaagctcctattttcctttaaaagaatcctccgtgacttatccatctatatccgtgctgcaaactccgtgattgtaaatatgccatttgtcctccaactttgtatggatgttctgagaggtcagggtagctgaatccataaatttatctacactaaacatattttatctcagctctagagaaactagatataaagaaagttaaaaatacataagccgtcctaatatacaacagttttcaaacgcatgatggttgggttttaaaaaccagtagaaaattgatggttcattttctcagtttaactaactgtgtatcagaatatccacttataaatttatattcataatatattaccagtaaataatataataatattgtaagatatgacattaataaatacatatttgtaaaattctaaattgttattctttaaagttattttacttcattatgacttcctaaagaaatctcataattgtaaaatattctacatgctcaatgtaaaacatgtgaaaatgagacaattttaaattagtaaaacttaaaatattttttcttagagaaaatagcaaaataatattttaatatgcatgtaccttatatactgtgctatttaatcacaaataatgaagacaatttatgtattttctatcttaacttttcccttttccctaatgccattaaatatccttcatataagcaatttttaaaaaggatgtatattgtcctattgaatgataaccaggacttagtggagcaagcccttgtttttcatttatttattatttatttatttatttatttatttatttatttattttgagatggagtcttgcactgtggccctggctggagtgcagtggcaccatcttggctcactgcaacctctccctcccgggttcaagtaattctcctgcctcagtctccctaatggctgggattacaggtgcccgccagcatgccaagctaatttttttttttttttgtatttttagtagagatggggtttcactatattggccagtctggtctcgaactcctgacctcaggtgatctgcctgcctcgtcctcccaaagtactgggattataggcgtaagccaccatgcccggccagagcatgcccttatttttgtacttagaggagatttcaaaatatctgttactctaaagaggagatttcaagatatacgttactctaaattattcttcaatgagaatagctcctttgtatttgtaattaagtatgtttaagatctaagtacaattagaagtgtctccatcccatttctgcttgcttcatttgacaacgtatttatattttctaattataatcatattttcaatgtcatttagataatatgccatttgggatacaaatgctttctctaatccttggctcaaactcttattcaaagattactctttatctctgagctaagatttgtgagaatataaaaatatctagtttgttagcttatacttttcttgaagaaatgatacacatagaaaatgtatagatctctttggaaagatgattcctacataaaattcactcaatgaaaatagaagaaataccagggcatattatgttatgcaatagtacttgaataaatgccaagtgaaattttgtagaccatgaccaagaagagtttttcagaagactggaaaagtttgatcttccctttagctctacaaaagttaataagaagacacatcaaaatccttgcagcctaactctggtttccaagatacattccatcaagagagatcatccccatggtaatatcataaggaagacataagaccaatagcatccgaacatttgaaagaatcattcttttgtttctaatttattctttgtgcatgataatgtatcctcaaattcagaacttgatgtgtattgggcaagtcacctaaattcccaaacagagctcattctttaaagtataatgaataaaacttattaaattgtacaggttaagtatgtatcccttaattacacccaataaagttaaaaaaatatatagccctgagagaaaaaaacactaaatgaaaactaatgtgagtgtctggctcctaacatatgcatagatttataaggtgagaaacatcatgtttcagtttaaaaaagaaaaacaaatacaactttagtttatcttaaattctaaaatcaatggtgaatagtaagagtaatacatgtgacttatttgtgaagatttctgatttattcttgcatttagagaaaggaagagaactttctgactaagaaatgtcatttatattattttagagttgtaataatatattcagctttgatcatttgaagcaaaataaatgctctgatcataagtaaaacctctgtcagaattggtctcaaattatgggagtgttttcctgaaagaaagctcaatgagaaaagcaatagcaaatgtgtttggtaacttgactatttgcacatttatttaggtatatatttctttatacatccacctgtcacggtaaggtcacttaaggaaggttacctcagtggaccagcatcctatttaaaactatgtataaactaacatacaagaaaaataagtttcactgagacctatcagaaaatagattatgaatatgagtgagaaaatttttcaaaatattttggagtgaataatcatgtgaaatccacaggactattttaatttaatattatagattagcaacgttcttgaatttctaaatgatagtagaacctctgaaatcccaggggatatttcttttttcccttggtactaagtagaagagtatatgtcacaatgttgggaagaagttgagagaagtcaaaataatcagaataccaatgactctcttccttgcccaggttttctaaggtgtatttgaagacagttttccagtctcaagatattatagtatgcggtaaaaaaaaaaaaaaaataacagtgaaggaaactacctgaatattaattcctttttgtcagtagaatattagtatattggttggactttggcccaatcacatatttttttctgagcctcgatttcatcataaacagaaaagcaagacctaatcaagttttttttaagcttgagacaagttatttcttggcatattgtatttgctcaacacatattatctttcttctttcttgttttattttgatcatgtctatgccagcatttgcaaatttccactccgggcattttttcacactttcctgtgttatttctcaccttcgttttctttcatatatctctcttctcttgtccttcccccacccctcgccatttttagttgtaaaggcagtaataataatattgatgataattaacagttaatgaacagttatacaacaaagactgtgctacatgctttatgtaaatatcacttaattctaataacattttccaataataagatctatgagggaataaaggttcagagatgttaattattttctccaaatgcacacatttactaagtagcacagctgggatttctattcacattttcagaaccaaaaatatagccaatacagaacagaatatatttcttaaagcctaaaaaggcaaagagaagaatgtaccttggggctagggcatatgtatggctgtgagttttttaggccggtctaagagaaattggtttgtcttttcccttatgttacaagaatattttcacaaaaatttagttactacagttaatcaaaataatttatgatatcctgaaatcctcatgttgtaagttactcaaatattaagttggaatcattctgtcacctttggattcctcagaagttaggcaattataagaatggaagatcctgttattggtctattcagagattcaacttcttcctggtttagtcttgggagactgtatgtgtcgaggaatttatccatttctgttagattttctagtttatttgcatagaggtgtttgtagtattctctgatggtagtttatatttctgtgggatcggtggtgatatcccctttatcattttttattgcgtctatttgattcttctctctttttttattagtcttcgtagcggtctatcaattttgttgatcctttcaaaaaaccagctcctggattcattaattttttgaagggttttttttgtctctatttccttcagttctgctctgatcttagttatttcttgccttctgctagcttttgaatgtgtttgctcttgcttttctagttcttttaattgtgatgttagggtgtcaattttggatctttcctgctttctcttgtgggcatttagtgctataaatttccctctatacactgctttgaatgtgtcccagagattccagccatcccattactgggtatatacccaaaggattataaatcatgctgctataaagacacatgcacacgcatgtttattgcagcactattcacaatagcaaagacttggaaccaacccaaatgtccaacaatgatagactggattaagaaaatgtggcacatatacaccatggaatactatgcagccacaaaaaattatgagttcatgtcctttgtagggacatggatgaaattggaaatcatcattctcagtaaactattgcaaggacaaaaaaccaaacaccgcacgttctcactcatagatgggaattgaataatgagaacatatggacacaggaaggggaacatcacactctggggactgttgtggggtgggggtaggggggagggatagcattaggagatatacctaatgctaaatgacgagttaatgggtgcagcacaccagcatggcacatgtatacatatgtaactaacctgcacattgtgcacatgtaccctaaaacttaaagtataataataataataataataaaagaatggaagaagaagaaaaaattggggtatgttcaaactattagtactatttatataaacaagtctcaaaagtctcattaaagtcaagaaattaatataaaagaggtacgtaatcacatatatcattcaatttacatcaccataagaaataattttggttgacttatactgaagcacattttcaactactttactctgtgaaatatttttgatagttgttttcctacttctaaaactataattagttaatataagaaggcttcttgcaagaagtttaatgtgtagccctaaatcaagaactagaaattgttgagtagggacaaataatgtaaataatgcaggctccagcatactattattaatgatagtgtaaaagaatttcaacttgcagaaacatattctgattttgttatctcaaatgtctttgtaatttacatttggaattcattttctgttcccccatcccacctctatttaatacataaagaagccaaaatgccattctctacttgaagttgctattaacacttactgtgttctgaaatggtacagccagtttcttttctgaatctctcctggaataacatccagaaacatgtaaaaatgcatttttaagaaattggtgttatttggatgaaatgatgctctctattttgacgttgaacatgggacatgttaataacagctcatggatggactcaaagagctagataaaatcctgaatttcatcttcgaaaatttcagatatttattatacatttcataattcgttatttaaggacactgtttttagtcacaaaataaacctaaccttccaatttgtttcagtttacataataattttgtatttactaacaatactggcaatgaaatacatgtgtctatttctcaatgaaaagaaagggaatgtgggtaccattataggagccagattacctcaagacctctgtaatgtaactattctgcactgaaatgtttttgtagcatttctcccaaggatatttaccacaatgtactgttaattatgaaactgttaaaaagagacaaattaagggacaacgtgagaaaaataagaagtgctctccaatgattgttgacaacagatggggagtcaatgaggtagagagatacagacattttatcctcaaatgacaatttctgaaagggaagctctgaaagcaccaacacaagattgcattcacagttctactcaggtgtcagaggggcaaaactcacagtagaaaggagaaaatgatcaattgttttataactgaaaatattttactgcccttaagttctctaatggtgatcttaaagtaacaagaaatcaatgcattacttttgctatatagtaatttgaaaatttacaagcaatatcttttctttgtagctaaatatttaataatattttcaaatctattaagcctcagttgcatatcaagccaacctgctagctcattttgatcctgtcatttctaatctatcattcttgtatgctggagatggttactcagaaaaagtgtcatgaaaatataattattcaaacatagcttttcccatatagtgaaataaattaccttatttgaaagcatgtagttttatatatcataataaatagatttccttatcaaataatagtttgtttatgattctaatacttttaaagaatttaggtaacatctaaatacaattttattttttttaatggtaaatcttgtaaaaatgcataaaaagaaagtatttgttccttgggtatgaggaagaatataaaggccagtgtcttattgggaaattcttgttatatcaaatgattctggaattcttttgttcacttagtgagaattattgggtgtctcctatgtgtcacacattcaatctggccctgaagacacaatgatgaataaggcagaccccctgctgcctaaatactgttctactccaagaaaagcctcctttagctttgttttgtggaccccaatcacagcatgcttttgaatatcattgttttcccttggaaaaatgaattttcttgtgaagaagtataacgtgaagacagggggaggggcttaattttaaatttattttagtgaaatgcataatgatcaacttggatttatttttttccccaaaactatagtttaaataaaatacaatgaaaatgcaaataggttctgaaggaagtttcaaatgtatctccacaattgtttgggtaaaagcatcctctcaggagctgtcttctacaaacctggccttttgagagcaataacagagctgttctttcccttctcttgtatttctgagaacatgcctcttggcacccaacaggtgtttaagtatccttgatggaaagtcagcaatcatctgacaaggtcatgaagcaaaatgccagtaaatagaaaaggttaatgtttatgtgcagtaaatgtaaaagtttagtcttcacatgcaaaagatagaatcattaaaggaacaaacgaagtcaaaaagacttaaaaaaagaaaaaaaggagaaaccaactgcttgagtttcacagctgccccgactacatgtgcaatcatttctccactttgtatgaacataggtaagaaaacaaaagagagagagaaagagaatggaattagtagtgatatctgaattcttgtttctaattataaatttacaggaaacaacaggtgctggagaggatgtagagaaataggaatacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattgtggcactactcacaatagcaaagacttggaaccaacccaaatgtccaacaatgatagactggattaagaaaatgtggcacatagacaccatggaatactatgcagccataaaaaatgatgagttcatgtcctttgtagggacatggatgaagctggaaaccaccattctcagcaagctatcgcaaggacaaaaaaccaaacactgcatgttctcactcataggtgggaattgaacaatgagaacacatggacacaggaaggggaacatcacactctggggactgttgtggggtggggggagtggggagggatagtattaggagatatacctaatgctaaatgacgagttaatgggtgcagcacaccaacatggcacatgtatacatatgtaacaagcctgcacgttgtgcacatgtaccctaaaacttaaagtataataataataaaattaaaaaaaattatcatttctctgaccatacatccaggaacatgtcactttcaatttactgtctttaaaagtcctttgttacactgggatgggaaggaaattgattactataaaatacttctaaatccttaaatttaaatgcaatataatttcactggttattagtattcaagacccacaattccagttaaaaatataggaggttcagaatcaatttggtaacctggagaaaaaaaaaaaaaactttactgtgtatatatatataaaagaattcaagacaaaatagacaaaaactccattagaaaaatgtaaaaaagtatataaaaatgaaagaaggcaaaataaataaccaataaaatatcaaatattcaactatactagaaactgaagaactaaagattttttaaaaagaggtattactttcacatatcaaatctgaaaaaactagagaggaagatgtcagtgaagctatgggacaatgggctcacacatgcgctgctcatagaaggcaaaatttggacatttcttgtgatgattaatttcatgtatcactagactgagctactggatgtccagagagctggttaaacattatttctgggtgtgtctatgaggctgttttccaggagtgactgaaatttgaatatggtaaactgagtgaagcagatggcccttcccattatgggtgggcaacatcaaatcagccgagggcctgaagagaacaaaaggttgaattaactctgcctgattgcttgggctggtggtttatcaatcttctgcaggcctcggtgcttctggttccctgcttttcaggcttggattagaatccattggctctctgggctctcaggccttcatactacaccgctggctttcctgacttcagttggcagatgacagatagtggaaattatcctctgtaatcatgtaagtcaatagcttataatacatgttttaataaatatgtatgtcacacacacatataaacatacatatgatgctctttgatttccattgtatattgaaaataccataagtcgaaaatgcatttagcacacctaacctatggaacagcatagcttggactagcctactttaaacatactcagaacattagcctactgttaggcagaatcatctaatagaaagcctatatattaagataaagtgttgactcactcacataatttgttgaatactgcactgaaagtgaaaaacagaatggttgcatgggtatgtagaggagagaattaacctccaattttctttttttaactttataaaagtttttttttgtttgtttgtctgtttttaagttctgggatacatgtgcagaatgtgcaggtttgttacataggtatacatgtgccatagtgttttgctgcacctatcaaaccattgtctataacctccaattttcttatgagtggcaagttattaggttatatattgctgagatccacctatattaggagagaatatctactttttgtaaatatatagttggagtcagctgtcccttctatgggttcagaggcaaagagaaatttatgtttcttgaaagaaatggtcagttatgctttgaaataaatggtaaggtttacacatttcggctctttttgtaaatcaataccttcaacattagaatgtagttttgcttgcttacatttccaagtgacaaacagttgatagccatcctcttttttgcatggttaggtaaatttgagtgaggagaagtagagaaacaatctacaaaggccagagaagagagaggaaacaagggaggagtcagaagatggtcagagtatggtttgaagtttgtccagggtctattcttttgtacttgagcctaaaaactgagggcttatattaaatgtatattccaaaaatatttaagattgacttctaaagatacccttttttaaaaaaaacttcagttatagtcctagactctctgttagataatatatatctaatttaattctcacaagtatttcaggtggcttttcaagctcatttaacagaggagcaaaaggtcagttgcttccatggaaaagtagggcctaaatcccagttctcattcatgaacaattggaaatttcaatgataactgaatatttcataataacaataaattatttttgtacatctggtaatagtgtgactatgttaataaaattaattcccatttttagaattacatgatggacaataaacagacaaaataatactatttctgggatatgttcaaaataatttggaggaagggagttggagaaggttgaggatgggccaggtctggccagggttgatggtagctgagtccaggcagtaaggaagtttattctacaatactacttatatgtatcttcaaaatttctcattatgaaaagtaaaaacaacatcaatactaggcctttttgtctccaaagcccatgctttaaaacattaatgataatttctttcttttttcattttttttttttttttgagatggagtctcatgcccagactggagtgcagtggcgtgatctcggctcactgcaagctctgcctctcaggttcacaccattctcctgcctcagcctcccgattagctggaactacaggcgcccaccagcaagcccggctaattttttgtattgttaatagagatggggtttcaccatgttagccaggatggtctcgatctcctgaccttgtgatccacctgcctcaagacagactctcacgctgtcgtccaggctggagtgccgtggcatgatctcagctcactgcagcctccacctctcgggttcaagctattctcctgcctcagcctcctgagtagctgggactacagacgcatgccaccacgcccggctaatttttttgtatttttggtagagacgaggtttcaccatgtcggccaggatggtctcaatctcctgaccttgtgatccacccacctcagcctcccaaagtgctgggattacaggtgtgagccaccgtgcctggcctcaataattgctttattaatatacttggaaaagagccaccatttctgttcttaagagactgagtcatcttttctgtttttcaatttccatatctgtatcagcaaaagttaaatgaaactatttttttactactctataatgtagttttttactgaagtttatcaaacaagccaagaagcaaacaatgtaccatttccagtaatgaaatttaaaactactgagtctcaattctaaaagcatgtgaccatactttctattgacaattatgtctgttaatcccctcttctgaaatcattaaacatcttacttaatgatgtttggatgttgcttagaggtttttaatgaggagtgctggtataatattaccaaactcatacatattgtgtagctggatttcagcttagagattgattagtctttttaaaaaacagaatatattctcttcattttgagaaatgaaaaaaggattatttaccaatcaaaaggcggtaatgtgacagtctgaaaagcctactcatagggcctgtacaagtatggcaggattgcaaatatgaattcatttttgtgatgaaagcaaatccctgccacaaaaacctaaagcttcctttatcttatttcagtttgctttaatgctggagaatgggcgttttgtgatttaaaaaaagtttaaaggtagaacctgactgtaaacaaactgaaagacaatcagaataataataccaatgcatatgacacaactgcaaaatgtaacaataaataagaaagtaaaagtgtggcctcgtgcggtggctcacgtctgtaattccaacactttgggaggctgaggtaggaggatcacttgagcccaggagttggagactagcctggccaacatggtgaaaccccgtctctactaaaaaatacaaaaattagccaggcatggtggggagcacctgtagtcccagctacttgggaggctgaggcacaagaattggatgaatccaggaggcagaggttgaagtgaggggagatctcattattggctgaaaacaaggtgcagtaacgtgagtggtggctccctgctagacctctgtgggaagaattctccagggagggaggcaggcctgacctggaggctggaaagggatgggacctggtcctgtgagctcccaggtagaggggagcactgagaacactaaaaatatattcttctgtattaaggcatttttctattaaatggaagtaccaccaggggagctaacatgaaatatttttcagtcttttttaactcaaaaataaaatggctatttataaatgtgtctccagtgtgacagtgttcttcatatgaatgctgcagaaatgagtagggctttggtaaggaatagggagagggtggctcctgaacacaactctggttcaatgccctagggagaggggaagtttcagaagctaggggtggtgggaaagctctgaaaatctggaacaaaggtgataaaacagggaatacagttgatctttgaacaaaacagatttgaactgcatagatccacttatacacggatttttttcaacccaatgcagatggaaaatacggtatttgcaggatataaaacccatgtaattggagggcctgcttttcatatatatgcgcattcagtggggtcaagtttgggacttgagcatgtgcagattggagtgtatgtgggggatactggaactaatggcttgctattcctatgggatcccgaataccaagggatgactgtaattccaaaacggggagttgcagagaccagagtgatgtaagcgagacacctacggtgcaacatttaaggctggactcactcccaagggctgccctgcacttgcacctgagaataaccgccttagaaggtgccccaggtgtcctcactttcttcaagttgccctggtcccggtgccataaacaaacttcacttaggataatttgctcagaactaatgctagtattctgaataatcacaaacatattattaaaatggatcaaaattcagattttattccatttatatcattttacatgtatatgtacattctaacatctgttagaatctttcaatatctacccaagtatcatctagctatctatcttttatctaccataaatgctatctaataattttatatcagttcatcacagaaataaagagaaacactcacttaatcaaaaatatatatggatagttgaatatctggttggtttgcctgctttactcatttaattaaaaacatacctgaatagttagaacatctggttggtttgcctgctttacatacaaatgttaataaactcacatttcttttcccaactatatactaagaacatctttgtatttaggaatggcaagggtgggtttcctagaaattttcatggatatagcccattatctggtaagagaaagatcaagtgtgcataattaattttaaatgatgttagaaagtaaaaaggtcatatgataaatacaaatgaatagtttgtaatagagctgagagtaactaaaaacaaactcttccagctgagaggtttagagatcttctgaggagaataatatttgagatagattttggaagacaacaggtatgtatttattagaccagtgctctccagatagattagatatcaagaaccaactagagcagtctgcttttaagtggagtccttcaaaaaatacgaaaaaggaatcatttttacaactgtttcagggaaagctcgtaagttttgtgaaattatatcttttggtcattcatcactcttttgttcccactctcaacatatttgcaacccactcctaacacacacaggttagcctgaaaattctgctagacttaatgttgtatttgtaacataatttccgatagaaaagatgttttctgtaacaataattatgattatagtatttaaaaattttgaaaagaattttgaaaattccaaaataattctcttttcagtttacagttttttcatgagccaatgactttcctatttgtcatcttctcttcttcctccaaccccttttctatataggttttctcctattagtttactaaaattaatttcagtctcaatcaaagacgtatggccagcaggtcagtctaggtttctttaaacacttattttagtttttcttatcttttgaattatttttataattaaaagaagttctatttgtaaaagaagaaaggaaatgtcatttaattttgagtgaacattttcatttataatgatattccattacttatttgtaaacattccatagacactcacttttattttacctttattaactactttataagaaatttttgattatgtgtattaaccatttgtaaagtttcaaattagatcacatttgaatgtttaataaaattttataaacatttaaattaatttacataagaaagtgacatgctaaatcttcttccttgcatatacaagtgagatttgcctatcattcagtaaacatttttgagtgttccctatggggcactctagtaagaaatggaagatctactagccaataataaagaggtagcaagagtcaaggcagggtggaatcttaatggagtttagaagaaattccatgttggcatttttccatccagagagctcattcttcattctttccttttttctcaaagtttttttcccttagattctttgtgtgtgtttgggttgcggagtgaaggggtagaaaacaacttctttccccaataaatttgcctctttattactgtgtattgatgttttatgtgagcaatagttattcatgtatttaatcttggaattttccaacatactaaacactgtaattcattctaataattttcccaattgattcctttgagttataaagataagcataatatctgaaaacaatagctttatctaccatctgcaaatagttcaactttggcctcttcttatttttttgcattaattaaagactccaaaattatatacttccctcaaattttaagtcattcatccacaaaactttctaaaccaactgccttttggaggatattttgacatttttcaaattcgtactttgttcattttctgttcaggtttttaattttatcttgaatcagttcaaaaattaattcaaaaaatggaaacatttgttataatttttaagcaaaatctccagttcattattattttagaatttattgctattatcattttattctacttgaaacaaatggatattatctgtatataatttataacaaggatttttaaacttgtaatgtgtgaatgttaagaagttacagaaaaagaaaaaaaagtttctctgattaacaaatatttgggaaacctctgcttaatccaagtataaaatttattttctgaagaatatttggaacaagaatttacatgttaatagatgctttttattattttggggttatggaagattctggaaacttatttcatgaaagaactctcattgatgggcataagctacaccaaacactttgaggaatcctgattaccaaatatccactggtgacaggtcacacaggccatctgtacattccctgttataccagatttctctctctcctctctttttctttctctccccctatctttccttcaggtactcttcttatattaagtgtcccctgaagtataatggaaataagattttttttctgggttaaatgagagcacacagtattaataatagctgatagttgctgtgctttgagagtaatgtggggggtgacagtgcagagaagagaaaagaaaagtaggttgagccaaggaagggcaatcatctggagggtaatttctcttctccaaggctttctgtttttgtgctcaagaaattcagcattgtcagtgtgatcctcctccaccttttcttggaacagcataatctcacttcttgaaaaatgaaatttctctgctgccatgcaacatctttgtgcaaatgaacgaaggctgaaaatacagagctggaatatttcccagatgtattgtggggggaaaattatataaaatatactccctcagaacaaattgtcaaaaataaattttatatattaaataactataagaataatgatgggaaaaagacttcatcaaataaatgtactgctaattatacttctgtaaaaggcgacttaaaacaatctagtttgcttaataaaaaaacaactctgctcatcaactgtctctatcaaattcttccttaacaaataaattccaaaattcataattttcatagcaagtcaaaattcctttaaaacaaatgcttgcgaaaagattatagtctttttgtatttgaatctgtattttataattaaaggtttctcatagtatttaatataatagtaagcaatctcttagaagttgaagacaatttttttttaaaaagtaagtgctaatgatacattcctttcatacaatgaactgatgtataattgtattactccttgttttccacatgaaaagaaagatgattggtagttgattggtggagtgaagtgaaaggagttaatttctagggcataggtactgatggtggagagaaatatgtcctcatgtgtataagtggcttatcatttgttactgatagataattatttgactttgaattttgaaccctctaccattttagacctttctcaaatgaacttcagtttttccattttgtgtctcagaatttttcaagttaaacccattactttctccaaactagatttttggtttgtttttttctgctgtccatacggtttctgcccatctgcactttcatgctatgtctttttccctttgtcaattattaacattttttctgtctttcgagacctacctaaagttcaatattctccataaagagatgcatattctggaagcccagtaaaaacggaagcaattgtgtggaagacatatcagaacctgggagtgtgggaacactgcattagaactgtaaaaattggattcaaatcttggttccatcgacaattcagtgatgttgaacaaagaaatgattagttctgatcctcaattttgccagttgataattggggatgcaaataactagtacattatcccctgttactgcagagattaaatgatatgtttaagcaagggatataagagcgattgagaaatggaaattattatgcatatgtcccacaatctgttaggtactttgcacacagtaggaacttagcaactgtcactgtcctttccccacctctgttcatctgaagcgactatgtcaccatgccatctgatatgtatgtgtgtgtattcacacatgtgcttcatagcacctgatccaatataatatacagaattttctctataaatatcctgctaatgtttgactgattctcaaaataagatttgtgaatccttaaaaatgagagggaaaatagaaaaactagagaaagttagaaatggatcaaatatcctacaatttgtgacatattcatgtgtttctccacatgtcttattgtagactcctttaggacatctaaaagattgacactaagtctacacatatttaatccccaaagctccgattgattttggctaagtaggagcagccagtttgggtaagtctgaagccccacttgggctaagggcccagttttgctaacagtgcacattcagggaacactgtgagcaattctatttatctaagagttcagcctcgtgcttgggcttgcaggtgcagctgtaaatttcaggtgatttacagagtgggaagcacaccaaatctgaaattatgatggagctcaaggctcacagcatcttttgtcagatgctctggttttatgagtttgggtgggtgccaccacatttttcttccaagtgcaataaaaaaatgatgccattcaagctgaaaagcttaacaaccactttacctttattgaatctgtagctaatgtactgaaatagcaggggttttgctgcaaatgtaatttgggtttttgtctgggcatctcttcattccttaaaattgggtttgtattgagcacaagtgagttacctaaaagatctaaagataaagaccctggcttgtccttaccgttgctgacagatgcccacctagacccaacgagaaggaagcacaggcttagaaatcatggagactattcctctagaagccatctgctagactaactgttgctttagataattgcttgacctccccagggctcaattttcttattaataatttgacagagtgggagtagatgatcttcatatttcttaaagaccagaaatgttctcttctaaggaaacttgcatgcttagatttttaacttttattcgttttttttttttttttttttgacattctctttatgcacctctaagaccctgttcccaaagtggcactctcttccagagatgaggtaaattaaacacaggtttttgatcctgaattatgctaaaattttgaccctatttgttaatcacacaggaaacacttacgagcaaatgggaagaaggaaaagcagtacttttatgattcttgagttttaatatagcttttacataacgttgaatcatattgcatgtacattaaagactcaaggaagcctcactttttttctaatcctgttcagatatagctaatgatttttgagctcttactattgctactcaatgtgctggggaatttcacctgcattattgaatgtgattatcacaacaaccatattgaaaattgcacaataagaaaggaggagttgtattccaactccaaacttctaattctgacctagtagtcttccacaacttctgttctatggaatcaagcctctcattaccagcaagcataaactgaaggtatcattcagcttacactcccaccaaaatcacagcttcgtaccatccttgaagccatctctgcttcataacattgtcttactttcctcctagacattctgtaattcttttctgactatgcaaattgtaggcttatgtgaagatccaaataaagtcccaatccccatcagtaactgtaagtaaaaattataacagatttcatctacttacttttctgaatagtttagtgaattttgtctgtacaacccttggatgcattttgctattatcttatgttattatttattaaattagcatttgtctatacattcctttttataaaaagattatttttcttgccatgtagtacattcataataattatttattaatctgttcatacaaaaagaatttcaactttcctggtcctgaaatatgcaaatatgataaggcactcttaactctttcagaactcaaagtgtggagtgagatatacaaacactcgaaacaaatacacttaaatattacaaagtctaattcaggactaaacttgacttaaatattattataagaacaggtgtggaaaggagcttgtgattaggatagtaggtttagaggacacatcaatgcagaggctagaaattaattgaaaagtgacctttctttcagacagggaagaattgttatattagaaaaaaacagtatattcaaacaggcacaagtatgggttattctaggaaaagggcctgattctgtgtactagagcaggtagaatatagagagatgagactgactttataacttggtacctgtcaaaagttttatgctatgctgaaaagtttggacttgatattgggagacatatttttcagttttgttttttggttagcagaggtttgatgcaatcacatttggtgttagatagataacgctgggtacagtgtggagaataaatggggaggggctattgtcgctatcatagctgtggtgaagaaagtgaggtaaaaattgattcaagagatgttcaagaaatataatcaacagaactcaattgaattgaaatgggctcttggtccctctagattgtttttcctttctttttcttttctttttaaatacaagtctgcccttatttcaagatctaaattgttgagagcacctgccaccatctaagtagaagtcaattgctttcttgctgacttcttttttaagaacaaatcaaactctcgtccttgccctttagatattagagttatctttggatgagaacactgcttagttgtggaagaattgtcaagaaaatgatgcccatatatgtatttaaaagttacctccctatggtactacttaaaataggctaaatggcaaatctgtggatagaaaaaaaaatgtaccaatttcaaagaagaaagatcttgaaagttgtatttgaaactctctttcacagtgtatattaggcatacaatatatcacaaaaggtgttaaggtaaattccagattgtcattttccagagggcaaagaaacaacacatacagaattgtgtttttctgtaagaacaaatgcatttctcatactacagtagatcctacatcctaatctactatgtgtgatgtctaaggaaatttgttctctcaatgccaaaatgtttgttgccttttcctcccagttgtggatattgtttaaaattcatatgcctctgccacttctcaaaatttcagttgctcatttttctgttctttaaaaggtttttaatacttaagaaatcatttatcatggtctcttccttcagtagcagtcactctgagttggcaatcttacagattttataatccccttctttcctggcaacgaattcttgattttgttcagaaatgcaattacattacgagaagatgaactatgattactgtaaagcagtagtggtagaacattatccactgttagaaatttacttttgtagtcttctgtgaaactaacatatagtcatatgataagtatgggcaaatgaggggttagtattattattttaaaagccttctggaaggattttgactgtctgataatacagatagtatgctgagaatctgcttttacttttccctcaataaatgtataaatcattaaatagagtcatgatacccactgaggtggtagtcatctttcaatcagaagtaacatgcacaatgaccaaaatacaaagctatgaggatggtggaacaaatgggataaaaaaacctgagttctgaggtgtgaacataaattactctctgagggcaaaaaacaaacaaacaaacaaaaatcctgatttgtagcatttgccaattttaatgtatacataatctaactatagttgaatttaccaatcacagaacatccagcacaccactgcctgggtcccttatgacataaatgagctactgggcttgctctagattatctaacttagatgtcgctacttacttatttttaaaaatacttaactaaacatctactatatgtcaggagctctccaaggcatttgggatacatcattgaatgaagtataaaaaagaaaatcctttttttttttttcacagagctaaaattctataagggcgagaaagaccatcaacaatcaacataacagataactacattatgtgatattttagaagttgatagcctcattaaaaaaagaaagaaacagtagagcagagtaaggaagataataagaatctagtggccagaagaggcaaattgtagtaataaataagaaggtccagataggacgcattgagtcagtgacatttgaccaaaattttgaaagagaagaaatgtttcactaattggatatctgcgagcggagcattccaggcagaggggactgcaagagcaaaggcggttgctcaggagcctgcttgcggagacatcaggagcaacgttagcaagaaaaaggaggaaaggtaactggcacaagatcatggggcccgtgtaagccatcagttgttaaagcagtgaatattattgctgaaataactgaagaaaagttactgattcctatctaggacaaagatggataattatgaatgccctgccttactgataatccttcaacatgaaatccagaacctgagttattacaaattttataaattttcactttgttataaaagaaagcatacagtctacattttgccttatttgataaataatagattcatatcaaacacttcataaaatttctgttaaaaccaaattacaaaacattctgggaatagattagtgccgaagtaaatagacttcacttatcccaatctctttctttgtcttcctcattctatttaacaaaactaccaaaaggatgtacaaagactgatgatttttaataaaaattagaataaataacaacatgctaaaaatgtaaaaatattttctgaaagcatatatgcagatgagtctagagagtgggtctgagggcattaatttacaggaagagaaatcactgtcctgtaggcatatttctgtattgcatgggactatgagagcttaataacaagaccctcagttgggtggagggtggggtggtgtctacagaaagcacaaataacgctgttattgaagggtaagaagcagtagtacaactcacctagataaagcccactctggaagtttttaaaatggggaattaaaataaacaatttacagaaaaattagaaataaactgacagtcagtcactctggcattcaaggaagtataaattggccagaagtggtggctcatgcctgtaatcccagcactttgggaagccaaggtgggcggattacctgaggtcaggagtttgagaccagcctggccaacatggtgaaaccccatctctactaaaactacaaaatttagcccagcatcgtggctgacgcctgttaccccagctactcgggaggctgaggcaagagaatcccttgaacccaggaggcagaggttgcagtgagccaagattgcgcctttgcactccagcctaggtgacagagtgagacttcgtctcagaaaaagagagagagagagataaaaaaaagtataaattttgaaaaaagaagggtatttttatcagttatatatttttagttaattttatattggatataatatccactatggttgaagtgcctgttaagaaggtctctcatatatgtaaatatcaaaacaaaccatgtactgctaaggaataattagcctacatggataaacattatcaatatacatagaccttaatctcagatatgtgatttctaggaatctcaattaaagaatttaatcctgctttgtgtttaaaattttgtctacaagagccactttaataggaaaaagaagaaaacaatctaaatgtttaactgatatttgttaatggttaaaataaattactgcttatttatcagtaaaatgttttattgccattaaaaatagcttatattaaatgacttgaaaatattttctttcccttatatgtcattaagctaaatatgtgctatgaacctgtatggtgttttgtaaaaaagaaaaaaaagcctactgaaacaaagatacacaacaagattttgaatattggtaatattttgtgtgacttttacttatttgttttcttgcttttctgtttcctcccctctaagttttcaaaaacaaacatgtatttcttctgtcgcaaaaaaaaataaaagaaaaatttacaacaatggtttatcaatttactaacaaaataaatttctctcttaatgttctagtattaaatattttcattattttttaaaacacattcaaaagtacagttgacccttgaacaacataggtttgaactacaccaattttcttccatgcctgccacccttgagacagcaataccaacccctcctcttcttcctccttctccttggccaactcaacatgaagataacaaggatgaaaacctttatgataatgtacttctgcttaatggataataaagatattttctcttgcttatgattttcttaataatatttccttttctctagataccttgttgtaaaaacacagtatatataatatatatataatatatatatcatatatatttattccttagcaatacatggcttgttttgatattcatatttacatatatgagatatagaagatacaaatgtgtgttatttgactgattatgttatcagtaaggctttggtcaagaataggctcttagtagttaagttttgggggaacaaaaagttatatatggatttttgactatgcagggaattgacaacactaaccccctcattgttcaagagtcagttgtattataaatggatatttgggttttaagactgaaaacctaacacagcattatagtctttcgtatttcagttaccaaataaatgtcctgcataattgtttatactgatagtggtgattattactgttttggcaacataattttgtgtcagcagttgtgcctgttttcttggcttttatgaaagtttgcttttgtaaacacgttttaactgattcattttaattccataatattatgttgatcttttctaacaggcaaataggcatttactttaagcattacaaactagcaaaatgtcccaacaatgaagaaatacttacttttaagaataaaatgaagaaaatatgagatctaagtgagcaactgggaagtttactccaacaggtactagagtgcagcctcaggcaattcttgtcactattagcacatcctaaaatttttatcaaagtgcaatttttatataacaattgaaacagtataaataacatcatatttgcaagcaaaagaaaatgggcaatagatatctataatggttagttttatgtgtcaacttgactgagtcacaggatgcccaaatatttggttaaacataattctgggtgtttctatagggtgtttttggatgagaataacaattcaatctgtaaacagagtaaagcaggctaccctgcctaagatggataggcctcatccaaccaggtgaacgcctgaaaaaacaaaaaggctgaccctcccacaagtaagggagcatttctcccacctgactcttttcaaactgagacattgactttttccgacctgaagtcaaacagaaacattagctcttcttggctgcagcctgccaggcttccaactgaaactatctcacaggttctcctgcttcttgggcttttggattcagattggaactataacatcagctctcctaggtcctcggggaggagtggggctatatgttttgtttctatggggaactgaaatatgcaatgtctatccaattttgaagggtactgtactattctgcagtaggtaaaatagcttgttcactgtagaggagtattctttcagtgatgatagaggaatcaagtaataaatagatattttactatgaaaactgctctgtaattgcaaactggtattctctggcaattttgaattataggaagattgtactagccagagaatatggatctctatcaccttaaatattttattgttgcaatttcataaatatttcttgtattattttgacctgagtttctttctaatttaatttagatctgagtcaacatttacaaatccctatgctacactgaatagttcagaactttggaacttcaagactctggtacattcatcaagaaaatatctccatccaggtgtctggatgggcagtttgcagctcttctgcagtgggccatttgcagcttttctcaggggaaaggctacactgtggggcttcttcaatctcaacacacagaagagtaactgctattgaattcacatttaaaacatagctatattttccaaatcagttttccatgctatcattttatttgcacttcataaaaataccataaagtagaaaggactgaaaagtatcatatttaacttaggagggggtgaaggatactggttgagtgcaagggtgttggagtaggaaagactgagtctgaatcccagctttgtcatttactgtttctttctgtaagttatatattctttttttttcctcagttccccatttataaaatagaaaaaatggcaccacctactcataagtttgttttgagaaatacagtgtatgatacctgttaaacacattggataatgcccagatgtattatatattcaataaatgaaaattgttatttatgttaatagtattgcttttgaatggaaaaatgatacacagagaagttaaaatgatgtgaaaaaagccaagagctggttaatagcatagttgaatttagaagtcactttaattcctgtatccctaacctacaatatttccctaacctatgacagtatgtgattaagtgcaaaatatatagataataaaaagttacataaaagtttgcatgacatggacaatcgtatactccatgtattctaccttggaaaaccaatgataattctaaattttacttgaagtttcctagctccataagctgtttactagatagaaatcttttgttatgtatttgaaaaatcagataatctaaaatgtatcccctggttgtgacctgaacttcttcggtctcagtggacataaatattccaatcttgtgtacagtttatctttgaatataaataaatatatggtttctcatttgtgaattgaccagatgaagttgtttagttttaactaactctgtaacagaattatagcccctagaatgcataatatgttgcatcaaaagtaccatttcttttcattatgggatatcacttaccatccatgggggtctttcccactcaatacagaaaggcctgggaattaattttgacaaaatgccttaagaaaacacacacagaaaataggagtacgtacaagagttgaatagtatatgccaaacatacaatatattctaatgatatcacaacaatatactgttctcagtcttcaaatagcctcaactattacattactatggatctcatgatttggagaagattgcaaagacatgttactttggctagctcttggaagatatttagagtttagttgggcaacaaaaagcagtcagaacagtccatgttactaatttgatattcgatgatgtctaagagtcaataatgatgacaaattagtgtgtttacatgtggagcagatccacatagttggatacaaaaaccagatattactatgaaactgtgtgcagattatcttagaaaatatccttcgtggctagctgtgcacactatgatattccaccccttgtgccataggttagatgaaggtttgtccttcacttaaagaattttgctgtgtgtgtgcatgtgtgtgtgcgtgtgtgtgtattgctataggctcacttaggagacccctataagaatggaacttagctatagtttttggattttaagactgttctgtttgcacttcttaattctgtaaaagagaaaccagactgtaaattgataaaagggagatttaaatagtgacttaaatacaacatctctttctacaaactccagaaatataaatacacttccccagatttagaatattgtgattaaagagaactagagaacagaaggaaacagatattgagtgggtaatgaatccacatcaagtaaaagatttgtaaaaatatattgtaaaattaaaaaaaagcatagtatcagaggaaaggcctggtgttaatatctcatagtatggaaatactaataatatataaaagaaaaacaaaatcaaggcagttgactaagacagtgattaatccagtttttctagaggtgatagtttttctgttttttccctttttagaatcaaaataggaagatcttacttactatttactggtaagtgttttttgataaaacattttgcctctttaggttttgatttacttatgtttaaattcagacgagctacattacttagacagtgaagttatttcaaccctaccaatcttaataatccaatgttttgatctaatttatgttctttatattcattcttgtattctaaaattccaggaatgcagaagactataaaacacatgaaatatcaggctaaaagactgcattatttttagttttttttaaactgagtcactaagaatctttctgcacatcaccaattgatttgattttttttcccatatctaactatatgtcacttacctccaagacgaatggaattgttccacttctccatcaaaatcatctggttaattcacagtttaaatttcttgcagaggtctattgtgagcagtactttgctttctgagctctagtacaaatgccatcttttcaacagccatactctctgtcctttcctgaaaattttgctttggcctttactgttccttaatcttgacataggcattgaaatatgccaagctgatagaatactcacttgctgatttgataaaagtatggtctcacctttttctttttaggaatcttaatataatgcaataatccagatgtatcagtaagaagaaagccttttagtgcttataactccaaattggagcacggcatgaggatttgagtaaagaagcattgaatttcccatgacataaaggaatgtctgctttactcttaaacgtagaatgacacttatctgaagtaacacaggcatatatggaaacaggaaatacatcaatacaccctgtggttttgtggtctttgtagggcccaaagcagctaaatcaatgttgtaccaaataaggcattcgttgcctggactattctttgtggagattttcaggttgtttgtgtgcttagtacaaatatatttatatacagccacaggtattggggcttgctaatttaggctttttttttttaaataaagcaagtgttttattttcactttgcaataaataacaacacttgtttgttccattatttcaactacattaaaattaaggaaaacagaactatcatctctaatttccacagtgtttgatatcatttgatttctgtgctttcatggcctgctggtagtggttgttggtactcttggtgcatagttcctctcaggtgacagcctgttctaaggtgaggaaggcttgaattaaatggcaattcacagcatcatcagaaaatgctatcttcaagacctagcaatcactttttatttgctaattttacctacaattgctgtgaactttgttctttactcagagaggtgcatggaaagagtgttaaaagccagctgtcacttctgaggtgagaatcaaatgctgagaaatggtattgtcttgaaaagatcaccctgaaggtcattgctctggactagatacaataacaatagatagtagcagcaagaccttcctgaccgaaagaaaaagaaggttgcgctttgaggaggagggaaaatatctcacacacgcgtgcgcgcgcacacacacacaaacacacagtgatatgcataaaataaggcattgataagagcagaggatgctctgtaaatgcagtttctctgttaaactggattttgttgaatcacatttgaacaatctaagagctgaaaatgagtatcttattcacatatatttgttgactttgaagaactggagctaaaagagaaatgtaactttaataaatgaagataactcagtgacaagatgtattcttatttttgcagaaaatctcttggttaagggtagcaacatatgtatattgtcttgtaacccaaagcagatcttatttccagattatgtttctaccctccgattatctacttttgtcaggatggaatttaaaagcatatgtcaccacaccagaattcaaaattggaagcatttagctggcatcttaaacacgtctgacattgaagacattttcctcccaactacccacagctttcattcaaactcttctattatttgtggacttgtccatttcccccaggctattgtaaaattttacggagagagaaaaatccagctaccaagagccaggtacatgcataagataattcagtcctcatgaggatgtcctaataagtaaggtacttatgactgttttgaaatttgccaggctgaaagaatactcacttgcttatttgaggaaagtatttcctcactttttaaattttttggattcttaatataatataatgacccagacacatcaatagtaatacagccttttagtgcttataattccaaattagagcatgggatgagtatttgagtaaagaagcttaggctggtgtatatgtgtgtttccacatcagaaaatctaaattcagagtttagtaatgtcctcaaggtcacatagctagtgtagtaggtataagatacaaatcctgaactctctgacatcaaatgtgacatgatttccactatgatttgcaagtagaagagtttcatatttatttatcttttattctcccctttccttgtctaaagctaagtgcggagtttttcaaataataatattcaatagatgctacttatacacaaaaaacacacacctccatattaatagaaaatggagaggaagagaaagtaattgttttttacatgtttattaccagtttgatttttaacaattctcctcatgatatagaaggcaaagtaatcatatctcatatcattaacactcagggacctgaaatacagtggtggctgcatgagattcaaaaagctttcatctcatttaataagaataaatgttaatcttacacacactggtttaaaaagatctatgggacctaaaaagattcagactataagtagttcaccacattttaacagaggaaaatcaaacaaaatacatcccacgtggaggacaatgatcagtgttactaaataaattgggaatattccatcaaagaaactagggatatttgctaggagaagaaaagtcttggggaaaatatgaaagcctttctccagtattttaatgtgaccatatggaacaagaattaaactaactctatttgtttttaaagtggtgggattcagatcaaaaggtaggacatggaatagagcaatttcctcccaatatgaaaccaagctatccaaagatggaatgaaatacccaggaggtagaaatttccacacctctgagattggttatgaaaacatttaaaaaccttttgttaggaattttaaagaaatgaagtgggctgggcgtggtggctcatgcctgtaatccaagcactttgggaggcctaggcgggcggatcatctgaggtcaggagtttgagacaagcctgaccaacatggagaaaccccatctctactaaaaatacaaaattagcttggcgtggtggcgcatgcctgtaatcccagctactcgggaggctgaggcaggggaattgcttgaatgtaggaggtggcggaggttgcagtgagccgagattgtgccattgcattccagcctgggcaacaagagtgaaactccatcccaaaaaaaaaaaaaaaatgaagtgatcttagcatcagatggttcttagaatcccattcaattttttccctttcttttttaagacaaggtctctctgtttttctgttgcccaggctggagtgcagtggggcaatcaaggctcactgcagcttcaacctcccgggctcaagtgattctcccatctcagcctctcgagtagctgggactacaggtgaatgccaccacttcagctgttttttttttttttttaattttttttatagagacagggtaccactatgttgcccaggctggtctcaatctcctggctcaagcgattcttctgcctcagcctcccaaatcttgattcttacttaattatattctttccattattgaaggagaaaaccattactgtggtcctgaaaacattccccacctcaatttctgtctgggttggttgtctgatagcacaataaacacttacgtaacacttcgcatacacattgttttaagaagtcatttatcattgtgtgtttgcctttctttctctttgctccctgtgggctccataggcagaaatcatgtccctcctgatactcacttcacatataatatgatttatttagtcaaaaaatatttatgggtgactaacaacacactaggattcccttttcagaagtcatgtttggatgctctcaggtagtgaaaaagagtcaacatagaattgataccaatgacaccattggatttacatggcccacctagctcaatggctatttttgaataggtttataaaattagagaaagtcctatccaaagaaacaatttacatttcttatccaggttttgtctatcctcatcattttatcagagaaagtattagactttcatcaaatgctgatccctaatttggagacatttgtttttctagattttcacataagttctcattgaacatatgaactcacataattttgagctccttcctataattcctaagatataatgatattttagaataaaaggaatctctaagattcttgcctacttcaaaggaataaatcagagagaagtatacttactcataatatagatattgactacataaaaggtgaggactacacatttaaataagagagaattgttatcatctgatggccctatttaaaatagaaatgaaagatgtattatgactgtcactttgcatgtttcaagtgagaaactaaagcacacttatctctagacctctgaagatcactttacattatgaaaaatgttttgactatcagaattattttgttgaaataatctaaattatttttaagaaaacacatgttactatcagggtgattagtcaaaaccccacataagatttactcagtagccaccgtgaaaggagcaagtggggatgggcctatgtattattcctttccccatctctgaatgtaaacaaaatagagtaacttggtactattccttccaggttaggatgattctcttcccacagaaaaacaccaattacctacctccctgccagatccatccaaaattaaataactgaatccctttgagagtcacgaaacatttcagaagtaaatttaaacctatctatatgcactttcactggggaacgatctcagtttccatcatccttctctttgaagccttgaagagctcgcctacatgaaacaattatgatgcagtgatctcatcttgaacattttcctcagggttttcatcagctctgctggttacctttctttccttagagcaatttcaatttccttatgactcggcaaggagcatttggatcaatactgtatttttttcttctttcagttttggattggctcttcattttttttttctaagactgatttaaaatcttttccttacaaaaggtaaaacttttaaaactctgaactgtatcctttttcaaacaatctttgattgatgtgtgatgttgtgtcacatcactttaggtaactctgtctccttgcattatacaaatcagcaaacaagtgagaatgatagactgaactgaaaaacaagcattaggtttccatgatgtatatgtgtcacattttctttacccagtctatcattgatgggcatttgggttggttcctagtctttgctattgtaaataatgctgcaataaacatacgagtgcatgtgtctttatagtaaaatgatttataatcctttgggtatatacccagtaatgggattgctgggtcaagcagccataaaaaagaatgaggtcatgtcccttgcagggacatggatgaagctggaaactatcatcctcagcaaagtaacacaggaacagaaaaccaaacactgcatattctcacttgtaaatgagagttgaacaatgagaatacatggatacagggaggggaacatcacacaacgtctgttagggggtggtggggcaaggggagggagaacattaggacaaatacctaatgcatgtgggggttaaaacctagatgacgggttgataggtgcagcaaaccaccatgacacatatatacttatgtaacaaagctgcacgttcagcgcatgtatctcagaacttaaagtaaaataaaataagataataaagtaaattaaattttaaaagaagcattaggatgtggtgtggtgcttgttagacaggtttctttgaggctttacaacaaactctgctagaagtacaaatataaagtttctagatcatgtttgtaaaccaaattggacacaaatgagttcaggtataaaagatttaaaataaaatacctgggttatggccaaaaccatggaaatatctttgctgtttatttcctctggacatatttagtgtggatgctaagtgtgtgtgttttaattttttgttagtttctttttatggatgttagaagttagctgctataataaatccttcaggggcttttcagttgaagagatacttgccattagcttaatgtggaactgatgctacagtgatcctaaatccaatagcaatatactccatcactgtgaatacattttccttatttgatgatgccatcttaatatagaatcagtaacttaacctggtaaaatagagttttttattgtttattgatggtgtatagcacactgagttatgagttgtctggaatagaatatattttctatcaggtacaccctttccccttaatacacccatgcatacacatgtatttatattttcttctcattttagttaggaaaagaaagtccacctaagtcccaggaaacgtagtactgaggttttgctggtttaagtagcctttggaatgttctagagagatcaattctatgagaacttattattgattcttactgccaagttaaccaagaaagccctattgagtcaagtcagctgtggagacatttcctgttgactcagatgttccgtcctacacaggatattaggatcctggctaatgtgagtgtcacaaactgaatcaggaatgtaaagtcatctgttgatattaagaatatttcctttcaactgaactttgtcagaccatagtaagattttagaatatgatttccatccaaaaatctcaaaacaaaggtagattttttaatattaatttttcttgtttggtaaaattaatagtttatgaatgtgtcagacataggacccagtttctatcctatgaggtctgaatcacatttattaaaattttaataacatctctctgcggacataagttacggtgggttttcaagaaattttttttagtgtgaacaaaataggaaaaaatctctctcatttatatagcacctttcaatcagaatgttctttgtacactgttcgtggttaatttttccccttgaatacacatgttaaactcccacggatctatcagcaatttaacggggctattttaggattatattagagacaggatttagcagaataaaaaaggcttgtgtagctttccctcaacttaaggaagttcaaactattttcatattgtctagttctatgtgaaaatattgctaagaatgtaataaaaaatattcagtggatttgcaataggtaacatgccggaggaagcctggtcccttaaataaagagaagcatcaaaaaacttaaactgagtcagacccagatgaaagaacatgaagtcgatctgtgattattctaagaacttttctgggcagtctttttttaccccaataaaatcaccctttgtcccttcctcttttcaagtatctgtattattatacctttcctggccaccctattaaaattgctttcaggaaagatagggaatttacttaacacgatagcatgtccaattgttaacagctttattttacttctctggggttttgtgttttaaaagctaataaaaatgtaaggtggccaggcgcggtggctcacgcatgtaatcccagcactttgggaggccgaggtgagcagatcacgaggtcaagaaatcgagatcatcctggccaacatggtgaaaccccgtctctactaaaaatacaaaaattagctggacatggtggcacgtgcctttagtcccagctacttgggaggctgagacaggagaatcgcttgaacccaggaggcagaggttgcagtgagccgagatcacaccactgcactccagcctggcgagagagcaagacttcatctcaaagaaaaaaaaaaatgtaaggtaaggcagaaaatttccagtggcaggttgaagaggctgagcctcttctttgtctttcagattgtacaacaggaatagtcaccagttttgtatatttcttccattaggcttgtcttaaactgataaatgcagactggcaaagctaagaagtcttatgggacattgtttggcttattctgaggctgatttgaaaaatgaatggaaggtgggaaagggtagatgattgatttttttaaaaaaagtcaaacctttagggggaactttaaaaaatgtctgccaactccagatatctacttaaaaacatggctgttattatgtgtgatgtaagttaacctatgctattaaaatcaaaatacaatataactggaggcaaaatacatttacttaacctcgaaaataggattcagagtttgtattataagattttaagggaactttaaagaaaggcacaaaagaaaataatacccaatgacaagaaaatattgtaggagataacaacatacaaatttaaaatagtaataataatatgttataaacttgaatattatttttaatttttaacaataaaattacatttgctttcttgaaatatgcccttctgtgtgaatgatagtataagtcatttaggacagtaagtgagacactacaacataaacataaaggaaagagagacttagggaggcacaaaacaattacccaaattggaatattgccaaaacatatggattaacagtcttgtcctttgaggagtgtcctgggatctttaatgcttaccagtagccaggattcttcttttatttctcaccagaaagacagatgatcttttatcctactaaagccctccactgtttcctgcttgctcagcatttttgcataccagtgccttttactgccttctcctggaagaatatatagattgcatttggatctgtgaagttgctgagtagtctgacaaggtctttttgtaaagggttgtgtgctgtatataataaatactacaaccctccctggcatctctcaccaattcttgtacggttgagtaataattatgtgggcatagtcataacaccccaaatgccaattccgccttgagagtttcccaaaagaatgagctgaaatactgggggaaaaaaggaaaaaaaaccacattttttcaaaggaaatttttgggaaatggagcaatatgtcaagcttaggtatatggcaggccaatgaacttttttttccagccagctctgtatagtgtcttgattctattgctacacagagcagcaggcctatacctttcctaatatctctacagctttcatttttctcttcccctgcacatgtcaagttcatgaaaagttaaacatttctccttcccaagtgattttcttcggtagaaaaagtcacaaaaattcacaggaggaagggtgagtcaatattatttgtaatgccatagaaagtacatacttgtggtgcaaccctatgcttatcatataaatgcaatcactgtacacaaggctcacatgaatgggaacagttaaatggtgagatattagaaaaacacacacagaaattcttcaactcagccaatccccaataatccacactttaatcaccctatctttgtactaagctttgctctctgaatgaatccagaataagtccactactcctgactatgcttacagagctacatcttacagacaacacaattaggttgcaaagcagtatgatgtctattataaaatctttgggaaaaaatcaatatcaatacaacatcagtatggccactcatattttaatatggcatattctttaccgtagagaacaaacattgtccaaatttccatacatatagagatgctaaaatagaaatgaacttctatttaaaagaaatagaaaagccttttaccaaacttaaagcttcaaactgctgtgtctgatgtatattaataaaatattagtattagaagatttctagttcaatcttctgatattacagataatggaaagagcataaatggagttgaggatttgaccatcattgcctagtagttagcagagaatctaaagtatagaccacagcctgcattcaactagtaactaatatagcaatctaaatagccttaccacattttctagtcaagaccatcactgggaatcgcctgtattgaattgaaaatcttgtttttctgccataacctatgcatcccaagcatataaaacctgtacatttgtatggtagacaggttctgaaatgatctcctatgatatcttccttttggcattcagacttctgggtaaccctctccccatgaatgggcaggaactgtcactttgttctaactaatagaatacagaatgatgggatgtaactttcccttctgtgttgctgtattacatacaattgtgtattccatactattgtgacttttgttttttctgatagactatctcctttactggcttttatgaagccaactgccctatggaagagcccacatggcaaggaactgaagactacctctgacagccagcaaaaaatttaggccccaagtcacatggcctgcaaggaagtgaatcctttcaacaccaacttaagtgagcttgaaataggattctttcacagccagatcttcagataacatattagcacaagtcagcaactggattgaagccttgtggggaacccgaggcagaagacctagctaagccatgtctggtcttctaacccacagcaacggtagggtaatgagtatgtgctattttaagctgctaaatttgtgataatttgttatgtaccaatagataactaatacaatatgcttctgattaaaacagcagtgcataatgtttaaaagacgtaaatcaagcaaatataatttccatataggaacattaaaatttttcacatcttaaggatacgttaaaatcagaatcatgaaatccatattaggattacaataaaacaatattgcaacattgaaccagtaagaacaataatcaaatggagtgaataagaaaagaaaattacaattgcattgcaaaatatgtttgcacgcaatgtaatggttctttgagtgctactccctacttggctatattgctctctttttgaagtgctcagataacacctccaggaagccatctctggcctccataacccatgtatggctttgtcctcatcacaaaaccatacatgggttctgcaggtcagagatggcttgctgtttttgtcacttacatagcacttactatacattattaatactgctggtggggtcacagacatatcttgtttcctaagtttggctgctaacttcctgagggcgtgtatgataccttttatctctctctatgctatagtttggatatttgaccctccaaacctcatatttaaatttgtttcctaatgtaggaggtgagacctaacaggaggtgtttgggtcatggtgccagaaccctcctgaatagcttggtgctgtccttgcagtaataatgagttattgctctactagttcctgcaagagttcctctgagaattggttattaaaagcagtctggaaccttcccactcacccttgctccctctcttgccaaatgatctgcattcactggctccttttcactttccactatgattggaaacttttgaggcccccagcaaaagcagatattgatgccatgcttcttgtatagcctgtagaatgatgagccaaataaacctcttacctttataaattactcagcctaaggcatttctttataacaacacaactgaactaagacactctacttccagcatactatacagtaatttatgacataaacggtacacaaaaatctgtctttgtagacagtgctgatgttgacaatagaaataattcatgtcccttctatgtaagaaggaaattgaattatcaaaaattttaaagacaagaggaaacccatttgcaatatagtggcagaaaattaagtagtgtggctagcattgtcatgcccagagccctctttggcacaacttcatttccaatcacctagtcagtcatctgtatatacacacattatataaatatatagtctgtatatgtatataatgtgtgtatatgtatacattatatagtctgtgtgtatatatatataacgtgtgtgtgtgtatatatatatgtgtgtgtgtatatatatgtgtgtatatatatatatatatatatatatatacaacatagttgtaaaatcaactttggaaaaagatatgctagatcctctgagcaattattgatttttttgacatttatgcaggtaatcagattaatactttgccccatctttaaattctatgatagctttgtgaccctgacatgtgtgagatgtgcttctgggtaacattttaccaatatgaccttattgttaagcatcaacttctactgcttgaagtcagaaattttaacaggtgaagcacatgaaataggttgatagattgatatctcaatcctgatgctaatgtacttaaacacaggaaaattcatgaacgatatagggaatacatgtaactactgattatttcttttgaaggtcagtctcctctgattatttgaatcccttgaaattttataaagttaatttttctaccttaatatcaaatcatatttattgtaaaccagatttaataaaaatttttggagtccaaaaaaagttcttgatagcaatcaaacatttactccccccagagcttcattcttagtatgctggtgtactttatagaaaattcagatcacacggtaaaggtaatgtctgctttttttttttctcggaacatttgcgttagaattttcttctggctggagcattcctccaatcactctgtgtctgcctaaatcctgttcatccttcatgtctcatcttagaaaacagtcaaggaagtctgactttgactctacaagcatagtcttgtgaaactttacatttgttctcctagcaccttgctttcactagacacactcaacaccacatttaatttgtctgaatcttttctttgtttattctatggctatactgtaatcaccttgagggcaaggcaaatgtcttaccactgtattcctacaacagacacagagctagccatgtaataaagcggaaatattcagtaattgaataactggggtgaatgagtggtctgattttatatgctttaatgaaattatgagtatattttatgctgattaaatattgaaaatataattttgaatagctgtgtaaagtcctatcacatgaagggaccactgtttatttagaaagttttttttttaggcattgatcattgatgttatttctaatgttttgctattttagatagtgattcagtagtcaacttgcaacacaatcctaatcactgtttttcatgacttcttcagaataaattcctagaaatagaatagctttcaggctcttgatactagaccctggctatttttttggagagatcagtgatctatgttgttaacagtggcagttgtttatttcttaaactttgcttatttgaagttgatgagtagccttagctctcatgttacagttataaaatttgaatattctgttcatgtattcatcagatatttgttatagtaatttaaatttctttatttcttatacgtatttgcatttctggtctccagcttatatgcctgccaatatctctgatctgttttactatgggggtggcatttagtttttgaagtcattttaatgtctatagattctacttcacaatgacagaaaatgaaagcttctgcatgaggccaagtagcacatagatcaaatagccacaggttcactaaaggacaaatattttattttacttttcaataatgcacatatgaagagtctgcatttgcctcagataagataaataatcatttctgtggtaagatttaacgacagtaaaagatgtgtctgttgtacttatcagctaatttctaccacatcctgatttccctcttgaaacttctccataatttctccttccttaatacttctatatggtttacataaactttgtatgtgactcatcatattgcttttacactacagactgattttttagccctctacattcccaggaggtcacctttacagttttacatatagctcatatgtgacataaggttgttggaaaaatgaatgaattgagtaaatgagtgaatgaactacatcagttaagtaattaagatgcatgtctatccattttgccattgcagagagtggggatataagggaatagcaagttgcattttgatgactggcaaacattagcaaaaaagaaaaaagtccctggcctttgcctgtttctatatattttctagaactatcttaatacctaattacccactgccattgaggagtcattcttaatatagaaaagtttaaggtgtgtatctatgttgagattggtttccacccatggtttgccagatcttgctagtcatttcatatcctcaatgaaaactattctttcaaaggcatcaatgtgttgtgggactggggacaactgccacaggcagactcaacttcagctgagtttccctataaaaatgtgtcttccatagagaagcaccaatatgggaacacctactgagagagagcatttactgacttgggataccagttatgggagaaaccatctttaacttgttgccatctttataatcattgactttaatgagggtttctctagttgtctccaaggaatctgctctctaatcaagtctaattggtgttttcccttgaggtaagaattacatacacacagtaaagaacatagtatgcctaacgattttagagaaaaaaaagaagttttttaagagcaacaaataagatttggattaatttctattaaatactgatctatctataatttactttaaataatgttcttttataatatctcaatttaaaagatactcataataggataataaagtaccaggcataatgctgaatttcagaagcataaaattgcctacaaccttgcattactgcatgaagattagaaaattgttatataatttttgctagttttaaaacctggcaaatgtgttgcaatgaatgttgtttttactgaagtatctctattaaggcattacactataaaacaaatttaattttctttccccttggataaaaatgtaaaaaaaggatagcataatgaatagctttgtatttgatacacaaaattaacatatgatgtctacgagttttcgtatatgccttgggtctattttgttaacagatgtttatagaaagtagagcataattctttatgctctacttctttcttgcttcttcccatcctactttctttataaatgacagacactattaacatgacttttagatatatctggtccatttttttaatatatcaacagcttatatgtaccactaacaacagtatataatacttgtattatatatttgtactttatctctgtcaattttttattttgcttagaaaaagagaaatcactctgtaccttggtaaacattaataaattgataagccaggcaatcaaaaggagatgatgatgaagtgagagtcacactgttaaattgtttaaaataaaggtttcaaatctctggttttccaaattttaaaatattagtgatacacagtttgcacactagagagtatactttgagcttagatgattttatgaatgtgggcatcttttctcatctagaatttattagggtttttgataaatatagatgggtcctataaatgctagctcttaaaactttttgtaagagcgggaagtagatttcatcttattttgagcagtctctgtctgctctgtttcttcagcaagttctttcaattgtttttattcattttcttcagtttgaagtgaatagtccaataaaaagttggttgaaaatgttactttattagttaacatttccataatttttgtgcaacttcttgggaatttaaaaacaagagtatatacattttaaaaacaattagtccactttcaaatgattttggtagcaaaatttctgagattttttttttcaggaattaatgactattttgcttttatgaacaatggttaatcaactaatggatcagcacttcacaattgcgtggtatttagtatacctagggtgaagtataaaataatgcctatgattattggaattttaaatcaaggtacaatggttaaaaataaaaatgtcttacctcactgttttacattctaacaataaactagaatttaattatttcggtttatttcaggaatatataacaagaaaattgactattcatttattacttctagaaattctattttcttatgataaaaactttatcagtgacacctagatataaattcaatatgaagtctaagtaataaaaaggaaacaactgaggatcgagcattgaagtagcttaactttccagaatatggagtaaaaagctacagggatgaaaaagtcagaggaaaaacatttaaaagacatagtgtatcagtgaagcaaacccctaatctgtataacaggtattccagaaagagagaacgaaaaaataagaaagaagaaggaaaaaaggtcacagatgcatacctcatcttactgtgcttcactttattgtggttcccagatattttgtttttaatacattgaagattggtggtaactctgcatttagaaaccctgcattgagcaacccatttttgcaacagcgtatgttcacttcatgtctctgtgtcacattttggtgattcttgcaatatttcaatttttcattgttattatatctgttacgatgatctgtgatcagtgaccttagatgttactgtcgtaattgttttgggcacagcaaacggcactcatataaaacatggcaaacttaattgataaatgttatatgtatatgttctgattgttgcactgaccagccactcctctatttctctctctctccttgggtctccctattccctgagaggcaaccatattgaaattagacgaattaataaccctataatgtcctctaagtttgcaagtgaaaggaagagttcaatatgtctaactttaaaacaaaatgattaaggttagtgagaaagacatattaaaagcaaggacagtccaaaaggtaggccttttgtgccacatatcccagttgcaaatggaaaaaaaaaaaaagttcttaaagaaagttagaagtctagtccagtgaagacacgaattataggaaagtgaaacttgccaggcgcagtggctcatgcctgcaatcccagcccagcactttggtagtcccaggcatgtggatcacctgaggtcaggtgttcaagatcagccggaccaacatggtgaaaccccaccctgtctctactaaaaatacaaaatttaaccaggcatggtggtgggtgcttggaatcccagctacttgggaggctgaggcaggagaatcgcttgaacccaggaggcggaacttgtgaagagccaagatggcgccactgcactccagcctggatgaaagagcaagactccatctaaaattaaaaaaaaaagtgaaacagccttactgctgatatgaagaaattttagtggcctggatagaacatcaaaccagtcagaacagtcccagcaagtccctaaatctcttcaattctttcaaggtttgaaggaggtaaggaagctgcagaaataaagttcgaagctagcagaggctggttcaaaaggctaaagggaaagccatttccataaaagtgcaaggtgaaccaacaagcactgatgtataactctgcagaaagttacacataagatctagctaagatcattagtgaaactggctaacattaaacagtaggttttcagtgtagatgacacagtcttctattggaaaaagatggcatctaggactttcatagctagagaggagaagtcaatgcctggcttcaaagcttcgccggaaagggtgactctcttgttaggggctaatgcagctgatgactttaagttgcagccaatgctcatttaccattcctaaaattttagggccattaagaattatactaaaactactctgcctattctctgtaaattgaacaacaaggcctagaagacagaacatctgtttacagcatggtttcctgaatattttaaggccactgatgagacttactgcttggtaataaaacattgctttcaaaatattactgctcattggcaatgaactagtcacccatgagctcttatggagatatgcaagaaaattaacattgttttcatgcctgttaactcagtatcctttcttcagcccatggatcaaataattttgatttgagaacatactgcttaagaaatatattttgtaagcctatagctgccatagtgatttctctaacagatctgggcaaagtaaattgaaaaccttctgggaaggaatcacccttctaaatgctattaagaacattcttgatttacaaaaggcagtcaaaatatcaacattaataggagtctggaagaagttgatttcaatcctaatgggtgactttgaggggttcatcatttcagtggaggaagtaattgcaaatgtggtggaaacagcgtaagaactagagttaaaagtggaacgtgaaaatgtgaatgcattgctgcaatctcataataaaatttcagtgaatgaggagatgctcctaatggagctaagaaagtagaatcttgagatggaatctactcttggtgaagatgctgttataattattgaaatgacacaaaggacatggaatatcacatgaattttgttgataaagtagggatagggtttgagagggttgaccccagttttgaaagaaattctactgtgggtgaaatgcgggtacagcatcacatgccacagaaagatctttagtgaaaggaagaatcaaacaccaagggaaactttattatctatttttaaaaattgccatagccacctcgaacttcagcaaccaccactctaattagtcagcagccatggacattgagtcaagacccttcaccagctaaaagattatgaatcactgaaggctcagattatccttagaaatttttagctgtaaaatatttttatttaagatattttcacctttttagacatactactattatgtacttggtaaactagagtagagtttaacataacttttacatgaactaggaagcaaacaaaaaaaaatcatgtgacttgctttattatgttattaactttgttgagatgatttggaacccaacccacagtacttcaaggtatgcaaaacagtattggaagaaaaaaaaccaaaacacaaaaaacctctgtggggccagaagaagtcaggtgtttcaaactgattcgatccctaggccctggattctggtacacaaaaacaagcttatgactagagaggtaattaaacgaacttttcagagtgggcaaacacagttacaactacaacaatatcagcaatggcttattaataagcaaacaagaatccaattggtatttgatttttcattagtgaccatgaagacatggagaacatctttataatccttaaaataatcagttttaaaagtagtcgaagatacaagagtctgggaagggtacagggagtgggggatagggagagtttgttaaagggtaatcaaattacagttagataggaggattaaattctagtgttctatagtaccgtaggatggctatagttgacagtgatttatcatacaatttcaaacagcaagaaagaacgttcccaacacacagaaataataaatatttgagattatggatatgctaatttatctgatcagatcactataaattgtgtatatggaaacatcacatcataaatatgtacagttatcatgtgtcaaattttaaaagtatcagctcaaacacagaattctgtacagcctaattagcaatcaagtttgagggcaaaatgaaatgattttagacattcaacaattcacagaatttactattcacacatggcctatcaaggttttatcttttctttttaacgtggtatttttttcacttacattcataatgataatatgtgtgaaatttctgctattacctaagaataagacttttttgagttgagaggcttgctaaagactttttttttttttttgcttttaaatgtgttcttgcaatctcttgtgctttatgtttccagtttttcctcacagatactgaatttatgttaatgtgattgttttggtaatcttaacagtctgttttaaattctccttgtgatactttttaggaaaaaaaactgaactacttctttttttctaataaccaccatgaaaagtaaaatagagcttctttagtttctgttagctaagatgaaaaaaagtaccaaactcttcctgttatataacagttttttccccattttctctctcatttttgttccagcatatattgttaaacttttttcctattcctctttgaagtattataatgtttgatttatatactccatcctattctaacactgaactttttatggaattctaattgtaaatggttgcaagttttaccaactgtatttttgtgtcagaaatacgctgtgaatctctttacttaacttcctgattggtgaaagtggtctttcattaaatccatatatatccattgcatattttttgataaatattactgataaaccacaatctggtgtaaaattgaattcctagtacaaaatcctttctccataacacttagcatttcagacttctgtaacttccgttcagaagttcatgccagagaatttcaggctaagttttgtctataaaagaaattaatattttctactaagtgatgtctatataagatattaatattttctgtttggtattgtgaaggtctgtggtttgtggcttacgtataaagtactttttgtgtaggagtgaacagggttctaataatattttacttaacttttactgaaacattatttattattatattttaataacaaagtgatatggagaaaatgagagcacattcttgctcttatgttcctacttcaaatgagaaatgtataaaaaaggccaggcacggtggctcacatctgtaacccttgcattttgggagactgaggtgggcagatctcttgagcttaggagttcgagaccaatccaagcaacaaagtgaggccccatctctataaaaagttaaaaaataaaaaaaaaaattaaccaagcatgatggtgcatgcctgtggtcccagctacttgggacgctgaggtgggaggattctactagtagccaactagtcagttgtaaaaaggtaaggccagaaacataacagtggtttatggagactggtctcctgaacaggacagtaccagttgctaaaaatggagggttctaaatgaaacattccaggagggagtttactttttccattcaggttattgtctccaccatccaccaggtctcacaaatgagaaatcaaggaggaatctgcactccagagctacagacaggagtcctgtccctcctgtcttccacgggcctactcttcaaactgtcatcctagtttcagcctatttcttctcttgcttggattgtttgctacagccatttatccttccaatgtcttcctttcaatctgtgctgctaccagaccaagctggctccactctgccagccaggtaaagtctcaactccttaccatggccatagacactccaggaccaggctactctgtgaatgctgttttcactctcctggttccagtgagtggctatgtatccaggtctgtgcttcaatatgtgaaactcatcttcaataagaacactgcaaaccccagcatcacctctcctgtggagctttctaccagtctctttcctcttcggtgacaagccagcctacttgtattgtgtgtttaatcagtctgtgctagtatgagcccctgaagatgaaaggctgcatcttatttacattcacagctgtattatgtaacaatatgcttaacacatagtaaatgcccaattaatgtttattgaaccaaaaatggattaatgggggacctgagttctacacttcacctttagcactttcccagccccgagccctccctctttagacctcagaggaatttctcgattttgtagccagaccatcctatggtttgagaatgcaatttacacatgccccactggaaaattaaccaaactacccaatgtgacatgcaaagctaggacagaggaactgggaagaggaagactcctgttagcaaacaaaaatgttaaagcttctcaccatatgccactcttcccctgacccccactgtttctcgcaaatccccatctcaggaattagaaaacttggagcagagtcacagtcactgaaaattttgctgaaaaaaacttcagccatctcagctttcatgatctgggagaactaaaatagagcactgcagacaagtgctaaatgattgtgaattgactgggagaaaggtcttttatactgctcttaacctaatcaagatttggatattttattggtacctgatttaaattagctcactgtagtctcaaactcatgggttcaaatgatactcctgcctcagcctccctggaagcttaactacaggtgcacaccaccacacccggctaatttttttttttttttggtagaactggggtctcgctatgttgttcaggctggtctccaactcctggcttcaagtaatccacccacctcgacctcccaaattgttgaaccaccatgcccagccaggaaatgtgatttttaaaagtgtctttgaatcctattgttgagcattttgtaacaagcatcatgctagacttcttgagatattttctcattgaattttcacaaaatcctatgaaggagatatttccaaaactataaccttatttagggaagaagaaagagtctaaatgaagtgaagtaacttgcccaagtcatggagctaattattaatagaaatgggcagggaatttaaagctagttttcaaagcttagaaaataactactatacagtctgttttcacacacaaaaattatattgtgtataatgttgaaaattggaaaatgactaaattccaaagacagacagatgtttagcaaactataattacatgtaagtatctttatgtacctattaaaaggtttgcatatactgcataaacccatgcaaaaaattgttaggccaaagaaatagaatatagaatgtaaaattgtacataaagcattattatgtacattaatatgtgtatataaataaccttatgtggttttgtttaaaaagacaaaaacaaaacaaacttaggcatggtagagaaaaaagagaaacaaccagtacaatctttctgttctttggcaataagttatgtcaaaagcttttaaaatgttgagaattctaacctagttcttctacttcttaacgtctgttgtaaaaaaagtaaacagtggataaatacttgtgaataaaaatattcatcagtgaaaaaatgtaaacaacttaaatggccaagagggtactttcaagaaaattattgtacatatataagatgtaaatttatatagtcattatgccttcaaaatgtttttaatgatctgaaaaaaagcttgcaatatgatggtaagcagaattgcattatataaagtatatgtatggtataatcataaagtataagcctagataaaaatacttataataaatattccaaaatgttagtagtgcttctgcttgggttgactgattttcttctttataagattatgttctattatttttcctctcatatagtatttttactgtaaatattttaaaaaccactctaacttccaaacttactctaataagtacaattacttctacaaataataaacacatttaaaaactatttgaatggtgacttgaaaagagtgatccttttttagagtaccttctttttagagacattagactgtaaactgaaagactgggaccctatcttacttatccttgttttcctattgcctgctagcatgtgctcaatatatgataactgaatgatcaacaaccaaaatatatgcaggatttgagatgactggtaagcaggaagaaagttttgacaaaaacatgcttttttttttttttttttgagacgaagtctcgctctgtcgcccaggctggagtgcagtggcgcgatctcggctcactgcaagctccgcctcccgggttcacgccattctcccgcctcagcctcctgagtagctgggaccgcaagcgcccaccgccaccacgtccggctaattgtttgtatttttagtagagacggggtttcaccgtgttagcaaagatggtctcaatctcctgacgtcgtgatccgcccgcctcggcctcccaaagtgctgggattacaggcgtgagtcaccgcgcccggccaaaaacatactttttttaaaaaaagctaagaattgtcaccagcctgtgggaattttatgaaaaatgcatataagcttacaactaataaatgctacttttgtactttaagttttccagatcataaaaaaaaagacatgaatcttttcaactcatttgaagaaactacaaatggcttggaagaataaatctgacaaaaatagcatacctccagaaaaactagacatagaatggtacactataagaaatataactcatttctaaaatttaaagaattgctcaacattttatcacaacaagtgttaagctgaaagatatttgcgaaaatcatcatcctgaatagaaaatcaaagcaaggtaaagaaaagcaaaaactgacaaaattgaggggctaaaagcattacaaaatttaaaaggtgtataacatttttctgttcatataatgaagggtacctatctcaaatgaatgcagtgttttctttaacaatgagcaatagtcattgatcatttgggtccaatacatttttgagaatttctcattaatcataattagacaaccttaaacttgcacatacatgcaacatgtctatgtgatatctgatggtgcataaattttcttaaatactcatcaatctttagttaagtttctctgctttaggttgttcccttgagagtcaagagtaagtgaacatttccatgattagaacctttataaaactgttctatccaatgtaatacaaccaataaataagataatatgagttaatatggaagaaaaaagagatatatatttacttaaagatgacatattttattacctggaaaatccaagcgaagaaattgagaaatcagtagacttaataagagcatttgttaaaatggctggttacaaaaatgcaaatagtaacataactctcctacatatttttaagaataaccacttagaaagcgaagtggctgaaaaaaattaatgaagaaaaatattaaatgcctcataaaatttttaacaatttatgtgtaggacctttacaatgcaaccaagactcattcctgatagatttaaaagaatgaaataaatgaaaagctcatattttattttgagagggtatgtctctaaatgaaatattgagcacaagacgactattgattcaaccaaaactaatccatagtttaatgaacttttttgaacataatacattgattttcatatttgtctatgagtttaaatgtgtagcccacaatgttggagaataaaaattaaaaaatatgcattgctgttattattgcttcataattattactttttaaaactgtgaggctaatacgagaatgcacagaaatatctacaaaataaagtgtaaatgaaaaaaaacacagatataggcgagcaaataccttaccataaagaagtatacattattcaaaaatattttgaatgacctgtttaactcattaaacagcaaaagttatatagtatcatatgtcaaagtagattcaagagggtatagcattatcatgagaaagttaacatataaagtattcaaaatttgtaaagcaacctttaattttatttgacttttcctaaacgtgtataattttttttctaaaccctgcaccaaggccaataccaaaaataaaccatgatagatgtaaatatatgacaaacagcaccaccaatcaatatcagcaatagattgacaaaacttgtaacatttagtgcctttattttatatttatatatacacatatatatatcatatatgtgattttttatctcccattgaatctcattttgacatatgtgcaaatatgtatatatacaaacagatataatatatacacacatatatgatatatgatacacactgtatatgatatatacagtgtgtatatatgtttgtatttatatatatatgtgcacatatgtcaaaatgggattcaatgggagataaaaattttaaaatgagtatatattaaaagtttaaaaatccaaattgctgagaaaaacataagaaaataaaatcctttaattttctactagccaatggaatttgacctaaaataataatttactacttactggatgtcaaattgtcaagaccaataaagataaaagataatgcctaaattatcaagtgaaagtcctactatttttgtgaatggttaaaagtatatgcactttgaactgaatcttttatatgtttctctctgtatatatttatatatactcttaatatctgtaaatggtgtgtccatctctgcacacactgtgtgtgtgtatatatacatatatgtgtgtttgtatatatatacatatatatacatatatagtgtgtgtgtatatatacatatgtatacatatgtgtgtgtatatatgtattacctatacatatttgtgggtggatatgattttaaagaagaaatactttagctgtgaatgtattcttggaataacaatgaaatgtagaaaatagccctgaagttcaataacaggaactagataatgataatttctataatggtatactaatatgtaattaagatttagttgtagaagtatatttatattttaatgacatggaacaattgtacgtatatatttagagaatacatattgtattctttctcgaacacatacatagacatctgaaaagtcatattcaaaagtttaacagttattctctattgatggtaacttatttttttatatgtactcataagttttcctttttaaaatacaatatgtatacacatctctcagtattaataaaaatacacttaaagctaaaaagtagctaaacttacttcaagtaaaaaaattaatagatatactttgcaattaaccttatcaatgagaattacccagtttcaaattatattcaaaatttattttaattattcattagttttttttctagattttagtttggaccactgctttcgttgccttttttgtttttcttttagtactatgtattttgttctgcacttttgctcctatgtagacataatgcttaattttttgcatctaacacctggttgccctgtccaaaagaacaattttttatgaactgttaattaagccagtagttataaaatatttggtggctagctttcgcctttttaagagaaagctgtgagactaaattattcaattaagacatgttatgaatctaaagttcctatataaaacagacatatttcaacaaatagctttgggcttaaggtagcctatgtacttaaacatctcatggcaatattttcatttaaacactgaattagaatgacaacatcacaaaggctaaaaatcttatcaaaattgagtttgaaatatactacttcatttcatttatttttgtattttttcatggaggaaacgtaaaaagatttgattttgcacttgattagattaactgtaattaatgtaaggttaatggtgttatcttgatcgccattttactcatctgtttatacactaaggtttttattttagttttgaaaatgctttaccacaaatctctaaactagaggcagctttgattgagaagccagatattgattgtgagttacacatatttttatacagacttcaaaatattcctttttgtccatatagtcttaaagaaaacaaatgagaagagttctttcttgaaatatgtctttcgttttcaatgggattaaagtgaaaaataaagtatcccttccttcaatattttcacaactcttcaagattattactgttcagtatttgatttatatgagtttgaaaaatgaagatgatgatgatagagtggaaacctggcaacagatatataaaaataatttggcttcaaagatccaaggatactgattaaagcaaagggaaaatcaagttaactgatgatccaattagcaagaagaaggaggacaaaatgactgtactttaacctgagcagtggccctgccaaatttttagtagatgcttaaataatatagcagtaaaattttacttgcttttctcttcttttgtagttttttcatataggagaggaaaagaggcaaataatagagtagagagaaagaagaaagagagagaaagagggagagagagaggtgagattgaggtaggatgattgcaaaagcaagcaatcaagaattgcaagctatggccacaagtattgaaacactgtttatctcaggacactctgttctgtgacctagttgtagatgtatgagtgcagtgcagggatatacatagagttctgtcattctataactagaaaaaaagatttgagatcatttggaaatgaatgtcccatccaagatcaatgaaaagaaataactgtagcacacacactatcaaaagcaagacggaatctgagatttttggagttggatttcatcacccatgcatagcaacccaataattttatgctgagaatgcaaagattcatgatcatgaaatgccacacagctagtggtctagcactgagtgtgaattagaatccaggtctcatgattccagattcaagaatacttttagtccataggctattactcctacaaataaaaaatgcaaagagggatgtgccaaagctgagaacaaatgacattatgtccttaccatcttaataatctactctacaagttctataagcatgggtaagaatgatttatgtaattatcaaaagttgcttcaaaggccaaaagaggatgtaggatctggtcaatgttgattacattttctaagactgtttaatgttcatattgtctcagactcagttaacactttaatatgtttgtgcacattgaaatttataccttaacaaaataaacatcagataagaaaaaaatagcaaatggcttttatatatatcaactgtattacaataaactgcataaacagtaaatactcatgtttctctaaaataatagcagccaactaaactttccaaaaagtatacatatcaacaaaaaataacgaacataactgacaacatctacacccaaaacataataggtggaaagagaatgctacaaagtttaattcatacagaactaaaatataacttcaaaccagcaaagccaatggcgacttgcatgccagaatagagggttagacagagatggtttaggaataaaataagggtacagaggcgtaacagttgcagaaattggaggaaaatcacacccagaaagagagaagcacagcctaatggggaaattagagaagatctgagactggtgggtcagaggaatgattcctgacatggcaacagaaggtcttgacatttcgctggaatgaaaatagtcagtttaaggtcccacttcagaaaaagaggaagaatgaagtgaaaggaggagaaaagaagaaaactgaagaatctacagaaagtaaagagaaacgcaaagcaaaaagacacatcaaacccttcccaacattcttcctcccaagatgtttgctcaacaaaaaacaaaacaaaaaaatctttagttaattataataagaggagaggttctcaaggaaatttagctgaccaactcaatcacccgctcctcctaaaaagaattacctgttgttattgctggtctgaaataatatagggaatttcaaagtaaataaaggactagtcaacatccttaaaagcatattggaaggaaaaaattaagtattttagcaatcggatgttggaattgagaaaattttcacagaactactcctggataagatccagttagaatattggaaaagtaagccaaatttgtaatatcatagaaaaagaaaaaatactagataaaatagtttaaaatttatacaaaaaaaatccaaatacgaatgaaaatttagcattataaaagtaacatttcaaatcactggggaaaatacagactttttacctaaaaggtattagacgattagactttcatgtggaaaaacatgaaattggattcatacctcacattagaataaactccaaatgaaaaagatatctaaacataccaaacaaatccatataagtactagaggaaaacatagatgaattgatttataaatgataatagatgaagcctttctaattacaactcaattcggatgcaaaaaagataaaagattcattaatttgacaaaacatttcaatgacaaaaaatggcaaaagtcaaaataaaatcgagaagaaaaaattgctgtatatgtcacagatgaaaaaataatttctctaatatataacaaactaaaatatgagattagcaaattaaaaataaaaaaattgcagaatagcctgtatccggtatactgtgtagaaaatgagtaattttaatattgttgttatattactaaaactgaatttaaaatacaaaaaataaaataaatttaagtccagtcttagttattttatgaagaattagatgaagaattcatatacttattatatgaagaatgcattcatctctcaaaatagaaatggtttaaaactttcttaggacagttaaattacaactcacatgtctcgttggtcaatttccaatggtaagaagctgcatccattagaaattattttacaagatatttggctatttggttatttgaaagagaacttatatgtgtttaaactctcataatactggtaataatatgaacaacataaataattactattattttagaaacatgtgccctgcaccgttttatatgctttccatgtatttatagcttctggaacagattttgggaagaacaaataggcccataaggcatagtttctcctaatttatgctttctgaaaacttatttaagtgtaaactgcaattttttttggcaaactcaaagacagtaatatgtatcaggaattcccaaaacatgttccaaggaaccatagaatgaatgttaataggtttaattttcaggaaaataataatcagtgggggaaagggagattcaaagtaaaatgcacttaggaaaagttgggcgattaatgtgtattttaaattcagaaagtcactgcaattttaatattcatcatgacactccaaaagggaaatgaagtatgtatcatttcccaaacacatttatttcctgagccacttttcaaggactagtgctcctcaaaaatttatttgggaaatattgactcagatgaaaatgtggtaagaaacattgaaactgcactccatctaatgctttggggatttttaagattttcctactaatggagtcaaaatcccaaagtgtgaaaagacggaaatcacaatttgaggagtattacttaatttgaaccacagagaaacaatcataatcattgtcagcagaaaacaagcaaaaaaaaaaaaatcaatatacaaaagttaaaggaaacctgaccacgtaatttgaattcataaatcaaccatcaaatgatattaaagaagtaaaattattctctcatttcatcacaaaacatccattagttacattttgtattaaaggaaaaagatgctcacacttgatctttaaaagagattgaatatgtgttgctcacaagacatacaagaaattctaattttcaaaagttatatccaaataaaaatggcaactttccaagaaaggggtgttttgtaaaaagccattattaattttagtagaagtggacacatttctaataacctaataatctctgataacttctgataacattaattttaaaagttaaaaataataactaaataaataataaataataactaacaaccaaatggctctaaatacagattatttctggtacagataattctagctaaaatacagatagttctacctgaaaggttttttctacttgtggtttctaaataattgtgtaagtctaaactaagtcctctcctacagttaagacatgcatcttccaagaatctaatgaaaacacttgggaacttccttaaagagaactcatcctaagaagatgagaatattgcctggcaagtttgacccaataataaaatctcaaggtcagaggtagaacagatttcagctttctcattgcatcctgcccttcttatattttacaaaaatcagagactcatctatgtgtcccaaggataaaaaaagctctaaatcagatctgaaaaactcaaaattgtatacattttgggtgcattttatttgtacatgtctcatatgtttaacatcaggagaaagtcacttttcatagcatacaagtttttcctcacaaacataagcagatatatcacatgaggataagtttgacacagttaaggcaacagtcaataacattcccaattaaagtcaaatgtgcatattatactgaaaaatatcagttaattaattgtatgtagtcataatgtttaccactgtacgatgttaaaaatatacagagtaccagtggaaggaattcacagaaagaaatacttgggtattcaaaattttttattctctaaaattaaatctcttttaaaatgcagtagtttccctcagaaagcagttggcagtccattacttaaggcattcatgcacatgctagaaaaccttatgatacttatgcactcatgagaattcaagagctaatgcataatttgacaacatggcatagtaggtccccttggaccagagatgccagcatgctgtttgtaaaaatactgactcatataatctactatatctagctaaaaggtattttctacttatggtttctaaattgaccagttttgaggatatgtctaaactatttcataaatttgtttgtaatcacttgaaactttcacactgttaggtggctacgatagccaaaaacaacaggtcagttgattatccatatgattcttttaatcacatggcaatactttgaaaagtcatgttaatgtttctatttctaggatgggcaaaggctctgaattatatctggtgatggtattacaaataaagccactattagaaatcttttgagagtaactggagtgactttttcttttgtgacctggctattcaaccctggaaaactgacttgattgtaaatttgctcaccgaatatctgtatttgtatatttatcacatataatttgcatataaatatacaatttcaataattacagcatataatacgtctgttgcaatacatatatacacatgcgcacattgttatttacaatgtatagtctcatatctgcacatagctatactagatacaactcattaataatttatgcattatattttatcttatcaataaagtataatatagcagctttcactttcttagaaaatttatttactaaatattagaaattatattgtattttaaagtgaaacaaaggaaaatacttcggcaaacatttcaatagtttaaaatttaaaagacaatcttagtagaataatcccaagtaggtattcttccattaaaaatttttgacactgcatttgcatttctatttgtaacttatctaatatttatagcatcctgtgttaatttataattctatttatacaaaacttgtggaagacaatttaccatgaataaaagtgcttcatattcaaataagcttcataaatagattacctctaagttctttactagtgagtgtactctccaattgctgtaccctttatccatgagaacgaaaatttagtaattataaaaatgatgcctcatccatgtctgtgtagcctgtaaaatttgtaaatcaagctcacaaatgttgtcagaacaaaggtaggcttatatgatacatcaagctaaaatcattcatcctctacaccaataggcatagaactgcaaatgcagcctcagaactgctcatctctcccagttgtggcttctcgcaaaaggaaacagccagactgctagagatttaaatattcctctacttttaccttgaactctagatctgtccatgatctacccataaatccagcaaactcttcaggttgcgcaactaagacaacaatctgtgccttcatcacgccatcggaatggaatgtgacgagccacagtgataaacatactgtgaaaaatacattggtggtgatgagcccaattctgttttttataaaaaattaagaaaatggctaacttccatgcagtctgtggagggtggtaacacaaccccgattacttaccttgacaactgaattaatcttcttcttttctttttctcttttcaataacatatgggcttccactcagctgtggaaggtggtggaacctcactgggatcacatctgtcaggtttacagggtgaataaaagcactcagcaggtttgtgtgctactgtgtgtatgaacacagggcaaatttgtgccaagtaaagtctatgtccttggaaaaacactttggttttataccatagatattaaagatcattatttattacatagatgaaccctacaaaatattccttatgggaaaatttcataaaattaatgtaagtatttaaagtgtcttacactggttagagtttttctccatctcctatgcacacacacaaacacacacacacacagacacacgatttagcctcttggttatgtttcccacatattgggtccaaatgatcacttcaaaaataatttagataataaacactcaaactgtgcaatcagggccaaaaagtaaaataaggtgaaaaagtgcttcaacttgagtgcaaaaatgacagttttcatcagatatagacatattttaatttctacttgaccctgatccagagtactgcaaattttgtcctattctatgaaaaaaaatcatcaagcttaaacaatacatgtggcttatgtcagaagcaacttttcatgatattgcaaagattccaaaaattaaatatgctagaattgacaaaagtttatatggttcaaagttacaggctacttgtcaattgtttagagagttttttcagaagaaattactttatttaaaactgtagtctttttatattttcacttagttaaaaagtgttatctaattaaatacttaagagtcagtcttatttttaaatctttttgtttcaaataagccagagtttattggacactttctgattgcactgtcttaagggcagtgaggtctgcatgagatgtatatgatgtttccttgtaccaggaacacattgtttggcaatactagatacatctaaaagatagagttaaataatcatgtaacacaacttctatcaaactaatcaaaattatgcaagaagtgtgagttatgaatgtttgaaacagggaaattagaagaaatctggaatctctaccttgaattgttctaaatttgggaatgagaatattctgatgaggaagcccagcatactttgtaagacggacactcgtagcttatttaaatttcagaaaggagatgattgtttagacaattctgctgtcaatgctccaatgagtttgaaagcaatacacgtactctgagaacttgtgatgacaaggcaagctttctgctgaattttgcttgtttgccccgtgcagagtaggcagcgtcaataatgcaatcaccttccatgctgcatttagagaaaacttagctctctggaaattaaactcctgagtggatagaggaaagaaatatggtcatatacacctgtgacatctcaaattctgtctttgtatctaaaataaaagtaagagcttgtgtgtaagggacagctatttttattaccaactctattgggcataaataaaacaaaaatgaatcaacttcaattttctaaattttctcatgcatagtttacatatggtatgtgctatataagtgtataatgttatgacaaatgtgccttttattaatctctggtaaacaggcataatattagatgtgatgaaggaaaagagaaaaggagtaagaaggagtctcaaatccttaggcctttgttaaaggtagccgttatagctgttgtcatgcctatatcaagttgcaattccaattaatacaactaaaaggtaatacacttaggcaaatactattttttaatcactggctgggctatgacatttcaaatgcaatctccttcagtgactggaacttggaggcatgttaattcccattgcacagttaggattgttactggctctgcagtctcctttccttgatccccatctccattcctgcctggccaattaatactagcagtaccactcattccatagagggcagaagcataagacgttttccatactggtagaattaagccatcaaagggaagacaatctaaataggaaacgctttacatgaaaaataatttaatctttttatgtttccaaatgtaaactgcagtcctaacaggatggcccagatttgctcctttgttcagtttcctattagagtttctctttagaattgaagagggtgagagcacaagtgagtggtaagccatctactgagttatacacatcttgttatacccttgtttttttctgtttttaaactctgtatgaaaataaaatacatgctcattatgtagagactatgtacttgcttttaaattcatgagagtgctttgacaaattacttcttttctcttaatatcttaacaattagcaattttaaatggaattttgctatccaatttatcctatcaaatttttggaaatcagcagattacatagcttatttgaaaggtaaaaaacagcaattgaaatgatttctttgcttcaataaaaatttcacacctgtagaaaggagtaatctcgaaacatttataaaagttagtatagttggaaggctgaggcaggagaatcgcttgaacccaggaggtggaggatgaggtgagcagagaatgcaccaatgcactccagccagggtaacaagagcaaagctccgtctcaaaaaaaaaaaaaaaaaaaaaaagagttagtacagtaatgggtggtaatgcaaaataattatttaattaatgtcctctattcaaatatgcattaatgtttttatttttcacagccatatagagtttcctgagcatctggacgtattaaattttatggaaaatatctactatatctaaaaagctctaggatgtgttagaaaaggtatagaagatatataaaatatagtcactatacattatatataatagagattttatattttatatatactgactgtataaaatataaaactatatatagttatacttttaatttttacatacgttgtagaccatttgttaatttctgctttttcatttagcaattcacatattttgaaaggttaatcttcccagaaacagaacctagtttatacaaggatgttctctttgattaatttacattcacaaatcagtagagaaaggaaggtttatgagcaaagcgtgttgtaaaattggtaagctacacagttgaagaaatatgagactcttatgtaactccttacatcaaaatgaataattgatcaaaagatcaacctaaaaattgagatgaaatatatatgagtatgcatatacctcaagataagaaaaaactttaacaatttattcaacaaatatatatagagagagatgctgggacacagaagtgaacaaaactgcaaaaacacctgccctcatgaaacttaaattctattggagggagagaaagactaataaaccacacacacacacacacacacacacacacacacacacacacatatatatatataaactatattttataatagtgcataaatactattgagaggtagggcaaaaagtgttggaggtgaatgattttagggttgactacccatgttaagctttatggagaaggtgatatttgaacaaagaatagaaagaggtgacaaataaaccctgcagatgcctgggagaagatatcctacatgaaggcaatagctaatgcaaaggacctaatgtgaattcatgtctgacacgtggaaggagtaaggaagttagtgtagctgaaagggaggaaaggcaggaaaaagtaatagaaaaattattaaaactatggatggaattactaggaatattgatagactttattacgtatgcatttacaacttctgaacattaaatacaaagataaattaaaaggcaaaaacaggtgaaatattggtaacaattataacaaaaagtaattcactagatagttagatctatgagagctagaacaagttctttgttcattatggaatcctcaaggcacacaacattgccttttgcatgacatccatacttataccaatcttgaatattgtttaataactgaatatatgctagtagacaccaggtgcggtggctcacacctgtaatctcagcactttggggggccaaagtgggtggatcacttgaggataggagtttgagaccagcctgaccaatatggtgaaacccagtctctactaaaaatacaaaagttagtcaggcatgatggatggctcatgcctctagtcccagctgcttgggaggcttgaggtgggagattggcttgaatctgggaagcacagattgcagtgagccaagatcacaccactgcactccagtctaggtgacagagcaagactctgtctcaaaaactaattgaaaaaccaaaaccaaaaacaaacaaacaaaaatatactagtagacgtatagagtgtgggatactgatatatatagttttttgtagataaaaatatgaatttatttaaatagtttgcaatatgtatcaaaggtttcaaaacttcatattatttcatgcttatctctattcttgtttattttcaaaccaatagtcattgctcacattaagttatatatttatgtttttataatatatctaatagggcaatgggtttgttttggtctttcttgtgtgccaaagcataaaatagttcctggtatattatggctttctataaagatttcttaaataaataaatgaataactgccctctaccaaataattcaattgaaacatgaaatgcagttaaagatttatgtgaaagtatgtccatttaagtatcatttaaagtaactgaaaaaaatgggacactttactttcataaaaatcgagataatagttaaaaaggtggcatatctattcaatggaatatcactgaaattaatcatcttcacaaagaacatttaacattatgggaaaatgttcacaatatgctaagtaaaaacagtgcaattctgagtcctctgacatttaattaacactcattggattgaataatgttgattagaagtaccaaaatttagaattttgaaagacctaaaaatacgccaatgcatgcattttctaacatttctttctctctttttttggagtaagtaaattctcctattcaaggaaatttttaagcagaagtccaatgagaaaaattgtttttttaatttgtatttttattttaagttccagagtacatgtgcaggatgcgcaggtttgttacattggtaaacgtataccatggtggtttgctgcacctatcaacccatcacataggtactaagcctggcgtgcattaggtatgtttgctaatgctctccctcccccatcccaaacccctacaggccccagtgtgtgttgttccccttcctgtgtccatgtgatctccttgttcagctccaacttataagtgagaacatgcagtgtttggttttctgttcctgcattagtttgcttaggatgatggcttccagttccatccatgtccctgaaaagtatgttatctcatttcttactatgtctgtatagtattccatggtctatatgtaccacattttctttatctagtctatcatttaaaatgggaccactgtgacttagacagaaaaaagggagagcagtgttaagtctagtttcttcattcccgcccattttgctgaccatggaaggctcagagaaaacctcttagtacttttaaggtatctctaagcactgtaaaaaaaaatttttaaagacttttctgtttaattgagatctagagaaagatataaaagcccagaatgacatgttactgtctgtagatatgtgtcggagaccagaaaacaactcctttgatcctgtttgagtacccttttactatctcttctccttgttgagtgggggttccgaggtcaccaaaattcactcattgttacatgcacactggatctggcagtaacttagctgacagaactgggcaccatttacatagaataagtaggcatactgtgtgcatttgaggagtatcattttaacttctgatgattagcaacctaaattccatatataatcttaattcctttgctctgtgggctaagtgttcacaggtcccagaaattaacatatgtgcctctttggggtatcattatccttcctatgaaaaagaacaagatagttttctcagaatgcaagaaatgtttagatttctaacttcctctggctaaggaatagagaaaagtttttaaaatgtgaattttatggaagagaaaataatacaatagaagcccacttaactatatctatttaagtgacaaaattaacagtccatctccaagtctttgtgaaaatacactgtctattttttacagcactctggccctctggctacacccagatattcctgttcctacctgccacattataaacaggtcagaaatcatttgtgtttttcccttttttatctatctttttttaaaattaaataaccatgatttaaaaaaaataattagccagcccctatccaattatacttgaaacattataacatattttcaacaatgaccttcacttatactttagcaaaagtttgtgtgtcaggccaccttaccatgaccagagattcctgaggaaaagaacgtgagccatgtggactttgatgaccttgatgatggatctgaatctggaatgttagaaatttgggggatagaactagaagatggtagccagaaatgggagccttataagaccagaggctgtaatggggtggaccctaaagacaacataaagagacttttcctggatgaggtattgtgtacattagtaaattttgcctattttaaattttacctggacttgctctctaagttctgtgatgcaccaccattttatttttcactgagcacttgtctagaatcaaactgccctagttttaaactattctattgagttgtacattagatggccccaaattgatagattcccctggtgcatttgaatgaagttttcgaaaatgctatcatgttcatttgagttcttaccatttcttggtgtgttttaattagctctatttccagggactctgagtaactttttatataataaactaataaattgggtgggtcaaggttaatgtaattttaaactgtcaatcaaattccacaatttctcaattcattaatatatgttgaactgtttcacttatctttcaaccagatttcattacaactacaaaaactggcctggcacagtggctcgtgcctgtaattccagcactttgggaggccaaggtgggtggatcaagaggtcaggagatcaagatcatcctggctaacacagtgaaaccccgtctctactaaaacaaacaaataaaaataaaaaaagaaaaacaagtacaaaacattagctgggtgtggtggaggacacctgtaatcccagcactttgggaggctgaggagggtgtatcacgaggtcaggagattgagaccagcctggccaatatggtgaaaccccatctctactaaaaatacaaaaatttagccaggtgtggtggcgggcgcctgtagtcccagctactcgggaggctgaggcaggagaaaggcatgaacttgggaggctgagtgtgtagtgagccgagattgcatcactgcactccatcctgggccacagagcaagattctgtctcaaaacaaaacaaaacaaaaaagaagaacaaacaaaacaacaacaacaaaactacaaaagcttattttatctaatcttgatggtgtttgttggtgatattattatctagagaaattaggactttgagcagtagtcaataagatgatattcttgtaactaggataaatcaaaaggagaaacatctataaagcacttttattacaaacaaatcatggaaatggcacttttactgggttacaaataatatttatagatccagttactaataagctgatcatagaaaggtggcatcgagaaaaggtggtatgcttcttttctcaattatgtatattttttactataatgggaacccttgatggacagaatattcactaacaacttaagtgttttagaaattaaagaaaacacttcaaatgaatgagcatcaagttagtgactattcttcaactgtaggaatccaatttagtgaaaatgttgaaagcccagtgcttcacattcaaactcatttaatatttgcagcaacactggtgacagctctgattcccacctactcagaacaactgaaatggaggagagaagttacttctcagggttcatgaagcatagtataattgagactcagacataattctttaaattcagtgcttgttctgctctattacaattgtcctggaacaaagtagcatgtgacaacctcacaggatgtctcttttatgagaagaataacaacagctgattgtttgagaaccacgttttttaaagagtagaaaatgaacaacctttactgaccacaccagatttgattcagagattgttattcgaggaagaaacaatgacagacagagtggacaggaaatccttccgacttgctggggcttaggcatgtcctatatactgactttacgctttacaattccatatattattataggaatatctttgtaagggaaaatattttgtgttccttcttagagagcttgagaaatgtgactgactgaaacattatatatctctgtcagtgttaatctaaatcttagtgggagtatagaaaatctttagaactctaaaagaagctatttttatataactgagcagtgaggaatctgcatcaatgttttagaagcgtgttggcacattggaaagaacactggctttgaagtcagcaaactgacactcaaactccatacaccaccgtcaagttttgtatgccagagcaacatcaaatgtaacatatgtaaaaaatgaaaggggaggtataatatataagaatacctaccacaaggtgttatggtaaaaataacatgagctattcacttgtcaaaagtgttttgaaaaggcatcattcttgggggaggagccaagatggccaaataggaacagcttcggtctacagctcccagtgtgagcgacgcagaagatgggtgatttctgcatttccatctgagcattgaagaaagcagtggttctcccagaacgcagctggagatctgagaacaggcagactgcctcctcaagtgggtctctgaccccctgaccactgagcagcctaactaggaggcaccccccagtaggggcagactgacacctcacatggccgggtactcctctgagacaaaacttccagaggaacgatcagacagcagcatttgcagttcacgaaaaaccactgttctgcagacaccgctgctgatacccaggcaaacaaggtctggagtggacctctagcaaattccaacagacctgcggctgagggtcctgtctgttagaaggaaaactaacaaacagaaaggacatccacaccaaaatcccatctgtacatcaccatcatcaaagaccaaaagtagataaaaccacaaagatggggaaaaaacagagcagaaatactggaaactctaaaaaccagagcacctctcctcctccaaaggatcgcagttcctcaccagcaatggaaaaaagctggacggagaatgactttgacgagttgagagaagaaggcttcagacgatcaaactacgagctacaggaggaaattcaaaccaaaggcaaagaagttaaaaactttgaaaaaaatttagacgaatgtataactagaataaccaatacagagaagtgcttaaaggagctgactgagctgaaaccaaggctccagaactacgtgaagaatgcagaagcctcaggagccgatgcgatcaactggaagaaagggtatcagtgatggaagatgaaatgaatgaaatgaagcgagaaggcaagtttagagaaaaaagaaaaaaaagaaacgaacaaagcctccaagaaatatgggactttgtgaaaagaccaaatctacatctgattggtgtacctgaaagtgacagggagaatggaaccaagttggaaaacactctgcaggatattatccaagagaacttccccaatctagcaaggcaggccaacattcagattcaggaaatacagagaacgccacaaagatactcctcgagaagagcaactccaaggcacataattgtcagattcactaaagttgaaatgaaggaaaaaatgttaagggcagccagagagaaaggtcgggttacccacaaagggaagcccatcagactaacagctgatctctcagcagaaactctacaagtcagaagagactgggggccaatattcaacattcttaaagaaaagaattttcaacccagaatttcatatccagccaaactaagcttcataagtgaaggagaaataaaatactttacagacaagcaaatgctcagagattttgtcaccaccaggcctgccctaaaagagctcctgaaggaagcgctaaacgtggaaaggaacaaccagtaccagatgctgcaaagtcatgccaaattgtaaagaccatcgagactaggaagaaactgcatcaactaacgagcaaaataaccagctaacatcatcaagacaggatcaaattcacacataagaatattaactttaaatgtaaatggactaaatgctccaatcaaaagacacagactggcaaattggataaagagtcaagacccatcagtctgttgtattcaggaaaagcatctcacatgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagatcaatgagacagaaagttaacaaggatacccaggaattgaactcagctctgcaccaagcagaatagacatctacagaactctccaccccaaatcaacacaatatacatttttttcagcaccaaaccacacctattccaaaattaaccacatagttggaagtaaagctctcctcagcaaatgtaaaagaacagaaattataacaaactatctctcagaccacagtgcaatcaaactagaactcaggattaagaaactcactcaaaactgctcaactacatggaaactgtacaacctgctcctgaatgactaccaggtacataatgaaatgaaggcagaaataaagatgttctttgaaaccacgagaacaaagacacaacataccagaatctctgggacgcattcaaagtagtgtgtaaagggaaatttatagcactaaatgcccacaagaaaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaagttaatgaatccaggagctggttttttgaaaggatcaacaaaattgatagaccactagcaagactaataaagaaaaaaagagagaagaatcaaatagacgcaataaaaaatgataaaggggatatcaccatcgataccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggagctgaaattgtggcaataatcaatagcttaccaaccgaaaagagtccaggaccagatggatttacagctgaattctaccagaggtacaaggaggaactggtaccattccttctgaaactattccaatcaatagaaaaagagggaatcctccctaactcattttatgaggccagcatcatcctgataccaaagctgggcagagacacagccaaaaaacagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaatttaacaaccttcatgctaaaaactctcaataaattaggtattgatgggccatatctcaaaatcataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaagaaaagaggaagtcaaagtgtccctgtttgcagatgacatgattgtatatctagaaaaccccattgtctcagcccaaaatctccttaagctgataagcaacttcagcaaagtttcaggacacaaaatctctgtacaaaaatcacaagcattcttatacaccaataagagacaaacagagagccaaatcatgagtgaactcccattcacaattgcttcaaagagaataaaatacctaggaatccaccttacaagggatgtgaaggacctcttccaggagaactacaaaccactgctcaaggaaataaaagaggatacaaacaaatggaagaacattccatgctcatgggtaggaagagtcaatattgtgaaaatggccatactgcccaaggtaattgatagattcaatgccatccccatcaagctaccaatgcctttcttcacagaattggaaaaaactactttaaagttcacatggaagcaaaaaagagccctcatcgccaagtcaatcctaagccaaaagaacaaagctggaggcatcacactacctgacttcaaactatactacaaggctacagtaaccaaaacagcatggcactggcaccaaaacagagatatagatcaatggaacagaacagagccctcagaaataatgctgcttatctacaactatctgatctttgacaaacctgagaaaaacaagcaatggggaaaggattccctgtctaataaatggtgctgggaaaactggctagccatatgtagaaagctgaaactggatcccttccttacaccttatacaaaaatcaattcaagatggattaaagacttaaaccttagacctaaatccataaaaaccctagaagaaaacctaggcattaccattcaggacataggcatgggcaaggacttcatgtctaaaacaccaaaagcaatggcaacaaaagacaaaattgacaaatgggatctcattaaactaaagagcttctgcacagcaaaagaaactaccatcagagtgaacaggcaacctacaaaatgggagaaaattttcgcaacctactcatttgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaaacacatgaaaaaatgctcaccatcactgactatcagagaaatgcaaatcaaaaccacagtgagatatcatctcacaccagttagaatggcaatcattaaaaaggcaggaaacaacaggtgctggagaggatgtgaagaaataggaacactttcacattgttggtgggactgtcaactagttcaaccattgtggaagtcagtgtggtgattcctcagggatctagaactagaaataccatttgacccagccatcccattactgcgtatatacccaaaggattgtaaatcatgctgctataaagacacatgaacacgtatgtttattgtggcactattcacaatagcaaagacttggaaccaacccaaatgtccaacaatgatagactggattaagaaaatgtggcacatagacaccatggaatactatgcagccataaaaaatgataagtttatgtcctttgtagggacatggatgaaattggaaatcatcattctcagcaaactatcggaagaacaaaaaaccaaacactgcatattctcactcataggtgggaattgaacaatgagaacacatggacacaggaaggggaacatcacactctggggactgttgtggggtggggggagggtggagggataacattgggagatatacctaatgctagatgacgagttagtgggtgcagagcaccagcatggcacatgtatacatatgaaactaacctgcacattgtgcacatgtaccctaaaacttaaagtataataataaaaaaaagaaaaggcatcattcttatagcaccattattacgaagaaatatttgtttctcattatgtcagggattgatggaatctttcccataaagaatgtatgtatccaaaaatagagctagtattaaattttttattcacgaccataaataataactttgtggctttgaagagttattacaataaaatagtcacaaagatgctagatggtcactcattcagaaacactctgttatgtaaaaacaaccatggtgtgaaatgttaattgatctcatatcactttctcttccagtttctcttatttttcttttaacattggaatatatcttgattatgtcattagagcctatctgtcttttctgaccattcttgtgcattctgcgtctgtactaaatagcagtagaaaagatgctgatgtgcttaatggtactgagaaatacattcatttacataaaatgtctttactcagaagatgtggattgctgaacactaatgcagtgcaaccatctaaagtggccaactttgctgaatacaaggaattccattttgattcataatagttacacatttttacttaggtaataatatgaaacagaaatatctttaaaacatattttttggtttaataattactcatttagtcataattgcttttctcgaaagcatggaataagggtcaggcaggtaccgagtttgaaaaggaaacctttgacaagaattattacagatagacgtgttgtgaagccagtagagtaaaaagatgctaacctcatcccatcatttgttaatgcaatcattgtttttaggactttcacaattatttcttttaagttcactaaggatttcttaaaaataaaagtgaaaatgtttcctggacagccaagaacagttactgtgacagaacctaatgcttccccaaaacaattacatcaatctgatataaatctctttgtttttgtattcccatcaagaatttcaaaaattttaaatccagtatatcagaattacagctttttctgtaaagttcaagataatggcagtgggatatgaattactgtgtccttgaatggatcattgtgggactctgatatgctcattctaagaggagaaatcaaacacggcagagagagagaaaagaaagagccagagagagaagaggtaaagagagaaagaaagagagggaaggatggagaggaagagaaagggagagacaggtagaaatgtcagtagaaatggaataggccaatcacttttttctgatgacatgtaatatacacactgaaggaagagcagaaagaacaatgaaaacagtgatttgtgtgtgtgcctgtgtgtgtgtatatttgtgtgtgtctgtgtgtgtgtgtgtagcttgaaattctccacaaccctactaacatgaattacaaagagtgagttgtggtatgtgctttttgggggggggggggggacagagtctcgctctgtcgcccaggctggagtgcagtggccgatctccactcactgcaagctccgccttctgggttcacgccattctcctgccccgagtagctgcaactataggcgcccgccaccatgcccggctaatttttgtatttttagtagacaggaggtttcaccatgttatccaggatggtctcgatctcctgaccttgtgatccccccgcctcggcctcccaaagtgctaggattacaggcgtgagccaccgcccctggccgatatgtgctttttaaattagatgtatgaatataataaaataacacattatatacaaattttataacctgttttcgttaccaagactcatttcatgttaataaatgtagtcctgtaaaaatgatataatattccattttaggatatgtctcacttcagtactattttcagttacatttcttacaaatatttagctgttagaaatagtgcttggataagtctcattataaaatttgatccactttaattactttcttagaataaattcttagaaacaaaatcacaagcaattggtaatgtcgaattccaagattatgagaacaattagagacaatgtcatttacaaagctcatgttaatttatatgcagccaaaaaaattgatatcgtagggcctgatatggtttggatctgtgtcctcacccaaatgtcatgaagaattgtaatccccattgctggaggtgttgaccggtgggaggttattggatcatgagggttgtttcctatggtttaacaccatctccccttagtgctgtcctcgggatagtgagttattgtgagatctggtgatttaaaagggtgtggcacctcccccactctcatcctcctgtgctggccatgtgaggtgcctagctcaccctttgccttccaccaagtttggaagcttcctgaggtctgtttagaagcagaagccgctatgcttcctgtacagcctgcagaactatcagccaattaaccactttcattcataaattacccagtcccaaggatttctttatagtagggtgagaacggactgatataggggtccattttcctaccttagacaacactagttatcattgtatgatttaatctttgcaaatgaaaaatcttataatttactctgttagcattactgctattcatattgaatatatctttacatctgtctttcctgctttgcttgtccataatcttgacccatttgtttgaaatattgttatatttattgatttgtaagagatacagatgttatatattagaaacacgaaaatttagcaatatatttttcctatgtcttgtatgtttcatgttaagcttattactgggtatttttttttctaaagtgagtgatatatttttcttatgattgtgtttctctgattattgctgatctaggatgattgatatctgttcatttatttaactaaatatattactgagtcttcttgttaattggaaacctttacattgaaaatgttttccttcacatggatatttttaacatctgcaaataaggataaactttgtcacctacttccaaatatttagagatcctatttcaattttttttttttttgagacagagtcttgctccattgcccaggctggagtgcaattgcgcgatcttggctcactgcaacctctgcctccagggataaagtgattctcgtacctcagcctcccgagtagctgggactgcaggcatgcaccaccacaccagctaatttttgtattttcattagcgatagggtttcgccatgttggtctggctggtctcaaattcctggcctcaagtgatccatccatcttggcctcccaaagtgctgggattacaggcgtgaaccaccatgcccagccgctatttcaattattctttatatttattagaagtattagaaaatgtatgaaataatcatagtgataggaaacttcccttttttagagcatatgctagacttttgcactgtttgaatattgtttagaaatgcatatctcttcaatatttaaaaagtataatgtacaattaaagatataaaatttaaaagtataattatataaaataatattttatacagcaaagtttgaaagtattatttatataactatcttttactgggattagtcttagacaactttaaacttttaaattgatctttgtagtctattcatgttttccggctttttattgttcttggtaaatttaattgatattcccctaaagctccgtccatcatatcaataactttatattattaatgaagaaccatacatgaataatttaatatattttataactatggctatgtcatttttaaatttatttcatttgcaagaggcttgacttatttctgtttctttaaaattctactttttttctgatttgcattgtcaataaattatataaactgcattccctccactgtgtctttatatttggggttgattttcacttcctgatctggattatattttttgtaaagtgtcaaagatgatttgaatgagtgcatattttgtttatgtaataaaataaaattgtatgtttattaaatcaggattataagtatattattaaagagattgtcatattgtgtcaacttaaaaagctgagcattgtgttataaaaggtagagaattgcatgtgtaaatgcattcttcctcttatctgactcaaaaaacttctatttgtctttaaaatgatcttaaattgaatatttaaattggtgtttccttttgtataattctatttctcaaatttatttgacctaaacttttgtttgatcacaagtcttagattaattttcaggtttacctaattttgtttctcaccatcatatttacttctctattatagtctggctacagttaaattattaataaagagcaaaggctctagatcacagaataacttgagtttactaagagcagaaagaaaatgtcagttatcttatgcattttaaattaaaattaaatggtactccttttctttgttgttgaaatccactgaggtacgcagaaagaaatatgaactgatgccgaatcaggcaaagagtgccattcaagcatcagaaaattttagaaatctttgaaaacttttaaagtaagacaaaaaggaagaaacaatctataggttacttgctatatgcaagaaaatatttgctttgggaataagagtgaaccctgggagcaagctagataaaatcctcttgattggagtgagagtagtgagaaggatgaacaggtggactaatgggttgaagtctgtgggagagtatgtatcacaaaaatcattctggaaagttcatcaggtaactgaaaataatatcaaaacgggattgagtcctaccaatcacagcgatgcatgccttgagggtcattctgggtaaagttgtggcagtgtggtgacactgcctctgtcacatatgcaagatttacttttagtaataggcaaagattgttttctttatccatctcaggttacagtgacatggtttgccaccaaagctaaggtttctgacatattactagagttaatggttaaattgaatgttcttggacctacccgatgttctgggttctacctttgtcacttaagtaaatctgaatgttttattttttattattcttttaccaagacacaaaagagtcacccagttaccttatgtcatagctgatggaaactatcttcaccatctcaaattttctaggacatactagttaagaaaagtattctctttgagcaaataagtaaaaaaattaaaatatgaaagaaatttcaaataaagaaacattttgagaatttgtttaaatagttataagaaagtgaagaaaattataaaatacctttttaatatccttatcaatattcaatatcattctacttctataaaagtagattattaaataataagtaataaactttgtgaggaaatatttattggtgaacaaaaaggtaatctttgcctcttaaaaggcagtttgttagtgagccatagattagttactggaaaagctctatcagcacatttgaagataaacagagaaattttctcaataatcagagattaagaataaaaatagaaatgatgagacagaagaacaaaaaatgacacacagaacagatgcaggagataaaatatacatagaatataaattccagaggaaagaaaaaactaagagagagattgtaatactttaaacaaagtagtagtagaataacatgaacacaagtttaaaaaatatgtatggtccaaaaaattagccgggcgtgttggcgggcgcctgtagtcccagctactcaggaggctaaggcaggagaatggcgtgaacccggtaggtggagcttgcagtcagcagcgatcgtgccaccgcactccagcctgggcgacagagcgagactgtgtctcaaaaaaaaaaaaaaaaaaaaaaagaaaagaaaaaaaatatgtatggtcaggaaaaattgtaaaattaccagcatctgatcatgtccatgctttttaagttacataatttttaaagttggaatccccaaaatacttgaaaggcactggtgtcaagggaaaataaatcaaataggcaatttgcaattaaaaatattcattatttcctttctttgtgaacccagttagaaaagaagaatggagggaaaaacatcacaaattcaagcctcaaacaaaccaatgcaagttaaaagtgactgtgtccttactaatttcaaagccatggtgttttgaggtaaaaatattgtgacctaaaattttagatccacaaaactccgatgtgcaaaaatataattatatttttagaactatctttaatatctcacttggaaccccagcttgcttcttagcaggcaaattcatctagttatttccagctaatttaagtccagctaattccagctaagatatttataaaaccatcacattgcaaataacagtttcatatttgagttttctctcttccttaagtttaactctacagtatgaaatttgtggcatctgaagatttgtgtccatattattttcggggaggatgtgccattttgtaggtgccctttgttaatacatcctttttggtgtagaccaggggttggctacctttttctgcaaagggccaggaagtgttttagacattgtgaattgtatagtctttgttgcagcaacccaactctaccattctagcatgaaagtggtcataaatgatatgcaaatgaataaacatggctacattgttttaaatcttggtttacaaaaccaggaggcagatttgactgggcctgtggagtgtagcttcatgatctctgatacacaaagttcacagaactctctctaaaatcctttaatatttttttaaatactgggtttcctagcacagtcattctcaaaaacagtcccatgtgctcacaaacaaaagtatatgtattgtgcatctccattggaggagttaactccctctattaaaatctatgtttcgctcagaatcacaccaaactgttgaaacttcctccaggccatttacctatatagaaaactcagggaggtgtttggggtttcttaatgtgcgtatatcaccattttctcatccctgcaaggtcaccgagtactgtaaatcaagatgataaaattaagctccaaattcactcttcccatactgcacacatgaaggagctaggaagctctagttaagataatggaagtacagtaaaaagtagaggaaaaagaagaaatgagaagcaatatgtcccacaaaggacagtcatgcccctaactttcctccccactcttttgtccctgatacaagtaggatacttgtgtcccttgtgggacagggtagaagtaagttatacctcacttctaatttcttggttttcctctatttttcactctgtcttcattatgttaactagtgtttcctatccctctctttttatagtggtatgggtatgctaggaagagaaacatgcttccaaatatcttctatctggaacttttcctgcaatcttgactataacaggcaaaaatatgtcacccttcccctactggggcagggaaaagggctgaagacaccatttgatattttaaggtagtagttgcttttccagtattaataattcacatattatcttttcacaaaacaatgacaattatgttaacaaaataaagtaccaaaaattgtcacaatacactaatacatgagaaatatactttcatgaaaaatgtctgctttcttaatccatttatgaaaattcttcagttgctaaaaaaggattaaaatcacagaatagcaacaaacttgtagcaaataaatatcaagtttaggaattttatttaatgtttaagtttttacttgaggtgtaatcaaacaataatattaatttactttctgtcaactcaggtttagatcaaatctcatatgtacagctgtgtatccacttggattaaattctttgacaaaatgcagaatttcaccattaagatacatttgtctaatagttttaagttttgtctaggaatatatctggctcatcacataggccgtattaatgaggaacatgagacttgtccccatgcaaaaatgtttttaaaaagcagcatttcacataaatgagagggggaaaatttaaaaatacagacgaacccggaagcatctgtgtaatcactcttggtggcctagttaacagccattttctttccctttttttcttaataacagcctacctcacatgacagaagctaaaactgccacattctcaatttagcctcagttgcagctaagcgtggcccagggtttggccaatggaacttaagaagtcttcagaagaaatccttagaaagatttccctctgttaagagcatgaataagaatgtcatccacgatgtattccacatttcatactaacttcgatcaagataaccctttggctcaaccatttactagaaaaactcacaggagtcagaaaagctgatatgctcctggttacggtttattgcagcaaaaggatatagattaaaatcagcagagaaaaggtgcaaaggacaaaattcaggagaaactaggtgccagattctaggtaatctttcctcgaagagtcacacagacattcttaattcttccagagaatatgtatggcacacaagcaaagtgttgccaaccagggaaattcaccagagccttcatgtgcagggatatttttggtggggggaggttggcagtgggagttcaatcatatacgcacctaacacctttgtgagtcaactcagctcttaagacttcaattccccatagcaaaaacagatatttgccataaaccgcatttttagtataaactaagtgatcaaactggtacctcatggcccaaggcctcagaaatgtgaaacaacacaacaaaattaaaagaaaaatgaggcagaatattccaagagctcagagttcatcttccaggaggtagccaaggaccagtactgaagacaaaactttcttgagaatgtgtgaggtttgagcaacccagcccttctggttaaacctctcctgcaaactttgaacttgactatgtaaggatatgatgtttgaagctgcggccctcatcctgtgactatcaggaaagttgggaaaattgtgaaagccgatacgagccctgacattttttaatttataattaccacttctgaaccaacttcccgtgaatggctttacgtgaaatatattaataaattctatttttacagccattttacttggctatccttttactcagttaaagaaatcttaactgacacagcatccaatgcacattatagcatacaaataaatattgaaggttaaaaagtatatcttctgacagaattaagtcttacatatgacgggtctgtcttcttgttgtgtcattttctggtcctttctccaactttaaacagatgcaacagctgcaatattcctgttgctacttttaacaatcggaagacattctcataatcttttactcatttttttttgaaatgctatttacttccaattaagctagcccagtgttttacatgataaactttcaataaatgtattgaatgttctatttgaatttcagatagttttccaatgagattttgccatataattcttttaaaacgtaatatgagatccttgcctggcatctacaggtgataaaaatcacttcgaaggagatatttatgacactgtaatcttaatggaaatagttaatttgtagccattccatatttttctattttgcttttcttttcctatagaaataaaaatattttcaccaaaaagtataaacattgatgtaaacctctattagcctcagataaggtactttaaatcctagctttccagtagttccttctgtaataccttgaatccttcagcacaattttagattattagataacttttataatctccaggcttgaatgtttggttttgaaataaaggtgtaatttcctatagaattctgaaggtttttcacttgtgtgaaagtctgacattgaggttttagtgatttattttggaacctggagaagacttcattttcatacctgtcacactaggtgatttgtagggcttaatgacattcaaaggttgtcaacttgatttatttgtaatttgggagactcagctagtagatacttggagctggtttgttggtttagaggtgttttcctgtgtgtctaaatacagaataatgctacagcagtaagtaaaatgtagtgtataaaacaaagctcccagaacaacttatagtgcatggtagattctcaacaaatcttctttgccttctacttcattcgctaaagccccattattataggtcctatctctactatattttaattaaataatttactgaaactatttttcctagcgtctgtctctgttttcttcaatttaaacacacttacaaaatttagaacagtcttagattaacggaaatttgcaaagattatactgagtttccacgtacccctcaccctgtttctcccatttttattatctttcattggaatggttcacttgtcaaaactaaaaagtcagccttggtacattattatgaacttaactttacactttattcatttcactagttttcacctaatgtcctgtttctttctgcggattctatccaggatacaatcacacatttagtcatccagcattcttaggtgcttcttggctatgacagtttctcagactttgcttttgatgacttgacaattttaaggagcactggtcaagtattttgtagaatgttgctcattttggatttttctaatgtttttctgatgattaggctggggttgtgtttttagtagggagaccagaagttcccttctcagctatcatatgaaatgtacgtgctattaagatgactaattgctaatggtgttaatagtttgatcacctggtagaggtaatgtttgacagatttctctactgtgaagttacctttccccctttttttcatgctctattctttgaaagcaaataattaagcacagtccacactcaagatttgaggaactaagcctaacctaatatagcaggtagtacctatataaattatttagaatttttctgtatggaatatttgtttctatctctcatttatttatcccatctttttataccattaaggacattataccataggcattattttttattttgctgctcaagttgtttcagttttggcagttaggtatcttttattttggctcctatatccctttaatatttccccattgttttgatttttgtggatgttcttactttctggaactataagatgttctagggtcattttgtgtattccctgcacaagcattagaatcagccattttttatggagccctgagtccttttatttagaatggcataagaaattaagatctggggttctgtgtgtatatccaaggaaataaaatcactatctgaagagatatttgcattttcacgttcattgcagcattattcacaataaacaaattgtggaaataatcttgctatctgttgacagattaattaaaaaagaaatgtgacatatacataaacgcaatatcattcagccttaaaaaagaaatcttgctatctgcaacaacgtaggtgaacctagaagatatttttccatgtgaaataagctagatgcaaaaagtcaaataatgtatgatctcacttatacatgtatattagtctgttttcacactgttataaagaactacctgagactgggttatttatgaagaaaataggtataactgactcacagttcttcaggcttaacaggaagcattactgagagtcctcaggaagcttacaatcatggcagaagcaaaaagggaagcaagcacatcttaccctggcagagcaggagagagagagcgtgcacaaagtgggaagtgccacatactttcaaacaatcagatcttatgagaactcacttactgtcagaatagcaagcctccatgattcaatcatccccccaccagacccttcccctgacacacgggaattataattcaagatgagatttgggtgggggcacagagccaaaccatatcattgtggaccctaaaaatttgaattcatagaagcagaaagtggattgataggtgccaagggctgggaggtaaagcaagtaaagagatgttggtcaaagcataaacttttaggtataagataaacaagttctggaggcctaaatgtacagcatgggtgctacaactaataataaggtatacttaaagtttgcttaagaaagtgaaccttaagtagtctcaccacatatgcaaatggtaaccaacatatattgcagccatgatgtaactatacaggaagccagcaggaaaacaaagcagagacaaggctagattgatcttcatctcctagacggagaaaattgctaaacaaaatggaagtgtcatggaaactaaaatgataaattttggaaaatattaatataaaaattacttggtactattaatttactataaattagcttatttaggggcaaacacaatagagttatgtactaagcattatgtcttattgggaagaatcacaaaagtactaagtatgatctgatatattcagaaaaatgtatatattgactttcaatgaattaaacttctgtcaatgtctttgtatgtctttgtatactttattgttaatgaaattaaaaagagataggttttaactatatttccatttctaagtctttcgtttttattgttttaccttttatgttaaacgtttgtctaaagttcatgaaacctcttgcaaccagtagtatgctggagctggtttctatcagcttggaagatccagttgttaaatttgtagaaagtttgtgagctggttgttaaacagagccattattaaaaataaaattacataaatttactattaaataagttatattaataaatgaaggtaataaatactcaaaactgagcaaaaaaaagacagggtgttaatacgctcattgctactgggtcctttttcatttctgtcatagaaaatttcaaatgtataaaaaatagaataattattgaatcattcaaaatgattcactcaattttaacaactatcaacacaagaaaatcttgtttcatctactcctctacccacatattctaggaaagcacttcctgtgcattttctaaaattatattttgtttgccacttcctttagtcaatcccactgtactagtattttgcaaaacaatctcagattttgttttctttgatgctatttccttactgtgtttcacaaaggcaaataggaatatttgtattttatgtttctttagctatttcagtggtaatttgggtggtaaaacttgaattaagtatagggtcacaaatcattatcttcaaagagaatatcttattgcctttttttacattcctgaaatagtagctcaaatggctctatatatgaggcatcctcaatattactgtggcataggtgtggagtgttttttacagggcttttttcaacggtgttttcatttaggtttctttcttgaggaagctctattgggaatatgtgctgacatttcttaaatatactggctccttaattacctggccagcatttcacaaatagttaaggtgtgaaatgaagacaaacttatttatgtctttctgaaaagttatattataaaaactcatctcctttcagaaattcacttatcctaaacacctattttaaaactaaagcaaaaaatatatataataggtctcataatcatgagactggaactaaggtactgaaattgcaccaacctgtctttataaactattttcctcaactcttctctttttgttctttatgagttctatgtgattatgtagataaaccatatattcatcccatttctctttttctttggctcattagagccaggagtacaatttaggaagaacttgatagatgtagctaaagccccatccatgcatttatcccaattccacagtctaattcaattctattttatttaaaagatattgctaaacttccactgtatggcaacattctaaatactgaaggtggtagaagaataaatacatacagttcactctggtataatacttcttttaaaaatgcacattagtctcaacactactgatatattatgaaacagtttgagcgtaatacaaattttgcattggcttatgcatgatttcatctgtgagaaacactagctgaatgcagaaaattgcacccagctgaactgagccaccacataggaataataagacacacacgcagacacacacacacacccctcaaatatctaccacctgccttagttcaccacatgtgttgtaaaccccatggattcatacattgtgttaaaactttcaatccaatttcatatagaattccttctacctcttcacggtaactttaaagccggaacccttctgacttaagcacagttccaggaagacctctattgacacgtgcctttgtcttatcccctgttcttgggtgagagagacttgtaacttacatctaaacataaaacatggagagtcgatgggctgcctctcccatgatcataatacattgtatggcaaatgtaagaaaaaaaggtaaagatgtaattgagttcctttaccagctggctttttgttaataggcagattattctgagtgggctttacccaaccaggtgagccctttaaaagagggtaaaagagatggaagaataagttagagatgctttcctactcttcatgaagaagcaaatgctgtattgtgaactgcccagggagcgggttggcttccagcagatgacagcctcaatccttcaaccttcaaagtctgttctggcaacaacctgaatgagcctgaaagaggaccaagcctttaacaaaaatcacagcctcagctgaccccttgatttcagcctctgaggctcttagccgaggatccatttaagctctgtctggctttctgacctatagaacttcaagataaaaaatgagtgttgatgtagcccattaagcttatggttgtttgttaagcagtatcagaaaactaatagacgttctgatgcccttatccacaaacaagcttcaggccattttcaaggtaaatttccatttttggtcatattcatgcatttcttaaccattcactctgtgtaaaagtgtgctacctgttttattaggttcctatcttttcttaaatgtctcactaacacaattttttagtgttatgacccaatcccagttactccatagggcttgtggtttttactatgcaattttgcatggcaaagtggttttttaggaatacatatgtcataatatgttagaactagctatactcccaagatttggggagaaaacctcacacagtatttataatgaaagcatcctaaaaagagtaaaacatttaaaagtggtattcaatatagttgtcatagttgctctccccttcctcttttaaaagtaatattcagcttgtaagttctttgaggataaaaccaggttgttacaagccttttctttccaactgctatgcttataaatgacacatggtcagcctgacaattcatttaggagtttgttactctaagtgaatttgttcaaaattctacttttcataaattgataaataaaattgtctccttcttttggattgtaatgtttttcattcaatatttaaagtgattgaggaaatgtgcaatgtgtctaggagtacttttataaatgattaacaaagaactttaaaacatttactttttaaacatagagaaaataagactacaataaattgtcttacaaagaaaaacagtttcaacaagaatacaccactgccaatcaacaatagtaccatatcactctatattagatccagcaaattttattacataataaatggattctctaggtctcatcctctaatgaaagtctatcattgcctattttgtatatgacaaggagatacattttgggcccgaggttaaatgctatggattgaatgtgtctaccgaaaagcacatattggaaacttaattcctaatgcaacagtgtttggagctgggggctttattagtggtgattaggccaggagggctctgtcctcataaattaaagctggtattgcaggaatgttttgttatggtgttagtggtttccttatcaaaggatgagtctgaccccttcttgctctctcttgccctctctttgtccttctgccatgagatgatactaccagatgccagccactctttcttggactttctagcctccagaactgtaagcaagtaaaattttattcattataaattatccaggctgtagtattctgttacagagcacaaaacgaactaagactgtctgcatgtacatactattccttacactaaagttccctaaaacctatcagaaaaggtcatgaaaacacgaaacatcctcctcgtttcaccaggaccaaagcaaagatacgtgaaaatgtgtcaagatggtgaatgaggacataatattttacatctgcttaatttatttttgcatacaaattgcaaataggcaattctctattgtgattttgcttatgacatttggatttttggttattagccacttgcaatacttatgttcatgcatttggtgtggatctctatagagatcttcatcagtgattatctaacctattccctaggaaccctccctttgctagacctgcatagtaccatcttaggagttaccatattcttacatgaccaccctaggaattaccatatgtatccacattgatgatttggattgagatgaaaacttctcccaaaatgatccaatttagttacttccttatgagttttagaccttgaggggattaaaaagcctctaaaggccttgctgtataacggttctacgatgtaaacttttgttcttcctgataaccatgattcttacaggtcaagtgtgagagataataaagcagatgccatacataaacagagacaaaagatggaattggaaaggcttcctggtagatgttggttctcggagctactgcctttcctattgttagttttccaaaagtcatgtatgtaaaaaagccaatacctttctctattccaatccactaatttacttgggtttctgtctcttgcagccaatggaatcctaattaacaaactaagaggtagcaaataaatgaatatatatcatttagtatccttgattgtgtattatgtcctcagtttaaaaattcaacctgatgtttgatattcttcttaagaaactttccatttaaaagtactgatctctctgtgaaggtctccgtctaaggctctcaacattgagacaggagacaatgcagttaagcaggtaaaaagaggtaaaaatgatgtcaagggttaaatcaagcccttttctgactaggaagcaacacgatttattttttcatgtaacttattacttcagaagccttgttcttaaagcgcaattacactgaaatgattcaaataagctgaataattttgtaaaatacgtgtcccaattgcctttctaaatttcatgctcctgtaaggcagagaatgtgcccttccaatttttatatggctttacatgagacatataatagtcacataataaatgtttgttgaatttaacagaaggacaggagccatgtggatgtggaaatttaggtttgcaacaaaagtcacactttagaatcacatctcatatctgatgtttaaaatcctttaaaatattgataaaataaaaattcagtgttaattggagttctctattttgactgtcagttctctcatttaaaacattaaaagtggtatcatgtataatttactgaataacagcaaaagccattccaaagtgttatgaatatgtttaaacaagtgcaggactagaggctgagatgtaaagactttcaattttgtggttgcaagatcaaattctgcagcgtgcctatgggcctgaccactatccacggaggagctttgaggatttttgatgatatagaacaatcagtggtgaaagatcaaagccttgaacattgagggcaaatatgggttcatgcattttaaaggcagtcgtgccttaaatgatttcagggcatagaataaagctgctggtgctggtgagatgggcattcagggaaaccaactcaccttctttttacatgaataggaaaataaaactgtaacccagaatactgagttctcaatgttttcaagctgacagaatgacttttaatcagttcatgatattaaaaaatgcttgtcaagtttgctacataatttgtgagaatttcctttattgatttacactgtgaaaaaaaattaagcaaagcaaagaacacaaaagaatgtgatgtagtcaactttaatataaaatcatattaatatatttcctgtgattgtttctatgttactctatttgattttaatcaacattacaaagctctatgtaatatagtatgttctcactttcagagtgacttagatatgattttgtgagcattcctgttacaaaggtgagcagatgactaaaacataggtttaacttactactactggagttatcttactacaacattactatgataatgttgactacatattttaacctcaagctcaagcctacaagctcagcctctcaggaggagctctggagcgcttcaaggaaataaaattaaattaggtcacagagtttaggaccagacatatcactggaaggaaagaagaggttttgtttgctttgttttgtttctttgtggggtgacattaaacagctagatgtttcgcaaactaacgcccatgaaccacatcgagcctacagtacaacaaatgcatttgtgcccatttacctccctagtgtccatggctgctttcatgctacgatggcaaaattgagaagattcaacagaggtcttatggctgacaatgctatctggacatttgcagagaatatttgtccacccatcggagttgggttcaagaaggagtgtgaactgataattttagacctgctctgctgttgctattagctttttttaacttcggttttcttctgaaacttcctttgcacttacagtgagaaagtctaaatatcctactacagactttagaaaaagtgagagagtagacatgtttctttaagttaaacaagtgaagtccagcataattccccagggctgcagactttacaggattatgacaaagccctttctgtataataaaatgagtgtttacctggcattgcctccaccaaaccacatatcctagcatcagtgatctgattaaaaaataatgtttcaaagagaaaaatcaaagttacctcatctatcctatctttgtagcatgtttttagaatataaatatttttaaaagtaggtgaatatgttttgtactaaaattctaaaaatgtgataattgcaattagagtttgtgtgtgtgtgtgtgtgtgtgtgtgtgtgtgtgttttaaatttaatttatagaatactttcttagagtgaaatccagtttgagttgaaaaactatctctggtggttatttttattttttgtatttctctgcagaaagattggagatcagtattgtatcagtttcaggctctgtgtactaatggtgtaatttctaacagccaatccacaacaaacccataaaacttgtcttaatgggattttgccttgagcaccatctgtaattaggtagggggtttccactgcaactctattactgtgatttctaggtaagtctcttgggggccctttggcctctgggcctccaagctttacagcattcactgagcattagctaagtctcatgatgctcaggtgcgtgtgcacgcatgcgtgcacacacacacacgcgatatggttaatatccatcagcagttctgtaattagtaaacgtgtctgtgctatgggttttgttcttattttattattttcttcctttttgcacatattggctcttttgatgtaagtacaatccaacctagaggcacagaagtaaccgcagatgccacagcagaagtgtgctgatggcaccatctgctttctgcaattctctcttggtcattgatttctccgggagattttcttcaaaatagttggacagtcttacagcatgttgtgtgacatatggagtgctttttcactattgacttcagcatgctgtagtggaaggagcaatggatgtggaatcagagggccagagttagaagcctggattagtttcctcactagataaagtcatgtgtccttcctgaccttaacctcctaatctgtaaaataatgataaatggttattaaaattgcctaggaggtacaatgatgaataaattagaaaacattagaaatgctcaagaaattatgaagcactgtttacaaataaattataatgaattacattctttataattttctagatggtagccaaatcattttctatcatccaaaaagaatatttcacaccagtcctagtgatgtttataaaactgtgtcagcactgcttgtggctcatagaccttgtatgatttttgaggtattttacatttgtttaaaatttgttttacagcagttatcttacctatgcaagcaaaaggccatgggattatggaacaaaagcaatgagaaagaaagaaagaaaaaaataactgaaagagaatagaaaatatatttacttttttatcaagtcaaaattaatgctaatatgttgatatatctgatttccatcaaataaacaagaaagtcattaaacagaagtgattatttacattctggacagtttttaggagaaatgtgagcatatattaatgcatattagcaaaaatactcatgactatcaacattatgtgaaaatcaccttctataataaaataaagtaaaatagggaaggagaagccatttccttattcttttctcattcctgctttgaccttgggttgtacagtcttccttgacctttctcacaatgtcttcctttaatcctgagtgtgggacaaggttccctgctgtgcccgtaatgtgcctggatacactctctctctccaccactttcatcactcagtgtctcctagttgtcctcctactgataaggacaattcttccttgccctcaaagttggagggatgaaatccaattggctggctggatacacatgttctctatggatctaactgcctttacagatggattataaggtcttgatttaaagaagaaaagtataaaaattcatttggccctcagttccaacgtacttttttctgtccaggtttaccagcataaagctgatattttgctaccaaccataccctagttttacctttcaaatgatccaaaagcattcaagaagggagtcgtgattaattagaaccctaaaaattcctactaataatttcaatattatgatagagtgcattaagttgagagaaaggaggatgggcagaacagggaggttactaagtaaaaacagggttttaagactaaacaaaaaatgtatttccacaagatatttggctccagttactttatcctgagaattgatgacttcgatcagtaactactgtgtttctcccatcttctgccctttcaacgtgaattttattgtgttcatcctgttcctccttgtattgtttattggatgaggctggaaaaagtatcttgagccacggagcatcatatccagatgtgatcacctccttagtagctagactttaagctgaaaacctgaaatgactgaaccttgagtttagttactagggaggggtaaaatttgcttatgtgtaccaaaaacaggttctaccattatttgagtgatcaaagcaccaagtatggagaggcagatattgtcttccaccaataactccttgtctccttctttcccctagtagtataatctccaacatgtatacattatgatatgtatacaggtacctataataaaggcattcccctatcttcatcacaggagtgtttagccagtggagtaaagtgaaagttaggagtgtgagtgcaaaaaaatattacaggaagaagacggtacgcccttagtctgtatcaagtttggaatttggtctcttctgtactctgaacctatgtttcattcttgtaaatagaaaaatattttctatgtattttctaaatatttccagatatttctaaaatattttctaaatattttctaaatatttgtatatatatgacatgttatatatatgaatgtgttcatatattcatagacacacatgtgttctctctatatatacatatacacacgtgtgtatacacacaaaagagaggaaaatacttactctaaagaaattaatttgaaatgatgtgttctttttttggtatttaattttttaaattttattatactttaagttctggggtacatatgcagaacatgcaggtttgttacataggtatacacgtgccatggtggtttgctgtacccatcaacccgtcatctacattaggtatgaaatgataaactttcacacagttggttgaagttcacatagaaaaatcatttgagaaatcttaatattcaattcctcacatcctatttttttatgcataagcattaaccattaagatagataatattgaacacaacagcaagtcaagttaggataacaataaatatatctaaatagcacattttaaaaaatatgtgaaatgccatcaattcccttcatctgaatttcatgtcaaaaaataaatgagtaatcaatgaaaattgtttctaaacaatcaataaaattgtttctatttctaaaacaataaagttatatgttacccctttctactatggtataacttgccaatcactacatcttaaaactgtgtttctctgtgcaaaaataggcatgtttttattctcacacggtcatacaaatacctgcttgcctgcagaggtatatttttttttagcattgctgtaaggatcaaattttacgtagttatcttccaaaagtaatttcaaaaaggtaaatagaattggggtatgtaaaaagagagaagtacttattaattttttagaattgtttactaaagttatcctcaggtattaaaaattgcattttataattaattattgcatttagattatcatgttttgaaaaaataacataacagggttttgatccactggtgtactagcaatttccattatattgattgaaagctgccagataactctattctcagttacaaggtgttgactggatctgagactgatgatttaaataaataaaaagggagaaatttctgagcacagaattagtatcagaatcaatgaattatccttgctgggtattattcattagccctggaaacaccagctttagagtcagccatgacatttctggaaaagttgataatttaaccctttaccccaaatttacatgctttccttccccattttacttcaatattaagagtagagatttcaaatatattggtaatagtctgtcctattcagatacacccatgctgagaaataacatcttcaagtcagtggctaagacgtcgataacattcacattgatttatcagtgttcactttgcatcagtactccagctctcaaagcaggactctgtattaaatggaaataaagaaccttactctgcagaaaaatctcatgagaatttaaataaatgggtctctatgcttgtcactcacataatttcttcagcaatatcactataatgtaattatgttgaatacgataataaaagagagcattatataaatacccacttacacacatatgtataactttatcagacagttaaactattaaaaggcaattgtttagtgacatggagtaactgtgttaaaggatgttaaaaatgattaaggtagtctgaataccagcatttagatccagtcgtatatatgacagtaatgtgactagggacataacaactaaaattttgcaatttagatgtctccattgtaaaattcagattactgtgcctttctcacacagttgttgcaagacttcaatttaatggtgtgctggtaaatgtgtaacaaccatttctccaggcaaaaaaatttaaaaagccctgatctatagcagttgtcaatttgcagtgtgtaaatattcccaccgtggccaatttcaaggtatcagtacgatgtccctgaacatggagctgggaagatatgtgcagaatcaggtttcataaactggcatgagttggaaacagctcaccactactcccattggaaaacatagatgacaatactgtgtactatgtctcacaaaaagcagatgctcactaaatctttgttgaatgaatgtgtgtatgaagaaatcctgtagacatttactcagaaaggaaaaacatagaaggtattcagcagtgtatcagcttaatctaacaattctgtaaatctagtttatgattaaagtaaaactttggaaagtacttagaggattttctttcccaattccatattctttggaggaaaaaaaaaaagatgacttagataggaattttaattaaatatgctgattatcgaactttctgagttcagtatcatttcaccaaaaagagaaaagaatagtaataatacaatcaatgcaatggtctcaatacaagcctattagattcaagagcaggaaagacaaaatattaaaaatgacattgtgtagtgtaagtaatgggacacagtatcccaaacctaagtaatgggacacatattctttcaggccaaattgtatattatatatgcaaaagctttgctactctagcctcgtagtatagtgtgaagtcaggtagtgtgatgcctccagctttgttatttttgcttaggattgtcttggctatgcgggctctttttggtttcatatgaaatttaaagtagtttttttcaattctgtgaagaaagtcaatggtagcttgatgggaatagcattgcatctataaattactttgggcagtatggccattttcacgatactgagtcttcctatccatgagcatggaaagtttttccatttgtttgtgtcctcttttatttccttgagcagtggtttgtagttctccttgaaaaggtccttcacatcccttgtaagttgtattcctaggtattttattctcttagtagcaattgtgaatgagagttcactcatgatttggctctctgttattggtgtataggaatgtttatgatttttgtacattgattttgtatcctgagactttgctgaagttgcttatcagcttaaggagattttgggctgagacaatggggttttctaaatatacaatcttgtcttctacaaacagataatttgacttcctctttccctcattgaatactctttatttctctcccttgcctgaatgtgctggccagaacttccaatattatgttgaataggagtggtgagagagggcattcttttcttgtgccagttttcaaaggaatgcttccagtttttgctgatacagtgtgatattggctatgagtttacactgttggtggaagtgtaaattagttcaaccattgtggaagacagtgtggtgattcctcaaggatctagaactagaaataccatttgacccagcaatcccatactgggtatatacccaaaggattataaatcattctcctataaggaaacatgctcacgtatgtttattgtggcactgttcacaatagcaaagacttggaaccaacccaaatgcccatcaatgatagactggataaagaaaatatggtgcatatataccatggactactatgcagccataaaaaaggacaagttcatggccttttcagggacatggatgaagctggaaaccatcattctcagcaaactatcacaaaacaaaaaaccaaacaccacatgttctcactcataagtgagagttgagcaatgagaacacatgcacacagggaggggaacatcacacactggggcctgttgagggtggggggttaggggagggatagcattaggagaaatatctaatgtagatgacgggttgatggttgcagcaatccaccatggcacgtgtatgcctatgtaagaaacctgcacgttctgcacatgtatctcagaaattaaagtataataaaaaaaaaaaaaaaagaaagaaaaagaaaaagccttgcagtgatactcactctttactggcaagtttctcattcaaagatccacctggccgggcacagtgactcacgcctctaatcccagcactttgagaggccaaggcaggtggatcacctgaggtcaggagttggagaccagtctggccaaatggtgaatccccatttctactaaaaatacaaaaattagctgggcgtggtggcaggcaactgtaatcccagctactcaggaggctgaggcagggagaatcgcttgaacccaggaggcggaagttgcagtgagccgagatggcatcactgcactccagcctgggcgacagagcaagactccatctcaaaaaaaaaaaaaaaaaaaaaaaaaaaaaaagagcacataagtatatgtgaaaacatatcatcttatcagtagattcatggtgacaatgacaacgggaagccacagaaggcctttaataagcatcatctgagggtgaaagttatacagagatagaaaaaactacagtcttggtgatggtaattttattacccaactctaaagagaaaacattacacagcatataatgagaatggtactccttgtttatggaccaaaatttaaccccaaaagctttagccataagtaggaggcatatggcaaaaatatttatgaagtttattaactgatgcaaaccaaaatctcaatgtttagccataatcagatatggaggaaaaatgggggtttctaggaagttctactggaaggcaggactttgacaacccttttcctgacaatgatgtgatgggaaattggcaccagaatcagtctggtcatccttcacttctaatctttgaagagaacttgctcatctttttaaaacttgattgagctaatgcatcaaatcattttgctattttaatgtaggcattaggcaagttgacaggtagatcttaattatctttacaaaatctttcttttgtgtgtatgtgtgtgaaatgagtcttgctctgtcacccaggctggagtgcagtggtgcgatcccgactcactgcaacctccgcctcccgtgggcaagcgattcccctgcctcagcctcctgagtagctgggattacaggtgtgccaccacaccgggctaattttttcgtattttagtacagacggggtttcaccatgtttgctaggatggtctcgatctcgtgatctcgtgatccgcccacctcaggctcccaaagtgctgggattacaggcatgagccactgcacccggccatctttatatatatatttttaaaaatgaaaccttaataccaattgcatagtatccttagatcaaagtataacttacgaaaaatggaggagctaaggggaatataattttgtttaaagttttgggagttttcattaattgattttccttttaaataccctccttttttccttccccagtattttaagaattatcaaataattatcttttcctctcttcttatattattttataaaatactttctgatgaaaaaaattctactgattggtagttgcacattattagttcattttaaaagcttttatttttctccttacatttatctgttctcaatccatctactgccaagtacagagagactccagagattagactagatattttgagttaatcaaaaatgcatcatttggtcctaactgtctggcaaactgaagcatctggctaatagtatcattctgctagtattttagatactagtgataaaaatattatgatgtattttcattttgaagacaaaagaatataaattgttaaaattttaaatcaaattataatgattcttttagagtgattttactgatgatgaattgcataatttcattagaaaggacttcttcctaattgctttttattgtttgtagttatgttttgggaaatgtgatttcactcctgttatgtttgcatatatgaattaatgagctgaattataataagcttcagtgaacaaaatgagatactacatttcaagtaattttcttttcatcatttttagcaaatcatttgaaaaagtttagatataaaactaaccaattgtttttctcaggaagaggtcttagaatacacttctgtaattgtttcatcaggcaaaaacactattatggaagcttattttaaaaattatcctttataatatatcactgaaaaagtatatttaataggaaaaacaaatagcaaaatatttcaaattattcatgtcttatgtaaaagtttttatttccagcaggtgtttcttttacatttaagttctgtatatatagtggtaaactagtcttatgagatttcaaacattataggtttgtgacattctctgataatttttttcatcataattctgtgaagaattttctgaggtttgtgagtaggagattatgaataagttaggggaatctagaaaactccccacacattctactttctagataaatattcagactccaacaactttcttatttactagaggtgggaataatactttttagcaattttcttttactggtaacctgttactgaaaaaaaaatggtgattgtatttttaggttgatgtttgtagctataacaagtaaaccttagattttaagtggcttaacacaacagaatttgtttcttgctcagataacatttcagtgcaaattttctgggagtctttgctttgcatgaagtgccataagctacctttctttcactttgttactccactactcctaaaggccttagaatccaccaaattcaacagtaaatgggcaaaaaagtagtaaaagcatgtctgctctttaagaattgaaaaattacacagatttttttgtccacattccattggtgaaaaaatcgtctggccagaattaaaggaatgcaattcctggttggaaagctcccgtgcagtgatacatttatatcatggaagataaaacagatttttagttgctatctagtggcccatcttagtactgaaggaatagaaccaatattttacttgttataaaaaatatccatgcttctctaatgactatgctaaataaataattttcatctgaccccaaattagcagaatattgtccaaaattattacaggtatttatgttagtcctacatgctctaatttttaagtgatatccttttggcaatattaatatttatgggcatctaactggtcatacatagatcattcataaatcttttcatttctcaggaaattttgaaaaatgaaaatcttggagaattttcccagattattcttgcttgataccacttaatccttaatcaaatgaatatgttactgacaattattcattatttcaatccaagaaggggttggttcaaatattcttttcttttattcaaaaaataacagatgctgaagaggttgtagagaaaaagaaatgcttacacactcttggtgggggtgtaaatcagttcaacctttgtggaaaacagtgtgtccactcctcaaagagctgaaaacagaactaatgttcaacccagcaaccccactactgggtatatacctaaagctatgtaagtaattctatcaaaaagacacatacatatgtatgttcatggcagccctaattgtaatagcaaagacatcgaatcaacctagaggtccatcagtggtaggatggatgaagaaaatgtggtacatgtacaccaaggaacatgcagacataaaaaagaatgagatcatgtcatttgcaggaacatggagagagctagaggccactatacttagcaaactgacgcaggaacagaaaatcagataccacctgttctcacttataagtgggtgctaaatgataagaacacatggacacatagaggggaacaatagacactcaggtctacctgagggtggagggtgagaagagggaggggatcaggaaaaataacgaatgggtactaggcttaacacatgggtgacaaaataatctgtacaacaaacccccatgacacgagtttacctatagaacaaacaggcacatgtacccctgaacttaaaataaaacttaaaaacaaacaaatattttgttgttgttgttctgtttcttagatgtgacaattctagattgtacgtactatgtacgtcagaaagaggttctgaaagtgagtgtgtggatgaggtctccacttccccttactacactgtgctaacctgaactcccttcttaagcccagaatttaaacctgatagcttagtccttgcaaaaaaatcactctctcaggattgtttttcttctctctcttttctttgttttgttgactacaaggctagcaagtgaacatttgctgacaatttcagtacctattgacttcttaccacttttgttatcttcagaatttacattaattttcatagtaaaagcagctcaagtgtttggtgattattgttgtttttaaatttgtggcttgaatttgatttgtctttcaacagaatatgagaaggcaatgaaaatgaaggtgagacacaataaagaagaaggtaaagtaaaatatatgtaaaatattatttcagaagtaaggtcaaacaaaaaacaaaaacaaaaaggaaaggcgataaagccatatcatcagcagtcttcattagcaggatgcacacatattatattttatatattgagtcatatttgattaattcccaggcaaaaagttgctgtttgtgtaaaacacattttattttatatatttttaaattatactttaagttctgggatacatgtgcagaacatgcaggtttgttacataggtatacatgtgccatggtggtttgctgcacccatcagcccgtcatctacattaggtatttatcctaatcttatccgtccccttgcccctaatcccccaacaacccccagtatgttatgttcccctccctgtgctcgtatgttctcactgttcaactcccacttatgagtgagaacatgcgatttttggttttttgttcctgttttagtttgttaaaaataatggtttccaggtcataaatgtctctgcaaaagacatgaactcaacctttatatggctgcatagtattccatggtgtatatgtgccacattttctttatccagtctaacattgatggacatttgggttggttccaagtctttgctattgtgaataatgctgcaataaacacacgtgtgcatgtgtctttagagtagaatgatttataatcctttgggcatatacccagtaatgggactgctgggtcaaatggtatttctgtttctagatccttgaggaatcaccacactgtcttccataatggttcaactaatttacactcccaccaacagtgtaaaatcattactatttttccacatcgtctccagcaactgttgcttcctgactttttaatgatccccattctaactggagagagatggtaacacattgtggttttgatttgcatttctctaatgaccagtgatgatgagctttgtttcatctgtttgttgtccacataaatatcttcttttgagaagtgtctgttcatatcctttgcccactttttggtggtgtttttttttcttgtaaatttgtttaagttccttgtagattctggatattagccccttgtctgatggatagacggcaaaaattttctcccattctgtaggttgtctgttcactctgatgatagtttcttttgctgtgcagaaactctttagcttaattagatcccatttgtcaattttggcttttgttgcaattgattttggttaaacacattttaaaagcatagtatgtgccagctgacggggtgttaagatttaaagatcattggtgctttgccccttgaagggaacaggtaacagaataggtatttctgatgcttaaacttctgtgctaacattttttttttttttttgcgataaaaacattctcagagtttcagccagataaaatagaaaatgtatgaatttttattacaaaaatgatctgtcaaaaagcttcaaccccaacatttatgaatactggttctatgttttactatatttacaatggaaccttggtcaagtaaccaacctctaggaatctgtgtgtgtgtgtgtgtgtgtgtgtgtgtttaaatctgtacaaagtagatatacatttttaagtttttagtgcatgatataatttacttaacattcttaataagagtgtggggaatagtaggtactaaatacatattaatttctatcttatggcttctaattccaaaatgaatgtatccataaaatgatatgatcttttgtaaaggtaggtaattgatactgccaataattaaggctggcatgttgtgataagtaattcaagattatttatcatttagtcttaaactacgtttcctagtccttttccctttctatacaaaagaacaagagcaacatgattttgagaatcataaataaatcagggacattatgaaataccataaaatagtaatctgtacatcaactctacatcgtagtttttagccctgccttcacactagaattccgggaaagctgttagaaaataccaatccctggagcctgaaatctccaaatcctcaaattccgatttactctttctgtgatgggttcagaacaccaatatttttaaaagctgcctggatgactggctaacacggtgaaaccccgtctctactaaaaacacaaaaaattagccaggcatggtggcgggcgcctgtggtcccagctactcctgaggctgaggcaggagaatagcgtgaacccgggaggcagagcttgcagtgggcggagatcgcaccactgcacccccgcctggcaacaaagcaaaactccgtctcaaaacaaaaaaataaattaattaaataaaactgcctggatgattaatatgcagacatgtttgagcatcacttaaaagactcactggcaacagttattgtgccataaagagttgtctacatttatgctgtatatggtctcattacaattttttcctctctccatgacaatttgaccctaccctaccacatttgtgagcttcagactcctatatcctattgccttttgaatgacatcagttatataccctgtaggagtctaaacctcagaacaacacacactgaatttagtacctttgtctcaaatctacttctcctctattatgcatctgaattattagcatgtaatccactcatgtgtttaagccataaatataagcatcagccttaatgtcttgcttatcttctttgtttgcacccagttccacaccaaaagttccacatattctcttactcatcttgtgtatctggccatatcttttcatacttggggccattatcctagtgccattatcctcttgtttggactatttttaaagttttttcattgatctcctagatttcagtcttgcccactatcaatgcaatttctatattgagccatccaaaaacatatgatcgccctactctctgacctaagatattaatgtgacctgtgatgtccttcataattgccccttgcttgcctctcacatctcttcttactctattctggatattcgagtcacactagctttcactgtgttttctgcatgttgtttcttctttgaacatgctgtcactactcctggaatcatactttcctaattcctctcttttatgctcctgactcatcttcctatgtcatctccttcagtcagccttctctgacactcaaatctgtataaaattttttcttaggggctctcatggtactgtacttcccttatcccagcaccaaaaaacacactgaattctccatctacttacttatttactcaaaaatattgaaagctttccagtaaaacatgttgatcttgttctcagctgtgtttccagtgatttctccagtacctgataagtattagttacccaacaaatttttggtgaatgaatgagtagaactgaatgtattgtttctgaacatgaaaggagatgacacataatcatgaaggaggtataaggaggttcatctatagagagaaattactggggaggggcagaaggcaaaagaaaaatttaaaactcgtctgctctcttcaattttttccctaaaagtatggtcatatttatctactgaaaattaggattgtagggaaattcagctgggaaattgagaagtgtccttctcaacttcccaaagttcattttagattaatgggaaggaaatttacaaatggcgagtaaaaagagtctcggagtgatttagaaaacaatcagaataatctatttgtaaaggttaaatctatattactcaggaatatttaccagtgttctacagctcaggtataagaaggaagatgacagagcttccttgggaagtttttacgagtccagggctgctataagaaactacacagtttgaagaatatggaaattatcccgtggatttgggacccgaatctgaggattcaaaaactttaattcagctttaggacaggtatgtgttttttggccaaggtcacagataaagtaaaaatcagcatattacacacaaaatataagtatgtaaagggaatcttaccaagtgtaattatttaatagttttccttttatctctgtaaaaataagacagaataaacaagtaacatcaactctagagaaattgttcacaaaataaagcaactagcgtgcctaaatgacactcttcatattttcctaaggagcataggatttgcttcaatgtatatttatcggtctcagagtaacaactttttcactgttgtgaaaatgccaccaccataaaatgtatcatgctttattttagcagattgaaaatggccctataaggcatggggcaatattggtgaaaatgaagagtgaactatcatggcaaatgtgcaatggagttgttggcagaaagaggatttatgatgcaatgcagaatattaaatagctttccacagaaaaagaagcagcatttgattacaaagtctttttaacctaaatatatattagagactgaaaaagtcctgcatatatatactgcaacccccattcaaagttttgcaataaaattcaagaacaaaaagaaaaacaatgaaacattaactagtctaagacgaaaacaatttggagtaaaaatatgaaatatgtcaagcattcagattttgagtgtgtagaagtgtgtgtgtgtgtgtgtgtatgtgtatgtatttatttcaaaacatcattacagaaaagtagacttttgtaatcataacaaaactggtttatgacttaaaattcattcaagtatgcaaaaataattttatccacaattgagaaattgtagaaatctgtatatcccttctcattcttgttcttcactgaattctctttaaacaataagagtttctcttaaaatagccatgatattttaacttttcaagcttcttgaaatctcaatgcaatatcactaaagtatagcattttgccaagtttcatacacataggcacattatatcttgtctctgtggataataatgccttaaaagtcagtattttccctagacttaaatgctttcctgaaagaaggtagaaatccttctgcagagtaagtatttcaaggaaatcacagtcctaatcattctaaatggacataatataaatatgcattcatgactcaacacatttttataaaacttttgcatgatctctagagggaattgaggtattgtcagcgtttgttcagtgtatacgtgtgtagaggaaaagtcagaagcctggtattctgccattttgctgacatccccatttgcacgatttttataactatagtggcacattcaaacaagaactaatatataataaatataaacattattcttgctttcttggaaaggtgtccagtactccgacttgtgcttggaaatgatgctatagactagatataatatcaaaggtcaggcttttggtgtttaaagacaactgagagtgaagtggcaaatacagagttaaaggtcatgcacaatgggcaactcaattttgtcatggttaaaatcaggataataatttctgcattgccagcttcaattgaaggaataagtaaaactgaatacctaaagcctagccagtttccacaacattgtagacatgtaacagatgttacatagcattgtcactcatacttagagtaagaatttggtctgtaatcttctaaattatacaacattaaaaagtggacgtttttattcctgtaaaattttattgaattattatcatttgaagcatcattcaatatggaagaaattatttatgcgccattatttgaaatatgtctggtctgccaaatgaggcacacttgtcatacacagctggacagaaggaagaaaggccaagttcctttgtttgaaaacattacagtgtaaccaggaaggcctgagtgaagagaataattatagaaccaataaataaagatgtagagggaagggttttaaactctcagttcctgttcttgaaatttcaaggaagtatttagatttgaatgggaaaaaaatggagctcttaaaatgttaagtgcccttgtcaactgaacatcaacagaaggaataatggagtaataagctgataataataagtagtagtagaagtagaactaatgtttacttaaatgcacttgatcctgagactacactgatatgtcctgtgccttctctcatttaagtctcactgtacccctgttattaacactatcttcattttaagatgagagagttaaaagctagatttgataggctgcataacttctctagaaaaacaaagacagtaaagtggacatgcaagaatttgaagccaggttcttatgaggaatagtcattatacactaaatacaataatgtgggaataatgaattgttctgtgaagctctgttttattaatatcatataaaataaaatatttgtgttatttagtgttcactcataatgtatgttaaactccatcttatctaacccttttttgtaggaatcaacgtatagactaaaataaaaaaaatgaaacttgttaacatacatacaaatagacatttgtatacacccatgcatacaagtatgatcacacatatccacacatatgaacagcattctacttttcataacctactttagatagcagctgttcattagaaaggaatagcagtatggttaatacaatacacccactaaccataaaatcatttatacttgacattgaaagtgtgtgtttcattatttgttttgagggaataggcacatttacagcagattcttatcagagcccaagcaaaagaaagaaattgcaaggcgactccccaaatcaaaaagaaattagaagctgcccaaatatcctgattttcctcccttctactctggactgaagcatctttcttaattgcatgctctgagctgggcttttacatttttctcattttgcagatcctcaaactattttctttgtaacaggatggagaagaaagaagctttgagtcaagagagagattcccaaatagtatcgtatctacgagtttcacggcaacagcaagtaatccacatcaccaagtggaaagtctattcaatgacaaaaaaagtaggactgtcttttgtttctttctcccacagtatttgttattgtgagcagacaactttatagatagaagtgatgacaaatttaccttgatgccacaattttgtccccataaatcctgttcaatatttaattagaatggagaggtgtgtaaccaacatgactgaactcatgtgggttttgtcaggtgaagacaaatgtcttgccttttagtgtttttctttcattgaaatgtgttgggcctatttgcaaagaaaatgtaatagtcttacactatttagaaatagttcattttaggatgtgtcatctcttttcatatttttttgatatccatttccagtagaattggtaagagtaatttcatttggaatcaatttcttgggctgattatgattctgcaggtgttatatggtaacttaataacagctcttatacatctaaaccaccagagataatttagagtagaaatgcctatggaataatatattgctgcgccactgaatttcaaaagaattcattatgattaataatattacaatagcaactggaggaagtaataatgatttgccacaagttataaggactcattgaatagttttaatcttactacatttaaacattgaactgcaagtaaattcagcaatactcaataatgaaatttggggctcataataatgctattaatcataactagattttgtacattttatgagaaggaatatacatttggtggatttcatttaaatattttactgattttgataaagctatatgtgtgatttggatcctatagtgagtatgtctttacaaaagccatatttgttttaaatgactgatagatttaattccctagtgaatattccgtatttgcaccaaaatccatactcttcttacaattaagagaaatagagtgctttggggaaaataaagagtgctttagctaataaaaatacagaaacatccaatcctctcttgcttacattacagaatctctgtttcagaattagcttacatctatttctcttcagttattggagaaatcctcaacactgaacctgggtacaattagaaaatgagttcaaataaatgaatagttatcaagtttctggctctttcacatgggatacgtgaggatgaagtatatgaagaagtatgaagaagtcaggctgctttattgggaattcgctctcatggaattcacaataaaggagatgcagagcaatacagagctcaatataatgcaaggtaaaccctgttctactagggaatggaataaagtaccccaaggagagaacaatttattctgcttgaatagttcacagaacacttcatagaagagataacattttcagccagacttgatagatgagagaaatttcagctgttgaaggtggcatgaaaaacgtgccaaaaatactagcagagaaatggtgatgctcagtggccacaggatacagtgggaagatctcagattcttctctggtatccagttcctctgtgtttcaattaatgtatctgtaaaatgtgttacttctctgtaattataatttactcccacctaacagattttgcatcaccaaacacattaagatagtttaaatcacattattgattttggtgtaaaaatattttgatgatgacattaagaaaacacagaaaatgcaatgattatttcaacagagaagaggtaagcagcattataattgactggtcaagatcataggctaagtcccattatagccaaattaagagccatgagaaaagcaaaatgcaggaaaagtagagataagatagaagacaaaatatataaaactggtgaaaagtaataagacaacagtaagatgcataagcttggacatgaatgagtgagagtagaggccatgattcaaacaaagagaaatgaattcacaaattatgaaaacagtagtggtaatggtgacacataggaaaaatagttaagcaagccctcccaaacacttcagagcatttcactgggaactcagtaatccttaaatagctctgccagaaaacaagagcaaccaccagttctgaaaagtagtctaaatacatatattaaaagtcacctcaaaggtctctatggtaatgttacattttagctcacatatcctggaaggcgtatttcctagggcacttcaggtattgggatggagtcagacacaaatacactataacctcactcacacttatgcatctcaacttaacaaagcatatgtcagaaaatcatccctgcctgtactttccaaactttgtctaatgcaaagtaaagggagttatttaagaaaattttattaaccttcaaaacaggaaaaatgaatattgtatctgaattgaaaagtttaggaaaaaatgtgtcctctggttaatcaaaatgaatactcactcatctgcttaatatggatttttttttgactataagaatttgctgctcaaaacttcagataatagattttacaaacagttgtaaacaaacactacattctgcatttggctaaattagggccctatgaaagcatttttaatgttgaaaagaggaaatagtgaaatctgatctaatacttacaaaaataaaacagatactcaagagcagttgtaggtactttttagaaagggttcagccatattaagactagattcagccatattaagactaggctaaaatgaactagagtttccgagatgtcagaaaaacctcattgttttcctgacaatgtgtcttcaaataaaccagacagatgcattcacgtgcagcctgttttccttcatttcaacactttggaggaggaatccatcaatgtgatttaagaatagatctgcatattaatgttttctatcataaggaggaaataaatacagtaagtgtagcacatgtaatttaatgatgatgttattcacagaaggtttatacaaaagtcaaatgatagattggctgctctgaataatagttggaaaaaattataagtcttgttctaaattttaaaagtaaacttataagcatcaaggaacaataaagctgaagtgattagcagtgtaaaaatatctgtcctgtgatttaacttgtcaacatgtatgaaatttaatggtaaatatgaaagacgtataatgattaggagagtatgaactgctattcttaaggatggcttctctttcagtcacttttttctaggtatcggagtctataaaaaaacaatttatttcttttaaaagataattaccgttaacctagagtttcaactctactcttcataatgacaaaatgtctttctctattaattaaagaaaagcaggtcactggaccacatcttttttttgtttgttccaaataatatttacctagcctttattgtcacagtaagagaggtgaaccttaaaaatttcaaggtttgtttgactataagaaattgctgctcaaaccttcagataatagataatttttttcttttactttaacttctgggatacatatgcagaacatgcaggtttgttacataggtatacacgtgccatggtggtttgctgcacctatcaacccatcatctagttttaagccccgcatgcattaggtatttgtcctaatgctctccctccccttgctcccctccccctgacaggccccagtgtgtgatgttcccctccctgtgtccatgtgttgtcattgttcaactcccatttatgagtgagaacatgcagtgtttagttttctgttcctatgttagtttgctgagaatgatgtcttccagcttcattcatgtccttgcaaaggacatgagatcattttttatgacttcatagtattccgtggtgtatatgtgccacattttctttatccagtctatcactgatgggcatttgggttggttccaagtctttgctattgtcaacagtgcagcaataaacataggtgtgcatgtgtctttgtagtagatattagctatagtaggctatagtaggcttttggcaaagtctttagggttttctaggtataggatcatattgacagggaagagatagtttgacttattttcctgtttgaatgacatgtatttctttctcttgtagaataatcagatggcctgcagatttggagaaaatatttgcagactatgcctccaacaaagctataatatccagaacctatgaggaacttaaacaaatcaacaagaaaacaacaaataacctcatttaaaaatgggcatgaacagacatttctcaaaagaaggcatacgtgtagccaacaaatatgaaaaaatgctcactgtctctaatcatcagagaaaggcaagtcacaaccacagtaagataccatctcacaccagtcagaatggctattaataaaacgtcaaaaaagcagaaataatggcaagtttgtacaaaaaggggaacacttatacactgtttgtggaaatgtaaattagttcggcacggtggaaaacaatttggagatttctcaaagaacttaggaaacagagctactgtttgacccagcaatcccattactgaatatatatccaaaagaaaatagatcattcagcaaaaaagacaaatgcacttgtatgttcaccaccgtattattcacaatagcaaaaacatggtaccaatctcgatgtccgccagtgtgggggactgggtgtggtacacatacactacagaatactacacagtcataaaaagaatgatatcatgtactttgcagcagcataaatggagctggagaccataatcctgaatatattaatgcaggaaaaggaaactactgcctgttctcccttataagtgggagctgaacatttagcatccaaggacataaatatgggagcaatagacattagagactactagacaagaaagaaaagaatgggagaatggttcaagaaactacctattggctatatgctcactacctggatacaatatactagtgtaacaaaccttcatatgtacccactgtatctaaaataaaatttgaaaaaaaataaagtaaaaaaaaaaatagtatacctggaaaaaaagaaaaacttcaaacaagaagagtttatggatgtcaccatgataacacaatagactattccagaccttttcccccacaggaacactgatctaacaacagtatatggaccaaaaagcctctatgagaactttagaaatcagtcaggaagtggcagtactccatgcaacctcaaagccaagaatagttgctttgaaacgggcaaaaatgctattttatttcaaacaagagagcacctttcctaacgcagcactgctcacaattggtaggaaaacacacgcgcacacacacacattacgttctcttgtgagggaaagagaagagtagaacatacatcatatatttcatcatttttgggaagctgcccaagggactgactaggagcactgagagttaactggtataccttgaatgtctggggtccacagagatcaaaagagagttcagcagcttattgaagccctggactacacatcataccacacagaaaccagcacaattcaccacaattgggattaaatgcctggtttgtggcttctctcttgggagggaaaaagtagagtagaatgtgcatctgatattcagcttttctgggactgtttgaggtactgattactgtcttatctgactcagagtcctgatgggagctggcataatttgtatgcttgaaggttacagagcacaagagaggtcagtagcttatgacagtatcagagaacctgcaataccacagacagacaccagagagagcaagagactacaacctcctgagaaagaaactgacaagcctcttcaacagagaaactacgtgcacaagcctggagaaaagaccacatgtataaaagatttgagaagccctcagagtctctagccaggcaggctgggggtggtctttctctgaatgaagccagtccataaagactcagagaggtaggttttttcaaagtgtatggatccccacacaatgttacacggcatgtaaagaaatagaaataaggcctaatcaaagaaacaaaataaatttttagaaacaaactctagggaaatagatgtatataaattacataacaaagaattcaaaataaccatcaaaaagatgaccaataagctcagaaaacaatgcatgaacaaaacgagaatatcagcaagatagaaattaataacaaagcaaccaacaaaaaacaaaattttggatatgaagaatacaatgaccgaattgaaaaattcactacagtttctagatcaatccaaagaaagaaatcaacagacttgaagataggtcatttgaaattatccagcctgagaaataaaaagaaaaaaaaaatggaaaagagggatgaaagccaaaggatctaaagtataccatcaaatgaacaaatacgggagttccagacgaagaagaagagagaaagggccagaaagcttacttggacaagtattggctaacgtggtctgaaatctggggaaagaaatgaaagtccagatttgaaaaacccagtgaattagaactgaaatgaacataaagaagcccacgctgatatacgcgataataaaattatcaaaattaaataatgaaaacaatttctaagcaatatgagaaaagcaactcatcacatacaactcaccacatcacatacatattcataagactatcagtgatttatcagcagaaaccttgtgggccagaaagacttggtatgatatagtaaaagtgctggggacaaaacaaaaacaaaaacaaaacaaaaaaaccgccagccataacataaataccataaccaacaacaatatccttcagaaatgaaggggaaacaaagacttttccaggaaaacaaaagctgcaggagtacatcaccattagacctgccttccacgaaatcctaaagggaactcttcatgttaaaataaaaggacacaagacagcaacatgaaagcatgtaaaagtatgaagctcactgataagggtaaatttatagataaataaaaatatggtaattctgtaatggtgatgtataaataacttttaattctgaagtaggagttaacaaaaaagtataaaaataactacaacgattaaaataggtcaattgacacacaatataaaaaaatgtgacttgtgacatcaatgtaaaaaagtccgttgggagaaaaaaagtgtagtgtttttgtatgtgattcaagttaagttgttacctacttaaaacagattgttaccatgataaggtgttttatgtatggtaatcataagaaaatatagacataagatatgaaaaataaaatgagaaaggaatcaaagtatgtcactactaagaattcaataaaacagaaaagaagcaagaggagagggtaaaaaagctacaagacagcgatatgaactgtttatgttcttcttaaattcatatgttgagttctcaattcccaatacgatgctatgtagaggtggggcctttggagtgtaattaggtcatgagggtggagctctcttgaatggaattaatgaccacctaaaaacagaagaagatgcaggatctcacctttcactctccacttggggagggtacaaggagtggatgaccgtctgcaaccaagagtgggccctcaccagacactaaatttaccagtaccttgattttagacttcccagcctccaaactacgaaaaatagttattagttaagtctcccactctatggtaaattgtgatagcagcccaaactgacaaagatggacagcaagaaaacattgaataaaatggcaaaagtaaattattactatcagtaattactttaagtgtaaatcgataaaactcccacttaaaaaaaaaagcctagagaggttgaatggattcaaagaataatattcaactgtaggctgtctagaagagactcattttagatttaacaacacacattagtcaaaagtgaaagaatgaaaaaagatatcccatacaaatgataaccaaagaagaatagaggtgcctccaggaaagatcacttgttaggtcataaagcaaggtttaacaaatttaagaagactggcataatggcaagtgtcttctctgaccacagtggaaggaaactagaaattaatagcagaataaaaactgaaaaaataaaaaataaaagaaaattaaacacatttggataactaatacgtaaagaagggaaaggtaaggggaacaatttgtccaaagggaaattagaaaatatcctgatagaaacaaaaataaagcacaacagaccaaaacctatgggatgtagcaaaggcagtagtaaaagggaagtttatagcagcaaatgcctacattataaaagaagaaaaatctcaaataaactatctaactttatacctcaaagaactagaaaaataagaatgatctaaacctaaagatagcagaaaatgaaaataataaacacttgataagaaaaaatagagaatagaaaaattaaaatattaataaaattaaggagattttttgaaaaatcaatcagttgacaaacctttaggaaactaagaaaaaaagagagaagattcaaaataaataaattcagaaagaaaacaggagacattacaaataaggccacaaaagaaaaaggatttcaagagattactatgaaaaattttgtgaaaaatttgaataatctaaaagaaatggataaatttctagaaacctacaaaccacccagactgaattacaaagaaaattcttagcagacttataactagtaagaaagttgaataagtgatcaaaaacttcccaaaaaagaaaagttcatgttcatcacagcattactaacaataaacaagagttagaaacaaattgtgtccatcaatggataaatggattaaaaaatgtgatatatacatacaatgaaatattatttggcaagaaaagagaaaatattgttatatgctacaacatggatacactttaaagacattctgttaagcaaaatataccagtgatagaaggacaaaaaatgcatgattttccttatgggaggtgttaaagtggtcaaactcttagaaccagatgtagaatactggttaccagggtctgaaacagggcaaaatggaaagtcattgttcaatgggtagagtttcagtcatgcaaaatgaaaaagttttagagatatgctctacaacaaagtgcatatagttaacaatgttttactgtacacgtatgttaaaaaggtgaatgtcatattatatggtttttccacagtgataacaagttagatatctcacaaataatttcaaggtaaaagaaccctgctttacttgattttaaaatctttctaaagtaacaggaaaaatattttagatttactggagattctatttaaattttaaacccaactttaacaatttcaagaagaatccctgttttctattccagaattatttttcaatctttatcaaacttggattatcatatttgactgtcctcttatgatagtgccaaatggatttaatagtacctcaggaaccatcattagaaactgatctaataaattgctataaatttgatgcactttctattaacagggtgtaaaagcttgaatataagaagaataatcaaagtttctcataatggcacacactcacatggttttgacacgctcacttctcaaaacatatgtgcttatgatatggtttgaataattctgccagatagactagctttcccttaagattatatgtatacatatatgtgtttgtgtgtgtgtatatatatgtgtgtgtgtatatatatttatatataattttaatcaacataaagtcttttattgttatttgttccaattttagttattatcagctgtaggccttaagtatttttgagacaataagttaagctttaacacttgacatgaatcacatgggaaaaaggaggtttcatttactacaaaattccatggaatacaacatttcttcccagctttcccttagtttgacatcaaatatttatagaatagctaacctcttgcactcagtggccaggcagagggccatgtcatcataataatgccaaatttactgtcacaatctttcccaggaatccagaatatgaacaataaaaaactatgacagaaactcttgattgctgaaagttttgagtttgactctatggttttctggcattgtgtactgatggattttccaactcgaagatagataactgagccccataatcacctgaaagagctgcgcttgtaacgcacccacccctacgcagaggagaaacacctacgctgatattgctgaatgttccagatagaacccttttaaatttttggtacagctggtttcatagttgttaaaatactatttaaaaagtaaacagcatccatttccatacaagatcctttaggttcacagtgaggccctgaagcctcacactatctctcatgtgcagattcgagggtcttcataactcttgaatttcactcatgttctttgtttcatttgaatcaagaaaatagctcttgggtaactttcatgtttcactgaatgtaagatcaaggtatcctactaaactgatacatagagtaccattttagtgggattagaattaccataaagtgtgtacaacaaaattactgtaaaatctgcagtatttttcagatttttaattttgaaatatgcccccttgccattcacctcctcacaacctcaaacaccaccacccaagtatcttgctggactagttttccaggcttgttacttggaaaacgcttgtgtagagcttgtgtaaagcccaaaagggactgtccttggtgctgaaaagggaagcagccacacggtcattgtttttcggaaaagggcctcctacctagaaagctgaattgctttttggccactttctgcatcatgagcataatcaggcctctaagcccagggcatccctttggctggttatgatttctgttacttagtgctgaaattttaaatttaatgtcttttcgtaatcttcactttcaatattctattaaaatagtctttaagatagtcttggtaagatgtcaaattttaaaactatattatgttttcatcatgatatcaattttaaaacaaatgtcatggtggagaggacagcattttgaatatagggacctagcatgcccttcctagaaaatgactgaaatgaagaaagtcacataaacatagaaaaatatcacatcagtattagaggtgggtgataagactgatatctaataactaaaatcagaaacatcaaaatatttctggggaaaaaaaacacgacagaaataaaacaaaggagaaattatccacctttaaaaatggggtttgttccattagacattcctgtaagaaagctaggacaaacaggcatatactccttaatttcaaaagtaaagggataaagtagaaggcagtatctaaaacagcaaagacttactcctattggaaaattttcatgaaatatgtgcaaacaacatgcaaaataaggtaacttaagcatgtggcattggctacggaatttaaagaagtgtgtgatgcagctcttcctctaacttgataggctgtggggtgtgattataatggtgagtagcaaagagtgggtgtgagtggcccacatgtcagcagagaagactattgtgtcatttacattatttaaaattccagtgcattatgatttaaaaactccaacccttatttggttttattattattttaaaatctctacaagtatgctggtcattattagtggtattactaccaataccattgccttcatagccactggtttactctgtattaaaaatggaaacttggccaaacaaaaaaaaaagctacctgttaaaaagggcctaagggcaaaacgactttaccaaacttagggaagaatggaaaccaactcaaggtctcccagtaggactgcctacaccacatctttctctccatcatcctaattaccaaacagtacagaacttatcacattctaccatatttgaaaaaaaaaattattccacattaaaaacaattttatagaacagctatctcgtggaaaaaatgtttcaagtgtatcagctagttataacaatgctacgagagagataacagtatatgtatttgcacagaaaacataaaacataaacagtggaattacatgcattttttattttttgttttatgattttctattttttaactttataaaaataagcattataattattactaaaaagacacaaacatcaaaatatttaaagtttttctatataaaggaacattatagcaatgtggacttgtaccatctctttattatttctcttctcagaagttatttgaaaaaacagaaactgtgagaccttattatccagctgcatgtggtatcttcaactcaaatactcaatttagcaaacacatgcatgtgtgtgcacacacacatattattttcaatatcacagtcattcaacaataatttcctgaagattaagatggtataaaaattaaagggactctagaatcacgacgttaagttttgaaccttattgtcatttgttatgtaacactatacattttgttttccctaaataaaaactgtaagcctttttatatagttgcttaaatatctggacttaaatcataccattcttataaaatttaaaatgagaaatatatttaaagagctttgtggaatttttggcacattttaaaaaataaatgctcaccatttttgttaaataatgactatgtataatacactgtgctaccaatgtgtggatattaaagtaatactacaagataatttattttttcaatataattttgtaattaatacttgtgaaagattagagaatgtaaagttttatttttaatttttctatcagcacttataatgtaaatatattaactcattatctactttcatttttatttattacaacgacaggttaaatcatttccccttattggatagcataatatacaggctttcctaactatctaacgttgtaaaaagtgctgtttatcatgtttatctggtgtcacatgtaaataaatatctaatataattggaaatcttcgggcagtgagaggagatgctgtcaaaacatgaatgatttgtccatatcatcgttttctgagtcttataattcccaactgttacaataaggcttaagcgaaatattagagatggaacatcacagatctgttagcttgccaatatttttatacatcaaagaaaaaaaaaaactcatcgtcattcctgacttttgtctctgctaatgtgaggaatgctctatcaggaatggctaccttaaacaacatttcagaatctcattatatattttcttcactgaaccattagccagaatggtgagaaaagaagcatcctgggcaacctaagcacttaaacagagagacctatataaagtggaatggatgttggaccaatagtaagaaaggcgttagattcccagggctactattaatgaatacttttacattagggcgtcacttcagattcctgatcgtcagcttttgaatttctaaaatgaagggttataaccaaattaggacaaaaatctattctatttcccaggctctaggtgatacatactatacatatgtatcttattttcaacaaattttaattcaataatatactctaaaattttgctttgtcaatatttaaagcattcattaaaccttaaagttgagaaataagacattgatagctctcacttgaacttgggtgatctttgcaattatgaatttattcaatgaagcccctttatgaatatagtatttctggttttctgagggtttcttcctcaatataggtcatataccttggagataaccagagcatgcttcatgcatgtatacatgttgaatctaagcccttatagagtctctactgtaactatttaaagatgatagaactaaggcttggagtagtaaactatatgtttaagaaaggacacactttaaatggtaggtcaaatatgatttaaacatcactacaaataactacttaagtaatttgaaagataaataaaaatttctgagaagacagttttgtacaaaacagcatgtacaagattagacacatacaaaaatttcaatacaaagtaatacgtattggtggataaatgtgtagcagtggttacaaatgtggcaaactcacaatcttaagtaattacattaccttccacctcccttttctcatgcctcaatttttgttgtttgcataacaatatactatctagataaacgaaccagagatggagaagagagagaggtatatgattatttactattatgctaataaataatgaaagtgtatttttttttgtctagggagagaaacaatataaatagctgaacttttgtggtgaagtgacttttactacttcaccatttaaaacccacgtatgtatttatttttaaaataaaaataaatgaaataaatttataagcaaattcagtaatataattgcaaattttggtgaaataaattttaatataatattaaataaaatactgttttaaaaatagacagaacatcttaggaattaaagcaagtattatgaaagaaatttcaaagggtattacagcttacctcattcaactcattaagatacagataattgcaatgctatttgcacatttccagagcattaaaaagatgctaaactttacatttttaaatgccaccgtgactcagaagccaaaagttgatttagaaaatttaaaaatagcacacttatacacacaaacacgtgcaccatcagatcagtctcaataaatctcaatcatgattatcaatgaacaaaaggtagaactctgacaatattcaaagtgtatattaagataaattatgcataataaatttagctttcatctaagaattcaaaaataattcaatgtaattatttaattgatcaataaatgaaaattttcaacttaatgaccttactcaatgtaaaaaatgtattataaaaatttaattcttattcctgaaagagcaatgattactaaaaaagtaaaagtaaaattaatataacaattttatagactacaaaccaagggtcaacattaaattgtgataaaatcctaaatactgtattcttaagtaaatggcgattctacttaagaaggcattactattagttatcattgctctggaactatctccttagaaaaaagtaaaggaaaatctgaaaaaatgtattgatcaagtgattaaaacagatttctcatcagaaaatggctaaaccacatgatcaggcaatacgtaatataaacacatatggccaagaaacctttgaaaaaatatttgattcagaaataatttaagaaattcaaattaataaacaatgaaatttatttcttccttgagaatgaaaacacatttaaagattcttataagtatcatctaagctataaaataaaaatgtataaggggaaatttagctttatgttttcaaagccttaggattttcgtactgtttcatactgcttttccatatttcagacatattacagggacattctcatgaatattggtcccttgacatattgtttataatagtgaaaaatataaacaatgtaaatatctaataatagtaagaagtttgtaccataggttaatggcagataaacatttaaggaagtatttttagtaagagaatattaccataattatataattttaaaaatttcatttttatattaaatttctgaaagtatattacacaaaacatgtcattaatattttaataatgaatatttttatggcctactgtattacaaattatgcttttcattaaatttatatacaatcagaaatatattatcaaattttaataagacaaataactttcagtgatagacatcaaataaatcttcatagaagtagtcagaattcatttggaattctaaaataaaaatgagcctaaacccctatgagccaaacaaaatgaatgtttgtagctgtgaccctaatagcacttcactttagttggaggtagacgggggatagtgttatgtgttgtttggagaatactgttaacattttaagcaataaaaaaatcaactcttcagatatgcaagactttattagttgtctatagtgtctgctttgttgagtgtaactagcctctgtttcattgaatgtaacatgaaatatgtggaggaaataattttacagataaattcaggtctaccatacagagtattcctatactatcaaaagtcagagcagctgaaatgtcctctgattcttctgcatcatcctccaacaaaagtgttgaaatttaccaattgtttttttcctgttcctaagtaaagctcaataattctacaggggtctgtactccctgtcatatattcaaattgtttgacatattgaaaactgaaataaaattatggttttagaattgagtagtgcatatattacaaaacatgaaagatctaaaattaataatctaatcttccttactttaggaaattaaaaaaataaaagcaatttaagcttaaatcaagcagaagaacagaaacaattaaaactggaaaagaaatcaataaatgtgaaaatgggaaaacagagaaaagcaatgaaataaaaaacaattaataaagagagagagatagaagacaaaaattatccataccagatataaaaactaggccctttgtaattttcccatggacattaaaataataacaaaagagtacaacaaacaactctatacccacaaatttaataatttaggtaaaattaatacaattccttgaaagatataaatgcccaaaattcaaagaaaaatagatctgattaagcccatatctattaatgaaattgaataaatgattaataaccttccaaccttccaaaaaatgaagcatctggtccagatagtttcattggtgaattctaccaaatatttaagtaggaaatgataccaattttccaggatctgtttcagaaaatacacacagaggacaaacttcctatcacattctatgaggtcagcattaccctaccagcaaaaacaaattaagatattatagaagagtgaatgtaaactacagaccaatctctctcatgaacacagatgcaaacaatcctcaacaaaatattagcaaattgagttcaacaatgtgtagaaagaattatacaccatcatcaagtaggatttatttcagctaggcaaggttgattcaaaatatgaaaatcaatttatgttatatgccatatcaacagggtaaaaaagaatcatatgattatattaattgatatctttgatgagcagaaacatctttaatttctaaacatttaactttggatgatgtaacaaaaactattttattgttttgggacctaaagtaaatacatacttgcatatttaactcttataattattattgtttacaggttaaaaaaaacagtattcaaaactgacttagcctgattttagctgaattcacattgagtaattcttggttctactacttacgcttttcactaggcatttcaaataaacactgtaacatgttctaactgtaaaatacacagtacttgaaaacaaatttatataaatgaaactatttcataaaatgtcacaattacataagttatatgtgctcatttaggacaattaaaaactatgcaaatgaaagtactaattatcatccctataggtatatcaataaagtgaaaaccgagtatctaaatttgcctttgtacaccctcataataactgtaggggttgattggagccaggtactcactggccagcttcaaaaacaaattgcaaagagatttcccaacatctactctggtggcaagagttggctacaaatcgttcctatcatatgacaacaattttaggaaagatgaaatctatactaggatagacaaaggattttaaagcataggctataattcccaaaccaactcccctaacaggttttatagtaaatggcaacaaatactttgaacattggaacataacaatgaattgcaaacaaaaagaaaagtgaaagaggaagaaaagaaatggaggggaggagaaaggaggaattctagtatcaggtgaaataggagaaggaggtagaggagaagaatggggaaaaggaggagcagggagcaaaggaggaagtgggagagaaagaaaagagagacagcaagaagggggttaggagtaattacatgtattttttggtctgttgtgtgtttttgctctagactctgacctcatatttacagtttacttagtaataaaagaaacaaatattgaatccttttcagaaaatttcaaacatgcataaggctctttcacttctaaaaaataactacgcaagcaaacaaacacaagcaagaagaaaatccctcaattctccatttcccattgtaacttaattctctccatcctttgtaagtaatttcttggaaaaattatcaccttcttgtcttccgttcacttcttcatcttattagaatcctgtttaatcaaattggctgtcccaaaaatactagtgtcatgcttttaatgacaatctaattaccaattccaacatgattttttgcaattcttatacaacattgtacagtggttgacactgccaattaaccctctttggggattcttaataacattctctgtggattttgcttctacctctctgacgacttttcagattgcttgtattgccttcattgttcatctgggtccttaaatattttcttaaggtacccattcagccctctcaatttttattctcgcatattttcttgtataatagtattactatatttttagcttttaaaactgccaaatcacctatcaaataaataaatttgtacttaatcaggctcctaagtcactatttccatcacataacatcacatgtttactgtcttgtagctgtttctacctgttatgccttattatgtttctcctttcagaataagtgcattcccttgcttttttttttttttttattcttaggagaggcactaccatttacctattcaactaaatgagtacttgtggatttattccagacacctccctgagtttcatgctcaatcagtcagaaagtgctagaaattgtattgaaatcgttctctgacctaatcttctctagctgcacagtcattatcagttgagatactaacaacactatatacagttccactcaccaatctatcgtgcataacattggagtagatctttctgtgttgcaattttgatcatgtcacttccaacataaggtcactcagtgatcctcctcccagggcctacagagcaagtttaatctccttggtattgttgaaatgtgggtttggggcttttttaacctgctgcatacctccctgttttaagtcttctaaaataaacttcccatcaattactctatatgccaccacatacaataaatttgtaattcatcagccttgccatatgtataaaaatgtgtgctctcaacgcatgaggattcctcttcttgaaatgccctttttcttcagctatgtacatagttttgtcaaattctaacacattctttgcagctcagatttcatttatttttctttgagaagcagttattcccattagtatttaattattattttgctttgcttttttttttaaatcacaacttgtaaatactcatgctataatattcattccattctccctctggctaatgggcttgaagtgaacagacactatgtcttacttgtgcctctgtttccagctgctagctcagttcccaatgcattacagttggttggcaaatataaagacaaatgaacattattgttcatctcctcattttattaaaaaggcaaaaatggataaaaagattaaaggtataagtaagcaaaatgaagtaactcattattcaattatatcgcacagatctatctgtgattaacattttgatgcatatgcaagcattcacttatgcaaagcctacacaggaaaaaaaaagtagcttacaagacattcataaaatctgtttaattcagtaatgataatcaaattagtgtaaattaaaacaacattggaaattctttttaaaaaaaacaaatctggcaatgagtctaaaaatctcacaatatatagggttggtaaaatgtaaatacaaaagtgtgtatgtgtgtatatatatatatatatatatatatatatatatatatatatatacacatacatacatacatatatatgtagtaaaatcccattaattttcttttgcattcccttttctctctctgctgcctctatatctatgtatctatccatctacctatctatttgtattctcacattgtatgtatattgaaaaaaatatctcttcaacagctaggctagtcgttctcaataacttttctttaatccactgctcattttgctttttagctaactattctgtttggggttaggcagaagagaagagggaaatgtatggtggaaggaagagaggacaggtgaagaaaagataattgatgagcacatgatgtctagtaaatccacactctccggtaaggatccttactctccgaaactacccttctcttagtccaggctcttgtccagtctttcagagttcaaagacttctcgtgttcagcaaagcatttaaagtggatccccctttctcattgatttgtggcttccttttaaagatttcacagtcccagagctttgttgtcaatgtattaaataaaacctagctcctccgtcagtgcctagggatttgtcaattaccttgcagtcatttggtctttgctaattgcaaaataaagagaccgctgcctttattggcctcccaaaaggctttcctctcctctacatactacattcaaggttgtattactctctatttcactttttaaagttgaagaaattcaattttttataactcagaaacatgtttaaagctttttgtcctccttaaagacacccttctccttgtcaggaatctccaccacacagctaattagtctcttgggcagattggtcaggttgcccaaggagtaatagcatagaccttgtttctttcctagtcattctggaaattaaactttattctatcttgtataagttctagtaacttttttatctatctcattttttattttctgttctttctgttactagctggtgacggacatggagacggaaaaattcaagaagtatgaacggtgctagtaattccctccagaggcaaatatttaaaaattcctccaagaaatacaactctggaaaagttgtaagagcagatctaactttagagaaattttaggccattcaggtggacatccagatggctaaaaacctattattggaacctgttactttcaaatggcaaaaactgcagtaactgttgcatcaatctaatgcatgctgaaccaagctttgcactttccataatgattttctaacaacaaaaaaaatgccataacaacaaaataatacatttaccagtaattacaatgatggtgattatgatgacgatgattaagatactggtaataatatttgagtacttgcttaattctcaaaatatatcacgtactatttgcctcttattttaccaatgttatcttcattaaacctcacaaccaacacaagagttggcaatgctatctccattttcttagggagaaaataaataaataagaaatggcggattagagacaattcgtaattgacacaaaatctcaaatctatccctcatggtctgtgtcttcttcagaatatatctgttctgctgggacttctgacaactttcatgtaacttcaaatcagaaacaatttttgagatcacatggccccactcacttattttaggaagatgaaattgaaacccacagagttaagtaacttgttcatcgtcactcaacaggtgagtctcaaagcagacctcaaaatttaatcctcagacacacaatacaatcttccttccatgatatgtaaaatggttccaaaaacaggattcataatttgataattttgtataagtgtacagggtaaaacggatagaatatttaaaatctctaagagcccaatatatacatataacgaagtacatcatgctgcctattttgttcacagacaaaagtgatgtatttcatattgatcaattttgaaacagtcttttcttcccctggcatccatggcaactaatagtactgtgaatagtgaaaaaatcattctcaggatacctccttttggtttctttcctattaaagtgataagcgtattgattcgtgtccttactctgtaagcatgctattgaataagttatataaataaaaagttttataaattcagcaacacttgtggcatatcatatgactattaaaaatattgtagaataactgttgcttttaccataataacccctgagaaataattggcttgcattatgagacttgcgatttctcacaaaaggaaaatatcctgaagcaatttcacaccatcttcacatatgttctgccaaaagttataaaaagctgaacctcacaacctagagctgtagcaatgtaattagatttcttttctacaaatgaaaatgctgattggattggaaggtgtttcgtgaccagtacgttttgtttagtgtgccatctaaatgtcatggttccaggttggagaagttgaattacaattaattgcagtttcagggaatgactgagacaagaacagtgtggagttacaattgaaatataatgaggcctacttgagtcatgggatcatggtattacttgctgtttagaatgtacccctctactcaaagtatctccagaacctataggacaaaaaataacattcaaagcagcatgtgaggtgtgtaggtaatgtgatggtccaaacattccaagagtcctgagaaagagaactgggcaatactggctgtgctagggctgatgctagtggaggggacagttgccacgaacaaagtcttcccaaacagttaaaacagactcttaatagaagatgtttttaaagtctgttctgaggatcatctgtatctgcatcagcccgtctgtagtttgttaaaaatgtgctttccttagccccatctacctaaatcagaatgtgttggagccctaggatatgtacctctgacaagctccccaggcaattctgatgtacactgaagtttgacaaccacagatttccaaagtttggtgacaggcaattggtgagaggcaagtagatgattaacaggggctaaatcccagaaggaatatcagttgagtttcaatgggaaggccaaccactgcatcagggaacctgggagagatccagacaggtaactggcatcaggggtgtctgtctcacaggataatggcagggctccagactcaagtttgggcacagctccaatcccaaggaagaaatatatatctggatggtgtcttgttggagcaatattggagcaagcatgggtggtaaaaagagaataagaagtaagcttggaattgagaacttaagagtcagcatttaactgtattaattgtatttaaaagtatttacaaatatttgcaaaaattcagtgataattttttttcaaagttccactgatgcatgatatgagaaaataacagaaaacaacaccctcccaccctatatcaggcccacaaaatatacggacaaaacatagaacaacatctataacgtttaaattgtaataaaaactttttaatagttatttgcttctctataaaatgaggactgttgatcatggtgacagtgctgtatttcattgcacagatcatgctatttcatttacttacaggggagcagaagcctttattgtggggctacatcattcttcttttatggcttccatttaaaatatagtactagaacctggttgtttcagcatttttctagaagtcagtcagttctatactaactcagtcattctcaactgacatctccacagaatagtttgtcttagcgaaaaggagaaacccaatagtagttctctgagaaactctagtcaaatctacccatccaattaggtgagagaggactgaggaggatgagatgagaggaagtagctgggcatgtgaatatagccatcattcttgtgaacccctcagcagagaacaaaatctcttcatatatgcaagctccttaataaaagtacttggaagtcacctgtcactctctgccttgtgtatatcatcggtagtccattcatttattcattgaacactttttttttttttttttttttttgagctggagtctccctctattgcccaggatggagtgcagtggtgcagtttcagctcactgcaacctctgcctcctgagttcaagcgattcttctgcctaagcctcctgagtagctgggactacagttgtgcgccaccacacctggctacttttcttgtatttttagtagagatggttttcaccatattggtcagactggtcgactcgaactcctgacctcgtgatgtgcccacctcggcctcccaaagtgctgggattacaggtatgatccacaacgcccagcctgaacaacttttataccctctttctgtgtgcagtgtggtagtgtaaacacatccataaataaaactgttgtccctaaactcatggcatttgaaatcccggatggcatgttttgtgtctgatttattatgtcacctttcactaagaatttcaccaaatgatataatggaataagtataatacaaaaaaggttgttaactcataattctgtgtttccttttcctgcatttcctttaaaaagcagtctatagtattgtgtaaatatttttatcaatattttaaaagactttaccatttaaccaaataaatatgggaatgctttccaggacactaaaacaatgaaagcatgttttgacttgttgaggaaaatgggaaatatcatcaagtaagatataaattaattttttcgtaaaaagtgctatacttaatggtagttacaaggagactctgacaaagagttggaagatcagtgacactgaattaccatgattagaatatgacttctatgatatctatcttgaaagcagtaattacacagaattccaggtcatgctacaggcaattttctattttattatatttataaaataggagagtactagttgtcccagttcccaattagattgaatagctaactttttgtctatttttaaaaaatattcttatatgggggaaatattttctcagaaatgtcagctatctgctgcataatttagaaaatatgtgttatatttaacatgtacactttcctgaaggtagacatgctattaacttttcccattgtctaaagttttcagatgaaaagaactcttcttcagtatttggaacactctgcccaagaaaatactgattttcctgggagacaagaggtattgcagaccatattacttctgatgagctctaatatatacttttgacggtatgctcatttttattctatcagtgctaatacaggcgaataacccatttacgtaattttccatctttcgacaagatggatgaataggcttaatgtataaaggatgacaaaatgaaatatagaagtctggatagaatagaataaccaaagtagtgcacacaattactagcatctgtcaatcttttcccatcatttgtcatttattctgttactaattctcacagctgagattatgtgtcatgggataaatgtaatggaaagttactgttcagcttttcttaaataaaggatcaatgaaacatacattcagaaacaaatgcctgtcattttcacattttcaagatggagcctaatgtactgtccagtgctttttgccccactaggaacatggcacttaagaggataatttccagttgcttagagaaaggttttaccatccgtttaaaaaaatgcagtttctaaagctgaattacataattattaacacatttgctcatatatatacatatatatacatacatatatatatatacatacatatatatacatacatatatatacatatatatatatacacatatatatacatacatatatatatatacatatatatatatacacacacatacatatatatatggattattttgacataccagagcattatcaatggtttaacagaatttaagcctattttggctttatcactcctgaaattaaaaaataaatggtttttgagctagtaacgtttaacttgagaacactaaaaggtttgaaactatgcactgattatattattattgttacaacatatggaacattttataatattaactaaactcctactatctatacaaacttgtaataaaacagtaccattgtgatacacacatatagtgtatatgtgtcacatacatatttataatggaaatcaagcaaaagccaaataactatccaagtatatatccactttcatctctaataaaagtggaatttcatatcactacaaaggatatatttttcagtaagttgtgctagaacttgggagaaaaattgtgaaatttgagagaattaattcaaataaatattctgacatactattataaatttaattttccaagaatatttctggagtatagtcaacaatgtactacaaaagttgttaaattttgcacagtttttgtcttttcaaaccattttactcttttttttaattggaggaaatcacatggagaaataattatgcacaacagtaatcatcttggcatgtattttaataataatatcttttttctcttttttatatttatgttctatttcttggtactaaaaactcatcaattaagtggcactttggagagtgattagctatctataaatatcctatgagctatgtacagtgatatgctgatcagtggttaacaaaaacaaacaaaccaacaaaaacaaacaaaccaacaaaaagccctaattggtgacactggttgattaccactgggtctatttatgagtaaagagcatatcacaggctaggaaaacccataatttgtttttgctaactgagtttctttttttctcatagtggtttactagatagtgctctgtttttgccatgcatgtgatgagaaacagggcatcttacttcctaatagctgtaatagctagtttaggcaagaaggattcagcttcacttgctcactatggatttgaaaacaaaatcttacaggaataaatgaaattcattcttctggcttaatcataagagacttatttatttatttatttatttattatttattttaaggaaaatctgagaattgagaaaagctgtttacagaaaagataaacaactgtatagataataccacgttctggcaaaatattatcacctctaatattccttatgatttggggcattttatctaacattactgtggctccatatgttcaaaataaaagaaaataatcatacctccaacagccagaagatggtcatgaagccaaggttagaagttaactgtggaactactctactaggtagaaaacattgaggagacaaaaaatatttactattggaccattttggcagagtaccttataataggccttgaagcatccttctgatgacaccacatctggccacatttacaggaaacaagtcaaatcagtgtcttatactctcttatttatttattttgtaactaatcaaataattaagtaatttagaaacaagcaaataagtcataacaacatttgagaagaggtacttcctgtttctgtgtttttcctaatgaaataaatagattgcattctttcttggccagtcatgctctggacttaggttttcttcatttcttgcttctaattctttggggaaatggtgtttccttctattgaattataactttccttatgatgaatatggtcctattgaaaactggtttgtgtgcattttatgggttttaaacctttatacaaattttaatctgtttttagacatgctctgtaatcctttcctttaaatgtataagcaatgttgttaccaaacttttccctttgcttgcttatcgtgtcattaaccattcaaagagccttcagtaataacacaatatatttttataaaagtgcatctaaaataatagtatcaagagagtaaataaaatcaaaatatattctatttagagccagcatctgtggaaagcaaaacatattgggctttgaatgaagaaacccatatataaacgatgaaagctttatttaatgaaaacatttcattaaaaaaaataaaccaaaaccacatgaataataatattagccaatattaattatgagacaaaatgttaactttttatcagtagccatttagtctcttggttcctatacacctcattagtctctctttttagctctccttacaatgttttccttctctactaatcctctaaatattgctgtggcctaggctcagcctaattcatttctctactcacccacaccatttatctgatttcatccatttctatggcattcaaagtagaattgtgggtattaggggctgggatatccgtggaaaaaggttggttaatagatgcaaagtgacagctggatgggaggattaatttctagtgttctgtagcactgtagggtaaatacggttaacagtaatttggtgtatattttcaaaaagccaggagagaggattttgaatgctcataacacaaagaaacaataaatgttctatgtgatagctatgctaatgaccctaatttgatcattaaacattgtatacatgtgtcgaaatatcactctacatcccatagatatgtacattatgtgtcaactaaaattaaacagaaaaaaagcattaataggctgtgtgtgtttgtgtgtgtttacatgtgtcagtgtacgtgtatgtgtacatagatttttctcactttcagcaaaactcttacctttgagctagcaacctggcctcttcccttgggtttttcttacttctgcttgaatattaataaatcctaaataaaactctagattctacatcccttgccaatcttaatgacatcagcaaccatccttttttacaagacacctggatattatactgattttctgtacacttccccctaatttttttttttcatatttgaaatgttttgctaaggtcttcttttgggtataatatgtgattcttagtttttgatcaatataaatacaaacacccaaaaacttaccaacctgttggaaatcacagttctttcatagagtatacacagcatgaaaacattttattgtaagctaactctgaaaaattacaaatgttgatttgttctcaatatgaaactaaaatttctgaaggcgagtaagcattaacccactgcagtcattcacacttgaaccagaagcctgtgatttccaaggtatctaaagttacctctcaatgcccaaggcataaatgcaataaccatcactaactgttattgggttcctaggtccacacagtcataactcactgtaaagttttagttcttttaaaatattgatgacgtttatactaggaaaatgtgacatttcattctctttgttataatggttatcaactgatgattattatatttcagtcataaaggaacaatctaaagcatagggaatgtagatttttcgttgtcgttgttgttcaaaaagctattagaagaaaacaaatacggattagggcataaacttcttttccttccaaatgtggtgaaaacagtgggatgtccttttttgataaatatgtctaagaaagaactgaaaggcttgctgagccagaaacataaatggctttgatagcactggagttgaaaacctttatttacattcagtcagtgtgaatgtgagcttccatatggtcaaacccatggctaaggagtctatggggaaggttaatatgttatctggctctgctcacacaaattatattctgatgaaaaacatttgccctctcatagttttctttcttttatgagccttcccatactattctcccccttggcctacaaacagattgcctcctccaccaggacagttcagcattatatgactcagagggcaagtttctttccttgtactgttgaaaattaataccttgctaaggcatttcccccagattccattagctgtttgaaatttagatacagataaacagaatgaaagcacatgcttggcttaagttgaaggattttattgcttagttatgttagtgatgatgaatggtaatggctgtagtcattttttcttatgtaacatgaaaatatattttttacaatgttctccttgcacatttattttctgcaattcaaatgctcactatataacctctagcttaaggctattgcattttaagaaatggatgagatagagagacatggaataaaaatgaaactggtgagatagcacagtgcacttaatcattcctttgttcattctgtcatttattcaatcaacacatatttacagaggttctacctacaagatgtagcactttcaacagtactacattaagattcagacgtgcctgagtatgcatagcgagccgctgaacatattctcaaggagatggcttgcatgagaacttctttgttttagcaaaaggttaaatgggaaatctggggatgttgccacctacagattgagactaggatggaggtgatgcagaacaatgcagtgtcttacctttccctgaagcatgaattgggtctgaggtctgaggttacagaaatgaagggaaagtgcagaagctattttcatgtagcataatatatgacgccaggagacaaccttaaagtccctgaaattctcacatctccagagaataaaacatgatacagagtggaggaaaaggactttgttattttccaccatcagaaaagtaccagagaaaccaggatgctaagtggtcaatgaggataccttgcccacatttagtgctgagcagttgcttaactgagtaatataaagattctagcattatcagacatgcataggatcacatatcaggcatttcttggggactcccagaagtgcttcaagggtaatttcaggtcattggaattctgcatgagtaagtgtacacaagaacaagtagggtgtctattactactgataatttcacctcacttctgcctgcagattgttgaagcctaggaaaagcagatctcactttcaaggggtaatttaggttttacatactaaacagagaaaaaagggaccttcattgcatgtgaccaaggtgctcatatgttagacaaatagaaaagtgagtacaatgtactttgagatgtgttgtgatatgtcagagagcagagatacgtgacagcacagacaatgcatatctaattcagactgcaaaactgaatttctgtatatatatatgctcttcctctatatatatatatagagagaggaagcataaaaaggcacaacaacaagggaactagcacgacattttatggtatattcatgaatctgcaagagcttggttgtgtttgaatcacagctttcaattagagtataagcgatagatagatagatagatagatagatagatgcatacatacatacatatgaaatacttgaagatgtgagtatttgaagatgtttcagctcacaccaacatggctatatattaaaatagtggagtaatgaagcagtttagattcctatctggtttcctgcccattattccacttactataataacttcttttcttctcaccccttcttctggaaataaactctctgatccaaattaccccacactgcatccaaatggttaacttcagagcccctggccacagatgatttgtcgctggcagggctgaggggtagctctagacccaagttcagccaatcctacccttctttggattttatataatgaatagtgagatcagactatctctacataactaaaattataatacataaactaaaatattacaagtatccatgttcttctgtgcagatggaggattatataaagccagtattcagcaagacagaaaaatgtaatagaggcccaaagaaaagcgaaaatgagaaatggagaaagtagtctgatgacagttgagtccctgggggaagcttctgctgagttccagataccactatctctagtttctgtgaacatccctgtagcattgtaacaagttacacttttgttcaagctaataaaagtgtagtgtcttgtatgtataaaagaaaaacaatggtcctgagcaatgtatctgttttaaaattttcaaatacataaatttttaaaagaaaattaaaggtggcagagaaaacagatggaatagtcctactaccttatgtgtcacttgcagaaaaattcaagaaaagagaagacagatcactatggaaagaagccactctcacagaagacaagttcttggcatcagcatgattaagacagatacactctagcctggtatgttggcaagcaagtgaaaagcaggaggaactttttaagtcagcagtggggtggggtggggtggaattttaaattcgagagtaatggctcctgaagtgagcccagccagcatttggtaaccatgagaaaagatttctagtgtttgaaacttagatgtcaagaaatgccggatgtactgattggatagaaagtataattaagggattagaaggagtgaaggtgctttgatttacatttctctgttacattatattttaaatagatctttaaaaagttaatgaaaattggaggattacatctcctatgattacctactgatatttaagtgatcttatctacctggttaacacaatgtcttattctttaacactggcctttaatttccttggggcaaagttgtaatgacttgattaatgtagttatcagatgctgcttaactcagttacaagtgcttgccatcacagtacatgctacaaaaatatttacatttcatgaagaatataatcatttatcttgttgttacactaaaaagtgatagtgttcattcattcgttattcaatattcattgactttgttttagccaacactggttatatgtgggaaatacggacatgtgactataaaattcatagtctctgctctaaaatagatatccagaagataataaaacatagaaaggaaattatttcttaactatctctcactcagaaatccacagttgggaagagcaactaggtacatcagacatctccatttacctcaaggcatctattccaactgcatacatctgccatggcagagacagctgggctttgcaaatcaaaatctatttcagttgtagaaatttaacatcagtccaactctatttggaaatataatgtaagctttctgttttgttttggataggatcttgctctgtcgcctagactgaagtgcagtggtgccatcatagctcactgcagcctcaaactcctgggctcaaggcacctcctgcctcaatctcctgaagcctggaactacaggggcatgccaccatgcctagctagtttctaaattttttgcagagaaggagtctcgttattttgccagggctcttctcagactcctggacccaagtaatcttcccgcctcagcctcccaaaggcttgagttacaggcaggagccacagcaccaggccagcatctttttttttaaatctattaagaaatagtctaggcttctatgtagagcaatggaacatacaatatgagttttgttttaaacattagataaagagtatatataaatcttgtgtggtttgaggagtctcagtttctggaattgatcaatttgggtcactgaaaattaaactgcctcggagaaggtttacttgccctttgatgcaagggggcttataacaacttaaaagcatatttgctaacaaaaggattgtgctcagtgaatttctattttctcatattaagttcttaaccctaggccatactctactatgtgtccatggatattgttatgatctaccatttgtcatatttcctctgcttctctagtcatttcacctgaagagaaaatcagcttcaacttccattttctcactcagtcttcttgcatttgaatacagaaaaagtaagaaaccctcagcagaaaaatcaccaaaataacataaatttctagaaagtttccgtgtcatatcaaaacaactatatatttcactctgacaatgccggtgatgcaaaagggacaaaaatatttaaccctgtaaaaattttacttttgggcaatcaggctctttctttgctcatgaagtaaatggaaaggaaaaaaagtatttgaagtgtattgccctcattttaataatgataataaaaataaattttcataattctttgcaatttttttgagcatcatgcctccctatcagtgagacagggcggacactgggtgaaggagcttgtatctagaagagtcaccagactgggtggtagaatatgacttagtcatgatgctgcagtgtgtgaggaaccaagagtgaattcagggaaatggagagacaggtatccattccggagctgtacaagcaaagtctgaaagccgaagagatgaaagagaggcaggtataaaccaaataccaggataattaataaaagccgatgttaaaatagatttgcaaaaaatagaacacacttgccaattaaaaataggacacacttgtcaaatacaggaaacacttgcaaataagtgaagtgaggggcagagagtcacaatttatattaaaaaaaattcttacagacatggctcttttgcaatagcataaaagcattttttaaacttcttttttgttttaagttacagataagtaaattgaagatctgatagttatatgattaattcaagctcacatatcaaattaaataaagacacatattaaatactctcactataaatattgtgtcctttacattcaaacagattttaaataatagttcacttaatcccagcataatggtaaaatggtaaagaccactcatttttgccagtgtagagaaagttactgcatagttcagtaacgttataataaacctaaatattcaaggtaatggtatggttagaatgaggcagaaaggtcaaaattggccttaaatttctaatccattttatagaccctaagtcacacattattaaacagtagggatatggtttggcagtatccccacccaaatctctccttgaattgtaataatccccaggtgtcaagggtggggccagccacagctaattgaatcatctgggcggtttcccccatactgttctcatggtagtgaataagtctcaggagatttgatggttttataaatgggagttccctgcacgagctctcttgcctgtcaccatgtaagacatgcctttgctgctccttcactttccatcatgattgtgaggcctccccagccatgtgaaactgtgagtccattaaacctcttccctgtttaaattacagagtctcaggtgtgtctttattagtagcatgagaatagacttatacagtaattatagtattttttaatttgactccttttttcaaaatcatacatgagatagagcaatcatacacagaaagaaatgatgtggatcgtttccaatcatcttcacaaattcaactttgtaaatcttttcagtgagattaaaaaataaggccatcaaatattttaaaattcatttgccttcacaatgacaaagtttagagacaaacagctaatcaaatcggtgatactgggccacaagaaagttgtgtttctagatgacatgcacctatttttcatatacttttttaaaattggattatcaaaaatttaacaaacattcattacaaacaggcagagcaatttccagtgtgactacctgaataccttctgtttgtaatcatcatctgaatgaagattcaccacatggttacctaaacaatgatgaattatttatacctttaatgaaacttgtatgttaaaatgttagtaattgcattttaaaaaaatagacacacaaaacagaagaaaatcatctgactgagaattaagatactgtgatacacataagacagcttttcacagctttatgatgtattgttgatttaatagcaattgcttttttatataaaatatattttatattagtacacattaattgaaatttgtcctcaaatttagaaatgtttcaatattttttaaatgtgtagtttttttggtagaattgtagcacctggtcattactagatgtttatgtcaaagagaatgaacaacaaaaacagcagatactgttgcatgttttagttgttctacatccaaaattccctgtttcttagcttaccgatatgtatgcatggccatgtaacatttggcctatgggacttaaggaaaagcctgttggatgacacatactcagctagcaggctctccgcagcatcctgttcctcctaccctaaactgtgatatggtgctggaggtggagaaggcttctagcaacttgaggtcaaggactgacacattaagattggaagatcagaaaaacaacagaagcctgaaacactggagatatgatggagccagtgaattaccactaaactgctattttcaagattctttatctaggagaataaactcctacttgtttaagctcatgttaagtgtatttactgcagttcaaagcattcctaactatattgctgctcacactcaagttaacatgatgaaaaaattgatgtagacataacatacatttgcacaagtagatagtagaggggaatttgaaaaagcaagcattattaactcgtttcagagcaaaataattattttttctgaaatttggggaaaatcagaggatagaagtttcactacgacagcattctagacattcaaaataaagtttttttaaagtattaattttctttgtatgagtgggtctttcaaaatcccatacattcaagcagtttctcttatacaattcccccaaaaggaattctttatcttctatcaaaattttggtacactttagaagagcttttaaaattttatttgagattattttgtaaaaaaacatgcattcctaatttagaaaatttggtgaaagagtttgtattagaaagatgtaaaagttgtttatatttaaaaagttccccacctgtgaattaaatggtgggggataatgtttccttaaaagtaaattgagagattgctgcttctgtaaaaagaacgattcacagagtttgctttcagcttagagccccagtgggatagcatttctttccgttcgtctgctaacaccacagaaaaggaacagaggaataagaagcaataggatgtcccttccagagaccttgagtgacagtatggcaaacaagggtcatcactttaattagctttaataacccagagccgggtgaaagatctcctcctgagactaaagttgctagctgctgaaaggatgttagtgaaaattctgttatgtcaaatgtcttgccgcatgatttgaagtttttgttaaggaatccaggaagttagaggcttctgactaatgtgagaggcaatcaaaaaggagataaaatctaatgctttaaaaacacatttatttaagcaaaacaccggcttttttgaatggcattgtgtttgtatattatagtggctctgttaatgtactacgcacgcatcatttttaatcataaaagaatattgaaagacaatgtgagtcgttaatgactgagcaggaagaatgaatttgccccactctactccactaacattcttacttagagatttcaaagacctgaaaacaagtaatccaccctctgaaccactgagatcgcaattcacaatctctcacttggctgcttctagcaaagggtagagttctcgaccttccattcgcattgtaacttttaattttatcatgtgctttgccatctagagatatgagtgattaatctagttagattttaaataatgttaactctagattttcattggacttttgcattttagcagtgctacttttttttgagatgttccttctgaatatctacttgaattttcattgtttgacttgaacttctgaagagtgtgcatttaaaattctgttcttttagttgtaaaggaaagcattattatcctttcttctgctattgattactaaaaatgatttggctgcaggaaatttagcactgtagaagatttcatttcatagtctttaaccaaaaatatactagagagatttcttttcaagatatgatgtctgcaagagctaaatcagaagccctccctgcataggtcagatttttccatttctaagttacttaggtcttttcctttttggaggtcttctcttctgcaaagaaaccaatagttgtttgtgcttttacattacagaagacatgtaactaatgtggctaatctgaacattttgggggcatggtaattacaaagatttatcttgctactgaaatctcagaagttgaacataatgaaagcccagaactaactggcacagctatcctggcacatagaataagtttggttgaaaagaaaatcaacagggagaaaacctgagccgagagacagaaaatgaggtagatctctaatgatattgtttgtactcttggattcagccatgcctaaagcaagtttactccttggactttgcagctatataggccaatacatttcttcttttgctttagctaatttgattttactttctattgtatgcaactaaaataaacatggcaaatacattacctcatcttcaatttgcatggtaactgatagaaaacatttcaaataactaggtagcataaactattctgacaccatatttatctgacagtcagtagccaaaagtgggaaggtattggcttcaataaagtattcttttatttattttttagaaagcgtgaaaaaaataaaatctggagtattttcgaagaatgatatgggttaggaataacaattcttatttatttaatcctcacattttttgtaaattctgtgtaagaattgtcttttacagtattattaatttttatattttctttttaagaagtattgtttctttttataaccaaaggttgtataacatctgattgtagccagaatgctagcacttataacatgcaaggaaagtacccaaacttcacctggtgacaaagtgcacacttttcaggattaaataatttattcttttaaaaataaaactctaaagaattatcataattgaccttatatgtctatatattctcttggtaatattaggtgatgtctagagcagtgatttccaaatgggagcaaaaggatccaagggaatgctcagaaatatgcaatggggtacagaaagaagacatgtgagtttctatatatatttttgtattagtaattttaagtttcacctgtgtgtgtatgttgcttacaataatctaagtaatgatgtggtaacaatttcaaaatttcaatggcttaatattgtaaaatatattcatctcttatggtcagaaaaatgagagataaatgtattttagagttttaagccacattagtttgcctagggctttgctccacacagtttctcgaacaaccagtacgacagagtctccattatcctgtagatgcactaacatgagctcatggtgttcctccactttggaggcctgaaaaagaaacaccgggaaaattctgcaggacatttcactactccactgactaaaagggccaggaaatatagtcacccatatgcccaaaaaagaaaagagctgaatattggtgagtactaataatgattgctatggaatatatttattatatgaataaatttcaaatgctaaatatgcagggtaaatgctttaaaaactttactagtattatgtgtgataaaagaatatttagagactacagagtcactcttagatactttctttatactctagctctgggttcttttttcttctatcaactttcatctgcctctataattagttctaatcattactatgggttttcttgtgttttccagtctgcagccaacctaatttctccaaatgcttcgtcttcctatttttttgtcattgatattgataattttaacaggtaaaggctcaactcgataatttcatagcaagtctccttaagcacaaggaaagaaaagagtagaatgaatcctttacatgtccgtggtaggccagcaatctaccaaaacatggtacatgttccactaaaacctaaatcggggcattgaggtggctgatgatgataatatccttgacccagctgctaattcagagaaatttgttctccataaagttgccatggtgatggaatgttccagtctacacaagagttttcttttttcccttatgctatggacatcaacttacactatgctgcaattactgaaatcgtgtatttcaaaagtcaccccttcgaattcctcaaaaagaaacaataaaaccttttaaaagccccaaattttctactaaatattttgtagaggctataaacttagtcattacattgcatatattatagtgaaacaccttaaaaattcttattaaatatttctgttctccaagaactctcgtcagttccataacaggtggtcctcctccacccccacccaccccattctttcttccccacgcgttacctggacttgacatctcctatcacctttttaccagaattgccaccagaaaactattaattcttttctgggaggcagtggtatgagggaactgaagctagaaaactcagattggtaaaataaatcttactgtagtgtttagcaaaacaaataacctctgagaaataatcacttaaaacagttcaggtattatcaattattatgaaaacaaaaatgtgtcttttcttaacttttacttcaagcatcttatcaaataatttttcccaacaatttcaatgcttctcaaatagttattttaggcaatacaatttctacatattattacatgtattgttcagttttcattttgatttatccattatttctcaattgtttttcaattgttggtcttgatcatagatacccctgtccctgaataaagtgactgagtagcaggtagattgaaaatttaataatctatttaatatggtatctacaatggtctgttcagctttcatacttcccaaattgctactagttttccacaaaaacatgcattagtggtctgtaagaggacccacaacaaagattttcttattcatgatctaagggtttgaagcgaattacttcatttgtgtttcaatacagaaaaattagtaaaaattttgaatctgcaactgtataaaatagcataaacaaagattgcatatgttggatatagtaccaaaaaggatacttttgttagtatgaaatcatagttacatgttgagagaaaatacagcaaatgagttgaaaatgcatgttctggagcaatctttccctgtctttgcaatgaatagttagcctgtccaaggttgcttaatctccctaatctcagtatcctgagctagaaatggcagtaatggatctcagtgtgttattgttacatttaaaaaatctataccagtcatattaaagcttattattactattgttttgattgtagttgtcattatcgttattttataaaaagtatttctataatgtttctaaacttctttttttccatcttaaagtatttaagatttggtttacttatctcaaaaagaagtgactaaaagttcaatgggagaaatgatagaagctaattgtgataaaacagataaagtacatggcacaatggtgagtaactgctggctatttacttatattgttaatcatattatgtttaaatatctaataggtttcataaaattatgcttcattatttagtttagggagaggtaataccccatgaagtttcagcatccataaaagttctttctgggtaaatctagaaggcaatgccttaatcactctttaccaggaaaatttctcagggttgtttttgcagggaaattgtgaaaaaataagtaacacctctaatccaatcttaattttgtttccacctatgaaaaagtagacttccttttgctttctaaaaagacggtgggaaaccacaaaataaaaactacaaaatgaccagctaacaacttcatgattaggtcaaaacctaatacatcaatattaaccttgaatgtaaatagtctacacacctcacttaaaaggtacagagtaagttggataaaatagcaagacccatctgtctgctgtctttaaaagactcatctcctatgtaataacacacctaggctcaaagagttggaaaaagatgtgtcaggcagatggaaaacaagaaagagcaggggtcactaccttctatcagataaaacagactttaaaccaacaatagtaaaaaaggaaaagaatgggcattacataatgacaaagggttcaatttaacaagaagacttaaccatccttagtacatatgcactcaacattggagcacacagattcataaaacaaataggtctagacctacaaaaagacttagacaaccacacaataatagtgagggacatcaacaaccactgatagtgcataggcagatcattgaggcagaaaactaactaagaaattctgaacttaaatttatacttgaccaattggacctaatagacacctacagactattgcacccatcaatcacaaaatatacattagtgtcttctgcacctgaagcatactgtaagattgaccacatgcttggctataaagcatgtctcagtaaattaaaaaaaatcaaaatcataccaaccacactcttgaaccaaagtgaaacaaaacagaaatcaataacaagaagatctctgtaaaccacacagttacatgaaattaaacaacttgctcatgaatgacttttgggtaaaaaagaaaattaaggcagaaagaaaacattctttgaaataaacgaaaacagagacaaacataccaaaatccctgggatgcaacataggcagtgttaagagcaaaatttttagtcatagatgcctacatcaagaagttagaaagatctcaaattaatgatctaacattacacctagaggaactagaaaagcaagaataaattaaccccaaagctaacagaagaaaagaaataactacaatgagagtgtaactgaatgaaattgagactcaaaaattcatacaaaggatcacaaaaccaaaatttattgtttgaaaggacaaacaagatcaatagaccactagctagactaacaaaggaaaaaagaagattgcccaagtagaaacaacaaaggtgacattacaacttatgtgacagaaatacaaaagattctccaacactgttatgaacataccaatgcacacgaagtacaaattctagcggaaatttataacaaattccttgaaatgcacaactttcaaagattgatacaggaagaaattaaagcccttagcagactaatattgagttctgaaattgcatcaatcataaaaaactaccaacaaaaaagagaacttgaccagaagggctcagagccaaattctaccagatgtacagagaagagctggtaccaattctactgaaactattccaaaaatatcaaagaggagggctcctccctaaatcattctatgaatccagcattaccttgataataaaaccaggcacaaacacaacaaaaaaagaaaactcaaagccaatatccctgatgaacatagatgcaaaaatcatcaacaaaatattagcaactggaatccaacagaacatcaaaaagttaattcaccacaataaactaggctttattcttgggatttaagattgattaaacatgcacaagtcattaaatgtggttcaccacataaagaaaatcaaatttaaaaaccatatgctcatctcaatagacatggaaaacccctttaatacaatttaacatccctgcacgataaaaattctcagcacactaggcagtgaagaaacatgactcaaaataataagagctatctatgaaaaaccaacagccaacatcataatgggtgggcaaatgctggaagcattatccttaagaattgaaacaagacaaggatgcccactttcaccactcctattcaatatagtactggaagtgctagccaaagcaaccaggcaagagaaagaaatgaaaggcatccaaatagaaaaagcaatcaaactatctgttttgctgatgatatgattctatacctagaaaaccctaaagactttgcctaaagtctaataaaattgataaaccattttattaaagtttggggatacaaaattaatgtaaaaaatcagtgttgtatctatatacaaataatgtccaggctgaaattaaaatcaagaacatttttcaacagccacaaagaaaatgaaatatctaggaatatggctagccaagcaggtaaaagatctgcacaaagagaactacaaaacactgctgaaagaaatcaaagacaacacaaacaaatggaaaaacaatccatgttcatggattggaagaatcaatatcattaagatggctatactgcccaaaacaacctgtagattcaatgctattcctatcaaaatatcggtgtcattttttatagaattagaaaaaactattctaaaattcatatggaataaaaatgaaccaagatagccaaagaaatcctgaggaaaaaaaaaaaagctgggtgtatcatattacttgacttcaaattatactataaggcttaagtaaccaaaacagcatggtactggtacaaagagagacacttaaaccaatgaagcacattagaaaacccagaaataaagcccacacctacaaccatctgatctttgatgaattcaaccgaaataagcagtggggaaaggacttcctcgtcaataactggtgcttggatacctggctaatctgtctgaaagaataaaactggacccttacctttctgtgtatataaaaataactcaagatggtctaaatatttaaaagtaagacctcaaactgtaaaaatcctagaagaaaacctaggaactaccattcaggacatcagcttttgcaaataatttgttactaagtcctcaaaaacaattgcaacaaaagcaaaaattgagaagtagggactaattaaaggagcttttgcacaggataaaaaaagctatcagtaaacaatcaacagaatggaagaaaatacttgcaaactatgtatctgacaaagatctaatatctagaatccataaggaacttaaatatctcatcaagcaaaaaccaaccccattaaaaaattggcaatgaaaatgaacagacacttctcaaaagaaaacatacatttggcttacaaacatatgaataaattccaacattactaataatcggagaaatgtgaatcaaaaccacagtgacatattatctcacataagtcagaatggctattattaaaaatacaaaagcaacaaatgttgatgagtctacagagaagaaggaatgcttatacgctcttcatggaatgtaaatttgtttagccactgtggaaagcagtttggagatttctcaaagaagtaaaaatagaactactattccacccagcagtcccaacaatgggtatgtatctaaagggaaataaattgttctaccaaaaagacacacgcccttgtaagtttattgaagcaccattcacaataggaaagatatgaaatcaacctaggtgtccaccattcatggatttgataaagaaaaatttggtacatatacaccatggaatactatgcagacataacataaaatgaaaacatattttttttcagcaacatagatgcagctaaaggccattatcctaagcagattaatgcaggaacaggaaaccaaacaccacatgttatcacttataagtggcagctaaacattgggtactcgtggacataccaatgtccacggcaacaatagacactgcagacaattagaggtggaatgaggcagtgggaaataactgaaaaactacctattgagtactatgttcactgcttgagtgacaggattagttgtatcccaaacgtcagtatcatacaatatacacacgtaacaaacctgcacatgtatccccttgaatctaaagcagaagttgaaattattttaaaaattataaaaataaacaattgagaaaaaaataaaataaaataataaatacaatgatggtgaatcccccaagctgtgtttctatcctgcaacatataaccaatttcatgtgcaagcatccaaaatgggccctttgcatttccttagtaggattggagagcatagagaactgatgtaaatcagcgtgaagctttggctactgttgatgccatgagcaataaaatcccatgtctctgatccaggagcctcatgacttctgctaccattattgagattgtggcaggctaacctatttgcttgtaaataggataaaatttcaaatcctgcatcattcttgacatagtctaactataagaaatattatgaaatattagcttttcaagaaatatcaaaattaacagaataagatgagtaatttgtgattgatacactgaagatttatctcatgattttatgaacgtggtatttatagtaaaggaaatccagcaaataattacataaaagtgtattatctgctgttttgatgaatgtgtgaaattgattcaccctactatcaacaataatgcacacaaagttttatttaaaaaaagctagggaactctattttatggcattctatctaagctaaattattatctgacctaactaggaaaatgaaatctttgctcaaaccccttcctgacatttttatctaaatcaagaggaaagttccaagggtagacctcagagttgaatctgataactgacaagtctgtcttattataagacttgagattggtaggagaaatttgactcaggaaactgaacttttaaattttgaagtgtgctctgtagaactaaagtttagaaaatgcatataagagacagaaagaaaggtaaggaataattacgaatggaaagagctacctagataattccttattttcatatttcctatgaattaagtttacacatattttaaaagtagcatattcaagagcaattattgaactacttttctgcctttgaattcatgttcaagagaaatatggatgcacaatgtttatgcttgtgaattctggtcaagatattgctgtaactatatgtggaattcctctccaccttggttctaaatacctagcatgatagttgcagtacttttacaccatatagctatctcagtgaacaaatgttgaactgaaacccacagcaataaatgaagcctgaatgataattccatgaagtttctagatcaaattctgggggaggcaaacgggggactggctctatcaaagtaaaaattaataaattcccctgttagtcacagctgaaacacccacaaaagtagatccaaaaaagtcacagtcattgcctagtgttgctacctaggaaagctggagggaatagagatgtccacacaactgggaccaaggtaagccatatagattcaggaactataactctggcatctctacaagatgtgaactctgtaactccaatataaatataagatcccaatttgcaggctggaaacaactagacacacatgggtgaacatgggaaatacaaagtaaatatatgcccatgcatacacaaacacctattcaagatgaattggcatatcaaggtctaaagcacagagaaaaaaactagtaacttaagaatactatttaaaaaactcagggagaaataattaacttacgaaggtatgcagataatgtagtattttttaaaaatgattataaagtgaatctacctaaaatactcagagaaataaaataagaagatcgtaaatcaccaacaggaaactatggaacaaaacataggtatatataaatcaggaatgagttgacatgcaaaagcaccaattagaaattctgaaaattaaacatgttatcataaacaagcaatagatgtaatatattttagaggggccatagaacagagaaaattattgaactcttagataatgtaacttagatcaattttgttgatttagagaaatatgatatcaaaagctcatgaatttaaacaaaacctctgttgagaaattattaaataatgttaatcatgagagattctgtgtcctactaatgaaaattgtgtcaatctgcataattttgcttagagtcctataaagtgttcttttcaggttacctgaacaaagacttatttcagaggtaaaataaaattaagcgaggttacttctttgaaaattatggagaaaagacaactcttaataattgtataagatcaagtaaaattttgcttaatattagtaaaaattcacaggaaaaataaaaaaatgactataaagctgcactaattcttaagtgcgaacttaatacaaatattctcttgcctagaaatatgaaaaatgtcataagcatttatgaccacagtaggatgttgggaggaaaatacctctggtaataatctttaggagcaaatgcacactgttagtaatgattgatgaaaagtttcctcacaatctgctgagaaaaaaatgttaaaatgaaattaagtgtagttatagaaaacaaaattacataattgacataacagagttattggcctgagagtcatacctattgcaatctatttcttagaggctcactcctgcagatgcttggctggaacttgtcaatgtttctatacatacaggaaatgataaacagcacatatcaagcctggcaaatacctatgctgagaaagaaatgctggtcctcatcaagggagaaggagccagagctaaaggacagggtgttgtcaagtgattttgagtatttatgcagagctagatttttttagatagctttctcagaatgtcttatttcaaagtcagtaaaattttaattaacctaatttcccctgttctgatttcatgttcccccagcaactatcaatttatgaagctcaatcaaatgggcttcaaatatttatatctctttgacactgatttctagaagtgaatttttactttcagtcctgatttttttcttgattctcatgcagttcaaatacagcagtagagctcattgattgtaaatatgttggtgtacctaccagtataaatgctttatttctcactgtaagtttgatgatttaaaaatctcttatttgccttagtttgttgagatgttttattcagcatgactcagtcctccagctcaggcctcatcacgcatgaacactgatgaaatatgaatctgaaaccctaaaatggtgtgacaaaattgagttactgtctcatgagatccaccaaagctcaaaccagttttccttgataccatactgctcccacttgctgattcagtctactaatttataccatcactgtttacaaagaagaacccatgaagtcacatttaagaatatgtggttggtgacagagctagagaaaattgaactaacattctatggcaggggtccccaactcccaggtcacagagcagtaccagtccatggcctgttaggaattgggctgcacagcaggaggtgagcaccggccagcaagtgaagcttcatctgtatctacagctgctccctatagcttgcattgctgcctgagttccacctccaatcaggtcagtggcatcatgagattctcaaagaagcatgaaccctattgtgaactgcgcatgtgagggatctaggttgcacactccttataagaatctaacgcctgatgatgttactgtctcccatcaccccaagatgggactgtctagttacagaaaaacaagttcagggcttccactgattatacattatggtgagttgtataattatttcattatatattacaatataataataatagaaataaattgcacaatacatgtaatatgctcgaatcatcctaaaaccatcccaccctgctccccatgtctgtggaaaaatgtcatccatgaaaccagtccctggtgccagaaatggttggggactgctgatctatggagtatctgttatatacaatacactgcctgctatcccattcagcttattcagtttaatccttcctatttcctacataagtttagagggttacatcaccagtctaactagagagctgagggatttggatcatactcacagctgccatgcagtatcttcccagggcacctacagctggggttaataatgatgtgtggcccttctactatctatattataatcaatttgagtgctgcttaaacaaacagatccatgatgcacacacaccacccctccccaacacacacagaacaacagtaacaacaataatgtcaacaaccaactatgaagtcaaaaacttcaggatgagacccaggaatctgcacatttaacaagaaaccccaggcaatttttgtacacattgaagtctgacatccactgctataaaatttacgtgtatcccgttggagagaaaaaaaacccaaaaaaacaaaaaacacaatgtgacaaaaacagtcactgtcacaatccctagttacccttccttcagtttttcctctatattttctgttttttttttttttccttaacatcaggcgtacattgagatttctttcagtcagtcctgacttatagcccctttgtggttatgactcatcccaaacactttcaaactgaactgcagcaaaatcaataaatcaacgtaattaaaccactatcataaagaatattactcaacagtataagaactgtaactactcgccctaacatgtgtttctttctatttcctatcagtctaacttagagagctgagtgcagactcctgggtctcatcctgaagtttttgacttcatagatggttgttgatattattgttgttactgttgttgtgtgtgtgttggggaggggtagtgtgtgtgcatcatggatctgtttgtttaagcagcactgaaattgattataatatagatagtagaagggccacacattaacattaaccccagctgtaggtaccctgggaagctactgtatggcagctgtgggtatgatccaaatccctcagctctctagttagactgatacaattctcaagtgaacagtttcagaaaatatcttgatagaatctcaagatgtacttgagcaactggtacacagtaatgatggctgtgacttaagactctctaggggccaatcgtagagctgcaaaaaatgcttaaatccaggaaggaaaacacaaaaggaaacaaaacaaaaaaaaaaagcgttggtgaggagtttgcaaatgatcatgtgaggcagataaacagtttctctcaatttttaaaaatcaacatatattgagcctaggcgggccaaaacagagatactccattttgaatcatgacaggaatagaagggcatgcgaaatttctccagcttttctacctttcagattttaaaagttgattcacttaagctgttaatacagtagaaacaatctacatgtatctggcatactgaattttcttcacccagataatagtgaattcaattttgtctttcacggcacacagtttagaatttctctgtctgtacctattttccacttgtctcaggatctcaactaaaagtcattttgaacaattatataatgtagattccaaacttttataaaactgcttcaacacaccatttttaggtggttttcattctaccttaaaactaagttgctacagtttaaaagtgcacaagggcagagtgacagccctatatactatggaaagaatgaaacagacaatgataatagcttctttcagctagaaagctgtacaatagactgttcttctttagacattactgaaggtagactgaaaaatatcacctaagtgaatttttggtttcttagcttcactggacttgatgaattgacaaaagccccagataatggctgatacggagaaagagtgggaaagtatgtccgtagatggaaagcatgaccctgaatcaaaactgtgaatgagcctgtggggacagctggacacaggagaatgttttgccctcattagtgagcaatttcttcttttggactgaacatacagtctatctccttctcagccttaagggatttctagaaaaaaaaaaagggttagtaattgtgtggtcttctccattacaaagatgctgatatttcaaattcaaagggttacaataaatgagagcttgggagagtgtatgcaaacctgttagtagaaaggtagagcattgcttatgcccttggtcttgtcagttgtatctacaacacgtaagtagtaaaggggttgctaagcaacttctaacttttaacattaagtgtgctcagggactgcatactgcaaaggcacagtattgcccattggtagaagaggatgccctaagtaagatgaagtggaaggtatctctttattgtcctttcagtttgttgtttgtggaacaggaagcaaaagagagattcatgttttggtttgttctggaaacttatagaactcaagagtagtagaatgactaaaattatttttgtcattcctacatcttgtttttcttcataactattatttagattctgctctctcatcaggaagattcctttttttcttcttttcctgaaatcaatccctgagcctccatggtggctgtggagggacctttcacatagcaacaccttgattcttgtacactgggaatctccttgcccttggaaaggcactgtgactccttagtattttatttcaaaagaagctaccttatacctcaggggagaacgatttgagacatttaaacaccagcaacaacagaacctgacacacaaataaaatattcttcctaagcccaaaggatacaaaaatgtgttcagtatatttaagctaactaactaaagttatcctgccttgttttctgaagctttaggctcaacccattgaagtgctgacttttagggctgtagtagctgtcatctcagcagctgctgcagagaaacctgtaccagccctccttaaaatctacactcaaaaaagtaaggcccaaagagagaagacacttactctccagtgtgccccaggcttaccttgtgaattctgattattgttttaggattacacttttttcttgaataactgacaggggatctgaaatgatgaatatattacatggagatcctgggtcccaattcccaggaaagtgatctacctgctacctcaacaagccaaccatatcagaatgcaatacaacattcctaaggcaagtatgtgcatgtgctaggagtttagtggattaaacattccttttctctgcatgagaatttctcattaatacttctttatggatagaaggcaagaacagaatcaataaacagcgcaaaatcaaggcaccaccctagagttctgtctttcctttatccttatagccacttttctatatctacattcactacaaaatcagcccctcgatatccaatacaggccatgtaaggtattccaaaaattaaaactcaattgcgagagacactgaaggacaaagaattttccacagtgcttcctgagcctttctcccatgcccttgtatataatctcaactcctaactgctttagttcaacactgttgacaaaagtcttattgcctaaacaataacggatctgcacaatccctttcttttcgagaaatatctatgacaaacatcaacttcagctcacccctcctgttaaacctccttaaaacactctgccctcctgctccaagtatgaatgttcatttggagccttctcatgcctggcattttcaataaaagcttatgttaatagggcttgattgattttcttccacacaatttataaaatacacgcttaacattttactctcttagaatcaacatcatgatgactttgcaaatcttcaatgtcacactctgtattattctcaaataatattgtgagtcccctgttttcaaatgtatacttggcctcttttcaaacatatatgttagcttccttttaaaatagccttttagagttcatttgctagccagtaccagatgctctaaaattggggactgcaaagtaatttcagaaggagtgaaatttggtgtcctacccagatttctaaaagagaagctggaaaaatcatgtgttaatgagagtcatgtggtagatgcccaattcttggctagaggaagtcattttttcctgtatgcagatccccagcaaatactacaatacattttcaaataaatagtatatgggtctgtttccccataaccaccattgctgactacctaatctgacaccattgttaactggaaatacaactatttccttctaattgctatccctatgtccttattagcctcaaacaatctattcttttcatagaagccagagcattctttcaaaaatgtaagcagaatgtgccactcttctgcttaaactcccaagactttactccacagtgccgtttttgatttctgaaaacaccttgttctctccttgcccttgttgcttccttggtgtccttgctctcacctcctcccaagattgtctttttctcatcatttaggtctctgcttaaaaagtctctttttaagagatgcttcttagaacacagaatctaagctctacctctcccatcaatactcttcatcacattgtcctgttctatttattgagcttacgttttggagtacttaataatattttaatttattctattcatttttacttgtttgctagttttctggaccacaccaatcatttatgctacacagagcaaggaacttatttgtcttgtcaacagtggtaacttcagttatgtagaatagacttgacatatagccatatagtgggtactcagtataatttctgtttatttttaatttttttatgtgtagtttttactttgcgataagaatatatggaatttctcttctctgaaactcccttattctgtaacttcagctttttatgttcttatttgttattttcttcctgttgatagaattttgtccacgtttgtgtttcttataatttaagctttttttataattatagattctattttacttttatttgcttattttcattattattataataaatattaactacttatgtagagcttataatatactaggaagttgatatgtattggctctgcacccccaccgaaatctcaccttgaattgtaataatccccacgtgttgtaggagggacctggtgggaggtaactgaatcatgcagatgggttttttctcatgcctttcttgtgatagtgagtaagtctcaagagatctgatggttttgtaaagggaagtttccctgtatatcacctttgcctgccgccatgtaagatgtgactttgatcctcatttgccttctaccatgattgtgaggcctttcttgccatgtagaattatgagttaattaaacctcttccctttataaattacccagtctcaggtatgtctttattagtagtgtgagaacagactactacagtaaattggtactgggtagtgggacactgctgtaaagacacctgaaaatgtggaagcaactttggaactgggcaacaggcagaggttgcaacagattggagggctcagaagacagaaacatgtggaaaagtttggaacttcttagagacttgttgaatggttttgaccaaaaagctaatagtgttatgaacaataaaatccaggctgaggtggtctcatagggacatgaaaaacttgttgggagctggaacaaaggtcactcttcctatgcaaagaaactggtagcgttttgccactgtcctaaagatctgtggaactttgaacttgagagaaataatttagggtatccattggaagaaatttctaagtagcaaagtgttcaagaggaagtagagcataaaagtttgaaaaatttgcagcctgaaatgcagtagaaaagaaaaccccattttctggggagaaattcaagccttcagcagacatttgcataagcaacaaggagccaaatgttaattgccaaggtgacagtccccaacccccatcataagctcagacgcctaggagggaaaaatggtttcctgggctgggtccagggacccctgctgtgtgcagcctacgtacttggtcccctgcatcccaactgctctagtcatggctaaaagagaccaaagtgtatcttgggacatggcttgagagggtgcaagctccaagcctcagcagcttccacatggtgctgagcttgtgggtacacagaagtcaagaattgaggtttgtgaacctttgcctagatttcagagcatgtatgaaaacacctggatgttcaggcagaagtgtgctacagtggtggtgccctcatggagaacctctgctagagcagtgcagaggagaaatgtagggtcggagcccccacacagagtccccaatggggcactgtctattggatctgtgagaatggggccaccgtcctccagaccctagaatggtagatccactgacaacttttgtcatgcacctggaaaagccacagacactcactgccagcacatgaaagcagccaggagggtggccgaatcctgcaactgcacaggagcgaagctgcccaaggtcgtgaaaatccacatcttgcatcagcatgacctagatgtgaaacatggagtcaaagattatttccaagttttaagatttgactgccccgctggatttctgacttgcatggggcctgtaaccctttgttttggccaacttatctcatttggaatgggtatatttaccaatgcctgtaccccagttgtatctaaaaagtaattaacttgtatttgattttacaggctcctagatggaagggacttgcctcgtctgcaatgagattttggacttggacttttgggttaatgctggagttagttaagactttgggggactgttggaaggcatgattgtttttgttttgttttgtttctttgagacagagtctcactctgtcactcaggctggagtacagtggcatgatctcagctcactgcaacctctgctgccctggttcaagggattcgcctgcctcagcctcctgagtagctgggattatacatgcctgccaccacacccagctaacttttgtaattttagtagagacagggtttcaccatcttggtcaggctggtcttgaactcttgaccttgtaatccacctgccttggcctcccaaagtgctgggattacaggcgtgagccaccgtgcctggctgattgtgttttaatatgtgaggacatgaaatttaggaggggccaggggtgcaatgatacggtttggctccatttccccactcaaatctcaccttgaattgtaataatccccacatgtcatggaagggacccagtgggaggtaattgaatcatgggagcagatttttcttgtgcttttgtcatgataatgaatctgtctcataagagctgatggttttataaagggagttcccctgcacatgccctcttgcctgataccatgtaagacatgactttgctgctcattcaccttccgcagtgattgcgaggcctctccagccatgtggaactgtgagtcaaacctctttcctttataaattactcactctcaggtatgtgtttattagcagtgtgagaacagactaatacagaagtattctaaacacttcacaaatattagcttatttattaacatcctcttgtgttagtgcatagatactattattgtccttattttacatacagagaaactgaggcacaaagaggatagttaaggttcataatcacatagcaaatagaagagtcaggatttaaactcaaatctgggtaatctggaatccagaatacaaactcttaaatgaatacataaatcgaaaccccaaaatgatatatatttaaaatattttctcacatatgattcaatattttccttttcaaccatgctcttctgagaatttttatgttttaaacaaaggacattcgtttcttaaggggtaaaaatatggcttagaataaaatggaccttagaatgggctaggatccattctttaatctggaccctaacactttgggaatctaaggaattacaataatttcgaacctaagcctttaagaaataagatgttttctaaattctcaagctcatttttactaaatcacatactaaagagatgttccctgtgctatggtggaaattggttgagaaatatgacctaggaatattatcattccaaaagtaaagcttccagaaaattttattttggtagatgaggattagaggaacaagaagaaaatcataacattagggccaatgccaattgcaaagtcctgtattcaatgcagcattctgaggtatagaggggtaagagctaaggaagatgtataagttgttgagctggagagtagcccccagaacctgcagacatcatcatgatgcacaaaaacaagcggagagattctagacttctggggatcatggaatatttgaagaaaaccgggagactagaagggtctggaatcacaatagagggattgcgactggacattttggtgcttgtctatggcaggtgggaacaagctgctcacaagaaacaggcaagaccagctaagcttcagtggaaatcaaagttgaacaccaagagtagaggtcagagcagaccttaatcctgtggagactcgttaagtccagaggacagcagttgtaccaaatgtgtctctagccaatcacattgacacaaacatcctttggcatccaggttcaaggaggacaaaagatgagctttatagaaagaggaatacctaataggatgggaatgttggctttgttttttgtttttgttctttattgtatgaacagtttgagttaaaaaaaaagattaaattttaacttgggcaagctgacaataatagaaactcaagagaatttgaaattttcctgtaataaataaagaggaatatatatatatacacacacacacacacgcatatatatatatgcacacacaagatgaagtgtgggcacatttgcaattctgttatctaagagaagaaagactaagaagcacagaggattgtgagtaaaaagaggaagcaatcatcaaggcttccttttatattatattgaaggaaatgctgagtaactttagacacagtgcaaaatattctagcaatttaaaaagatcaatatgaagatagagtcatgcatgtaaaatttgctgagatatattggctatatgaccaaatttcattcccatgtgaaagaatatatttggaaagcaatgaaagtctatacacagaaatagccatttccattcactggaggaccaaggaaaaattaattacaaggtctgagaaagtgttaatctgccatagtgcttttgctgtctataaaaatggcaacataggtttgttactaacttgtacatttggctgacatattatcgaataattttgcaagtaaatctcaccattcaagtctctctaaagggaaagaataaaggaaggtatttatagtcttcttgcaatggttcggtggaaaagaaaaggctacatgtcttccattcggctttagagagagagttctgtgaatagaaaattggctcttttcctaattactctcctggaatcagctgctgagtacaactccataatctacaccatccaacaaaagacatggcaaaggttaagtgattttgtcctatatccaagatagctttcatatagcttcattgttccttcaatgaattgagtcattcactgaaaatgcacacttttactgtgttccagatttattatctaaggtattaatctccacttcaccaaactgaaatacagaaggaaaatgtaaaccacaccaaagtgaacaactgtagcatcctgttgtttaaccaatcgcttatgtttggccagaggcatcaatgaaagagacaatgaaaaaagagaataagtaaaaacttcaaatgttgtgtggtattagcatatattattctcatcccaaatggcaatctttacctttaagtcccaataactaaaggaaaattacttgaactggtggtacacacatttaggtttacatcttaagtgaaagctgatatgtaaaacctctaacctttatttctctgataattgtaatatgtatttttttaaataaattcaagccaaattcctaaaagcagaatcatggagatatcacagaatgtatggttcagattcttcaacatgtttaaaataatttagttttattcaaaagccagcataactgtagatagtctgatttcaccactgatatgatattgatcaagctttttgaataaggttgctggcattgtcaccacagaacaaataacgtaggggctgacaggattaaattcactaaatgttgtcaatgcaattcctgacagctgtataattgaataacatctggataccagactatactcttgtctttcttgttgaggtgtgtttgccatatagctcatccttttaccagtagtccaatcatgtacatcaactcagcgaatttattgcttctgcctgggacacagtgatttccaaatgtaccatttttataattgttttctaggcctgaaggcatgacgaggcgccggcaatgcctttctagtagcttattactttttccttgtaggattcactgtttctgactgggttagcactttctgtctaacactttactgtatcatacagtatgctaggtctcaagccatattggagccaacaagaaaaaaaagaaaagaaaaaaaaaacgatgaaatgcagctaaacagttttactgactgacatcttcttgtctcttttcattcacagagtgtgaacccctggagttttacaatcatttgaaattcaaaggcaaatgctgagagcacaccatcatgagaattggcaccaatgaaaaagtttgtcaaaatcactctggcactaaaccactgaatgttttcaacacaaatggaaagctgacatcatttatagacaactcatggaccaacacaaaggaaaaaatgtcagatccagtgaatttcttttcttgtaattactgtatgatttcaacattggcgtctgtaagaaatactattttcctctgaagtgttttctgtagcattattttgtttaccatgggaggtttgtcttctcccattttccttagaagttgaacacacattttcaaagcctgctagtgattttgaatttcaaaagcgattacaagcatgattcatgcaatatgactcatccctctcaaatgctctaattgtataaactatatccttcaaagcgtcttatggacacattaaatattagtaaacacattttcaagtgccaaaaggtatggttccttcacacttgctgataagactgtaattgatcctctaatttccatgtatgattcaaaataaagctaagactgtggtaagtctcgcatttttaacattaaacttgaacacaccagttctgccactgcagtagccacatcttgattcttaacagcagtcaccttcacctccataatttcccttttgttgcttcaaattatttgttgtactaagcacactttctctaccaataaattcatgcctcttattacagtgtaagtttccatctcttagtaatttgaagaataaacggtcattttccaaaccatctaaagaagacctcttcaagtcactatcatattatattactcacttttattttgctcaggacagtgtaccgacagtcttccatcattaaacttaaaatttcatcagggcaggaccctttttttaaaaaaaaaaaagttgatttaactttatttttaaattcataagaaataattgaatatatttatagtatacagcatgatattttgatatatgtatatgttttggaattgttaattcaagctatttaacatgtgcattatctcatagaagtatctatttttgtggtgagaacacttaaaatttactctctaagcaattctcaaatatacaatatattgtcattaactgtagtcaacaagatgtgcaatcgttttttggaatgtatttattgtgtgtaactgaatatttgtgttgtttgattaatatcctcccattccttccatcccctagcctttaatgactactattttactttctgtttctatgagtttgattttttttacattccatatgtaaatgagattatgcaatatttgtttttctgtgcctggcttctttcacttagcataatgtcttcctggttgatccatgttttttcatatgacagaacttccttcttttttaaggcagaatagaattgtattgtttacacacacacacacacacacacacacacacacacacacacacacagtctttaaccattcatctgttgatagacacttagttgattccattccctggctattgtgaacaatgctgcaatgaacatgggaatgaagatatctctttgacattctgatttcatatgaaacagaactcttttgtatcatgttcaaaactgtatctgccttcttttctctgcccaggatgtaaaaaaagtggctgatacttagatgatacttggagaatatttgttaaatgaataaataaataatgaatccactgttgagaatgagattagtcaactaaagtcttatccacagacaatgttctgagttgagactgattgtggttaggggccatggaaggtgattttacttcaccattcttaacagcatagccatatgaaaggcaacattcaaataaacttgacatcagtatgattttggggactttctctaacattattcatccatataggagacaggagatattaaaggtaatgaccaatttttgatcagacagtcagaagtactatgagtagcccacaagagccgtatctagaaagaatataatgcaagtcccaaatatgaggcacaagtataatttaaattttttagtaatcatgtcttagtaaaaagaaagagataaaaatagttttaacacagtttagcccaatattttcaaaaatataatttcaacatgtaatcacatataatactatcaatgagatcatttacattcttgttttcacactaaatttctaaaaattagagtgtatttgtactcatatcttaattcagactagttgcatttatgtactcaatagctacatgcgtgagtggctatcacattggatagaatacagctgggatagggacttattattgggattagattttacaccattattggaactggtagagaaaaccatgcaagattttaactgcatgcttattgttgagcttgatgtctctaaagtcagccaccagactggcaactaggaagaagcatttgtgtgtgtgtgtgtgtgtgtgtgtgtgtgtgtgtgtgtgtgtgtgtagaatgaagaaaatgtgaaatacatgagaacaaactgaaacatacatatgatttctagcatagccagcctagaagccataacttgcaggagaggtcagtatcctttgccatggatgaggcattcatccatgtggttgagatgttaactctttatagttaacattatcttattggggtaaatatataactcttaaaaatttcaatattttatctgagtcgtttctccctttacacaggattttgtttccagttcttctgtccaagagattgtgtaaatttactggggagatttttatcgctcttaaccattcacgtggttgagacctcagaactgccaaaggaagagaactggtgtaaggtaaggaagataccaccccacatttacaaggtaagttaacagatcagtgacagcacgtgccagatgccagcatttgaagcctgcatcaaactttagagcataaaaatatggcatattcctttactcctacctttcaaatctcacgcaaaatgttgtctgtggccaatgcaaacctgaaaccatacagggaatgaattctgaaaaatgtagtttaattttaattaaattgagagaatataaatgcaccataggcaagcagggaagcttactcaagtatttctaggtcctgtcaaaactggaataattcgttagaaataattattattttcaaataacattattatttccaagaataatcatttttttttggaaatcagtattataacacagaggtttgaaacggatgttctagtaaaacctcttgtagtgcataatcagctttgacaatgagaaattaatgcctaacaagcgtgtatttgtaaactcctcccttccacttttcatcttctcctgtttctttaactcaaaactaaagacacaaacataaaatcatttaactgcagagatactgaagattacagagaatcacctgcagagcctgggcaggattgatgagtgctgatctcattgcacgttaaagttctaatgttacttgttaaagtaaaagtatcataggcttttagaactagaaatcccttttcaaattatcaggttgaacctctagatatggaactgggacccagaagcatgaattgagtgacccccaaactctgtgattatgcagcaattcagcaaaactaggcctctggtgttcaactaacacacaatataactgaaataaggtaagaaaagcagacaagattaccaactcaaacaaggattgctttgctggttaagcctaagccaccacggatatataataccaatttgtaattactacctaaaatactattaataacatacctggaaatgggcaaacgatgtattaagtgactgtaggcctatggcacatcctaccaaggaaaatacagatgttcaagaggtataattttatttgtgacagaattatatagaatatagcatgaacaacaggatgagtgcatgcataatagcatgaatgaatggataaccttctctccactttactttattctcatttttctttttttccttcagctttcccattgagatagatcattacacaaagatcttcaatcacccagctttgggctgaatcaggagggaaaggtataaccactgaagcacttgaggtagaagcaaagagcaggagaaggcatgtgccttgattccagtttgtttttctgctgctgtcagttggctgcatagagcagatgtggtgctgtgatatgttttggcaaaggcagggacggagaaagtgattgtcattctccctcagctcgcaggcaatagagaatggatattactgtggagcaactttacccctgagattaccactgtgagggaaaatcgccttgtaatgagcattggatggaaaactggtagtcaaatggaagttgcagccaagcctgagagagtctgaaacactgttaaaaaaaaaaaaaagtgaagtgagtagtactatctgtatcaatggggagatatcctagatcttccaaaacaattgacagcctaggctgagagaacaggatacgagttacaatagtctttggcttgtcttcagtggaagcaacaagggcagaaatcaatgccagctcctaaagaaaacagcgataacaatctccccagtaaatttacacaatctcttggacagaagaactggaagcaaaatcctgtgtaaagggagaaacaactcagataaaatattgaaatttttaagagttatatatttaccccaataagataatgttaactataaagaggctgtcttaaactgggagggtctgttctttcaactggacaggttacctaatttctcagtgcttcagtttcctgtaggtaaaattaagatcattgtatccatatttaagggagtttgacaataagattaggttggttccttatggaaaataaagttcctttttttctttcaccatatgggaactaaagtgaataaattcttcactgtgtgttttgagtatgatgagagagtatgattaatatgatcaaatctgcatgatgagtatgaacatgcacagttttttgtttgatccccctacaggctatggattagcaaggctgagtagagagggcggatcaagaggagtatacaaaggcaaacaaggctgagaaggccaaattcaaaagtaacgggaagtaggcaaaggcagatggtgaaaggaataggccagttgttgagcacatacatattagaatataggactgagtgcatattctattcacattgtaaattaaatattaatttattataaaaagaatagctactcactgaaatatttcaaatgtacagaacacaaataaggcaaactcaccctacaatataaatcatctcgtccctcttgtcccatggtttatatgattgactattctcataaaaagcattgcagaagaagcatttgtgccctttcatatatatatatataaagattttataggccaggtgcagtggctcatgcctgtaatcccagcactttgggaggctgaggtaggcagatcgcctgaggtcaggagtttgagaccagcctggccaacatggtgaaaccctgtctttactaaaaatacaaaaattagctggatgtggtggtgggcgcctgtaatcccagctacctgggaggctgaagcaggagaatcgtttgaacctgggaggtggaggttgcagtgagtggagattgtgccactgtactgcagcatgggggacagagtgagactctgtctcaaagaaaaaaaattataaatattacttttagtgacaaaacataaggattatataatatctcataattgacttttcatttttttcaaagagattttttatttgaagagtgatgattttttgatgtgtcaacttggctagcctactgtctttagtaattggataaacactacttttaatgtttttgtgaaggtatcttgttgatgtgattaaactccatagtcagttgatggggagagtagcctggataatcaggatgagtctgattagatcagtaaaaaggcctcaaaaacagggatgaggattgcctgatgaaaagattttttccctgtgcatagcagctttgcttatatccacagttccagtcaacccttctggatggcctaccctagagatttcagacttgcctgcctggcttgtccctaaatcacgtaagccaactccttgcaataaatcccttagtatatatttcccattggttctgcttccctgactgatacatggaggaagttgtactttatttatttatttatttatcttttttttgagacagagtcttgctctgtcactcaggctagagtgcagtggtgcgatcttagctcactgcaacctccacctctgggttcaagcaattctcctgcctcagccttctgagtacctgggattacaggcatgcccagccaatttttgtacttctagtagatacaggatttcaccatgttggtcaggctggtctcgaactcctgaccttgtgatccacccgccttggcctcccaaagtgctgggattacaggtgtgagccaccatgcccggcggaagttttactttatagaaacaacattgccactggatgtatttttgaagtaggaaataaatgaccaagagacactcttctgccttgcaaatgtatgaagtggatagaaaaaaggggaaaaagcctggaaatgtcagagaaacagaaatactgaggacttgccgccatgcttaccaaggaggataagagaacatttctggaggataagagaacagccaggtgcagtggctcacacctataatcccagcacttgagagtctgagatgggtggattacttgaggtcaggagttcgagaccagcctggccaacatagcgaaaccctgtctctactaaataatctgtaatctactcaggaggctgaggcaagagaatcgcttgaactgggaagcagaggttgcagtgagccgagatcacgccactgcgctccagcctgggtgacagaatgagattctgtctccaaaacaaaatataaacaaacaaaaatccgggagcagtggctcatgcctataatcccagcactttgggaggccaaggagggcagatcaagaggtcaagagttcaagaccatcctggccaacattgtgacatcctgactctactaaaaatacaaaaattagctgggcgtggtggcaggcgcctgtagtcccagctacttgggaggctgaggcaaaagaattgcttgaacctgggaggcagaggttgcagtgagcccagatcgcgccactgtgtccagcctggcgacagagggagaactccatttaaaaaaaaaaaaaaaaagagtgaggaagaagatgggcaaaagaaacaagttctgattgctgaatagaaacaaatatttcagatttaacgggccagggtaactaagagctgagattttccatatggtctgtaagcctataatgtattacaatcatgttgccttatatcagctcaaaagctttccacatccatttgcagctggactgcttgaattgcctctctcttctcacgctaggtacctatttctgaaacaaggcagaacattttgcccctgaaaatgcaaataaacttcccccagtagaggcccccactcagaaatgataaatggaggccttgaagtgtttcctctagtgaattacatattagaattacactttctatttctgggaactttgcattctcacctattgccttgttcaacatttgccgcctctggctgcagaaactgattaggaagcaaggccaattggatatttgaaatgatactttattgacttttttttttttaataagggagacagccagcagagaaatgtgtagcagcactctatttgcctgtagttagggtcatatcttgttttctttatttcatagtagcaagctgtgaatactccatgcttccctttcaattatactcagctaaaatatattgggtgttattcattttaaaggactgagggaaaagaagcaacacctggttgcaggcactttgctcattgtttgataacccttaagtatcatcagaaagaattctccaggataaacatcaacatagatgaggacatcacggccacagagataaagtgtgatatccaaggtggcaaagacattttaactaaggcctgacctcctgttgttctaccatcttatcactttaagtaatgcatatattctctaagagtcacatttaaattaagcccattttactacataagcttttaaataatctgataaaataattatatcctgaaaactccttttatagaacaaatgccatccttattggcctcatacatctccttttccatttatcttttctttttaattttaagaaaactataaaagaatctttcctgcctcagatatcccctccattagctgtacctcctaaggtctggtaagtacaagtaaaaggaacatttgctggagctaaatgaaagtagtggccacatctctcacgtgtttgtgtaccatctacagaggagtttcctactagtaaggacagtttgatcactcctagacatggagtacttaaaccaaatacactttgtatatacataactcctctcctcctcctatacttacaacccgaggtagtcattacgatatctaaaagaaaaataaatagaagaggagaataaaaacaacaattttaggaatgactatgtgaattgtctcctaactttatttgattaatttagcttttttataaatttctagacaatgagaacccaatctacttatatttagcaagtctgcataatcacccaaaaattatatattagaaagcgtctttctttaaaacaggaagtgttagctcaaacgagataagatgtgaacaaataatcataatggcataatacttaaatatattttatatataaataaggtaaatctaaatttcttatccatctatgcgcatgtttagatcaatatatacttgacttctttttatagctttggtatacaaattgtttaatgtaagaaagaattgaaagtactatttttccttttgatgtttttgaaatctagtttcaatttcaaatatttaatttctgttgtgtgatgaaaaataggtcccccaaagaaaaattttttttgttttttttttcaaaagtacatttcacttaaccatgtaatgctaagctcttgattgcttttttttttttttttttgtctttgttctttatctgactgtgagctggtgaaaagagaacagtcagggaataaagacttctttgataccagcaggactcctaagggttcttttgtttgctaatggctgggattttctcatttacatcctttcagggaagaaaccatgtagctgccatatcatatctgtgtctggataaccttttgcactagactgctctgtatggatggattaacgcatgatggctattgactcagacttctacagcattcctctgagcagaaggcagaaaccaaccttttgcatttctggtgataacatcagcaaccaggccaatttcaagaatcattagattttcattatgataagaaatataaacatcattctttcctgaagttaaattttgaattactaatagttcagaagtacagctgaaggtttaccacaactcagaaaactttctaactaaagaggaaaatataattgttaaagtttaaagccctttaagaagtttaagttctttgatgaagtgtaacttgcacataataaacaattggtatgtcacattattattcttctttcatgaaagcaagttctaatgaactttaaggtacaggaatattttagtctaattttacaatggatttgtgtttgaatgtggtaatgcataatttcattaaatattttaaattctgattattttcatttagcccattacttcagtttctaaagaaaaaaaatgaaatatcttgtaacagaaatgtagtgaatttgaatctctagtctcaaatctcacacattggaaggccccaatctgctgtacacttcacagtgctatatgaaaaacttcttgaatgaaatatggaaactcaatttttagacttgttatagagagtcagaatatagctacactaacaaatggatagtactgagttttacaaaatggaatttattcaggaacatactattggatactaagcttgtcactgctctacaaaaaaaaaaaaaaaaaaaaaaatataagaagaagacagagtgtattgaccctgcttactgatatctttgccattgttaagccctggaaggccttaatgccaggtatgcaacattgtgtagtatctaagagtactacctcttcagtcagaatcatgaggttttaatcacaaatttctaactttctatgtgacctcaggaaggttataaaccttttctaagcctcagtgactacaccagtgaaataatactataaatctcatggaaggagctgctgtgaagatacaatgaggaaataaatttaaatccttagcacaatacctggcacacagtaattgcttaaaatggttagcttgtattattaacactgctaaccaagtgataaaaattacatcagttgcagataaagccaatttcttgtttcagatatatctaaatccattttaagacagactaaacttggttataataacatattattatattaatgatacttattatgtagcaatagataactgaaccagaaaatttttatcaaaagtgaggctccaatataataaaaattttaaaacatgtagcactggctttagtactgggtaatgggaaaaggttagaaaaatggcaaagaggctgtgggtgaaggttgaaagaatgtcaaacaaaatgttagtggaggctcgaaaggaagcaaataaattattattggaggctgaaaaaaatggtgacctgtgttttttgatagcaaaatagttggaaaatttatctcctaggttacttggaaaacataaaatatacttaatgaacttatgaatctaaggatgtgtctaggatagatattataaatgtgcttctttttgctgtatgtaacaaggtacaggaagagaaagatgaagaaaggtagaaattttcagtttataagtagtattaataaaaaaaatagaaggcacagaactcttttggtttggaaaaataaaaaataaaaaccttaatattctctagtgtctccagctagccaaagattctcaaagtaagaaatggcctcacaataagaattaaatctagtgtagttgtatgatcctctgctaatattaggttggtgcaaaagtaattgtggcttttgacattaaaagtattggcaaaaaccacagtaacttttgcaccaacataatactttagaaagatttatggaggtacctagcagatcccatcagctacacaaaaaggtttctaagaatcgtacatgtgttgtccctctaaccctctaccaaattcgacagaataatctatttttaaaaaatcatagatctgacatttggggcatgatataaacacaaattacacactctcaatgtttttaaggtagtaacataacgaacaaaaagccagaggtagttcaaaatgaaaaaatatctctatgcatgcaattttctatgacaatgaagcagcctgagaaggtcaagtagatactctgctcaaacactggtcatttcttaaagaaaagaaatggtatctctcagcgtagagccatgagtgaagtcaacaacaacgaagatgctgagaattccatgtccaaggaacagaagcagactaaccaaggatcattttctgtccatggattggggagtactgagaaaatataccaaactattttcagaattgttatggactggtgattgacttcgaagtttcgaatttttgaatgggagcttctattactgttatcctgtatgtgtctcaccattatatgcttggagcatgaaggtatataactcagtttttcagtttgtgggtccctggaacaataagaagccactaaaggaactgcaggcaagaaacttctctgtatctatctatctatgtatctatctatctatctatctagccttatctatctattgccttatctatatgtatagccatatatatgtatataatcagtgatatatatatatcagtgatgtatatatcagtgagaactatacagataacaagaccacgaacttgaagacgaatgctaggaacttgtaagatgttgggggtgcagagagagtatgaccatattttacagacagaggagggacatgcatcagtggagtcacagaacacaccaggattaagtgttacattaatgggctgcaatgactcacttctgtcatctacacattaagacatcaagataatgctttttcaaattgactctggacttgcccatgtgacatattttggtcaaagggacaccaatacacatgatgcaagcaaaaacgtgataagtgattatacatctaggcttgtcagttggcattttgtgaagaaaaggtcacactatttgtactatatgtgaaagaccacatagagaaagatctccagttatcccaaccaggtcccatctttaaccagactgccagctgaatgcaactgcatgagtttaccttggggaggttagcaaaagaaagtttcaatccataacatcaagaaaaacatatgcttttggagcctctaaattttgaaagtggttatttagcaatagataatgcaattactaatgccataaatttttaatatgtattcaaggtgcacaacatgatgatttcatatacacatacattgtttaatgattgccacacccaaattaattatggtatctatcaccactcatgctgtatcttagctccctagaatttgttcaccttataactgaaagtatgtgccctttgatcaacatatccccttttcctccacctccaagaccacctgtatgagtccatttcatgctgctgataaagacatacccgagactgggaagaaaaagaggtttaattggacttaaagttccacatggctggggaggcctcagaatcatggccagaggtgaaagtacttcttacatggtggcggcaagagaaaatgaggaagatgcaaaagagaaaacccctgataaaaccatcagatctcttgagtcttattcactaccatgggaacagtatgaggaaaacctcctccatgattcaaattatctcccaccaggtccctcctacaacatgtgggaattatgggagtataaatcaaaatgagatttggatggggacacagagccaaaccatatcattcttccccctgcccctccaaatcccatgtccttgaatttcaaaaccaataatgccttcccatcagtcccccaaagtcttaactcatttcagcattaacccaaaagtccacagttgaaagtttcatctgagacaaggcaagtcccttccacctatgagcctgtaaaatcgaaagcaagctaattacttcctagatacaatggaggtacagatattaggtaaatatagccattccaaatgggagaaattgtccaaaacaaaggggctacaggcaccatgcaagtttgaaatccagcagggcaatcaaatattaaaggtccaaaatgatctcctttgactgcaggtttcatatccaggtcatgctgatgtaagaaatgggttcccatggtcttgggcagctctgcccctgtggctttgcagggtacagtctccctcctggctgcttttatgggctggcattgagtgtctgtggcttttcaaggctcgcgttgtaagctgtagttggatctacgattctggggtctggaggatggtggctctcttctcacagctccactaggcagtccccagtagggactctgtgtgagggctccaaccccacatttcccttctgcactgccctagcaaaggttctgcatgagagccctgctcctgcagcaaacttctgcctggacatccaggcatttccatacatcttctgaaatctaggcagaggttccctaaccccaattcttgacttctgtgtacctgcaggctcaacaccatgtggaagctgccagggcttggggtttgcaccctttgaagccacagcccaagctctatgttggcccctttcagccaaggctggagtggctgagatgcagggcaccatgtccctagactgcacacagcacagggaccctggccctgaccatgaaaccattttttcctcctagatctctgggtctgtgatgggagaggctgccgcaaaggtctcttgataccctggagacatttttcccattgccttggggattaactaacattcagcactgtgtcacttatgtaaatacctgcagctggcttgaatatttcctcagaaaatggaattttcttttctaccacattgtcaggctgcaaattttctcaacttttatgctctgcttcccttttaatactgaatgtttttaacagcacccaagtaacctcttgaatgctttgctgcttagaaatttcttctgccaggtaccctgaatcatctctctcaaagttccacaaatctcttggtcaggggcacaatgctgccagtttctttgataaaacataacaagagtcacctttgcttcatgtcccaacaagtttctcatctccatttgaggccacctcaaccagcattttggtcaaagccactcaacaaggctctagggagttgcaaactttcccacatcttcctgtcttcttttgggccctccaaactgttccaacctctgcctgttatccagttccaaagtcacttccacattttcaggtatcttttcagcaatgccccactctagtggtaccaatttactgtattagtctgttctcatgctgctgataaagacgtacccaagactgggaaggaaaaaaaaagattaattggacttacagttccacatggctggggaggcctcagtatcatgatcgggcgcaaaagtgctttttacatggcagtggcaagagaaaatgagggaaaagcaaaaagggagacccctgataaaaccatcagatctcatgagacttactcattaccacaagaacagtattggggaaaccactcctgtgattcaaattatcccactggtccctcccacaacacatggtaattacgggaatacaattccaaatgagatttgggtgggggcacagagccaaaccatatcaccatggtaaccactgttctactctttgtttctataagtttgactttttagattccacatgtaagtgagattatacagtatttgtccttctgtgtctggcttatttcctttagcataatatcctccaaattcatcaatgttgtcacaattggcagaatttcattctgtattatggctgaataatattccagcatcctacctcacacatgcatgtcattggttgcaaagggtctagaattaaaaaaaaaaaaaaggaaaattcaagttctaaagaaaaaaacaacagagaggaaaagggaaaaatcacatttttttttgttactaatgaattggaaaaccacaagtaagccttataatctcttctctttttgtttttatagtattttttccttagggataataaaacttattttactcacttaacacttttccagtttcagaatggaacaaaattacatgtatgaaccactctgaaaatataaaacactttcaaatttaatatgcttgtaaaagtatatagtaggaattctattattggaaacacattttaaacactgaatctagtacactgtttctctaaggatgtctggaaagccaataaggattatatcttgttggaaatgtaggacacttcttaattgataatgtggataatattttcaaaatatttccaatagtcaacaatttgagaaattattagttttttgtttcaaatacggtgaaaaagaatcttgatctatatttttgtaattttaaaactttcaacaagtcaaagcatttatattttcatacttcaaattgtgataaaaatcagtacgttcataattagtgggaatttatatcactcattctaaaagttaagaatcataacataataggatccgtaatactttagtttccaggtaaaatccatgacatgtcaagagatcacatatatttagctggaaaaatatggtgagctctttcaaatacaggctgttgataatcctttcaaataatctctttgaaaaaggttgatttacgactacaaaatctagataccctcttttgctgtttatcacaatatctgatctttcctacttgaatagtactaggtccttctattcctaatgagcacaggaaaaatcttggaggaggtcttgggtatgctgagatgtaagagaattcttgtccctgctccctggtgggtgggtgggcattaacctcttctggtttcctgcaacacatttcttagaaatggcaaagattcttattcctcttcagtcttctctctcttattaatagtcttgatctgtgttccttccctttcaataatcatcatccaaataaataagatcaatattctgtttttcctctcagttgtacaatagcttagtaagtgactaaagaaaaaggacaaggctggtagaagcagtgatgacaaaaacaaaaatgtagaatatttctggagcctcaagaagactgttggcttagagagaagcactattatgaatctttagccacatccactccaccctactgactacacaagttgtataatttttttatccttttattcctcattttaaatgccattttatcaacagttatttccacatatactcagcaggagatcctagttcagtcagtatttcaaagagattgaagtcaatgaccgctcctcaaaaatattgataaattatcttgctaaataaacaagtcatgggacacgattgcacatgtttcctacttgaatcaaaataaagcatgtgcaatgggggaacaatgaattcatagctctaaaataaagtcacgcattataaacgttgactaaaacaaaatgttattttctttgccttgggtaagtaattttactagggactaaatgaaaccagaccacattctttggaatgctttgtagtaattagcattacaagaaaaaaatattttgatttattacagtgaggaaaataatagctagcatttatgttgcaggggccatttgaagcactttacatgcatcatgtcaatcaatcctcatgaaaaccccagaaggtagatattatatttcctaactcaacagataaaagaaatgaggctcagaaaagttaaaatccttgtgcaacttggaaggtagagctcagaatcaagtacatgctgccagatcctaaatgcttggtttttaacccacagaatgatcatgggagtggttgtctcatatatgcactaacaaaaaaatctaaattatcacaataagtgagttttattaacattttaaattgtattgcatatttacaacaaaagtaatagtaagtgaatagcctatttctaaaattttggtatcagattccattttaattttataccatatttaattattatatatgtaaatccttctataaaacctgaaaagctgtttattgtcatagaaaaagtaaaattctgaatgagtattatttgcacttctgtttgcctattatacacatatacaaacatatattcacatacaaattgttttaaaaattgtctaaaataaagctgcatatttggggaagccacaatgttagactgtagaaatacacatgtattcaaaagaagactgcaatattgataaacataatgcaaataagtattaaatgtgtctatgaatatttagtaagatgttccaggaaatgttattttgaaggaaaatatatggcacaacttaattaaagccaagcaaagaaaatcaccctttcccattagaaatctggaacagaatttgagttcctgcttccactacattggtcttttgacacctgctatattaaaataacccactgagattacaataatccctatagtgcccacaacccacacctccccaatgcccctctttccttgccttctcttttacacgatttatggactatttccaccactagacataaatctccttttctgatacaatgttagattactttttatttacatgcctcttcataccagaggaaatgctatgtaagagcaagattcaatttttaatggggaaatagatgctttaatctgaggattattttttaaaggttataaaggtagaggagatgaattaaataaaaaaagaactcataaatgctttttaaaatagcctatgtagtagaatgaatagtcacagcatgccaaaattaattttcagtatgtgcatgcttcagtgattaaaaggttttagaagcattaaaattctcctaatctcaatagccaggtggcagcaatagaatgagtgagtagccactcaagggtcttatggtggaaactatttaccaatcagtatagaagcattttaatatcttaacaaatggcatgactacaccaatcctaccagtgtactatcagctctaaatgcataatgtgctttctgaatcactaagagccttctaaacaactgtagttagtagtgaattgccgaaaggataatttcatctagttaatcttttattgactgtttggcttttaaataacatgcaaaggaaatattacaaatatcaagacatttgaattacaatgagcattacattaattatagcatgtttgtacaatttataccaggttgattttaacatattatatattcaatatccaaaagaatatgttcaatacagtcccatttgagaaacagcaatactgcttaaagccagaatgaaaattatcaacagaattaatggtgaaacttctaactttctctcttatctagtatttgtttacaaattaaaaaaaaaactacaaacttgcaataatttaaaactatgaaaaactcatgatttttcactctacagacatgtcagatttgatgaggctttgctcaaattaaaaacatataagtaattatttattgcagtatctctgttaggctctatatggacaaaaattcagttggaaaaagtaaatgcaaacactcaaatctaaagtccaaagcaagttctgaagtaagaagatgtatcagaacgtagcgcatgactcattgagtaatgaaaggtacatagattaggaaagttggctagtgttcaacgatacagaaatagaacatcagaagccaaaagcatgaatggaaatcaagtgtcagaaaccacttaaaaacattaatcagaggatttccaggaaaaatgttgagttgagatgaactttctaaccttcctcacttcattaacacacttctggaaaatcccaagagagtataaagatataaaaagggactattcatgactaaacttcaaaaatttcacttgaaaactggattatgtgggatgagattggaagaggatagaaggaactatactgtcaataattatacctataatttcaacaagaataaggtaaatattgattctgaaaagaaggaaaaatatcaaagatggaacaaaaatgattctgatgttgacaaaaagaaggcagacagaaataaacacaataaaaataggatgatgatataagaaaagtgtaaaatgcaggacaaaaaccatagaattaaaatattcattagcaggcctggcgcggtggctcactcctgtaatcccagcactttgggaggctgaggtgggcaaatcatgaggtcaggagatcaagaccatcctggctaacacggtgaaaccacatctctactaaaaatacaaaaaattagctgagcgtggtggtgggggcctgtagtcccagctactcgggaggctgaggcaggagaatggtgtgaacccgggaggcggagcttgcagtgagccaaggtcacaccactgcactatagcctgggtgacaaagcgagagtccatcacacacacacacacacacaaatatatatatatatatataatatatatatattatatatatattcattagcaataaaatgagtcacctttgcagacagtagaatctatgagttagtagacaagtttgataacgttagtatttagaggttgtattagtcaaggttctctaaagggacaaaaataataggatagatgtatatatgaatgggagtttattaggagtattgactcacacgatcacaagatgaagtcccacaataggccgtctgcaagctgtggagcaagggagccagtccgagtcccaaaacctcaaaagtagggaagcagacagtgcagccttcagtctgtggctgaaggcccaagagcccctggcaaaccattcgtgtaagtccaagagtccaaaggctgaagaacttggagtctgatgttcgagagcaggaagcatgcagcatgggagaaagatgaaggccagaaaattcagttaagtctccacattccactttcttctgcctgctttattctagccacactggcaacaccctcagagacacactcaggaacaatacttggttgacactcaatattagccatcacagagatgaatgtcagaaatgaaaactctaaaagagatgatttgataacataggaaacagaaatctaatatatggtgatgcgaatttctgaagagagggaataaatgctaagcaataaacaaagatgtagtaacaagaaacattcttgagcagaacaaagatttgttttgtaaaaaaggaatcatcatctaccctgacacatcagaaaaggacatcaatgacaatgaagcagagtccttacagtctgacaggtttcagtggtgaccaaaatcctagggactcagggggaaattaaaacacattaaataaaataagaggattaaaacaaataattcaagagctatagtgtcatagtgtaaaaggtctagtagtcagcccatggaatgtgcaaaacacaattatgatttaaacttcttttaaaaattttgtctcattaaaaaatttcatgtgaaacaataaaaacttttacacaagttccaattatcacagatttaacaacaaaaatgaagtgataaaaatgtaaataggccggacatggtggctcacgcctgtaatcccagcactttgggaggctgaggcggggagatcacgaggtcaggagatcgagaccatcctggctaacacagtgaaaccctgtctctactaaaaatacaaaaaaaattagctgggtgtggtggtatgtgcctgtagtcccagctactcgggaggctgaggcaggagaatcgcttgaactgggaggcggaggttgcaatgagctgagatcatgccactgcactccagcctgggttacagagcgaggctccaactcaaaaacagaaaaagtaaacatttattgacagtaagtcggtgtgttttctattacaatgtttagaatttaaatctaaatttgtaaaaccttaaagatagtgaatataaatacttccaacaggatttatacttccagaatttatagaggatgaaaaaggaaaataatctgaatctaccctttaaaacaatttttcaaaactaaggataacaaccaaaaagactccttgataaagaacaatttaattctttatgaaaatgaacttagatgagtcaaataccaccagaaaaaaagacgcattatttccttccagtaatatcctgaaagatgattgcttgctaaagactattggcaatctttaaagttttaataagtaatgccaaataatctgtcacaaaatttgtatcaacatgcatttcttttggcaatattttgaagtaactgttctttctgccccatcaaagctcaaacactcttcaggttctaatattgttacttgcaactgtctctcttaatttgcaatgtgtcaatggctattgatgtaaatattttaagagattcactggacagtgggatttatctttttctttgtgaataaactgtaaatattattttcttatattttaaatggagaatttactcaggtttgtaagcacaatgttaatatcttatgtagaacatacatttacagatattataatttttctgttatttatatagcaaaatatctatttctacatttgccatttattttaactattgtttgtttacatgccaaatatttgtgtttttaaaataattttgtgtagctaagtgtactatgcattaatttttcttttttcattaagaatggacttccaaatgctttcacaaattttagatcaaataaatattttcctttagctgtcctgtggctttatgtctttatttcattatttaatctacacaaggtttattttactataacatctgaggtggaatttaactttcttttctaagtagatcatgattatcctagggctgtttattagttatttcctaatttttccacatggctaaaaatacacattgttctactgaaatcactggaacaattatcaaagactgtagatgatgggttactcggggagtgagatatattagagagtcccaaggtttatttagtcctaggatcgcttttcagggcttctctgtgtcagtgatgacatgcagtcacatggtttaaaatgtcacctatgtctgatgacacccaaatgaacgtctccagtcaataatgaacaccatgtgatctctaactatatctttgtgtgtgcgtgtgtgtgacagagagagagcgcgcacaatatgtgcatgtaaatgtaaattaatatagtgaattatacttataagaagtaaatttagagatatgactgtctgcctacttgacacgtcttcctgaatgtctatcttctctcccttcttgtccatagcagttcagcatctcaaatctttcaggcccctaaccctaacatgattgtcaactcctctttcttctatgcctcgcatctcatttcttcgcaaatcaaaacactttttaaagatattaagaatctgatctttgttcacctcctctacagcaactgtcctggtgcaaaccaccattaacttgggcctagaattttgtattctgctcctaatcagcctctctacttctatccttgcgctttccacctggctctgcagtgactttcacatacaggaagcacagtgaaactttaaaaactgcagggccttcatatttaccattcccttcttctgaagcaattccctcaagttgttacgtaggtaactcttttacttcaaatccttgctcaattttcattatatcagagaggttagtctaatcatctcaaacaaaataacaactccaagcttattctatttccctgttaattttcctgttttcctcacagcatttaccattggactattatatgtctattttattacctagtatctttctccttccactagattatgaggttcatgacaataccaagttagttttgttcacgttgccatctgttagagcagaaattggcacaaaatagaagttcaatatattttttgaataattgaataaataattgaatagatgaaaaaaagctggactaattaagatctgttttattcaaatttaatccagtttttcctaaaagctgttcagtttttgcaaagaaggatcattaatatatgttttatagtcatagaccccagtgttattcctcattatatgctgaaagactgcattaggatcttctttaagacttaccgatttaattcttttaggctttttctgatttataaacagcatttatagaaattatgtttcaataatgatatgtttggaaatgctgattctttttagcaccagttgtgccatgatttcatgggagtttgtaatgtgcaaggtttcttccttgctgggttctaattgcctattacaccatacaacatggttctactaattgtactaagtaagagtgatctacccgtgacacatttgatattttataactgtgttttaactcccagtagaacagcacacagggaataagaaagaaatatctctcgggacaatcacaatcaatggtaatctgatgttttaaagttgaaaaatagctgaaaaactgcagcagaaataatgtctcttgggaggaatggcttcaaacttcagctacagagagagaacaataattccaaggagccaatatagattgtaatctattcagtatttaaaactcatattttctaaacaagatcattgtcacatgcatttattattttaaatgggctctctcaagaaagcattgaatttatatttatgaagacatttatagctcactaaatgccaagtaaagattattaaaaaaatctttatcgaagtctaacagcaatgaaagacattttccattagtagtataattagctcataaatatgtaagcaataaatgcatagttttttttactcttaatatattaatattgtatatgatatcggccatggagctgtaaataatgttgacaaattaaatcaccattccctgtgtaccgaatatcaattttattgaaggaggagatatttctaaaacagtattttaaaaattctcccaccacaaatcttcaaatgtctctccttggggctcttagtttagattataattctccatatttgtagtgaagggtgataataatctatgctatgcaaaagtcaacatagagctaagatttgtaattttcatttatacgtcagttaatttctaatatcaatagggctgttttgttttatgctatatatgtggcttgtttgtctcttaaaatttaataatgtcttattaaatgaactaataaaaataattaacttataaaggaggagatggattacttaaatgttaaataaagacttacactgcagatgttcagatcataatagttttatatgttccttactttgcgagctgtaagcaaaggaccagaatatctgaggctgaaactataatacaatcaagatttcaagattttttaatataaaagtatgcttagtatacctttattattgataattaaatactggaaaaaaccataaaggttctgttatggcaaataattatattaatattttaatcttaaaatagcatataataagatttttaaagtaaagatttcaaagcattttcaaaatttggaaaattttcattatagaatccatttcaaattgtttaattttaataaactacagaaaagatatgcagaacttagtgaaatattataaggtaaacatccttgtcaccacaacccaagctgtgaaacagaattttgccagctttctagaagtcttgcccaagtgtctcaattcaatcacaacttcttccttctctgcaagattaaattgctcttttgacatttattgcaatccttttcttctacgtttttctagttttaatatcaatatgcacattcctagacataaatagtttaatcttgctcaatttttaaaaacatgatgcctttcaagcttctgttcaatctgcagattttctctccgtcttctattttcttactatttatgggtggaagctctggggaaatctggatttctcacagtctggagtttgttgatttcataatcatggtgcagtgttacgtattcctttgtctcctgtatttcctgaaaataggcaactaaatccagaggcttgtttagattgaggtttgatcactttggtcgggctgtagatgttttccttctgcaggaagtgtatcacgtctgcctgtttatcttttggtgatgtttgcaatcactgaaatttagtgcctgtattcagtaatcttttgagggttgcaaaattatgacattctaattctaatattcttttcacttattcttagaaattattctataaagagaagatttcatttatctaccattagtttacccagtgttacagttcatatataaaacccaggataaaggcaagatatttcacattatttactagttctcaagaaaatgaattggtttcctctcattctccaaatgtgattaactaggcttttaaaaaataatcttttatttttattattttttttcttaattattgttttttattatactttaagttctagggtacatgcgcacaatgtgcaggtttgttacatatgtatacatgtgccatgttggtgtgctgcacccattaactcgtcatttacattagatatatctcctaatgctatccctccccttccccccaccccggtgtgtgatgtccagattcacacatagttctaagaaaaacaaacaaacaaacaaacaaacaaaaaaccagaagaatcctgtatatatttactcaagttcccccgatgataatatcttgcaaaactacagataacattataacctggctattgacattggtataatcaagaaacagcatgtccatcactacgaaggtccgtcctcccttttacagccacagttacttttctcacattccccacaccttcataacctcaggcaacactaacagtttatcatttctataattttatttcattttttaaattaaaatagtgttttgcttttcttttaacataaacccaagaaacaaaaatgatgtaagctgttataattttgttatttcaataattttataaatatcaaattatacaatcagtaactttttggaattgacttttttcactcagcataattctctggacatctaggctgttgcatgcatcaatagtcccttttatttctaagtacactttaggttatgagtgcaccacaatttgtttagtaatttacctgttggagagcatgtgagttgattttcattttttaaaatgttccctagctactaaatacgtaccacaatggcatctaacaaccatcaggggctttttgaaactttgtcctcttagagttagattctattaagctctgaggagcagcctaatggttttcagattccagacttcaaccatacctctctagagtgttacagtgtcttactctccaagaatttgtttggatctttaattaattaagacatattattcccacagtgatgtggatgttactacataaaagctaaagaatacaaattgataacttatgcatatgcatgagtagtaatggtttacctgcttgcagacataatgtagaccacaaaacagaaacaccaggggaaagcattatggtggaatgagggacaaaactgagaaaaaataatgaaggtaatactgtcattatgggagaagataaaaaataaaataattgcaaaataaattttatttaattggatatagcatttctggctttatccacatttctacatagatattttacaatttcatggactagagtattattatcctagtttagggtatttcttccccctcaggcttgtcttcaaactctagaacattattaatttttctggcaaacaaggctgtcttagaaattctactttaaggatcttgctcagatatctcatcctttacagaactattgttgaccagcccagtaaaagaggatttctatcaacccataggcttcctacaatccttatcatcatttacttcttgacattctctaaatgtttcagtttttctttttgcatgaacatgtcaaatctcttaaaatattacgtattctgtggaatattgatgctatttctttgtagtctcctaagcactcaatatagagactttcaaagagtacctattttggccttagttagcttggctcttggctagtaagctggatattgctgaatatctgagagaaagaagagtcttttccagtttactcaatagtagtaactgaagcaaaaatgtggtgagacatttttcatacataagcgtcccaacccaacttagggatttcttaaatcaatctgctgatcaagaaagacatatagattatttattaacctaaggttgtgagggaattctctgaaaggaagtgattgacccctacttaattccatagaaattggagatgactcagatgcctagcatgctagggattcgtctaccaattgtttagcaattccctagctgtcccctcaaagggatggaactgtagaatcaatttttccatttccctctcacccaaattatgctgtgcaggcaactggacggggttccactgctaggctgtaatcatttagttcaccagaagtataaatgcactaatattttatccattatatatgtctatatacagagagagaatatgggcttcacggatcctggttttccaacaaagaccaattaaatcatccaattaaaagggagttaaaataacttttacaaaccatgttaaatacaaagttcacactagtgatcaaagaatatggccccctattatcttttggtgagtcttaaatttataaggcactcagtcaccacaatctctgtgggtcactatagttctctctgtaaccattgcttaatcctgccatgcacataattgcaagcattatacagctcctacatgttttgtctctaaattcttgaaatattacttgcaaacataaaaaaatgcttatgtccaggtacttcctttgttgctgttttattaccaaagaaaagcctcacatttcacttaacacattgtgtctcatgcaaataggatgcacaaatatccattaaaaatgtagactctaatataagaagaaatatttaaaatgtgtcttaaagaggcaatttggatagctctatatactccccattagacacattttatttgtttggttgtttgtttgcttatttgttttcagcttggaacatcaaccaccagagtttatctttgcatgcaaatgataatagattgcaagtgctctctcagtgttaatctcacaatttaaattggtttcatattaatgcacttggtaggaagtacacatttatctctggttttctcacttgaggattctaggagtgaagtgtttctggaggagtccagtgaccagtaaaattcttaaggagcacaagctcacacactttgctgaagttacacagagccttgtgttccttgaataacctatataattatagtaagcagactttctccccagtgatgtgcccatctgtttcttttgtagacttcttttcttcctaaatatttattgatgaatatctactatatttccaaggaaaatctttacaggcttttgagtagaaaaattgcaaggactaattcaacatccttactatggttttcatttattctttacaaatcatttaaaaagagtcaaggccatggtttaatcaccatattgcattaaaaattcagcatttgaaatttgcctaatagattactatttgctgtgaacagtcaggcacagctttgctattagaattcacttgaccttaggcatgttaagctaactgcagtcctaaaatagaatctgctttgtttcgatttgttttgtttttcacaagttagcattaccttttaatgactaaatttattttagaaaaattataaagtactgttcagagtctatgaagtaatattttagcattgtgtatgtcacatgcccaatactgactagatacaaaattctgtatccccttcagttgaatttattctattagtttccctagcacctgtatgacatagtaagatttaaactatgtatggatagaactaaacaactagcataacaacttcttgtcccctagttttagtctccttctgccattttgcaaagccagatttcaagaaattatcctagaaattcaattaagaggttttgtgcttactcaagttatcctgcaacacaatattgataggggaatcagttggagagtttcttctttcttacactactgctcatggatctaaccatctaatgttgcattttatttctttgcacacttgactctcagacaaaaaatgtatgagtttagagaccaaattacacttgtggcattgctcttattatatagtgggtttttaaaaatctgtaaaataagccacacagcaattgcaatactaaaggtccagtaaaagtcaacagacctctaaaaacccccttcagttcataagaaaatggaacaaggctaaccatatttacaatataaaaatgagtggaattaatttaaaaaataaattgatcaagggaagtaattaatttataaaatgataagaaaaaataagatattacatacctaagttttaacagatctgtcatcttataaaaagaggatcacagaatagcttctaaggatgaaaaagtaggggcagcttaattttctcttagatacaggctgtaagtctgagtcggggacatatggtgaaatgagtccaaaacatctttcaaatgtttttaaaattgtaagtctttttttttttttaaatgaaggcaaatcagatgataatatgaacagagatacaggtatatttgttttaatcaagctctgtttaaaaaagttagtgtcagttccctcagagtcaatgacatagatatctcttactaatctgtcatcataaatatttcgttcaattttagaggacacatttaggactagcagtaagaagcaattttaaagttaagtgatgtttggatttatgtaaaacaaacacctccccaatctatcttccatttgttaggaaattatcttattttacaatgatgaaaaaagtataatttttataccatatcaaatattaataatgtaataccatcttgtgtttatttgtatacacagattagatccttacattagaatgttcccttttttcatgttagtcatttctaagaaatattatttgattctttaaatttttgtctttttctttatataaaaccaaaaatgattaacaaaataattaggacaacattgcactcacaagggagattatctttaaactattttaatagaataatattgcaaaaggaaacttagtaattttctcattagttaatattaataaaatatttttaaaataattattttcttagctgttaattacttaaaattacaataaactgtctttataatcaaaagtatgaggatgtatttgttacatattggctaaatcaaattatcttgatgtatgttgtagcattataagacaggtgggtaggcagcaaagtataataaaaactgtcacctgattaatgctaccatggatttcattgtagtccaaatccatgaatccatataaaactattgagattttccatgtttttccatttaaatactaattaaaatataattgttcttcccttaacaagacacatatattgaacctccttatgttctacaacatatatatatataaaatcatgatgtatgcaaattacagctcatcatttgctaaatgcttgcagagattttgacaaatggtgcacacgaaataactaaaaataaacagctcttgtttaatctactgaaacaaaatgaagcttgaataaggtcatatcatatgaagctgaaagagattgtcaaattgataaatttcaatgaagtctcagtaaatttagtaaagagagagagagaaacaaggtcatcaagcttgtgttttgatagccctactcataagtgctagtaaacagtaggcttctcagtagagcaaaatactgtggagcctttgcatatggcagttgcaaaggcttatttactcaaacacagagccatatacattttccaatatacaaggcagaaaaagtgacatatatattgggctgataatgggtttaggggagcaaatgaaaagagatttggaaactaaccagtccactaatgtttatagctctggagaagagaaactgctttagtccattttttccattttaagttttattttgtttttcactgatacacgataattatacatattgatggggtaaagtgtattgttttaatatatgtatacattgtgtaattatcaaattaggataaatagtatacctatcacctcaaacatttgtcatttctttatgaggacattcaaaatcctctattgtagctattttgaaatacacattattataattatagtcatcctattgtgcacagaacaacagaacttctttctcctatctaactgtacctttgtactcatcaaccaacccctccccacacccttcctccttatactttccagcttctggtaaccaatctcctgctttctacttctgttagatcaactttagattccacctatgagtgagatcaaacactatttgtcattctgtgcttgccttgcttcatttaatataatattctttgggttcatccatgttgttgtaaatgacaggatttcattctttcttatggccaaatagtattttattgtgtatatataccacatttgtaaaatccattcatttgttgattgatagacacttaggttgatttcataagtgaatagtgttgcaatagacatgggagtacaggtacctccttcaacatcttgatttcctttcctttggacatatacctactagtgagacagccagatcatacagtagttttgaaattttaaggaacctctatatggttttccatagtggctgtactaatttgcattcccaccaacaatgtataagaatttgcccttctccacatcctcatgaacatttattatttttcgtcttttttagccattctagctagagtgagatgctatctcatttgattcacatttctctgatgattagtgatgttgattactttttcatacatctgttggccctttctatgtctttttttgagaagtatctattcacatcttttacccatttttaaatcagttttctttttgctagtgaattgtttgagtttttaatattaggtcggtgcaaaaatcattgcggtttttgcttttgaaagtaatggcaaaaaccgcaatgacttttgcactgacctaatattttctgaatattgaaacaattctataatttgtatgaaaacacaaaagacccggaatggaataaagagaatcatctgaatacactttctttatgctcatattgagactaaggagatgttccaaatttaaaaaacaagaaagaacaaataaacataacaaccgaatgcaatgtgtaattcaatatttttaattaacatttttaatatgtgaggaagagtattacttgaacaattgacaaattctgaataaggcctatggttttagataatagtattatatcactcttaatttcccgatttttgagaattacactatgaatatatataagaatgtccttgttttttaagaaatatatactgacatatttaggggtaagtggacattatttttacaagctactctcaaatagttaagaaaaaatagaaagaaagaaatcaacacagcagtatgataaaatattaacactgcaaaactacagtgaaggatttatggaaattctgtgttcaatgttacacttttctgtacatatgcacaaatatgtaaacataaaaagttattttttaaaaagttattgagattatctctattataaaatttactttgatgtatgaaacatagtatctacttaatattgaatattataggtactcaaccaaactggaattataacaagagtgtagtttttgtataacacagtctagaatagaatatggggtctatttttgtacaggaataaaatagaagtttgtttttattgtatagaaaatctttatataaagtaaaattaatttcatgccattcttatgatgataagtaaattatgtgaatattgtataatttaacattactaatgaagtgtttctaaacctatattcatcaagagcatttccagtgctagaactgtgatggtgtaataaaagcacttgtaacttcaggacctaaggctcctttttacctcctcaaccaactttctgacctctcccactcttcttagacaaagtctctggaatgggccattgtggtcaaggataagactttttctgtgccacacaaagggattaaagctcaatctagagttatcagggtgaagagttgggggtgggcagatggtgggggtttcttaggctctgtctctgtttctcaatatatgctgggactcgtgagatttactcaggcctaggaaaccttctccatggtttcgttaggcctaccctgcccttggacttaggaagtaagccttaatctaactgattttctctttctttcctgttttgtcttttgtacgtatctttcattgttattgctgtataagtggatgtggttctgtggggaaaacaggctactttatctattttgattgcaggtcagaagttgcctctagtctacccattcaagtttggagttaatgttccaccaactaataactgactttcttcagcgtgcttaaattttctccactacgttcagaagtgttgtccataggagaatagaaaaagaggatttgggcattgtcttcgcaacagtattgtcctccaactataacacaacataaaatatagcaacaaagagcacttctgagaaatttctggttccctgaagggatttcctgtaatgcttacacaaacatgcctaaagatgcctaaacgaatgtcattgtgttcaatttatgtagtctactgaaactgaatttaagttataatcaacaatgacactgcaagagagaagagagagaaagagttaagcaagtgctgtcttattcaaaaggtataatatgggaacatttaatcatactagaaaattatcatataaatgtgcagattacagccaaactttatgaaggatgatgaatcgggactagtctaataatcctacaatctggcagaattcctcttgcaaatatccttcatcttaaagcaatgaaggatttctactggaataataactaacgaatgtaaagctttatatggcagataaaaaaatcaattataatgtcttacaattaaaatagcaaaatggtcatttttgcagcccataaacaggtaaaaacatttttttttttacccacatactagaatagcatacatcccaagtaatgaaatgctggtttacttattccagggtgtgcaatgctcccatatggaggatttcctcatttcctccttcatttctgtttgttttcttcctcattttcttccaaataaaaataaataaagacaaaaattataatgccttagatattctgaggaaggacctggaattatttaaatgactgctcttggtattagaatatgttacatagtgcacccaatgcagcaatacattgcagaggacctactgtccttcatacctgagtaccctgaacactttagaatataaagtatatacaattttaaaggtaatattattttaataaaattaaacatacactacttaaaataggtcaactaaagattatctgtcaaatatggtacttggaatgtttcttcaacactctgccaattacatcaaacagtccaaacattaccttctatggaagctcaaaaatgctaacttctatcctattctctctgaaaagagagatatactaaaagaggaaatccatatagctctgaaagttgacattcaaatgtttcttataataatgtatttttctaaacatatgcagatattagtcaagggtgtgtgtgtctgtgagtgtgtgtgtgtgcatgcaaaagggaggatttagtgggagtgaaaactagtttatttgattttttttggctatatatatatacacacaaacatatacaaacacacacatacacatatacacacatattacaaaatatatatatacaccatacatttatgtatatgtctcatttgtgccacctatatatagacagacatatataaatatctacacatacatatgtatagatacaggtgtataaattatgtgaatgtgtgtgtgaatatatatgcatgtaggtggcacaaatgagacctatataaacatacacagacaaatgtatacatatacatatatatgtgtatgtagataggtgtttgtgtgtatatgtgtatatgtgtgtgtgtatgtggcacaaatgagacatatatctgggtagtaggaatgctgtagttatgatcatgattggttaccaattacttactatgtgaggtacctgccttttaaatatgtgaaaataaattctctttacataaagaggtaatatggtatttttagcagaatatacaaatgaagtgagaaatgtttacccagcacaaatctagtaactctacatggagaggcagggattgaacacagaaatatgtgaatttaaagtcagcattcttactttttaaatgtttgttacaaaacttttcaaatctcacaaaaaaagtagagaaaaatctcacaacaaattcccaagtgcctatcactcagtttcaacagttgtcttttcctcattccttttatctattatttatttttattttatttatcagctgaagtactatgaaactgattccaggtatcatgtcatttcccctgcaaattcaatcattattcaccttttaaaacaaatatggagatattttatgcctaaaacaaaattggctttaattcggttaggctgtgtccccacccaaatctcatcttgaattctcatgtgttgtgggagggacccagtgggaggtaattgaatcgtgagggcaggtgtttcctgtgctactctcctgatagtgagtaagtctcacaagatggttattataaggaggagttttcctgcacaagctctctctttgcttgctgccatccatgtaagatgtgccttgctcctccttgccttccaccatgattgtgaggcttctccagccacatggaactgtaagtccaattaattttttttcttttgtaaattgctcagtcttgggtaagtgtttatcagcagcatgaaaatggacaagcacagcattttttttgctatcatctgatatccagcccataatcaaatttttctgatagtttcctgatatagttttttacacttggtttgaacaaagatccaatccatacattacatttgattgttatatctcttaagaagtacatttaatatagaacaatttccttcctttttcttttaattatattaacttgctagagaaaccaaattcactgtcttaaagaacattccacattctggatttgtacgtttgattctttttagtatcatgtaagtggttcttctcttgtattacctgtactgggagctaaaactcacatcttggtttgattgcagttcaactatttatgtgaaaacacttcataggtgttcctatgtgttttacactgcaatagaaccagctctagatgcctaaaagaatgggtacttaattttaaagtgcaggctgtttccttccaggcagatttcactcattcacactagtctgtgaactccatctctgggaacaatttttaacacacggccaaccaaagtgcaaaatgtgcaataggcagattttttttctagaaaaatagttacacatctttgggaactggaagtttagtgtcagccactatgctctatcactccactgaattgtacatttgaaaataacctgatatccagttgccacagaatcttggcagacagtctcaatgatgatgtccctggaggagcctttggcagaatgactagagtatataccattcagcagggaaacatctatgtgtctgacacatgcaccctcaatgttgcagtgcagagattcattttactcagaggaagcaattgcctcattcacactatgagaaatagtagaaaaataagattcaaaattttaaaaagcatagagaaaaaggcagaaggaggtctgtcccatagtatagtcacacatgcatgtatatctatgcccatctctaacactcacacacgcacacaatttttgtcatccagaaaaagacagaatgactttgaagagtttgaagtattcacaatgcatttatcatcaaagcaaatgaagtgactttggctggataaaagaaagggaagcagaagcctgatacttagaaatgcaactgttttgattgctaacttgttctgcatgagcatattctgctcctctctcggagcaaatgtccaataataaagatacattctgctataatttggtagttataatgcatttactggttcagaaacatgttacatctcagtttgggagtaatctttaccagaaattattgttctgggcacccctactacatcttcagacatctttagcaaagcatttgtttttgctttggtttcaaacataacattgatttaaataaggtgattgcattattaaatgaactgagccttactcagtcatttcaggcacagcttattgttgtggatattattatttctctttttttcacaggtgttcctcagcagaatccttaaggaaggtaagtgctggcacagaagttaaaagtgcaatatattagtttgccagggctgcagactgagtggcttaaataacagatatttattgttctagacttgtgaaggctaaaactctgagatctaggtttctggagtgttggttccttctgagagctgtgaggaagaagctgttctacgcccctccgtgcacttccggtggtttgctagctagcaatctttggcattcatcaggttatataaacatcaccccaatctttgcctacatcttcacatgatgttctccctgtgtgtgtgtttctgctcctaatcttgccattttataaagacaccagtcatattggattaatggtctaccctactccagtgtcacttccctttatcttaacatattacatcggcaatgactccatttccaaatcaattcacattctgagggactggggattaggattttatcatctgaattttagaaggacaaatttcaactcataacatacaataaaccaatcgtacttggaagataaactattagggtttatgaacttcagcattactgacattttgggcatacttattctttgtcaagtttggggttgaggtccaggctgtcttgtgcattgtaggacatttagcagtgaagtaacagttaactttttcaaataatgctcatttgtgtttttgttaaataaggtgattatttttatatctagatgcaaagacattttgatacaaaacatatctctcgattatctcatcttatatttctctgcatttttattttgctatgtcatgaaaataaagtcaaatgcagacaatggaagatattatgttagggaaaaaatgaagcagcatgtgcttctgcttatacacaaaataatcatgattttataatgatatatacgtatgtatgtatgaatgtatgtgtgtgcatgtgtgtgtaatggtacattcagaatggtcagctgaagtattggcgtgagaaattgtttttatgctaaatgagtcaagggaagtggacccatacatgcatttaggtgttataatgaagttttagcatgaattatttggcattaaaaagtacatgaactgccatcatagatcaacttttataaataagcaataaagtcaatttgtgttacagcttcttaatataactttcttaatcttgaaaattcaactggagaatttccatatgcatatgattaaaaccatgctggaaaagagttctaaataaaaattctattgacttgaatttttaaaaatccctattttgaatacatttacttttgaaacctttattctccagtttgaatttttcttattattatttttaatacatacacgataactatatgttttttatgggcatagtgtgatattttgatacatgcataccatatgtaattatcaattcagggtaattagcatatctatcatctcatttattgtttctttgtgttgagaacattcaaagtccattcttctagctatttcaaaatgtacaacaaattgtttatcctaaacaccctatagtgctatagaacactagaacttgtccttccaatacagctgtaatttagtatcctttaaccaacctctggctatccccatctccccactctcttatccaccctttaataaccaccactctactctctattagtagaaaatcagctttttagtttccacatactagtgagaaaatacaatattcatctttctgtgcctggcttatttcatttaatatatctgagctcatccgtgttgctgtgaatgacagtttgtttttttttgactaaataatatttcattttttatatatatatatatatatatatatatatatatatacacacacacacacaccacattttctttatccattcatctattgataggcaacttaggttcattccttatctctgctattgtgaataatgctacaataaacgtgggaatgcatatatctatttgacatattgatttcttttcctttttcttttctttttgatatatatccagtggtgagactgttggatcatttgtaattgtttgaggaacctccatactgctttctataatggctgtgctaatttacattcccaccaacagtgtataagtgttcttctgagccttgctagcattttgttattttttgtctttttaatagcagccattctagctagagtgagatggtatctcattctgattttgattggtatttctctgatgattattgatattgagtgtttttgagatacctgttgaccgtttgtttgtcttctattaggaaatgtcctctcaccttatttgcccatttttaaattaaattaatttttttgttgttgacttgcttgagtttcttatttattattaatattaaccacttgtatgatgaatagtatgcaaataatttctctcattctgcaggttgtctctttactctgtttattgttttccttgctgtgcagaagctgtttagtttgatataatcccactcgtctatttttatttttgttgcctgtgctttttgagatcttgttcatgaaatctttgcccagaccaatgttctttagtgtttcctctctctgtatatattttgcttcgtaaaattctgcttcttttagagatgatttaaaaagcagtgaaatgaccaaagttgagaaattcaatagctagaaaggcaatattcctttttctgcaacaaagaatcatctccataatatattctaatttataaacacttgtcctttggagcagaggtcagaaagagtacccaataggcttctagtctgcagatgtgttttgttagaaccaagtcttttttttttttttttttgctttgattttaattcattctaagcaatacaatcagggaattttatgtaaaaatctgggattctggcatttcttgtgaaatcagcagatctgggatccttaacctcatattcctgcatggcaaccatgagctggaggtaataggctgctaccacttttggatgggccactggccccaacattgccaattctctactcgaggcctaatgccagatgctatttataattgtagggggttttgtttgttttaatttagcccaatcccctcaactatattaccttgtaaatagcatatcggtttaccatttggacttgaagcttgaatctatggaatctaactttaaagatccacgtgtcagaatacttctataaggaattaggacaataaagataagatatcattatgaagaccaagaatctgaacctgtaacagtcggtgcattcaagcattttacagaagttattgccagtaactccttggaactcttagaaacaaactagatttctgatctaaacatatatcttgaatattgcaaaatacatccttcacctatttctttttgctagctgtgtgatcttggcattacttaacctctccaaaccactctttctacttctgtaaaacggaaaagtaattttatttatttcataggattgagtattagataagtaaatacactttaacttcttgaaattatcagccagagtaagaacttctcagatattattcatcagtactcttattacaaatattttgataattcagtcatatactctctaagtaatcatgacaatgtcttatattctcagatgattttaaaaaagggtaattaacttttgtgtatctaggtaaacaagatacttaaaacatttttttttttttaaaatagataacactaagccttagagcaacggttcttcattctgggcagttttgctctccatgggatatttggtaatgtctgcagatatttttgatagttaggatatggaggggctgctattgtcatctagtgggcaaagatcaggggtgctgctgaacatcctacagtgcacagaaaacagcttcacacaacaaagaactatctagttcaaaacgttggtagtgcaagtttcagaaaccctgcactagagatatttaccatgagaaactaaagaattactgttaggagagtgggataaaagataatcataaaagcaggatctgtttagggagaggccaagtgagagtgaaagaactgtttaccatttgcactatgcacttcctaaagaagttctcagtgtcaaatgaattaagcgctcttctctggtccacagaagtttgactttcagaagaaagcttttagaatcaagaaaaaatccatcatcttaatgcctaagactgagtgactgaagccaaaatacattaattccaccagtgaatcactagccatgtgtgtgagtgtgctcctaaaattaatacatgtaatgtcatggtctgaaattattttctattctttttctctgggatagatagtacagcaaacttttaaaagtccctagacatctgtaaaaccaggttttgtgtagggctgtcatctgttagcattaactatttacataaagacaaaattaatgatcaaatttgcaacttgagcacctgaataaagacttttttttcactctatttcaccttgtcaaataggaaactgaaaacagtggataattttcatggcagtggaagcatctatgtaaatcagccatccatttcattctactatgctactatcttcagacatgtaattgtttcttgggtcttaaatgctttcatttccattttatccttgagatccagcagtaatttatgtgtacttttaaaaatttattttatttataaatgagacatagattgtgtctgaagacattttgacctttgaccatgagagggataagtgaaggaaaaaacaaaggaatacaaaaggattcctgggaaaaggaatgcaaaaaaaaataccgttacatttcctttttttttttttttttttttttgagacagagttttgctctttgctcttgttgcccaggctggagtacagtgcagtggcatgatctcagctcaccacaacctccggctcccagattcaagcaattctcctgcctcaacctcccgggtagctgggattacaggcatctgccaccacgcctggctagttttttgtatttttagtagagatgggtttcatcatgtttaccaggctggtctcgatctcctgacctcaggagatccacccgccttggcctcccaaagtgctgggattacaggtgtgagccaccatgcccagccgacatctcccttttcataaaagagataatcaaatatataaaagtgaccattaagggccatgttactcatctaataagttaaagtctcctcccatctttcaactggtattttttttttactgatctgaaggaagaagtcataccataccatattttataataggttagaatctatataacaggttttattataacattttataagcattgcttttcttctctattattacaagaacgtgtttgtgtgcgtaggggtgtgtgtgtgtgtgcaagtatcctcgtgaaagtttctattgattttcattttaattatgttcttacaatacaaaggacgctgacacagaatttttttaaaaaacagtgaaaaatgtgtttgatgtaagactcagcctaattgattttcttcagggcatatacaatggaatagctttccatttgaattcactaatataataaggtgttaggcccattcaataattcttgaaaaggagctaggaatcctaggagaaaggctaaaaaaaaaaactatcaaatgaaaagaaagggatattttactaacatagttcgggtaaaatggaaagcagctgtgtgaaatttgagagcgataaagaagtgagtccttggtgataactacaacctcactggtttaaagaaaccgtaactagtagacaaaatgcaaatgtatcagtaaggcagaattcagatacaggagaaatgctgttacaggaaattttacttgcatttgtagatatgacaactttctcctatatctccatgactgatcactgcaaatacttaaatccaaataagatattcatacttttaaatactaagtaaacaaaatttaatagtttaataagacaacaatgcaggatgatggataggaaaaaaagtggaggaattaaggttcaatatgaagcatagtagaacaaagtatttaaaaatcaatatatattataaggaactaataataacagatctgtggaaatggataatagaaagacaattgtaggcctaggactctcaattttaaaagactacatttaaagtttgctttgtgttttctgaagatttattccaggcctaaaatgattgcttacagctgacagcttgctagtctcctagtgatttcaataattatctctattgagttagggtattgatctgtagctgctagccatttcaaaagtccccttttatctgctagaggtaatagaattaatgagtctctttgccaaacataaaaggaacattgggtacacaattaggtcacaatataaaactgaaaaaaaagtaagggaaaattaaattgaaattttgagctaaaagagatttatataaaatatcttcccatttaatatgtttgtgaaatataggtatcatactaagacaatggctaaaggaaatcaaatgaactgactagagaatcttcaaataacctgtgttgatgtgagtggtagataattcaaacctatgtgattttgagtcagaaatatacttagtgacttaaaaaaaaagctttcagtgaaaagtattgtatgataagttttggagttctgactcaagtcagcatgcctaaaatgaaatctggctttgaatagtctctagtttcaagatattgtctcagatttttcgtccaaaacatggggaaaccacagtagcaatctcaaggagttgttctgaggagtcagtaacagggcaggccagagagacggtgccttgggagagggtacctacagagactgtgcaagcttctagccaaatgtgcaaatgtttagaagccacaagtaatggtttccagcaaactcttcaaaaataaattggttgaaaattacattgtacattgttcaaaactacaaatgaataaaatgtaagtatgtccaattgctaactttaaaactgttttccagcagcagccactcttatttccaaataacaagagggaagatgctagacaaatacttctccacaataaaaaaaagtatgcacttatttgcctcacttggcattttgtgagagactttatcaaagctatttaattaaataagtaacggaaatactgtgcagggtaaatggagtaaacatagctaaatagctaggataggtacaagccagagaaaaattcccaaactagattatttctcattaatttgacactcccaataagtacagacattattatggcctttggcttaatgactcccatttataattagtaagagctacctgcttagtttcaagaatcatggtttataaaagtaggaatggtaccacaggctgacctctgtttttaaaagtagaaacaatcaggctgctatttctttagtttgagtaattgctgtttttaaaagtaaagcaggcatcagtgactggaaaaattgcaaaatcagtggctggaaatattcatttttgaccaatctatcatttcaacaagtttgtttttgacttattcatttgcaaccttttccccaaacaatttattagcaaccagatcacttgcttctctcagggcagagattcaacagctgcatttattcctgctccaatggcaaggctgagccaagagcagggggagccctgtgatagctggctcccaaggaggtaacagtgccagcagaagaggatactgactccgctacttagagttaccacaacccacacagaaaaggagctgtccagcacagcggtgcttccctctgccatgacagcctgccctgctgctttctccatccacctccctgggctgctggatacctgatgaagcaaaataaaaagataccacagaaacatcctcttctctgtgactgggtctttgattctcaggaaagaacatgcccaacctctagtagaaatcagccttgctctttctgggcacacgtacatctcttcttgtttaaacagctaacatgaaggacatgaacagacacttctcaaaagaagacatttatgcagccaaaaaacacatgaaaaaatgctcaccatcactgcccatcagagaaatgcaaatcaaaaccaccatgagataccatctcacaccagttagaatggcaatcattaaaaagtcagtaaacaacaggtgctggagaggatgtggagaaataggaacacttttacactgttggtaggactgtaaactagttcgaccattgtggaagtcagtgtggcgattcctcagggatctagaactggaaataccatttgacccagccatcccattactgggtatatacccaaaggactataaatcatgctgctataaagacacatgcacacgtatgtttattgtggcactattcacaatagcaaagacttggaaccaacccaaatgtccaacaatgatagattggattaagaaaatgtggcacatatacaccatggaatactatgcagccataaaaaaggatgagttcacgtcctttgtagggacatggatgaaattggaaattatcattctcagtaaactattgcaagaacaaaaaaccaaacaccgcatattctcactcataggtgggaattgaacaatgagaacacacggacacaggaaggggaacatcacactctggggactgttgtggggtggggggaggggggagggatagctttaggagatatacctaatgctaaatgacgagttaatgggtgcagcacaccagcatggcacatgtatacatatgtaacaaacctgcacattgtgcacatgtaccctaaaacttaaagtataataataaaaagctaatgtgagaataattatgtgatatatgaaaaaataaggcagtttagagagaccaataaatgcattgaagaagatgcccttctatgaaataaacttgcttcaagaataagattttattaaaaattaaatttgtattttccactagactcaaaagtatagcacctctatacatcaagaacttgtacaaatgaaataatcataatgtgagatcaagggcaactacaagactaagatcaacatatatctaaaatacaaagtaggcaactaggagcagattggctataacagaatacataataaatgatttaaatcaaggcttaaaatcaataaaaggataaagagatgaaagtaattgaaaaaagtattaaaatatatgaaaagactgtcataaaaatacacataaagtaatagtacagtaaaagatgtgaaactcattccctgaataaatattgaaggtttcagattattgtgtatcagtaagaaattgtatgtacctgggtatattcttggctaaattattgaatcctaatgatgtggagaaaaaagaaattcaaagcatcttttttccttcctcaaaaaatggtttccagtttggtgggaaaattctgcttattctctaatttcccttcacaccctaaatatctataggcaaggtaaaacttctgcaaaattttggaagataatgcttatagcccaagattttttcatacagacaaactatagttcatataatataggatttggcaaactcaacctgtgtgcaaaatcaggcctaccacttgtggtaaataaagttttatggtaacatagccatgactattcttttgcatattgttattgctgctttcacattacaatgacagagtactgtatggtctacaaagccttaaatatttagcatctggcttttaacagaaaacctttgctgacctgatacaaaatttgctgatccctgattcaaaacatataccatggttcagaaagattaccagacatttatgctttcaataaagatataatgtaaattaaatttgagggagaatcccataaaacataggataaagtttagataattgtgataagttaccataaaacatatgcatatgttaaaaaaactggaaaagactaggctaacagtataataggtacttatcattgaaagcaattgtgatatgtgtgcgaaaatgctttgaaacctggaacaagctaaactaattaattggattatcattggccacaagaagaccactaattagaggaataactagctcacaaatagtaacatgcaatttagttgctaaatcatagtgcagcagtggtgaattttacttttccttactattagtaacatgaattttagtatggctcttttgatttcaagaaattaagaaccaacccagctagtccagtgatttaaaatcccagctgcacattagaaccacctcaggtggtttcaagcaaaacgcaagtgcccttcccctactccattaaatcaggacctcttaagtacttttttaaaagctttcatatgctttagatatgcacctagagtcaagaagaactgagttattaaaatacatacatacctacaaacataaatgacacctctattaaggatagatatgaagtggggagataactttcatgaagaataagattcatcataacccagagattcatgaaacttagaggtgagaaaacttatcctaagagtttggatgcacgtaagtgtatttcatttccattttctgtatcagcttttccacttgttactaccaactggattctgccggtttctgttcctccaataaatttttgtcaatattttgtcaatattttagatttttcatgggcctctgttgtcaatcccaccttatgggaacatttcatggtaatgtctattttttctagccctgattccttcagttttctaattcaaacaaccaacaaaaagttccaaggaaagtcagtctgtttgaggttgctcatatttgatgtcatttcataggtcacaaatcagaggtccttagttagtgggtatttttttaagttgcttttggtcatataaaaagtgcttctgtttgtagggacaaactaaaaggaaccagaaccagcctgaggtcagtgtgtaacagctagagctaccgaccatgaaagccaagtctactggcgaattggggagtacttaggcaaatgtgaagagagggcagctgttacatagtcaatataaaataaatccttggaatccaactgtagcctaacgtccttctagcctctttttctttttttcatctctttccttctttctttcttccacactcagtattttctttttcctattttcatctcttcttctatttattcctctgtccccttaatacaaagtaaaaatctcataatcatcattgtattcccaatatatttcaagggtaattagaatattattcatttgcttgattaaaaccagaacatatattattacaataaattttaaatagttaaaacacactacaaagagaattagtataagatgtcaaacaaagctagaattatgttttcttgttttctatatttggcatatgattcaaacaatcttatttatttagacgattgttttaaatatattacttatatcaatctaatataggtaatattggatacttagttcctttgaatcttaagacagtaagtcttggttttaattgcttgattttaaaatggagtttctataaatatacttagaaattagagttttttattgagtgagtattgaaataaccaatttctaagtgacttttacaaattttttcatgacttgggccagtcaaaaagtttgtcattttgaaaacaaagtcttttttcttccttcgctaaactttgtcagtctcctttgttatctgctaaacttggcaatggttttcaagatctgtagctaaatttattcttttatacatggttatttagcatacttgaatcaaaggaactatactaacaacctgaaagaatacacttcaaaataaacatattgtgtttgtctcaagtttttttatttcctgacaaatatattgagatttggaaggccatttgtctttcagtaataaaccattatcttgtcacagtggataattctttcagtagagttgtcttaatattccaaagtcactttttctttatttccttttttacttgggtagcttcagcacttagatattagaaccaaataacaagaaactaaatgtaatggcttatatttggcctagagtcaacacaagctcgttgagtgtggtgccagttcctcctcaatcatcatttggaacacattccatgtgcctgaccagcataatttgtttagaatcaagtcactggcaagagactcaataattttgttttcttttcaaatgagttacatgggattccttaaacctgaacaacactattctgttatgggcatgttctgtaccaagtaattaactcacatacaatgacagtacaataggaaagctgaaagggcaataaatgtttgcccaatgatcattacttgaccacttttgggaggagtgaaaagtaaagcaaaatacattttacccacatcttaaagtcgctttttacattaaatatatttttcttggccttgtgaagtctattatacctgaaataatatctccaacttctctcaagagcagcaggcttatttatccctaattgcttgtcaaatcaggaatcttaagaattaagaatcaaaacaatgttctttgttttttgtatctgctttgtttttagaggcagggtagagcagcagttaagagcaggagttagcagactatggcttgcaggccagtctggccgcctatctgtgtgtcacccacgaactaagagtgtttttcataaacatttgcaaactatttcatggtagagaacaactggagtcagtttgtctggattctacctttgtttgactgttggatgttggattaattttgtaatcttcctatgccttaatttataacatatatacttagaaaaaagcctgtaaatatatgcctataacttagatagttattgatgaaaaatttactggtgattttttgggggtgtggcattttcaaatttttgtgctaaacatgcaattattttgtaatataaagatgctattggctttattgaatagtaaatgaaaagaattcagattaaatgtcctcagaaaaaaatagattagcactttttagtatctttgtaaaaagagatttaggtaaatatgtttgggaatttaaaaaatattaatctaagataatatggctgtatattttcttatttgtattaaaatgacttgaatattttgagaaaacccagcataaaaacatgggattataatagataatttaacaattatttttaattcatgataaaatatagtgtgcaatattaagggaatatctatatatggtatacacagtattgtgtaatgctgaatagctctagatctggagtttatgattaaaatatggcttctgccattaacagttcttaccttgggtaagtgcaatgtatcttaagatgcaacctatgtctcttttttttcaaaatgaggaaaatatggtttttcttaatgggagtgttttgagggcaaggtagaaaaattcatggaaacatgtgagcacaattcctgtcacataaatgtttatgactcaaccacaatttatataaatttattctatgcatctgactttattttccaatttaagtacagaataaaaacaatagcaaattataaagttatatcagtaaaaaacacaacagtttactagaataccatagaaagctatcatttggagtaaaaaatatcaattccagtcctagttttgccacttccttgatttatttctaactctggacaagccattagagttttttttttttaaccccagtttctttaaatctataaaatgagttgattttagtagtccttcttatatcacaatgtaatgtgagaagcaaattagataattgaatatcctttagagtaaatagtagcaccaattttaattattgtgtttatacttggccaatcttgaaaataagtttatattgctaatgccagtatttcaaattttaagtctagggttttaaggctgctctcaacagttccttaatttattctgtctagtccaccaaaatctgaaaaaaaagtgaccttcaaaacagaaataataaacctgcagagttgctgagagtcaacacattaattatttctccattcagtgtgatacagaagctttcaaagtgagatcagcgctgctttagcctgttgtatcgcatcaatcttaggggtcatgacaaacattcaaatctctccagaaagagtgttcagtgtgggggccagattagcaagattaaacactgctttttggttgcagcattgctaattttcatattagtagaaaatatcatgttcatatatacatatatatgtatcaaaccaactctcaaatagttttccattatcctccatattgaaagacctaccacataatgcccatccattaaattctatgaaactatgattcattaatgtgaacaatcatgagttaattgaacaaacttttttgctctttttatacatatacaaaccaatcacgctggattatcatcactgcctgatgaataaattgaacccaagttgactttcaaagtcatctacatagtatttaatagttgatagctgttaatgagccaattaaacaaaatatttaatgtagacttcttgagaatgtataaaccacaagtgaccttataaagtacagtacgatgaaaatagctaatgttccagaatatgcttgtgacaaatgtgtccggggcatagagaggtgagaggagtgactgaaatattttcgtcattggtcagtgatggattgaattaacccttgggaaagatccactttttcttttttggggggtggcaggcataactttctgcatatttacattattggacactcctccaaactgacaatatccacttacattattacacaataattctaaaatctaccaaaatggaaacatcattatttgcagtttattttagcttctaaactaaattaatcaaaaagcatatgtcagggagaaaagcagttaagaatgttatcctttaaaaatgttagagtcctacataacagaattcgagtccctgcaggaaaatgataaaactccagagttgaggagagtagcttacacttgcaatttaaggcaatcaatttaaagttaataataattttaatcagtgtttaaactgatgagtaatctgatctggtaattattgcagattttccaactccacaaacccttatctggaaaatgacctcgtacttctgcctactcaatatgcatagtgattatactgatactttaaaaccctagaatagaggaggagaggcaggacttagatggtaactcaggttccttttttttctctctgtctctgtctctatctcttcccaacataacatattctttaattttcaatgtatcttattgttgcctccaggaataagcaggtggcttatggatctccaaagtttaatcacttttaagtgttctgtgatgttggcacaagatacaatattctgcagtacagatgcaggatagtagaagtaggccttcattgttgtcagtgcaaattgtaggattcaaacaatattctaagatttttcttctgtgttcagttcctcttgttcttttttaaaattattattatctttttttttttttttttgagacagagtcttgctctgtcgcccaggctggagtgcagtggcacgatctcggctcactgcaacctccacctccagggttcaagccatgcttctgcctcagcctcctgagaagctgggactacaggcacatgccaccatgcccagctaatctttgtattttttttttaggagagacagggtttcaccatattggccaggctggtctcgaacgcctgacctcgtgatccgcccacctcggcctccccaagtgctgggattataggcgtgagccactgcgcccggcctccccttgttctttttatggtagcataacctaattgtcatcattgtgtccaggttttatatcacagtaagatctccaaagacttgttttacatctcttgggttaattctattttgaatagtgtaatactgccttcttagcctgtgtatttgctaaccatgcggccattatttcataggcctctctgtttctaccaaattacctgtactgttaaagttttgggaaggaaatacatgaagtagaaaaatagagctttttttaatgatatcaattgttctaccaacagaagatacatgtgtagtctctttcaaattagcatttttatccagaagtctttaaaatatgttattgcacataagaggaaaatgtttttcaagttaaaaaccaaatcaactctttttataactcccaaaattcaataacattaaaaattggccattatttttggtcaaaattaaattgagcagaggttggaaacattcagtttcaaacattacccatcctgccaaatgtttattataataaactaaaatttttgaatgtataataaaaatgtttaattccttctctttgtgttcttcccccatcccatcaattgagcaggctactgttcttggacattgagaatatttcactaaaataaagatgactaatggcctagattttttttttggaaggagactaaggctatttggaaaaatagattcaaaaggaaaagtgagaaaagacattaagtttactgttagtgtgtgcacgtgtctatatacttacagcttgacttttaaggagcaagaaattcttataagttgttccttattttttttaaaaatgtaactatgcaacatggaaacataatttaaaagaaatttattgggggtaaaagttaacattttaatctcaaaactgattcagctttggtttaacaaaaaggattggggaattctaattttatccaataagtacttccaccctagataatgttgcataagcttaaagaagtgataactgtaaaatgatgtgttgcaacagtatgattatatatcatttaaaataggccttcagtgggtaacctgataattaccccatttattgtggtatatatatagtagagataaaataaagcatggaaagctacagaggaagctaagaaatggtatcttaataacttaatttgaaagtagatttcaaagttggcattttcttcctctttgagagtttcagggaaattgtgacagatgacacatgtacaaatgcttttgaaagtcacctgtcaaaaataatttcacatcacagttatcagctatcttcttcaggctagagaagtatgtgcatatcttagaagggcccagtttatcatcaggcaagtttccactccagcattaagttcgggagtgtatcatcaatcatcacctttgccccacaagatgaatggtatcttagatttgcttgatgcttttacttcatataatgtaagaaatttatttccataaaattatccacctcttttggggaaaatatttgtcacagattggggggacttttggatatgctatctgggccgtgcttttttcgtaccctgctttctctgccttttctgatttacagacttaacctacccttgacttaacctacccttagcaacctacagaagacatctcctacattctggagcctgcccattcccatacaactagtccttagatattatatgactctgataagactttttaattaatgttcattatagcacctattgaactcaactgtggctcatttaacatatcgattcaacacctggaataataattaataataatgttttattgaaaaacaaccatgtatcaagtattatgatgggcaattcataagcattatttcatttaatgctcatcaaaatcctttcaaggattactattcccattcaacaggaaacttaactaatttgcctgttgctaattaggaggcaaaactccttttccactcaaatttgctggactcttgagccatgcacttttctcatctctatattaattcccattgataagctcagaagttataaagataaacatacagtccttgccctcagagaactcacattataataatggcaattaattatgaaaattatatttaaagtgcaatgtaaaattaatgcatgtcctgctctttattgaccttttttattaggtcttattatcctcagcatctcaacattgccgtagaggatgctaaatacatgtttgttcagtgagcaaataaataccactattactactatatgctactaaattacattttgtaacaacatagtctaacagaataacacgttggattatatgaaatgaaatttcatgtaatactgagaaatgcctggggctgtgattcaggagaaatatactcagtattaggaaacagagtgtaacacaggaacaagacattttgctaaagctcagtgaattcctggtccaagccaggagcctttgttaatcttatttgagtctccccccattagttaacagaatggagttaatttccaattcacctgcctatcatttgcctggttgacttaaactctgagatgccatttttatattggtaaaaaggagaatgatgctagccttatgtatctcacatgaaatgagatcatacatgtgcaatacttgctacagcaccaagcacacagataatgcttaacaaatgcttgtttaatgtaaaacgagatctaatagatctatacagtatggaatctctatagagcaaattcaggatggtgcaatagaagctacagcttctcagagaagaataaaaatggtgtactataactttttctatggattttacaatgtgaatactaagaactcactctagtatgaagcagaatagcatactggtgaggagctcagatactgagttagattgcttattataaattcctggttctattaatttctatttttgtgaccttcaatatagtacgtaggtttttatgtgtctcagttcttcatctataaaactgggttaatcatagaacaagaactactgagtctgttgtattaagtggataaaacaaaaaaagggacttaggacaacagtgccatgtagtaaacattgtaaaaacaaaaagactaatagcatcatctttgcaggtacagctacctgtggtcattgattcatgctgtgaagttcaagttatctaagttaattcatttttaaagttcaagctttggcaaagagccactaagacacacaaaaacccgtatattaatgaatgagatttgcgaagcttaatgtgaaagttcaacagtttccctttattggagagcatctactataataaaatgccaacatgaagaaaaaagatcaaaggcccttattgtcacagaggagcttactatgtagagagaggtatacaaatcgtatagagatatgtaggcatatacatgcatatgtacctgtatatttttacataggaaaggtatgtgtgaagtattaaaataataggagctactaaagattgacattttataaaacagaaattaaagaagatgtgacatttggttgaatttggaagaatgactaatttactcaaaccagtatgtctggtaatgttgtgcatgtatgtccagtacccatgcatggctggcagagagagcggggctgaatcccaggccatgaagtgatcacaaacctaatatctttgcttggattccccatgggggaagtgccaaactccaaatttacttcatgacaaggtattggccaaagaggaaggggttctgacactccgttagaattaaagtatagcacattcccagttaatagaactggagataagtctacttctgattgctttacactgcctattgcaacatgatgttggaaaataagcaaagtgagtatctggcaggagacaatctgaacttaacatcacttttttttctaatttttattaaaatgactgaagaaagaaaagaatggacaacatgtaaagcacttttaaaacttaagggaaaatcctgaaaactaaaggaatttctaaaagataaattacaggtgagataaaaatggtggatggcctcactgtgtattgcaaattagagaaaagtacccctagataataaaacctggcactaagctggtcaacaacaacttctaattaggatcattgggcacctacaaaaaaaggagagcctccactcaggcagtgtgggtggggggctgggtatgagacaatgagttcaaatgtagatacaactaacaaattttaaagaatctttttaagtatcagatggaataccgtagaaaacagatcaatgatttagaaagttagaacaagaatctttccagaactcaggaaaaaaaaataagaagatacatattatgaaaaacataaaaagaaggattacggtgattggttttcaaagatacgtacacacacacacacacacacacacacacacatacatatttcaggaaaaatgaagaaaacggaagtcacaggagcaacaacaatccaatgtatactaatttctgagcccaaaggtagcctcacatcagaaagtctcttagtggatgtagtcaaaattaatgaaaaaatatataatacatacaattgtgaatataaaactaatcttgatgaccatcaaaaaaagggaaagtgatatattttcatgacatttcttaaagtatcataaaataaattgaaagtaaattgagctattgccttgcatactatcaatttatacggaggataaaggaatatattaaaagttataaattaatacatttttaccaatcaaatgatataaatactagaggtgatatatggacaagagatatagagactatttcatttttcataaatatagagactggtttatttgtgtataatctattatggaaataagaccataaatttcaaattgtttaaaatactactttccgcttcctaaaaaaatctgcctattgaaaagggagaacatctgccagctagaaacttgtaagttgtttcacttggttcttaatgcttcctgtttttttttaaattgagatacacatcacataccataaaagtcacctttgtaaagcataaaactaagtggtttttagtctcttcacagagttatactatcaccactgtctaattttggaccatttcctacactctaaaatgaaacctagaaactgctagcattcatttctcatgctctctcaatgggaacccctgacaaccatgaatctcctttctatcttcctagatttgcctatcctgaacatttcatataactgaatttatacaatatgtgacattttctgtctggcttcctttaattgtatatgttttcaacgttcttctatgttatagcacatactatgttatggtacttcattttctgacatggttagataatattccaatgtgtggatacactacattttgaaagctgttattcagttgattgacatttgaggtgtgttgggaacaggccccccaaaatctggccataaactggccccaaaactggccataaacaaaatctctacagcactgtaacatgttcatgatggccataaggcctacgctggaaggttgtgggtttaccggaatgagggcaaggaacacctggacctcccaggggtgaaaaccgcttaaaggcattcttaaaccacaaacaatagcatgagcgatctgtgccttaagggcatgttcctgctgcagatatctagccagacccacccctttatttgggcccatcccttcgtttcccataaggtatacttttagttagtttgatatctatagaaacaatgctaatgactggcttgctgttaataaatacatgggtaaatctctattcgaggctttcaactctgaaggctgtgagacccctgatttccactttacccctctatatttctgtgtgtgtgtctttaatttctctagcgccactgggttagggtctccccgaccgagttggtctcatcagaggtgtttctcattttggccgttatgaataacatatatattatgaatataataatactattaacatacatgtacaggctttcatgtggatacgttttttagattttcttggatatatacctagaagtactgggtcatatggaactctacatttcactatgtgtgtgtgtgtgtgtgtgtgtgtgtgtgtgtgtgtttgtgtgtgttggaagagttcaagaaggatttgtggcaattctgtttttaaatatttggtagaattccccagtgaagccatcttgttctggacttttaattttgtagaactaattcaattgttttacttgttataggtatattctggtgtcctattacttcgtgggggtaatgttggtagcttgtgtatttcaagagatttgtctattttcaactttgccttagcctttccttcctagttatgtacagcttcatagccagccacgagagcacagggccttctaaagtctttcttgagcatgttcacaactctgtatatgtgggtggctttctagattctctggaatatatagtagttttacaaagatcttatggacatcacattctttagctttatcattttcgcattttagttattctttgcccagcttttggcttgtcttttctatctgttgcctcaggcagctgcaaagttgaaaacacttgcctgtaaaacatatttcagaaataccctctaagagaaagctcttaggcctggcaagctccagttgggtcaaatgaaaacaagccttttgaattaaaacttacaggcaagtactgcacagatcagattatatatatatatataaaatcggaaatgaggctatgaatgagctatcgcgtgcttctgctttttccagaatgcaggctattttatttttggcaaaaatatatccgagtttgaaatcagggaatgggactatgagaagataaaaatgccaccaaattcatgcttcttacagaggctcagtcatttttttaaaaaataaaatacaataaatgctccacaggttgctgcatgactttggttagtttcaacagtgatgaaaatgttacttctgacaaacttttgccagtttttgagttgactttattgagagacaaattttcagaagtcctttctctgccattttcatggatgtcactctctctatatatatattttaaagataaaacataaatgaccaaactacatcctaaaaatgttcaatctttctaccttgcagaaaagcaaactaaaatattattatcactaaaaatttgacaaatggcttttatttactcatttttctattttcccttcaaacatttctactaagatattgtatctttttttataacattaggttataaagttgatttttttgtttgtttgcttctttgttgttttgagacagagttttgctcttgttgcccaggctagagggcaatggcatgctctccgctcactgcatcttctgcctcccaggttcaagcaattctcctgcctcaacctcctgagtagctgggactacaggcacgcactaccatgcccagctaatttttgtattattagtagagacggggtttcaccatgttggccaggctggtctcgaactcctgacctcaggtgaccctcccaaagtgctgggattacaggtgtgagccactgtgcctggccaaaagtatttttttgaaataacaattttaaaattaaatggctgtttctttcagaatattgacatttgaatcccaagttacccttgggattactacctgtgcatgtctaatattttattctcctttttgttttttatctcagagatcacacatcctttgggaatagtacacgtaggtaaacacaagaggataaagagtatttcacagaaaactttgaaatacacaccttcaatgccaaaaacaaatcatcaaaatcttcgcaaaggacgtaaaaatgatacataaaatcccactgtccaatttagattctatacaataattacataacttaaactttaatttgtttgtgcttcagaatgctccaacaacaaaaattttccaaacctatattctttttgatatatgcatattttgttatggttatccagagaccttcacatgcttattaaatttccaatatgcattattataataaatacaatgaaaattgaaaatttatgagtgatataaagatacatctctggtatttcatatattcattaaaatatgcccaaactctcaatattttaagtgtattgaaatttactaaattagaatcttgctcctgaattcttctaaaggaagactaacaatagcaataaattataattatgcctagaatagaaagaaaagagaaacggagatttattcctgtaacattatctaagtctgaataggactattaaaaacctgaagttctaatcacataaaaattatgaaaatgtaaaaacaaatctaaattgttttcttgtttaataacaaccaactaaagaatttgttcccattcatggggatgtatgcttcagagttttacaagtagcaaaattcaagaatatacagtatctgttgttgataaagaaaaatcttcaaacaggatccaaaacccagcatttgtgaaggaaagttgaggacactagtgtccaagcttcatctacataccacctccactacagctcaggccacatcgggctagtgggtggtataaagtatgagaattaataatattttttgacttggtaagactctcttattttagtttggatcattgaattatgcaactcctctgtccctcaaaaattctgacttgtttttgactaatttgaaaatatacattattaatacatttttatatatacattaaaataaaatttatctgaaaaactcagagtcataagaatgttattaaattttcaaatgttgaagtctatggtgttaatttaagatcccagattgagaataatgactccagttggcaccataaaaatggggaaaaattaaatcaactaattacagttctgactctatttaaaaagtataggttaatctcttttaaatgagtgggctttagctgaatatctgcctgactcatgtcagcatacttataaacttatacatttaacatgtttttcattgcaattgaaacattatttctgtgaaaaaacctgatggtctaaacacataaatatattttctctcaaaatagatgaatccaaagatttagagcatataattaattgagattccaacatacaatcctgggtcacccaagactgccttataggccagacacagtggctcatgcctgtaatcccagcacttagggagactgaggagggcagatcacctgaagtcagaagttcgagaccagcctggccaacatgacgaaatcccgtctgtactaggtatacagaaaattagccaggtgtggtggcaccctcctgtagttccagctactcgggaggctgaggcaggagaatcgcttaagccctggagatggaggttgcagtgagccaagatcacaccacttcactccagcctgggcgacagagtgagactccgtcttccaaaaaaaaaaaaaaaaaaaaaaacaaaggctgccttacagtttccaaggtttgtatgattttctcagttattcggctacttgcgtctgtcagattaccatagaagactttggaagatgatggtttgttaagacagaagaagcataaatattattcttaagcacactatatagattgttgcttcctaaagtgtgatgttaatatcaatagcctcattgacatcagttgggagatctttcagcatgcagaatatcaatctgcatcccagaccagtggcatcagaatctgcatttgaacaagatctccaggtgattcatacacctgctatgtttctgatacagaggcaaacactattaaatatttgctggttcttcagtgttttttttttccctagtatgttatagtttacatattcatagaacttgacaatactataagtattttcttatgtcattaacattttaaaatattactttagaattccattatcacatatacttattggaaaaaattagtaaaataggccagaaattaaatactatccaattcttcttacttagtgtaaaattttggtctatatttcaatcagataaatacattaattattattatctattatacataggatgaggaattatatagcatttccagtacagacattttcctttccattatttgttttttctatgttataattccttctatgaaaatgttttcaatgtgatccacacaaatcattagcattttttattatgaacctaaggatgaatcttagagaatgtgcaacagtctttctacaccaaaagatattattgatttctgaattttcattttttccataatcttcaaatacattgaaaaatatgggtataatgagtgaatgtgaatataagatgaattcaaatttcatgttgcagaaaactctcatttcccttcctttataatgtttttttctgtctctctctctctctatatatacaaatatatatttcactttacaatagttttaaaaattcactatggctaaatctgtgaccttcagccaagtattttttttctgggaatctggtgaagcttcttgatttttatgctagtcattcttttcttcagctgagggcattttatttaataaatttaattttaccatttatctttatgagaaatgcactcttcgttagttctacatggttcttcttataaataacatattgtgtacatttatatttttcccctacattgtttaaaaagttcactcttcttataaattttcaatattgcatagtgatattttatgttttgttttcttgaatgcaattttaaatgtcttaatggatattttaactggctccaacttcatctgcatctatttctcatctaattttatgattttgttttatcatatctgcatttatacttgttataacatagatggtctaacctaaccagcctttgctaacagtgtgagtgtgaggtttcatttgtacatcctgtgttcttgggcatttgtacatcctgtcttcatgggcctggctgatcatcttcaaatttggagcttggaagtgaattattgtccacagtcccttgaacacttttttctgttgaaactgactttatcatttaggaattagtagtagtaagatcatatcttctgtgtcctctactgcttggaattataaaaaactgaaggctgaatattcaacacccctgttattaagcttatggtactctatttctggtgatggaatttccaagttttcacaactctgaatttgccttacccatttttacatatgtgtatatatctggctggatatattttttatcactgtgaattatagtctactacaaggagaaaaagaagtactgattttggacagagagaaggagaactatttagaaattagtcccaaaacattagcatgaaaaaaggtcaattgttgcaaaccttgactttctaaatcaagaagtggacaaaggtaagaatagattttcttctaattgttggttggcactgaaaagttgtgtcagaatttgaattagtcaaataaaattctattaagttatggtttaaaggaaaaccagttacattggcagaggtttgacttaagtttcactttttttccaagataacaagatattttttctatgtttttgttagcatttctgtggaaacgtatttaccaccatatctagactcctaacttgttgctaatttaaaaccaaaactgtctctgagacacagaaaccagatcaatattcttgcataaaaatttaagatttattttattttattgtcatcaataatgctttcctacatagtagataatatgtgagctgtttctgctaatacctggtaactttgaagatgaaacagatcaatgtcaagtatagatgttacaccctttcaaaacttatacagaaattgattttggaaggaacagttttgtttttaataagcactaattatttgactattatttctacaacttgtaaatgttaggcttaaccacaaattaattggaagtctgtgtcagtctgtttatttgtctcgataagaaaatcagaggttaatttttaaaaaatttcttcagactaaataaaaccttggctttatatgtaggtttacatttcacagaagtttgtgtcttgtttcacagtaattaggaggatatagccaaggtggcagcaatactaatactactacttaggatcccttttgtaaacttggcataaaaataaggtctacatttttctctcatacactcaaattgtatgcaaatatgatgataaaaatcaaaatttaaaattaattttcaattttgttttaaaaatggggccgggcgcggtggctcacgcctgtaatcccagcactttgggaggccgaggcgggcagatcacgaggtcaggagatcgagaccatcctggctaacaaggtgaaaccccgtctctactaaaaatacaaaaaattagccgggcgtagtggcgggcgcctgtagtcccagctacttgggaggctgaggcaggagaatggcgtgaacccgggaggcagagcttgcagtgagccgagatcccgccactgcactccagcctgggcgacagagcgagactccgtctcaaaaaaaaaaaaaaaaaaaaaaaaaaaaatgggatgaagaattaagctggtttctgataaggtcattcattctgaagtctgatgcagaatcctttccaaaaactatttccatttatatcagtactttctcctagcactatgttggtcagtaagacttttgacatttacataaagcaaaaaggcattttcattctcttggagccattctttgaagagaaagatgctgcagctagggaaaacattaattaaaagcccatctaacataaatggcttgtcaccaagttaccatacttagcagaacttacactgtccttggaagatagaaaaattccttcagtgtttggtttaacttgagaagttaactactctaatttgtagcaatacatatttttcacaggctgcaatgtatttgcatattttaaatactttaaggaatgtatcatcaaatgagtccctaatggaatgtaatttagttcacaagttaaaaaatgggataacagtttcagcccgttactcccctaatgcttgaaatatagtcagagaatgaaacaagcagtgtataaaaaacagatattacagtaacaactgtcacgataatgagaaggatacactgtactgtttttgcttagttataacaaatgagcatgaatatcttgttatgtttcttcggggaatagtattaattctttctgctacattgaaatgaagcatggttaatgtcactgaatgtatatctaaatgactctaaaatgttacattaatagaaatgatagaataaaagtcatgcaaatgagtagaatgtttatgtcctccatattctttagtttttaagttgcgtgattttgagataacatttcattgtccaaagtatcgatgaatgtcatttgatttaaaaagtagcctttgagaaaacagaaactgtgagtgctacattattactagagctatgccagattataagtactaaaatttacatcagtcatccctttgttaagaagcatccttttctctcccctgtatttcccctagcagtaatgaggtaaacaataacatcaacaacaataaaaatgcagcaactctaaaacaagcatttcaactattgtaatccattcccttccccaacagcttatttgttgattagtacctagatggtgtctgacaagcaaaatttattttcctgtgtattagaatgtacatagagtatcacaccatatgcaaaattctatagaggtagaataaaggataactatattgattaatgagtttgatataacacttcttttcatgtagcaaatcattttatcacttaaaacagaagtatcagtaaattgtgccatagatatcactaagtgacttatccatacatttcctaaataactataatcaatctgaagatgtgagatgggggcaacttggtcctatagtaagactagcttattcccagtctaggaacatggtaagttttattatatcctaatagatagtacaagtcagacatattagagatattttcaagttcttccaggaaacatttggaattaagtcagaaatgttgggaaattttggtatgaatatatctcctttagacatttaaaagtcattagaactgcctgtagagcatggtggaaaacccagttcattggagctgtagaagatttttcttactcatattctccaagtatagctcagtgatctgggaacctactgagataattccagtgcccaagatccacaaagacatctagcattgtaaatatggctcctgggaaattatggagaatgggaataactagctctaaaacatagagtatgtttttgggaaataaatccccaaaaatgcttctcagtctgtctttatatgtgtggaacatacccaacaacttctaaaaacaataagttgacccatattgaaggagtttgcattttgattaataagctatatagaacacattcatggtaattagcacatgtcaaataattaatcttcatagcctcattaacaaagggagcattgcatttttaagtgaagaaagagagacacaaagaagtaatttgtgttcccttctgttttcatcaggtgtttgaatcccagtttttcactacttacaggcagtgaactgcagactttacttcctttctgacacagttgatctactctttctactgtctacaagcaagaatttctttgtgttttgcatttttaccttttgctttaaagcaataagcaacattgtcattaacttaaataaaaatacctccataagccatctgacatttcattgaaaattctgtcatttatatctgccataaactaatctaacaataactggcaatgttgaatttgttctaagtgttagtttctctcgttgctattttcttttcatacctagtttcttctaaaccaacaacaaatctaggaaagataattttattgaaaaaaatatgtttgtctattacacacacacccacacacacacacacacacacacacacatgttctggtgcactgctctgtgatcccaaaaataacagaggaattagcgataaagtgacaaaacataaccaagttgcctgagctgaacttgttcttcattataaagtgtatatatttttataatcaatattttattaacatagcaagtcagaaagccttttgtatggataagctgtcatgatttatggtaaaacaattgccattatgttggggagatgctaccttttgattcattgacaaaaatctgtcatcatctgatacacatatagtttagtacagtgacaaaccttgtccagcaagcaaaaggctatagaaaatatgtacaaacttctgttaaaattgccttttcattagggagatacattgaaataccatcttacttcattccagatgctctaacaaaatactatagactgagtagctgattaacaatataaatgtattcctcacagttctggtagctgggaagtccaagatccagacactgacagattctgtttctggtgaggactctctccctggctcatgggtggctgtccctcagtggcagaaggggagaatgggctcccttgagcctattttataagagcatcaaatgcattcatataaggactaaggcctcgcgatctaacacttcccccaaagctccactttctaataccatcacattgagggtcaggatttcaacatatgaattttgggggatacaaatactgagacaatagcaaagacactacaagtaaaaagaaacaactgacataagggaaactgttttctgccagtaatagatttgtactttatgactatttaacatttcaactttttttatggagttaaagctaagggttagaattttaaatgcaatgaagtcttgcgtgggaattggcaaaccatggtttgcaagccaaatatgaaccagtggctatttttgtaaatacagttttattgaaacacatctgtgcctactgatttacatattgtctgtggatgcttgtatcatacaattgcagagttgagtagttaggacagaaaccttatacaagcttgtggccaaggacactttgaatgcagcacaacacaaacgtataaactttcttaaaacatgagatttttgcaatttttttaaagctcatcagctattgctagtgttagtgtatttgatgtgtggcccaagaccattcttcttccatttggcccaatgaaaccaaaagattggatacccctgctgaatgacctgcacatctcaaatatttattgtgtgctcctttattgaaaaggtattctgattcctgatcttcctgtttctatgaagcttgataattattagttaaaagttaggtaagtgctatttattaaataggtaactgctatttattaaataatagaatgatggtgatttttatttctaatttctattcttttacttttttttagttttctgtatgttccagttttaaaatgatttctacaattaaaacattttaaatttaattttatatatacattttatgatagaaatatatttttaaatgtacctttaaagattaaactgttttgttcttttccaacaaaattctccaaagagttatttatattcactgtctgcaattcttttattttcattctctctaaatttattctcatttggattttatctcaacaggactttaaaattactctcattaaacccttcaatggtcatacattgctaaattcaatgtttatttcttgcttcttttcttgacctattagcagcatttgaaaaacttaataactcccttgaaattctttctgtacttggcttctagaattctatgtacatctgatttcccccttacataactggttggttgttttcaatctcctttttttgacctttattcttctcttcagcctcatgttaactgtcagtttcctttgagcactgtccttgatcacctttctcagtctgcacactctcactgtacacatcccatatccgactgaagtctcttttataagttaacaactctgaaatgcatatccttatgttattctggaatgcagaagtatatttactaccttcttgacatctacccttgataatctaacaggcaaatcaaatttgacctgtctataattgaactcttcaccacaattctaccccaaattgacctttctggaatctactttatctaaattaatggaaattctgtctccagtggttcaaactaaacactttaaagtcatccttgacctctctctttctcattttaacaaattatttaacactttaaaaaattatggtagctccacctttattttatgtctagaacttaagactcacaccttttattaggaatgcagttaatgccctagtctgggccatcatcatctcttgccctcaaggtacttaacaatgcctataaagccttctgtgcttagcgcccagttatttctcctttactattactttgctcctgtttcaccacctctgcaaagctctaccatgacaggaaacactctccagcttcagggcttttgtgcttgctctttactctgtccacatccccacttcccaaccaattcccacaacccagctatgtactaggtaactgcctcaattattttcttgctttaattgcaatttctcaatgcctcccatgctgcttatgtaatttatcacctttctctagtcttttcagttctcattgcctttggttttctgtgatagcctataatttgctttttgatcatgtatactttttatctgtccctcttatagaagctaagccccaagaagacagtaattgtttctgttccctaaagtattcccagcaccgaaaaatacctgacagcaacacacacacacacacacacacacacacacacacacacacacacataaatttgttggaaaagagcaaaatgtttaacctttaaaagtacattttaaaatatatttctattataaaatgtacatttaaaagtaaattaaatgtaaaaggtgttcacattatacaaatcatttaaaaattggaacatagaaagttaatgaatagaaaatgaaataaaaatcactgatatatatatttaaataaatgtgtaagaaattaatacatatatatgtgcacatagaggtaaacatatctatctgccactcactccagaagaagtcaagctttcatcactttcacaaattttattgtacataggtgactttcttcccaaaaaatggcaagtatattgtcaagtttggggttctatatatttttctcaaatcttatttcattagcagtttatcagttaggaaacgtattctggataggcttttaaaaaattgttctagacctaattttctgataatgctgcacactgaaaaactgtttaactttcttgccatggggtattgctgagtcaactaaatatccttttagaccaatcagatcattcctggaagcaatactccagtagtgacagtcacaaaatctattagagaatctaccaagacacatttcatcggctttttgggttttatttttaaatagtcaaataaatgaaaacttctatctaaatttcatcacaaagagattactgtcttacaatccatacatattatttgaaagatttagcattacctagtttagtagctatatgttatacttttgttttgtattactgcttatttaactttttctatctttcaagaaaacaagtagatccaagaagaatacttcatctcttgaagaccttttcttaactacttttctgtcctaatttcttaatatctttattcttcatgtaaaattccaggagtattgatgtgcccttttggattttgattctgaggcacagcttatttttgcttttcccagttgcttgtattaattcacgaacaattttttttactcttattttatttcttggacacttatgatgtgtctcatattgaactctatgcgagagggacccaaaattcaaataccttactattatgctgtattttgttcttttcataagttgtgtcatagaaacaaatattaattttaaataaatttagaaacaacgtttatggtaaatttgtacaacttctgctgttgaggacaaattttcaacatcacttaaagcctttacctatagaatttattgtaaaaggtaccattcttatatatatataggtcaatgcagaaaactgctgttagcttaataaagtgaaaaacagtaaagataagccagtgcgtcaacacatatacatgaatatatttgaatttatctcgctagttaaaaaatattaacataaagtagagaaatagaaatatcctatttgttctggaattaatgtcagagaaaaaaagtctattttgaacatgtttgttcttctctaacaagtatttctttctatgatgtcacgtatttgctcttttaaaaaaagacacatctgccttgttttaaacattatatacataataaaagtaatattttactatttaatcatttttataacacattactttagaagaacgacttgttgtgcatcttatatttaaaataatttcatgcccttagatatctccctaaaagaaaaattactcaataatttgatattttcagttttcttgttttatcaatttataacttttaaatatatcagtatacacttctgatctatattaaaaactgtattcttatgtttctgtttttagtaaatatattcagattcattcattattatttttatgagcaaacctggaaaatttcaatccctttaattttccataaaacaattgcagcatggtggaattccatgaaggacaaaggctacaaaatgcaggagagatattgttaatgtcttcagttttctgatcagctattccatggtgcaaaggatctcagtaagtaaaagctttgggttgagctccatagtaggggtcctgaggagtgctgatgattctttaatatcccaaattctcagggattcttaaaggtttgccaacataggcaccaaaacaacataagatgtgccatagactgaagtcagaacttgtagtcaataaaaaatctaccacatatttcaccaaccattgattttaacagtggaaaccagtaagctgaccaaaaacatgaccaaattagctacacagcaatgaaagctagtcctgaaaatattagacagtcagatactgtgtctgaatattagatagtcaagtactgtagctagtcctggaaatactagatattcacatactgtagttttctacttcatgatgaacagttagtaaagatcaattattctaatgctcctttcactcactctggtagagtgttgattgttcttcagtaatgattcttcctttctttcatagtaacaaaacttctcaatttttaactggacacactttttttttttttttttttttttttttttttttttttttcagacggagtctcgctctgtcgcccaggctggagtgcaatggtgagatctgggctcactgcaagctccgcctcccgggttcacgccattctcctgcctcagcctcccgagtagctgggactacaggcgcccgccactgcgcctggctaatttttttatatttttagtagagacggggtttcaccatgttagcaaggatgatccccatctcctgacctcgtgatccacccgcctcggcctcccaaagtgctgggattacaggtgtgagccaccatgcgtggccctggacacataatttgtttaaaaataaagtgtgtaactaaggtctcaccgataatatatgaacagaaagaaaacttgcggaaactttcaatgaacattacttcaaagaaaattgaccttgtctttcgctcatcttcaagtagtcttagattccgacacttgtaatatgggatgtgatggctaggctagttgcaaccatcttgaaccccgaagatgaagaccatagctggcactgaagggtgatgagatgcaatcagcctacgtcctgaggactttgtgaacagagattttatagcggccttcagaattttatttcagaaacaagtacccctcttgtttagctatgtttaccatgttgtgttctttctcacagccagacataactacgtatcgtacttaatatttccatatttacccttacattatttatggtaagttgactagtttatgcatgttttaacaattgtctacatcccctgctgtacatctacatgtaatggttaagagtatagctctgtagcttgactgattttggtctgccattgactagatgtgttatattttcaagttatttaacctctctaagcatcagctggtgtcatcatgagatagttataataatgggacctactatttcataatattgtcataagaaaccatttacagactgtacacagggctctgcatagatgaagatatacatgaagtactaacatttataagtggtaacaattataagtggtaggaaaagtactagacaatgaatgtaggccagagtttaatgtttaataatggtagtgataattttatgcatatgtacatatacataagcaattttaaatttcaaaaatctattgtaaattcaaagctgttacttttgttatgtgaaaaagcttacaatgcttataatgcaacaatggatgtcaacatttcaactaaagctactttgattttagtaggataattttaaaagaaatcctttctattgctggaaaagaaatatttttatgtgttaaatgggctagttttagaattttagatacaactaaatttatgaagaaatattttaggctactattggtctttaatacattttattttatttcattttatatatatggtaaatcatataaactttttgagtgatacattaatttcatagtaagccttttatttttggacatttcttacctacaagagtgatccactaacaataatttaagaatcattgtttgaagagttgaaagaaaatacattcaactggcaatccctcacttttttttttttttgcctgttttaaggatgttatttgtatacttttgaatctgatgctatctctttctaaataaaagacagattaacttatactaaaattattaaaattattaaagatttatatagtttcctattctctttaaaacatggaatcacgtattaagaagagcaatgtggctttgtattctagggaaaaaatactgccaatatgccatttgttcattttcagaaaatactatatgaaataccattttccgcttgacacaattgctttaatttttagcaagaaaaatgtgtccgactaaacagaacaatcgaatcattgtctctttcaaaagtggtgtcatattctatgtctcttttcagtattgtgtacatcatctaatgattttctgttggcttaatatggcttcttatcacaaactgattagctaatgtaaaatatatagagctaaaatgatttctaagtattctcagttcctaaatcttttaaagatttcctgttggcctatttctagcctcacaaaacttatgtgggtaatgaggagccaaaaggaagaaatttctttatgctattgtcactccacaatggactgaaacgcagtatcagtccattttttgagaaagggagaaagtacgtgagttaaattcaattttaaaaatatcctatgaaagatggccttgattatatttgttaagtaattcagaatttcactgaagccggactgtaaaaaaccttaataataattgaaaataatcatagaacattttaatgtgccagccactgttctacacacttatactaattcacttaatcctgacagccatccaaggaagtagaaactgttatgtttattttgtaaataagagaagtgagtcaaggaggatcacaactggttcaggtctaacatcactgacgtaataaagccagaggcaagtttaggttgtctgcctccaaagtttatgcttttcaccaacataatttgttgtgtcttaaattttgcatattttttactttttaaacatttttagtgtgtgtatgtgtgtgtatgtgtgttttccttttaggaactcatgattgcaggttacatataataattttttttttttttttttgaaatggagtttcgctctttttgcccaggctggagggcaatggcacagtctcggctcactgcaacctctgcctcctggactcaagccattctcctgcctagcctcctgagtagctaggattacaggcagcccagcaccatgcctgactttcgtttgtttgtttatttgtttgttatttttagtagagacggggtttcaccacactggccaggctggtggcgaaatcctgacctcaggtaatccggctgccacagcctcccaaagtgctgagattacaggtgtgagccactgagcccggcctatatgtaataattttaaaacctgcttggtaaaagcctgttaaccccaaacacagtaaattaacaacacaattcaacgtcagaaaacagactcctgtttctggcagtaatgttatctaaataacctccagaaaaaacaactgacaaagcacacctaggcattctgggtttaatataaaactgcaaccttttaaaccttgtagctgagctcccagcgtaatattgcaattatcagaaacacaaaagaagatagaattgaaaatcagaaagttcataccaaaactaaagcaaccagtgtatagctgctgatcttatgaagcaagaagcttgtttgttatgcatcttgagttttaataatggctctgtagacaggaaacaacctcacagcatcaagagagtgggcatacatacacaaatacacacaatcaagctgaattctgaaaggcctatttcctaagtgaattgatgaactagaaacatttttcctgttgacaaatacaaaactacaagagattttacctatctagtcctagaatctggtagaaacaaaaaatctcacccataaaaatctacaatcacaggctgctctcagcagttaagaatttgattttatgatttttgtgtggaccaggaaaaaatgccagttaataaattcattttaaaatttcccaggttggtagtaacccagaacacctggctgaaagcccaaatgtactcaaggtacagacattcaaccaatgtttacagaaattttgcaaattacatcttgagaaacttgagctcaccacttaaagttatcaaatacatgactacaaaccaccatcagtgagaattatcaggaacaataagaaacataactgaagcccaacagcataggataaaaataatcaaattcattggatgcatacaaaattagtatgtttacagatataattgaaaatgatacaaaggtacatagcattatcaaaatagaatgagaatatatgtaaaataaaatgtatactaaagaaaaatattatttaagaagagctctttaaaatgtgctaaataactaaagagataataaactgatagacgtgtgtagaaaataaagtagtgaaaatatgcaaatatatgtctttgccaaggttccctttttccagaggcaaaagatcatatgctatccctttattgttgagtgcaaccccagagatgcacaggtgaatgaaaagggaaataaagcagggaagcagggacaacaaatacaagtaagtgtgctgaatgtgtcactgagctagctacagcttcatgtcaagttaaatgattggtcttgcctgaacaaagaggagaaaagagaagataatttattttgattactaaatttcttctgctgtttgtcaaagtttactgcctacgtggttaaccccatatacttccaggtggcacataaatgggtatcacacagaacagcctgaagcaatcgcgtcccctgtgacttgcacgtatacgcccagatggcctgaagtaacttaagaatcacaaaagaagtgaatatgccctgccccaccttaactgatgacattccaccacaaaagaagtgtaaatgaccggtccttgccttaagtgatgacattaccttgtgaaagtccttttcctggctcatcctggctcaaaaagcaccccgactgagcaccttgcgacccccactcctgcctgccagagaacaaaccccctttgactgtaattttcctttacctacccaaatcctataaaacggccccacccctatctccattcgctgactctcttttcggactcagcccgcctgcacccaggtgaaataaacagccatgttgctcacacaaagcctgtttggtggtctcttcacacggacgcgcatgaaatttggtgccgtgacttggatcaggggacttcccctaggagatcaatcccccgtcctcctgctctttgctccttgagaaagatccacctacgacctcaggtcctcagacccaccagcccaagaaacatctcaccagtttcaaatccggtaagcggcatctttttactctcttctccaacctccctcactatccctcaatctctttctcctttcaatcttggcaccacacttcaatctctcccttctcttaatttcaattcctttcattttctggtagagacaaaggagacacgttttatccgtggacccaaaactccggcgccggtcacggactgggaaggcagccttcccttggtgtttaatcactgcagggacacctctctgattatacgcccacgtttcaagggtgtcagaccacacaaggacgcctgccttggtccttcacccttaggggcaagtcccgcttttctggggaaggggcaaataccccaaccccttctctccttgtctctaccccttctctgcttttccagggacagggcaagtaaccgaaccccttgtcttcttgtctctaccccttctctgcttttctgggagggggcaagtacccctcaaccccttctccttcactcttaccaagtcccacttttctagaggagggacaagtaccccaacctcatatctctgcaccccaatcccttatttccacgccccaacctcttatatctctgtgccccaatcccttatttccgcgccccaacctcgtatctctgtgccccaatcccttatttccgtgccccgacctcttatttctgcgccccatcccttatttccatgccctgacctcttatctctgtgccccaaccccttttcccacttttctggaaggtaagaacccccgaaccccttccctctgtttctctactctctcttttctctaggcttgcttccttcactatgggaaccttccaccctccattcctccttctactcccctggcctgtgttctcaaaaacttaaaacctcttcaactcacacctgacctaaaacctaaatgccttattttcttctgcaatgccgcttgaccccaatacaaactcgacagtagttccaaatagccagaaaatggcactttgaatttttccatcctgcaatatctaaataattcttgtcgtaaaataggcaaacggtctgaggtgcctgatgtccaggcattcttttacacatcagtcccttcctagtctctgtgcccagtgcaactcatcccaaatcttccttctttccctcccatctgtcccctcagtactaaccccaagcatcgctgagtctttgttatcttccttttctacagacccacctgacctctcccttgctccccaggctgctcctcgccaggctgagctaggtcccaattcttcctccgcctctgctcctccaccctataatctttttatcacctcccctcctcacacctggtctggcttacagtttcgttccgtgactagccctccccgtcctgcccagcaatttactcttaaaaaggtggctggtgctaaaggcatagtcaaggttaatgctcctttttctttatcccaaatcagaagcgtttaggctctttctcatcaaatataaaaatccagcccagttcatgactcgtttgacagcaaccctgagacactttacagccctagaccctaaaaggtcaaaaggtcgtcttattctcaaaatacattttattacccaatctgctcccgacattaaataaaactccaaaaattaaattctggccctcaaaccccacaacaggatttaattaacctcgccttcaaggtgtgcaataatagaaaaaagttacaattccttccctccactatgagacaaaccccagccacatctccagcacacaagaacttccaaacgcctgaaccgcagtggccagaccttcctccagaacctcctcccccaggagcttgctacaagtgccagaaatctgaccaccaggccaaggaatgtctgcagcccaggattcctcctaagtcatgtcccatttgtgccagaccccactggaaatcggactgttcaacttacctggcagccactcccagagcccctggaactctggcccaaggctctctgactgactcctcctcggcttagcagctgaagactgacgctgcccgattgcctcggcagccccctagaccatcacggacgccgagcttcaggtaactctcacagtggaaggtaagcccatccccttcttaatcaatacggaggctacccgctccacattaccttcttttcaagggcctgtttcccttgcctccagaactgttgtgggtattgacggccaggcttctaaacctcttaaaactccccaactctggtgccagctgagacaatactcttataagcactcctttttagttatccccacctgcccagttcccttattaggctgagacactttaactaaattatctgcttccctgactattcctggactacagctatatctcattgccgcccttcttcccaatcaagagcctcctttgcgtcctcctcttgtatccccccaccttaacccacaagtataagatacctctactccctccttggcgaccgatcatgcaccccttaccatctcattaaaacctaatcacccttaccccactcaacgccaatatcccatcccgaagcacactttaaaaagattaaagcctgttatcactcgcctgctacagcatggccttttaaaatctataaactctacttacaattcccccattttaccagtcctaaaaccagacaagccttacaagttagttcaggatctgcgccttatcaaccaaattgttttgcctgtccaccccgtggtgccaaacccatatactctcctatcctcaatacctgcctctacaacccattattctgttctggatctcaaacatgctttctttactattcctttgcacccttaatcccagcctctcttcgctttcacttggactgaccctgacacccatcaagctcagcaaattacctaggctgtactgcctgccgcaaagcttcacagacagcccccattacttcaatcaagcccaaatttcttcctcatctgttacctatcttggcataattctcataaaaacacacgtgctctccctgccaatcgtgtccaactgatctctcaaacccaagcaccttctacaaaacaacaactcctttccttcctgggcatggttagcgcggtcagaattcttacacaagaaccaggaccacaccctgtagcctttctgtccaaacaacttgaccttactgttttagcccagccctcatgtctgcgtgcagcggctgccactgctttaatacttttaaaggccctcaaaatcacaaactgtgctcaactcactctctacagttctcataacttccaaaatctattttcttcctcatacctgacgcatatactttctgcttcccggctccttcagctgtactcactctttgttaagtcccacaattactgttgttcctgacccagacttcaatccggcctcccacattattcctgataccacacctgacccccatgactgtatctctgtgatccacctgacattcaccccatttccccaaatttccttctttcctgttcctcaccctgatcacacttgatttattgatggtggttccaccaggcctaattgccacacaccagcaaaggcaggttatgctatagtacaagccactagcctgcctcttagaacctctcatttcctttccctcgtggaaatctatcctcaaggaaataacttctcagtgttccatctgctattctactactcctcagggattattcaggccccctcctttccctacacatcaagctcgaggatttgcccccacccaggactggcaaatcagctttactcaacatgccccgagtcagaaaactaaaatacctcttagtctaggtagatactttcactggataggtacaggcctttcctacagggtctgagaaggccaccgcagtcatttcttccattctgtcagacataattcctcagtttagccttcccacctcaatacagtctgataacagatgagcctttattagtcaaatcagccaagcagtttttcaggctcttagtattcagcgaaacctttatatcccttacgatcctccatcttcaagaaaagtagaatggactaaaggtcttttaaaaacacacctcaccaagctcagccaccaacttaaaaaggactggacaatacttttcccttctcagaattcaggcctgtcctcagaatgctacagggtacagcccatttaagctcctttatagacgctccttttattaggccccagtctcattccagacaccagaccaacttagactgtgccccaaaaaacttgtcatccccactatcttctgtctagtcatactcctattcaccgttctcaactactcatacatgccctgctcttgtttacactgccggtttacactgtttttccaagccatcacagctgatatctcctggggctatccccaaactgccactcttaactcttgaagtaaataaataatctttgctggcaggactatgctgaatctccttaggcactctctaatcagatgtcctgagtcgtcccaattcttagaccttttatacctgtttttctccttctgttattctatttagtttctcaattcatccaaaaccgtatccaggccatgaccaatcattctatacgacaaatgtttcttctaacatccccacaatatcaccccttacacaagacttcccttcagcttaatctctccctctctacattcccacaccacccctaatcccgcttgaagcagccctgagaaacatcgcccattctctctccataccatccccccaaaaattttcgctgccccaacacttcaacactattttgttttatttttcttattaatataagaagacaggaatgtcaggcctctgagcccaagccaagccatcgcatcccctgtgacttgcacatatacgcccagatggcctgaagtaactgaagaatcacaaaagaagtgaatatgccctgccccgccttaactgatgacattccaccacaaaagaagtgtaaatggccggtccttgccttaagtgatgacattaccttgtgaaagtccttttcctggctcatcctggctcaaaaaacacccccactgagcaccttgcgacccccactcctgcccgccagagaacaaacccgctttgactgcaattttcctttacctacccaaatcctataaaactgccccacccctatctcccttcgctgactcttttcggattgtttctgtttgctgatgacaatcttagaggtagaaaaccctaacaacttcacagaaaactatgagaactaataattttggtaaagatacaaaaatcagtagcattttatacaccaccaacaaaaaaagcaatttaaaaacattccatgtataatagcaacacaaaatataaaatacataggagtaaatttaagcaaggagctgaaagagctgtacaatcaactataaaacactgacagaataaattaaagaagacataaataaatggaatgctatcccacatttatggattttaaaagtttatattgttaaaatgtctataatttcagaagagatctacagattcaatgcaatttctatcaaaattctagtatttttttagagaaatagaaaaaaaatcctgaaatttgtatggaaccaggaaagaccccacatagccaaagcaatattgagcaaaaataacaagcagagagtataacactccctgatattaaaatatattataatgctattgtaatagaaatagtatgatacagccataaatatagatacatctaccagtggaacaggacagaaagcccagaaataaacaaacccaagtatttgtggtcaattgattttttacagcattctcccaaacacacattgggtcaaggttagtctctttaataaatggtgttagaaaaactggatatccagaatcaaaagaatgaaattggatacttcggtcacatcatatacaaaaatcaactcaacatgggatgaaagacttacatgtaagaccccaaattgcaaagctgctagaagaaaacaggggaaaagctccatgacattggtctggacaacaattatttaaatgtgaccccaaaagcacaagcaacaaaagcaaaaatagacaaactagattgtaccaacctaaaagcttctgtaaagcaaaacaattaacagggtgaagagacaaccatagattgggagaaatatttgcaaatcataaaactgataagaggctagtatccaaaatatgtaagaaactcaaacaattaaatagcaataacctaatttaaaagtgagcaaaggatctgaacagacatttctcaacagaagagataaaaatatccaacagatatatgaaaactaatgatcaggaaaatgcaaattaaaaccacagtgagatactacctcattagtgacaaagttagaatgtctactatcaaaaagacaaatgatagcaagttttggcagggatgtggaggaacctctgtatcttctcgttgagaatgtaaattagtacagccattgtggaatatggtatgcaggctcctcaaaacactaaaactcaaattaccatatgatccagcaatcccacttttagtatatatccaaaagaagtgaaattaatatgtcaaagagatatctgcactcccatgttcatggtaacattattcataataaccaaaatatgaaataccatatgcaaacttttttttttttttttagacagagtctcgctctgtctcccaggctggagtacagtggcatgatcttggctcactgcaacctccccctccccggttcaaatgattctcgtgcctcagcctcccaagtaactgagactgcaggctcagttagccaccacgcccggctaatttttgtattttttagtagagacagggtttttccattttggccaggctggtctccgactcctgaccttcaggtcagatccacccgccttggcctcccaaagtgctgggattataggtgtaagccactgtgcctggcctctatacagccttaaaaagagattctgtcatttgacaacatgaatgcaactggctgtgagaaagggattgatggagaaagagatgtttatcggatagtacaaagtcttggactataggaataagttttattaatctttttgactgcatggtgaccagagttaataataatgtattctatacttcaaaattgcttaaaaaaagaggttttaatgttctcatgacaaaaatgaaataagtggcagaggagatggatatgttaattggcttaactgaatctttttacaatgtatgcatagatcaaatcatcatattataccccataaatataatcattttttaattaaaaattaataaattaattttttaaagatagtgactaaaaattgagaactgcaaaattgaaaatcagaagatttctcaaagcaataatagaataaaaaattgtggaataatgccttcaaaattttggaaaaaactgtcgtaatttaaatatgttcatgtatcattcagttatgagggtaaaataaggatatattcaaacaaaaggagcttactactaataaattttcagtaaaggatctaaaaggtggcttttcaggagtaaagaaaaaaactcagaagtttgatatgtaagaaaagaatagtgagtaaattaataaattaaaatatgaataaatataaaatgtcaaaagtacaaaacaataataaaatgtctatattaaaagtcgagaataaaagacaaaatgagagttaaataatgtctgattatgacatgatataaaagtaaaaagtgataaaatctagaatactgtacattttctgaattgatttgagaatatagagaatagataaaggtattgtgaaatcagtatgaatattagcatgttaatagtaactaaaagtactacacattgacaacatagcttctattattgggaaaaatgaataaatttgtaatcaattcaaaaggaggaataattaaaaacacaaaaataaagcttaaaaaatcaggagaaatagagtgtccatattaaatggaagaaacactttcagatatatcagctatcaacttaaggtaattggatgaaactcttcagttaaagaattgtcatttttcaagctccattcaaaataaaaaaatccatatgctaacatatatacatattattttatttataatgaacacaacaaaagtgtaaggttatagaacatttgaaagcaaaggaaaaatacatgccaggttaatactaatcaatgacaagctggtaggacaatagtattatcagattaaaatttaccccagggttaataatataatagatatgaagagaatttttatataatgataaaaatgacacctggaagatattgtaattcttatgtttcatgtgcttatttatgatactggcataatattcaaattattaataattataattcagacaaaagctactgacccatcccccattattttggaatttcaatacagatctttaagtaatgttaatgaaattattgtaagattgataacattttgaatatgtcactatcacaacttacttggggatatttacaaaactttgcatttggtagtttgaaaatacacattcttcttccactccaatgaaattaagcttgtgccaatccgtaaaatcatgtttaacaaatttcaagatttcatgttttacagatcacagtcactgaacaagatataataaatagaaagaaataacaaaaatgactaaaatattaggacagttaaaaatatgtttctaaagcactcatgaattaaaagagaagtcatattggaaattagaaaataaaactcaaataataaatgtaacatacaaattcatgatttaagctaattggtactaaaactaaattgttaaaatctgatgttcattgttgtggggaaaaacatgtgtgaaaatcaattatccaagcatttgaattaaagaattaaaagagaacaatgtgacacaaaaatgtaaaatgaaataaagataggagtggtaattaatgacatagaaaacaaggcacaatagggaggatcattaaagacaatggttattgtttaaatagattattaaaatctacaagctctggagagagtatttatgattatatgagaataaaaagataaaaatgataaggaaaataaggcgataaaattatagacccaataaagatttaaaacttaattgggaaatattatgaacaacattgtgatgataaatttgaagactcagaaagatacatttttacataaaaatgaaacttattattcacacttgcaaataaatagaaatctccaaaagatagaaaacttcattctaaacctagaacttgatgccatttaaaaaaaaattttgtggaagaaggcggccacgattagtcaagttaactgtaaaaatcaacttgggagaacttatcctgtctcatcattacaccagtgtggtaatcatacatgtggtattgacataaatatggacaaatagtccaagggaaggtaactgatagtcgataaaaatagataaacaggtatgaggccttaatatgtaacacagatgacactggagtctttgggacaagatgggctcttcaaggatgattcctgggaaaaggcaatcctcataagaaaaaataaattagatatctacctcctactagagacaaaatttatagttgtagttaaaaacctaaatataaaaattcaactttaaaattggtaggaataaatattagagcttattcacagggcctcttgctaaggaaatattgcttccataagacataaagaatacaaaccactaatttaaaagactgataaaattgatcatatttaaagacttctgtgactcaaataattctacaataaaatgactatacaaatcactaagagatataatctatgtaacacatattactcacaaaagattagtttccagaatatgtcaagactacaaatcaataagataaagacaaatcaatgagaaattatcaaaagatatgaaaagacaattcataaaggggaaattataaaagtcaataaaaaaggaaaaatatttaagtccactaatagagaaattaacattaaaaccatgatgagactccatttcacatctattaggttggcaataatataaaagtctgaaagtgtcaaataatggggagtaagtggaaccatggaaaattatacattttgatggtaatttaaattcattaaaaacactagggaataatttagcattatctagtaatacataaactcctagctatagacactatccttttagctatagaaattttgctcaaggagattgatacaagaatgttcacaacggtatgaattctcatacatatgacatctaaaatagtattaattatcatatacaaagtactattcctctatagaataatgaaaacattaactgtactatgttttcatgattgtctattgtatagcattgaaaatgaatgaattagacctataaatgtcaaaataaatacatctcacaaaaacatgattagacccaaaagttgcaatacaatgaatatattctgactttatctttgtgtctattaaaatttgcatatcaatattatacatggtttaaggagactatatatatttgggtgtgtgtgtgtttatattaacatatataagatatgttaataatcttaagcaaactccagaaaataattacattcagaaaaaagagaatgggatgcagttggcagtggtatctaggacaacttcaatagagcttataatgttttattttattaggtgtatattggatagatgaatgttatttatcgtttttgtggatgagaaacaatttatactgaatgttaagtaatagggagaacaatcagaccaacatgtgtgaatgtctgtttatgtggagaagctgaagaaacaattgtttgggttgataatgattactaactggaagctatggaaattgcatattaatcttcaaagtatttgaatataataaaaattacctaaacatcattcttgaacataattttaaaaataaaataataatatattattcactgtcacttatgtattttttgtgagtgtggagtgtgaaagtgcaggtgtataactttctggagtcaaaaacaaagtattaataacagtttttttaatagcagaattcttttctacaaattgttctttcctttctctaagctactgattgatttttctcatttttggtgtcctcttggtcctttaagtaacatgaaatgaattttctgtcatttctgcatcatttacacattaacctccttgtcagcctcattccactgttttgtcacatttgcattgataatgttgactgcgatagaagagagagtatccatcattttttcaggaatttaaaccaacttgggttgagaaatttattttacgtcattaaacacttcatcagataacactcataataccttgacatacttctccagaaactagacttcatgctgtttctctattctcagcaactaacaatgtaaaaatttcatacaacataataggaaatagcatcactgatgaagtgttcttgcttcaacgatggagcgcattgcctccgagttgaatcatacctttagctctaatactagcttacaggaaacaccaatgatagaaggttgggttaaacttcaccacaaggaagcaatcagccaaattgagaatgtggcacattctacaggacacataacctggattctttaaaaaataaaaggtagggtttcttaaaagcctcttcacaagtagaacaatgaaaccaatgggcagccatatttaaattggtttaaaataaattaaatattgggaaaaatcattgaggcaatcaggaaaaaagaatatggactgggtattgggtgatattaaaatatttttgttttactttgttaaatataataatggtatggtagtcatcaaaaacctttttaatcactaagagatcatacagaaatatgttcaatgtaagcttctattaaagtagctctgattctttttttttttttttttttgtgacagagtcttactctggagtgcagtggtgcgatctcggctcactgcaacctctgcttcccgagttcaagcaattattctgcctcagcctcccaagtagctgggattacaggcacccaccaccatgcccagctaaattttgtattttttagtagagacggggtttcaccacattggccaggatggtcttgatctcctgacctcgtgatccacccgcctcggcctcccaaagtgctgggacgtagtactgacttttttagttaatcttaccatctatagactatatacaaaaatattttagatcttcctaggatcttgcacaatatcatatgcatagaagacattggaaatattacatgaataaatgggaaaaataatttatagggttggtaaataaagcatttgctttaaaacgaaagacatgcatatatatctccttaaaatctgaggaataattatattctctataccagaagtccttcttatatgaaagttgggtttatcaaaacagagtgcgtacatacaaaatgaggggggtgaagattaagcaactaccaccaaaactgagtaatgctattagcttaggagtaaagtttttagatttctgtatatattatgccaagcaatatatccaaatatggcatttcctgcacctccacctgacacctgaacatcatagttagcctaataaaattttaaggaaacatttctaaatctagttatgctctttatttacctattgcctggcagtccaaagcccatctttatttatttattttttaactttcacataggaattctgatttactcaaaagaaaatttccacatatggattcagataacgttatcagctagtcatttagactaatttggaaactgaatatgttaactctaaagacccaaggtgaactaaaatcaagttcatcaccactgtttttaataatcttgtttgtacattaatattttcagtttgtttaatcatgttgctgctaagcttttgctattctattcccagtttttcgtaagcctgtctttacattagaacatccttgctacatgagtcttcaaaaaaacgtttcccacattcgcttagtccattggcattctcttccactaagataactgcaggaactaagcggatattgcaggacaaacaaagggactttcttcctgtttcccagttactatctgtgtgtgctgtttcagcaacattgggcaactggctccagcctgcagcttctttctatactcaaatctccagtttcttatatctttctgacaattggaatactaatcagactgcagactcccacccactgagatgtttctccaccacaaccccgcaccctcatgtggttctaggtaccagtcaggccctgctctttccacagaagtctaagcacctcttacgtgttgcttccccattcctctgcttccacatccaagcactgtactagtggattcccaccttactgctcttaggtttgttaattccacgtattcccacttcggctgcttcctgctgtgatgaatgtctaggttacttcagagttctttttctgctctttcaaacttccaccattaaggaaaacagattcccttgttgaaaacatttagcccatctacctgactagaactgagtcaaatatgtttcaaatgggggaatattcccacgtatttaaatctcctgttttataaaactttttcaattgatcaaagatatataataccatcatagggcaggtgacaattacagttagtttcaagccaagaaactcttctgtaagattttaagtgcaggaaaaagactgaagaaagggctatcaacaataagaaactctggagttattgggctgactcatgaaattctcaatgcaaagaaaatgctttcccgtgaacctcaatattatcacataataggggtcaacgagctgactggtgagacaaaccagtttggtgtctgcttttgctaataaagtcttatttaaatatagtcacactcattcatctatatattgtttatggctgcttttgtactattaataaaaagattgaggtgagtctctgtgtcagagaccatgtgacatggaaagcctaccatatatactctttgggactttaatagctgaagtttgccaaaatggtagacacgagattgaagggcaaatatgaccccatttatattgaacaaagttgggccccaatattgatttcacatattacctcaggtgcaacaattctcacagataaggcattgtatcatagcatccattccaggtttcatttgggggcagagacagcagcagactgtggttcagaggtagaaggcactgccataagaagctgctaacaagggaggctatgacatttgaagaaggaaaataccaataaaaatatgtttaccgcagaaaataaaagaaacattttggcctcaaagatacaacagatatgagagacattgcacaggcaacctaagatttaaactgccaaacaaatccaaatttttccatctcttttgtcataaaagattaaaacaactcaatgcaatctccaaaagaattccccatagtgtgaaaaacagccatccatctgtaagaatgagaaagcacttgttcgctgagcatgttaatagatttggcagatgaaaaaaagcggaccaagttttgaactctataccaatatcctcttagaaataaatttgcaatgtgaaaagctaaaattgcatgttgtttttagttggcattttcaatgtaattcaggagagtgttatatacatgagtgtatatatatatatatagatatatatatcacatatatgtatatatacataggcatacataaaataaaagattaggtagttctgtaaagcaatacttgaagacaggaaaaattgattcaaagggaaaggttgccctgtttataaatacagtggagccagtacaataaatggcagaccacaaactgcaggaaactcaattaactcaaggcattctcaccaagaagaaagcctattctcctagaatttaaataaaaagaattcaatgaagacaaagagaaataataaatcagtcggatctcagttctgatctgtccctggatttcaaactcaatcattcaactgactatttggtcattttacttgaatatctaatagacattactaacaagatcaaagaaaaattctttatttctatttttcaaaccttctcctcctatagactttctcatcttagttcacaccaccttccttcagttgctcaaggccaaaatctacaagtcatttatcttgtctcttcaatcctatcaataattcatcagcccacactgcctacctttatctttgagtctgtgtcatcttcagtctcttcctccacctctgcctcaatggcccagttattttctcttacctgaactgatgtgaacacctccttccaggccttcctgcttctgtttctgtccctcgtcaattcactctccacgtggtggtcagagtgaccattttaaaatgtaagttagctcatgccactttcccaccagaatccccaaatagcttccctttgtaagaatacaaggcagaaatttgaaggcagtggtgatatagattttaatttttgtaggtattcctttaggacaactaggagagaaaaacctccaaccctcatacaaaatagctacaataaaactcgccacaaacctcaaaatatgatcagatggtgaaaaaatactaagtgctaaagacccagacagataagcatttgtgcagaaggaagcacaagatccgacagacctgaatattgaaacctcctcaaacagttaagacgtccccactggaacacttggtggcgccaatttgaggacacccgctgaaatcgagcagggtttattcagtgcagtccaattcagaggtgagcgccagggtaccaaagtgaaagtttcaaccactcattgttcacttcagggcaaggccccatactgagcagaaactgcaggatacagaatccagtcatgtatggaagaaacccaggaggaaaatcagataagataaggagggagccagactgtctgaaactacaagattgttaaacatttcaaaaaatggcaagagagttcaagaaaagccactctgacctaccctaccccaataacgtttgagaattcttcaatgagctaactaaaaaaatgaaaataaaagaaaaaaaaaatcatgaggagaaaagcaaaggggaaaccatttagattaagagaacatttagaaatatgccaataagtcccaatatgtgaatattatttggatgctgagtataacaacaacaaaaaacaccaacaacaaacctttaaaatgttatgacgcaatagaaaacagcaacgtctggagatttgtggatttaaaaagaaattattttgtgtagatgatactgttattttggttattaaaaaaagaatccagtctatcattgttggacaaatgatgagttcatgccctttatagggacatggatgaagctggaaaccatcattctcagcaaactatctcaaggacaaaaaaccaaacaccgcatgttctgactcataggtaggtgggaattgaacaatgagaacacatggacacaggaaggggaacatcacacaccggggcctgttgtggggtggggggaggggggagggatagcatttggagatatacctaatgttaaatgacgagttactgggtgcagcacaccaacatggcacgtgtatacatacgtaactaacctgcacgttgtgcacatgtaccctaaaacttaaagtataataaaaaaaagagtctatactatataagaaaacatactaaaatatttacagaaataatgacaaaatatctgtgatttcctacaaaataaaaagagggattgaatgggatcatagatgaaataagtttgcctgttttgaaaattctttaaaataatgatacatgaggtttcattgtactgtcctgtctttgaacatgcttgaaatcttacaagataaattattttttaaatataacaaactgaaaattaatcttcaatttataatttcttactcaattagttcctgtcatactttgaaacaactttctccatgaaattcaccatctccaactacactcaccttcttcctattcctcatcttgattctatcctggggcctttgcaccagctttctatttttctcagagtgattttctcccactctcagcaggctgccttcttttgatgattaatatctcagattaaatatcactttttaaagaggccttccctgacctcttaatttaaacaaattttgcaagttttcttatcatgacactctaaatgattttcatgacaacttcactattatataaaacaatctctttaaaatgtaggtattggttccttgtctttttcatgatagtaacatataaccttctggagagcagagattagtgtgtcctgtttatgttacatctacagaatttagattagcatttcacacatagtccttgtggcacttatttaattaaatcaaaaccatatattcatttgtatcacatgttgtcataaattttaccttctctgctgtaagcattacctctgcacttactttttatcctgttggcatttggctgatatatctttgagggatagaaatactggaattaagtaacacatattaaaaaaaaacttaatgaagagaaaaatatttataaggctaaaaaagatataaacacttgtagtgagatagacacccaaatggtgggtaaaataatggatatgttagaattacaaggatagaaaaattctagcttaaaatgttttcttatttagcaaaacacaaacaaaatatataacaaaatacgtatctataaggaagggaattccaagaggctgccgttaagtttctaagttgccaatattaatgataataataataataatgagggtaagtggacaatagctaaagaattataaggaaatgaattttttccttagattactaaatccagtgatgttggtcaaggaaagaaaaagattcttagacatgtagagattcagaactagaaacctgcatatacatctatctgataaaaaaaagaaactatatgtaagaaaattaatatttttgagaaatataagccacataatgtacatttttctcagcaatttttgtaagatattcatgaagtactgcatcacatcttgaaagataagtaaaacattttaaaacatgttaatctagatatacgtgtctataatatttcactaacaattggaagttaagaaaagacaataggaaagtctttggatgctaaatttctaacttttaaggactattaatgtagatattaacacataatgtagcaacattaaaaagaaaacacatttaataactcttatctttggcacaataaacaatgaactatattacctttatatattgcaaaaaatatgcttgattaaatcatgtataggtgttaaaaataaatacttaggagaacgtcagagaatcttttatatggtaaaagaagattatcttttttgaaatatatacacatatatacttttttctttcttggaaaaatgaaaccacaatatgtttcaaaatataggagagcaatagcctattctgtgaccacattgaacatatagcaagtgattaaaaataactaggccgggcatggtggctcacacctgtaatcccagcacttcgggaggccgaggtgggtggatcacttgaggttgggagttcgagaccagcctaaccaacatggagaaaccccatctctactaaaaatacaaaattagcctggcgtggtgatgcatgcctgtaatcctagctacttgggaggctgaggcaggagaattgcttgaacccgggaggcagagtttgcagtgagccaagatcacacagttgcactccagtctgggcaacaagagtgaaaatccaactcaaaaaaaaaaaaaaaaaagaaagaaagaaaagaaaataacaagatttaaagctattctgtatagctcttggtttagaatgaaaataacttgccattataagttgtttagaaaataacaaggtaacactacatactaaatattagatatgatgaagttttgctcagaacaatgttcatggctgtggaagtatttacatttcaaaattcattaaaaaaactgaatttattgcatattaaactctgtgaaaaaacaaccagtaagtgaacccagagaaatcaagtggaagaaagacttggaaaaatatttaaattagggagaaaaagaaaatgaataggaattactgaatgcaagagctcagatattgcaaaggccacaaaatataccatcattagcatactaaaaaagcaaatgataattcattgtatgcaggagtagtaaacaaaaagaaagagaaagaggaggcagtgggggaggaagaaaaggagaaggagtagaaggagaacgagaacaagaagaagtcattgtattatcaatcttataaagaacattgtataagaaagttcctacaattttatgataatacaaaaatatcaataatatggacagtgttttataataatttaaattttcaaatttaaaaataaactgcaaaaactatagaatatatatattttaatttcttaaataacttcttcagttgtattattgtgttctattttaagaaatagttatttaattttttaaagaacacaaacattctttttttttttttctttttttttgagacggagtctcgctctgtcgcccaggctggagtgcagtggcgggatctgggctcactgcaagctccgcctcccgggttcacgccattctcctgcctcagcctcccaagtagctgggactacaggcgcccgccaccacgcccggctaattttttgtatttttagtagagacggggtttcaccgttttagccgggatggtctcgatctcctgacctcgtgatccgcccgcctcggcctcccaaagtgacaaacattctttatacataaaccaaaaacattaaagaataaaaacttctccactaattttaacaattctagaaaagacctaaagtaaaattatttaaaactttaatttctgttaacatagcagaccagataaagtaaaatgaatttctccaaaacatatacactaaaataaataaaagagatattatattaagcctagtgctgaagcgtacaataaaggcaatgaattccccaaggtaacagaaagtgaaactatactttaaatacacattgacactttatttgccatgttgggtttttgtttgttttgttttgctctagtcatcatgatagccaaaggacttcaaaattgtttggattttaatgactaccaaattcaggaataatgtcttagaactaccagggtaaggaataagattttgagttacatgagcttgaacactgtaaaacttgtaaatagttggaatgtgaaaaaaaatgaagtttcaattagaaaattaggaggaaggctaaaagataattaaagtagaaagagttatttcccttctcctagattctggatagaaatataaagtttctctgaagagctaacaatctttgatctgttggcatattgatttggagactgaatttatgcaacccacatggtcttggaatcctcattcctataaagaacaaagcagttccaggttaaagtatcccaggatacttcacaaaagcaaaataaaatttttgtgtgggagacacattctaacaaataattgggccaagcatcaacttaaaataaaaaatatcaaagcacatgagaaaaatgatcattgtaaatacaagacagtaggaccaaaaaatagtaacatagaattaaaaaaaatagataaccagattaaaatataacctaaaaacatgcataaaattcttaagataggaagaaggctcaaaacataacaacacaaaaaagtccagcacaattggaaaaatgaaataagagaacatttagaactgaaaaatataataactaaaattatagacaaatgtcttaaagaacagaagacaaataaattgaaagacagatgtgaataaattacccacagtgcagcacaatcagctgaagagattaaaaaaatataaaagacaaggaaagaaaatacaaatcttattacaattcaagaaaaaaagagaatacaaggaagagaaaaatgcaaaaatgtatggcttcacatttctcaaaattgttgaaaggcatgaatccttagacacagacatcacaggaagatgtaagcaggataaaaaagtgaaatctaaacctaacacattggagtgaaccttcagaacatcaaaataatgagtgatattaaaaggtggaaacaaatcacttacctgaaaacagacaactggactatttaaaatactggctgaaactagttggcaacctagaatttatgttcagcaaaaccactgtataaaaaccattacagaaccaaataaaatacaataacatcttcaggcaggtaaaaatcaaaacccactaacacaaccttgctaaagtttctcctgtaagatattatttagggagaataaaattgaatccattagtaaggattgttaatggaagttgaaatttatgcaaacataatttgggtattatacattaacactttaaaaatggatttttactttatcttttgcaccaagaatttctcatctatatataattttgttgaagttgtgtgcaaatgttttttgacaagaacattttatttgttcatattgaaatcagaaatatgtctgacccttaacaagaatggacttgtgaaatataccatgcaatattgaagtagtatgcaattattaataattttactataaaaatacatctgtataaaagcatagataggtgtctaaggtacattgatatttcaaaaacagctcacactgttatatacagtttgaatataattttgttgaaatattattaaagatatagccttaagatattaagattgttatctctggcagtgaattgtgaatacttttaaattgccttctgtacttggcaatattttaaaattgtttctacactaagcttttgcttttgtacttagaataaaattattaaaaataaaggctgtcttttggtataaacatggtctcagtttttgagttagaagacacaaaatttaaacaaggaattgagaagcaagaagtggctatttggattggctcatgagtgaaaggaagtacagtaattccctgttttttgttttgttttgttttgttttgagatggagtcttgctctgttgcccaggctagagtgcagtggcaggatcttggctcactgcaacctctgcctcccgggttcaagggttcaagcaatttccctgcctcaggctgccgagtagctgggactacaggtgtgtgtcaccacacctggctatttttttttttttttttttgtattttattagaaacagggtttcaattgttggccaggatggtctccatctactgacctcgtgatccgcccgcctcggcctcccaaagtgctggtgttacaagtatgagccaccgcgcctggccaataattccctcttatcacaggttcactttccaaggtttcagttacccaggtcaaccaaagtgcgaaaatattaaataaaagattccagaaataaacagttcattagttttaaattgcacactgttatgagtagggtgacaaagtctctctcactcctgtgctgtcctaccccatcctacttggtccttaagatttcctgtgtccagggtctccatggtgtctatgctacctgcccttagttgcttagtagctgtcttattgcagtgcttgtgttcaagtaacccttatttaacttactaatggccctagagtgcaagagtagtgatgctggcaatttgacatgctgaagtaaagctggaaattactttctttaagtaaaaaggtggacgtttttgactgcagaagaaaaaaaaattgtatgctaaagttgctaaaatctatggtaagaacaaactttctatctgtgaaataatgaagaaagaaaaagaaatgtgtgcatagtatacatagaatttaggaatgcccatagtttcaggcatcgactgggggttgtgaaaagtagcctgcaagtgcaaggagggactactgtactgagagattttctacattgaacctttaatcttacatgtgtaatttagaaaatgtgtgaggcaggaggatggataatagaggaggtgaaaattaccctgggaaatctggggctatttctaaggcaaccaggagccttctgactaacctcaagatgtgattagatatccagaggtctgcaatgtaatcatatgaaaactgacttttagtaaatgttaacttgagtgactaccactgtttacttctatttgtttatgtttttctttcaagtggaatttaaactggctctttattttcttgaataaccaagaaagaatttaagccaccagtttctactgagattataagtggagtataaggtgacaaaatatgtagtctcttattaccctatttctttaaaatgaccattttaatacatctctaggcatgggcaatatactgaaaattcttgaaagtaagagtaattttatcttttatattgcttctgcaattaataaatctgtaataggttttcaatattatcccaaacattttattgatttttcaggtgagaatcacttatgaaaggtttaagcaaggagggattttttttttttacagaaatggagtataataagcttttttttttgaggtaatttctgctagatagagataaagcatacataaatcagagaactcagatgaccacaatcatcctaccaaagtaccttgaaagaaaggatcagtcgagccagtttgattgctgtcctttatggcccatgcccacagaacggctttgtgggtctctgatccaatgtcttcacaagctttaatatatgcaggcaacacctcctgatcaggtacattttgttgctggacggaacgcatggccattttacactcatggttcgcattctcaaaagctaacatacgagggagaatttcttgagcatgctcatccgagacagatttttcaaccccgtcttgtaatttagctaaaaaatcagggtataattcattgtgaccttgtttaacagtaggagcttggcctggggtgcgtaatttatcccaagctctcatacacacctttgttacttgttccgtggtaacagcatcaaagcctaattgggcataaatatcagagaagtcatcggagcctgtgagctgagcctgagtaattagaatgccatcagcccgatttagctgagcctgcagacgggcctcctctgaccaccaggtacggaattgtaaatgctgagatggggttagaacagcttttgccaaaaggtcccagtctaaaggaagcaaaatgacctcagtacaaaaagtctgtaataccattttaacacaaggagaagtaggaccatactgagtacaagcatccttgaattcttttaaaaaggtaagattgagcggcgcatagcgacgcatttgtacaccttgagcattatgaggttctagcgtgaccggacaagcccatgcctctaatccacttgtttccttgtgttggcgtaataagagttgcattgaagtttcaagagtaggcacctgagacggagtcagcatagaagtgacaggaaaagcatgtgtagataagggaaactaaggttgaggaggtcggaccggtatgagagtgtgagaaaggggcattgggggagcagaagaggcagaagtgcactggtgattactggtatccatgtgtgaagaagggtacagagaagcagcctgagtggatggcaaagtgaccggttgaggaactgaaacgacaggagggcgaggggctgcagaggagggggaagggcctgcagaattataggtgaattgtagtttggccccggagccattagctgactccagaggcaaatgctgcaaaggtttgaagagggaagaattagcatatatatggcccagggctgtcctattcggggccgcggaagctgcaagtagcggctcttcgggaaataaaataagatcaccagggggtaatgttaagccaaagtcaccagaattagatattgaattctcaacatcatcaggtgggggaggagtaggcgaagggagaggctgatcagataacgaaggccccgtgggagaagaaagctgaggaagaggtagagggtctccagattcagaaaactgtagtaactgcagggggtcacgggattgctatgtcatcaggatggcacgtaccaaggcccaatcaccccacacagtgatgggaacataattccctgtagggaccagttcctggaattttgcaccaacactatcccattgttctacacttaaggttcctttttcaggaaaccaaggacagtgttcttccactgccctgaatacggtaacatattttccatcggtacccgaatacctccttgttttaacaggagtttaatatagcagagatgagcatgatgtttagactccctgtgacccgtagttaacccagacagtacacagactactcaccagttgtcagggagtagaacaatcatttctgtggaccagacagacgaacatttctctgcacctaccagagggaatcaggttcccacatgcacttaggaaaaagaaaaaccatgttggcatgccagatatcaggggaaccagcccccaatatttcaacgtaggttctttctattttccctaagtgtcggccagtctgagaaataaaaagaaagagtacaaagagagaaattttacagctgggcctccgggggtgtcatcacatattggtaggaccatgatggtgaccccgagctgcaaaaccagcaagtttttattagggattttaaaaggggagggggtgtatgaacagcgagtaagtcacaaagatcacgtgctccaaagggcaataaagatcacgaggcaaggcaaaattagaattactgatgagggtctatgtcccgctgtgcatgcattgtcttgataaacatcttaacaggaaacagggttcaagagcagacaaccagtctgactacaatttaccaggctggaatttcccaatcctggtaagcctgagggtactgcaggagaccagggcgtatttcagtacttatctcaactgcataagacagacactcccagagcagccgtctatagacctaaccccaggaatgcattccttccccagggtctcaattattaatattccttgctgggaaaagaattcagtgatatttctcctacttgcatgtccgtttataggttccctgcaagaagaaaaatatggctctattctgctcgaccccgcaggcagtcagaccttatggttatcttcccttgttccctgaaaatcgctgttatcctgttctttttcagggtgcactggtttcatattgttcaaacacatgtttgacaattagatttcatattgttcgaacacacatgttctacaatcaatttgtgcaatagtggtcctgaggtgacacacattctcagcttacgaagataacaggattaagagattaaagtaaagacaggcctaagaaattataaaagtattaatttggggaactgataaatgtacatgaaatcttcacaatttatgttcttctgccttgcctccagccggtccctccgttcggggtccctgacttccctcaacagaaagcaaaacacaagtcctaagtataacaaagtggaacttggtagcaagatgattttttagactcattggaaaatttcgcctgttgaatcatgtaggacaaagtatatagattgacaattatgtgagaaattcttcaaaataaaatattatagcttacttcaaatttttgatatctatagacttccttgacactttacaacatgaaggacagatggattttgctttccacctagacctaaattcaacatttgtgctttccatactagagatctctatgtaacaatcatctgtttttcctattcccccagtttatctgcttcagtctagctttccaaccagatcttcttcagtgttgtacttcctgaaccttgtctgcttggggagtgttctttttgactaggtatgtcctccctgaaaatcagtgctcccttgactgaaagcagagatacataggactggagcaaaatgggtttaggcacttgcatttggataactcaatttaagagtcttgccttgcttgatttgtagtgtcaacgtttaggagccttatacctttcatttaagtagggattatttctctttgtttggaattaatatactgaattctgaatgaacaaccaaaggtggtgtaattaaacgcaataaatcatagtatttgagtttgaaaaaaaaaaagaaaattcaaaaagaacttacataatatagtcaacctataacactaaatttatcctctaatatctttaacagaaatataagaactcactcaaattgaacatttaaacattgtatgtagagaaacatataagaataaagaacccaatgatttattgaatatataattactgcagtaataaaatcattgcagtttaagaagggttagtcataaaagcttactggttatttttagcaaactaatattttagatttctcattttctaaccacaatgaacataatcaactatgcttcatatccttttgcttgtgtgtagcccgacaagctaacatttgttcacattatagggagaaatccagtgactaaaaacagtcatccagagcctgacaagattcagcactctttatttttccatattgtaaggactcttacttttatttttttccattttttcccaaatacagtttctttctactcccccatacactcaaacaacctccctttctgttttcaaaagcaatcaatatttttacatatataatttgtccatttcaagtaagaagtgtacaactcaatgatgttgtagtaaatttaccaagttgtgcaacaatcaatatcaatcactttaagcatattcttgacatgaacataaactgttaatacacacacagacatatacacacacacatgcacacatccctgccccaggccaactacttcctgtcttcatagatttgccttttctggacatgtcatataaatgggatcaataatatgtgattcatattttgagtaactttcactgagcatgatagttatgaagtttatccattttacagcatgttttcataagtttattccttttaattgctaaatggtattcttttgtatggtttatgaatcattcattagttgatggacattagatttatttttgactattttgacatatgttttcaaatatctataattgtaattaacaaaaaggaaaatagaaaatagtttttgaaatataaaattttagaaaaatagatagcaaaaagtcacaggatttttgctgtaaaacttagaacaggtatttaaatattatctcttacatgttttatgaatatatggtatatacctctatttttacttataaaaattgaagaaatccattatttattatatctaatatccagtgattattttacccccaggttaacatttactcaagtgccatccttgtttcttacttttcttttttttccccaaaacctatctgctccatatgggcatggcaaatatctaaaaactttttgttcctctgtgttagaaatgaccaataaataaataaaattgtcaaataaacatttatttatgcacttaaattcgtgcaacaaataaaatcagctgatttaatttttttaaggtttaattatataagaaattcacaaattgtatacacacaaatatatatggacagctttttatggtttatttttaatctcataagagacttcatttactcagacatcctaaaaacatttatgggtcctggacctgctctaggtgctggagcttatttctgctttaagatttcaatagttcattggctttatttgtcctcctgctgtttgaggagatggaattcctgtattatagaataacttggtctccatctgcaaaattcaagcatcacagtgaatgtgcactgcaaattactatcaaaatatatagcttatttcacaagtaaataactatttcccaagtacactaaatttagaaatttatgctataacaagaattaaatttgttgtcttcaggaaatctgcctcttcatcacactgacttcatttatttctataaggccagagcttttgtcaaatgctgtcactactagaaattggtagatttttttgtagagacgtcaccactgagagtaaggctcatttcatgccacgttgtttgggaaaaaaagccaaacttccaaactttaatacattttactttgggcttacaaacattgagtgctaatactgacataatatcgagaaaaaaaagacaatgccaaaactcagaaaagtatctacttttttcacaaaggaaaatgatatactcattattagcatcagtgcagctgataagccactaattcattttttattatttgctgagatttaagagttgacggggacacatagtttctttcagtcatgcttgcttattattaatgcccaagatcttccaatgatggatggagcatgcaacagtgctgaggtatcattatacaaagttatttctgagactattttgctaaagcataattgctgaatctactaaaattgagtctatcaaggtgaatgaatgatcatccctgaatgcaatagacatgtttctgggaagaggaaagcagcaagccttagagattaagaacaaacattatggagacatgctacttgatttgttattcattaatcatttgagagcccgagacaagttattcaaatttttaggcatccatttttcacctttcaaaaaataggaataataatggcatggagattctttaaagatcaagtgaaaaaatcttataaagctgagtagaccatatacatttttgttctaatcaggatactttgtgaaagggagcaattaataattatgctgcgataacatatgtaaaccaagatgtccaaagctagccaggcatgggattactctatgcagaacacacctggcatagtactcacaacctagagagtgttaatgtaagaaaagattaccattattttaatttgtgtatatccagccaatttttgaaggttcatcactttcaaaaaatgttatgaagaatccacaatttcaatgaatccaactcatccagttatctatacaatgtatgctctcttttgttagtggtatacctaccacccccatccccactctaacttccatcttctcttttcttgaatttcttgagtctactttcttccttttccttctgctgcttctaaatttgtcatgcacagacactgcttcattgacgttgatttattagtttaaaaagagtgttgatctttctctaagaatttgttaaggtacaattttctcccagttgagtaagtttcctcacattgcagtttgggagcaaaaatttcttccttgggtgttaagaatctttactgaaggtatctaagagcaattaagataaaaattcaacccaaccactgtcccaggaaattttctcttaggcatagctatcaaataaccatttatgcaagtcatgtttgttgtgcctactgtactacaaatactaagagagatactgaagatagagcaatgaagagagatttctgccccttggagcttacttcctataaacaaattcaaatgataacaaaatcatttagagaatcgtaaaaaagagctagccaatgatataagtctgcttcatttcaaatgaaatgtggcttacatacatagaattacatacatatcatattacatatatatcactacatatcactattctgggtaacttactcctctcttccatgcttcgtttctactctttagatctgactggaactgaaatgtgaagatattctgggttaattggtctaggatgtattgtatctgaagagtgtatattaataggataacctacgtgtatgctgaggtaacacataaccctctgagtctcaatgccctaacacataaatacctatgctttgctcgtggaaactgtgctactggttgggcagatctctaggatagctttcatgtagtgactcagtgatccaggatatttctgtcttatgaaaataccatcactattctggccttcacaatcatcattcgaaaggaaggtaggagctataagattggaaaatggttttttttggaagcttcagtccagattgatttcacatctcttgtgcttagaactcatcagtagtttccagagagcgggaatacatggggaaccatctagatattcaaccaacagaaaatctatcatccacgtgattcttcaagtttctcaaatgactttgtaaatgatttagaaaattatcacatagattgctaacgggagacatactacagttaaactcagtctggaacttgggcaaaaattgagatgaagggtgatagtgagaatttcaaaagatttgctttattcaagattgaagaaagcaatttgagaaaataaattattgaagccatgagttcaataatataaagggaaatattataatagtcattttaaagaattcagaaataagctacataaggttttcaaatactttactaattttctaggtcactaaagtaatttcacgcttctgatgcatacttcctaatcagactgaagcatttcttttgtaactcactttcttagactcaagtccactgagaaatatcttgacagtgctgaaaatacatatatttttataaaggacaatatttatcttggtagaaaaacaaaatctccacattgaaaaaatatctttgacatctctgatagagccaaatattgcattcacttcactgatgcatggtatttgtgtcagtggaggagagcctttttctaccaacatttcttgttctctgacaatctgagaacatataatttaatttggctttatacagcagtctacagtcattcaatgcagaaccctgagtgtttggaatgattttaaagcaaaccttgaaaaaagaaacacagtagatctacgtatctgtgtacgggctatgtgtgtgcagaggtactgtttggaagataatgacgagaggatgaataagacaagaaatggagttttaacaacaagctctcatgtctagataaaagaattagttttttgggggaatagggagaaaaacaaatgcgaaaggcaaattaggaatgcaacatttcatttaatgcttccaacagctctattatcctaaattttgttttacatgagagtaaatatctggatttgaaagacaaaactatatctaatgatttttatcctcagcttttcattgttataaagatgacatcagtacgaacatgttttcaatgaatctgaactgcacttagacaagaacatagcataataaattacctcttcccaaacaaaggataaatagtgttgcacttctcattttaaggcaataacaaagtattaagataagacatattaattgttatgcttcacatttaaaaacacatatctaaaatttgactgctctggaataccacaaagtttgaatttacaatgtagataggtattatttacacacatagatgatttttatgccatgaaatatataaaactgaaatagttcagaaaataagaaatggctttggtgcaaataaattatcacaaataaagcagcataaatgttattgtacaaccagggattcagaatggctaactggactttcgtaatttgaagtttgactgtagtccaatttccctaggtagatgacattagccaatcgcttttctaccatctggtaaaaacaaacaagtgagatgatatttaaggttaccgtctttttgagaaagataagcaatgatttagaccactgtgtggtgacctcccattgcaatgtgggatcttcaagtgtaataacttatcataaatctgatttaaattaatgtctggaaattattctgaatgttattttgtaattttgcagaaatttataatatcattattagcaattacttcctaggttgccactgctattgttgttttagaagacatagacatgaacaatgtttacatgtttatatataaatattattctacccagtatgtattactttatgaatgattaaatattagaaaacttcttttaacaacatttatactaacagctagatatattaaacaatcaagtttcataaatggcaaccacacaaacatttcctgagtaaaattattaaattgagttcaatatgtactgtttaaatctaatactatatgtaagtcagattatgaccttagtgcaacatcaagtacattaagaatatttgtatagcataaaattaaaaataatgagttctaatgttacatgatcctacatttttgtcttttgttattcttttaattatcttacttcaagaaaacctacatgttgcagaattcaccagatgtaaacatatatatgtgtgtgtatagatatacatattatacacatatataatcatatatatacacacataaatactatatatactatatatacacacacatatatataatatatatacacaatagatatacacacacacatacacatatatataatctttgaaatgatatattttggacatgcacacaccatttctgcaatctgcatatgtgtggctcagaaagtctgatattaggcaattggatgttaatattctaaagctctgctattcaccataaatttttttcctcatgggactgcctgctcaccaagttaaaaaataaattacagaacatcatgcaaataaaaagcttctcccaaaaaatatgggacaataaactgaaggagaggcaaaactaagaaattccacaatatataatgagtgagaaataatgaagcttgaaaatactatatgtgttattttatctctgcaagtgattcagcaggctctgatttcctcaaggcttttatttatttaggacacgtcaagttttacacatatctcctccaagagtcagaaaatgatgagactctataataaaaattactggcatggctcaatgtgttaagaacaaagaaaaatgattaggatcaattcaaatatgcaaaaaaaagttttattttttttctaacactgaatgcctaaattaatttccatagtgggaaccaatcatgaaaggaaatagatcagttgacgcaagaaaaatacataagcaaatgaacaagccaaaaaaaagttcctttgtgttcagcttcagtctcacagagagagagagagagagagagagagagagaaatttaattcataattcagtcttttaacttgagtttggcatgctttttatatctttacactaaagtatatcaactttcctattgaactccatttaattaaataatatttcttcctcttttctggcttacagccttaattacgtaaaaacagaggaaaccccaactgaactatgtagaaaactaaatgacaatgttgctatatttcccccatgtttatgtattcaactgtatttttgtgggactatgcctttgcaaataacagtgatgttaagaacctaaaatagcaaagattcataaaaccaatatataatcttggccttaactatcatttttaacacagagagaaagaaggaaaaaaatcgcttttttgagtgacattttaataaaaaggaggttttttctcttttaaaaattcttaatttatatcattttatttctttgctttttaaattttgttttcacatcagaagttaatatttgttatattaatgcatattggatggcactacaaatgatttccatgacatatacactagtattccatttaaactcaaaaggcataactacacaaacataaggcttctcccattatccttggccttgacagtaagtgacagaattcctagctcatcttcctgggacgttgggaggatataagaaaatatcacactttacatgccattgcaaggatggttagacagtggaaataaggaaaatgcagaagttggtgagccaaggaaatgtttccactatgggctaatgtagacagcgtaagaagctaaggatcagtaatgtgtgtttgtgagtgaagtagtgatctactcatttttctagtcatagccttggggatgtctaacttcaaggaaaataaagccatagagattagaaaaggaaaaaaatttaatcataggaggaatggacaagctcaattctgagtcctatatctggagcaactggggcaaaaaaacaaagagatccaaaaacattaggacgacgatgaagaaaggagcaaagagactgatagaatgtggaagtggcctggggcttatacagagcaacaagaacaggaaccaagttaaatacacacaggacaatgtcaaaacagaatcaaaatgacatgactttctctaggctgtgacactgaagacacagacaaagcggtattttagcccccctcccgccaaattcaagacaaaattggttgtaaattttggcacagagcagcacgagttcagaagttttaaagaaaacttactgtcaatgagccaatttttgtgctaaatgaaagttttcaacaaggtaaggtggatgtctcttggtatcaaagtcacatcatcacaccagatgattcatgctacttctgtaacttcttgtcaacctttgattaaattggcaatattggagtcattctcaatatttccagtccttgaagggaataataatatttttgattcagttttgtattcctctagccatcagcatgatgtgcgtcgcgtgttttccagacaatggagcatggcagcaagatattctgtggaatatggtgtttggggctgtgatgtagtccatgatatccatcttcttcaggtcaatacttaacattgtgctgacttttcaaaaccgtgtctgtggtcccacgtgcactgcagatatgtcttcaggaaacaggaataagcatacagagatgtgtagctttcacagcattctgagcctagttaagcaggacatgttttgaaaaagcatcaagtgtgtcagttgcttctttctctatttttgaatcatagttccataaaagtcataaaaataaattactatttttaattgagatggaaaactgattgaaaaagatccaaaatgatttccagtgccaacatggatagactgtagtagaattttcttctaaaatttttggccacacacatctgctggagttctagctgtcttagtggatcacaagcttctgtcttcacaaaagaaatccatatttaggacgtcatctgtgaaataattgtccttcgttcttagatgatgtttaaagattttgtaaacactctttctataattgtatatgacatctgatgaaaaagatattctagaaaggtttccatcacagatagaggtgcacatgagtacagtccttactagggccaactttctcacttttgtcattggagtgtgtgaagactggcatgcatttgatagaccacgcattgttgttagtctcctacctttttccatcctaaacgctcaagtcaaacctcctttgtcattaggataattacactaaggcaataaaagtaaacgaggaccatcttgttctgtgctaataagtttaccatttttaagatgcttcttagcatggtcgttgttatctaattgtgctttttgtctccacaattaaaaccaaagtgcatgcattctcttatgtccttagtgtgtgcatgtgatttgagaaatatatcaaaatataaacaaatttaacctcaccactagaaaatttagataccattcctaatttattgaatttgaaaaacagttgtgcatcataaaaatttcatttgaagttagtaacagagccctaaatttagtaataagtaagggattgcatattacacacacacataaatgtgtgtgcacatatgtgtaaatatatatgcgttgaatatatatatatatatatactatgtatgtgtatatatatatatgcagtatgtgtgtatatatagacatatactagactgaccatacatatatatataagttctgggtcatgtacatatgtgcactttatatatatagggtagaagtgaaataaatgcattttctgcaataagatattaaaataactgttacagtctcaagaaaattaatttatgaaattcttatttgtttacccccactcaattatttttttcaaagcacactgtacctttatgttgtaaaactaacttgccttgattattgtttatttaaaacttgatgacatagtccaataaaggaatacattataaataatattctaagagacagaccaaaaattggagaaagttatacatttatatttaagcatcactaaatatgacaaattaataaagaaatatatacaggaatttcatgttgaggttatggggtataaagcaaggagaagtagagaaaagctttggaaggtgttctaggtttctgtatcatttattgtatcttctctttgcctctagtgtgatatatttcaccctgtgcaatgagaggaaaaaagttctgcatccagcatcccaaagctacgtataatggtgattccattacaacagagactatttaagaaagacaggttcccttcatgggaaatcaattctttaaactcactttatatggatttctctcatcctacaagtgaaatatgcgttgtaaagagaaatgggaagtgacataggggtcttgtcaggtcattcctggaaaggtttgatggtattaatggagtcctagggggttgatttagaaacacctggaagtggaagaacaaagtatacgaaagttttcagcaagatcaaaggaaaatcaagcattcaatccctgcaagatgtgcacatcactggcttttttcaggagagggttgcattcctttgggttcaaagatatttacccaccattatttttttctacttttcagagagcagctgagaattacattatgcaaagccaaggatttgtgaaaggtcctggaatttatttttaattcttcctctggctttgggaaggttgctatactgtcttcatgtacaaatacttctccctcccattcccatgcttaatatttttttatcctctaaatatactgaaaacacttatgtgatatgtcatagtttcttgttttcatttctaaaatttttattttatttattcttcctcagtttagatgtcacttactcaaatgtctgtttttctcagatgtttgtcttttctggtcacccaagcgttagtgctttcataggattttgagcccaaaacagctgtagcttttctcacatacttttaaatactctgttacatggctgtcttgtaattttcatatggctcctggtatgcacttaacagacattcagggaataaattaatttaaaatactcatttaaatttaattgcataaatcacatgaatcaataaactagtaaatgatctgatagctaatttccaagatagccctcaatgatccttggcttttgatattcacactatctgtaggttccttccacactgtaccaaaattggtctacatgacccacagaatattataaaaatgatgatatggcacatttgagattagaaatgactgcagcttccatcttggtaatcccctctctctcttctctctctctccctctaaccactctttgtcatcacttactgttttgaaagaaatattataagcagtcttaccaatggcccagttgtgacaagaacaagtctcctgaaaaaaacacatgcatggtcttggagtcaactctgcaaccccagttaagtactcaaagacagtagtatccctgatggaaagttagacagctcgaatcacatagctaaatagcccttagattcttaagcctcagaaacaaatgttttttaagccggccaggtgcagtggctcacgcctgtaatcccagcactttgggaggccaaggcgggcggatcatgaggtcaggagttcgagacctgcctgagcaacatggtgaaaccctgtctctactaaaaatacaaaaatttgccaggcgtagtggcgcacgcctgtaatcccagctactcaggaggctgaggcaggagaattgcttgaacccaggaggcagaggttgcagtgagccaagatcgcgccactgcactccagtctgggtgacagagcgagactctgtctcaaaaaaaaaaacaaaacaaaacaaatgtttttaagcctcagaaacaaataaaataagtgttgtttcaagcactaaattttgggataatacagatgacgtaagggaaaaaaatggaaattagaaagttcatgacataaaatgtcattttaaagcagttggtatgatttgactgttttctttacttggaatttgatatctggatttagaagcataagataacaatgatagggccaaaattttgaaattctgtaacagatagatagatagatagatagatagagaaatgtcccatcaaatttaaaactaaaactttttccattgatgtacctgggcctatgtatttgtgacagtcagactctgacacaataagcaatgctacctcagtattcacaacggtaagtcccatctagtaaaactatacaaaatctttccaaccctatttttcctcttatcatcaaaagaaagttttcattgtgcattataataagaaagaagaattatgctgatgagacgaaatctcactcttgtcccccaggctggaggctggagtgcaatggcgtgatctcagcttgctgctacctccgcctcccgggttcaagcgattctcctccctcagcctcccaagtagctgggattacaggcgcccaccaccatgcccggctaatttttgtatttttagcagagatggagtttcaccatgttgctcaggctggtctcaaactcctgacctcaggtgatccacctgtcgtggcctcccaaagtgatgggattataggcataagctaccacaccccatctacgctgacatttttatatttgaaaagtgtactaaaatttatgtttctcatatttttattcatgtcatgttttattttccaccaagtccttgcaaacaggtatttccaatcaaataatacacatttttctctttgaatctcctttgtcttttggagtctcttacacaaagcttccaggcaaatctttatatgaacatggtagcaccatgaactcatgtatatgtcaagtaagtgactgactacatcagtattgttactgtctgctatgaagcgagacccattagtttttttctttggtgtaaggcattgcctaatgaaagtgactattagcaacccagagtggtaatcaatgatttcaagctttttgaaatgttaaatattacaattcaaactgccacagcctaagcagttacagttatgataccatctgtcacagagtcttcctccaaaaagttctactaatattacactttggaggttcatattcattagagtatgtcttgctgtatgatctttacacaaattatttgaatctactaatcactttgtcttcagaaaagggagttatcagaaactctaaaaatatgcttcatttcatcctcatcagtggctttaagcatcacatattgtttatatcagtaaatgcatcccattttctagtttcattaagatatttgcctctactttacaaatgagaatgatgtaaatgagaaacaggtctcagatgctttatctataagtcttcaatcatgagtgttctagaacaaacattcagaagccttttcattcatcctgtttcagacccagatggtgtgttcactattaaattctccttaagacaatctgtttccctaaatttgtctacctcattattacttaatctgactctctatcacataaggtataactttgggagtatagcacataactgtaatgttaggaaaaacataatagagggctcattagttcttcatattcaagagtgtgtgagagagtgacgtgcctaaaaatacgaataaaaacaagcatttttttcttgagtaacttttaatctgtttctgaaaataattattaatgcagcttttagtcttgtgacatactaggcttaatctatgtttagtatccaaagactaaggaaaagaacaaagatgtttgaagtgtggctcagggcaaagaatatgagttatttgccataacatttttaatgcatcccagtgctttgtaataaatctattactagggaagttagttagagaaaaacattgaacttcacacaaaaagtataagtataattgcatgtattattcactccatgaaaacgcaactttattaacaagtaggcattactcaattgttcaggttatccagaaggcaatattctttcctccagaatggtggaacattattagttttccatgtcattatttggattgtttaagggtgtggcagacagctttattttctttacttaattattatttgtacactatggagtatttttgaagaaatttccatagtaaaactaatgttattatttttgtttgtcagacatatactataataaataattatttttatttttatttttttgagatggactctcgctctgttgcccaggctggagtgcagtggcagaatctcggctcactgcaagctccgcctcccgggttcacaccattctcctgcctcagcctacagagtagctgggactacaggcgccggccaccactctgtgctaattttttgtatttttagtagagacggggtttcaccgtgttagccaggatggtctcaatctcctgacctcatgatccgcccacctcggcctcccaaagtgctgggattacaagtgtgagccaccgtgcccggccaattatttgttctattttttttttttttttttttttttttttgagacggagtctcgctctgtcgcccaggctggagtgcagtggcgggatcttggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatatcctgacctcgtgatccgcccgcctcggcctcccaaagtgctgggattacaggcgtcagccaccgcgcccggcctggttctatttttattattattttattttcgtacgtataacacaatagaggaagactgatatctgaatgtgtgctaaacaaagccgcaagtaaatgatttataggcatttaatcataacagaaacttatggggtaggtattagtgttattcccatttgagacgagagactaaacaaaggcccttcccttctaaatgtgaaagctagaaagaaatatcagctctcctgaaattccaagtcttttaagcacgagtgtttccatcactgactaattggctctgataatctgttgtgttaaattcataaaacagaattgatggagttagcctgtcttttgctcagtaatataaacacatgtgtttgggatcttacctgaaccaaaactgtggttctaatgttcgtatggtgtgtgttatcagaacacaattacaagagtaatatattgcataggaaggtgggaaagagccaaacccaaatttctctattatttcattttgtcaaagataaggctactctggggctttacactatgggggaaattatggctcaggacaatggggaagaatttagaatgctatttgtaaaggtaagatctaaagcctccccttttcaataaacttcctgtgaatatacctgactagtaaatacttaggaggaagcattcctgaaggactgtgtcttactctgtttgagctgctgtaacaaaataacacaatttgggaattttttaaatttatttttaatgacacataatacttgtacatatttatggggtacatgtgatattttgttacatgattagaatgtataatgataaagtcagagtatttagggtatccataacctcaagtatttatcatttctgtgtgttgggaatatttagtcttccagctattttgaaatacgtgttacattattgttaattatagtcatcttgctctgctatcaaaaattagaaattattctatctaactgtacatttgtacccatgaactctttattccttcctcaacccatacagtctttccagcctctggtaactatcattctactccctaccttcataaaatcaacttttttagctgccacttacgagttagaacatgtgatatctgtctttctgtgtctggcttatttcacttagcatactgactttcatttccattcatgttgctgcaaatgacttaattttattcttttttatgattaaatagtacttcattgtgtgtatatataccacatatttttatccattcatctattgatggacacttaggttggttccatatttttgccattgtgtcaagtgctacagttagcatggtagtgcaggtatcaaaatttgtaatttatagagaataaaattttatttctcagagatctagaggctgggaaagccaagatcaaaaagctagcaggttcagtgtttggtgaggacccagtctctgctcctggaatggcaccttgaatgttgcatcctccagaggggacacgtgctgtgtcctcacatggtgaaagagcagaagagcaaaaagggcagaatgctatgtgaagtgtgttttacaaagagcttaaaacccattcacgagggcaaagccttcatcaatgaatcagctcctaaagtcccctcctcttagtaatttggctcttaagttttaacacatgaattatgggagacattcagatcaacacagactcagaagcatagttttaaggaaaataagagacagaaagggaaagggaagaagaaggagtaggtgtagaacattgggagggaagtggaggaggaagaagatagataaaatgcaggttggtatagacattacactgctactacgtgacatttctattatagatatatattatagatattaatatctgcccaggtaaatctatttcccagtaaatatctatcagaactgaaccagtcctggagtgaatgtggcagctgcccagaaaatttacttcaagtttttgagcatagccaatggtcataagaagcattgtgagcttaaattatgcctttgttgagttttatttgtttagaaataaagctatgctagtgttgtcaacttttcaattatctacaacagagacatgctagctcagcagtaactgaggtaaatattgagaacacttagtctgacatgacacaactgatgcacctcttcattatttttctcaatttactgtatttttattcactcttttttttcctggaaaattatttaagttttgctgtctatgcctaaatctgctagtcatatctgcagataatggattatacttgccaaagaaatataagacaaaaatttgtccaattaacttttttaaaaaataagaatgagttacttcaagggtcagtttcatgttaaggtggattaatttttaataagtgataattgaataagataccatttggacttcatccactactaggttaatgattgaaggtgtttttgttttcaatatcacaggcttaaaaaaatcagctgtgtagttgtgtcatactaaattatatttcgatgttggatgaaataaataacttatctgcatggatatacatacaacctggttctgagagtttcatgaaaaaagtagcacaaaaatagctgcctcctcactgtatgtgttgctatgacgccattgaatgtcaccttgactcttcaggcatgagtttccgcagtcagttggaataaatgtatgtgactaaacaaaatttgtgattgaacaaaagtttgttctattgtgttttccatatgcatactggagaaattataaaccattcattattcgaaaaaataataagaaattttaaaagttagttctgtcaaatccaaaaattaatgtaggtacactcttccttggtaactaacattgaaaattagcaaggattaaaaagcacttgaaaagattctattacatataaataacacaaaacacatccatatctacttatctgtattttatcaatacatatatgatatatatgtatatatttcatactgcaaatccaaaaatttctataatcaagagctgactttaataaagatggaaactaacacatttttgttctaaagaaaggtgctaggtctttcaaattggccagattaaatttacataaaacttaggtcttctagtgccgtgacttgttaataacaaggatattctaaaagtagcctagaaggttgcttttagactaagacacattgcctagcctgggatgattgttttgaggttgatgactctgtccaacatatttatacacttttttccattatgaaaattgtttttattaactttatattagcaacaagaagttcaggattctggagataattattttaaaaatatgttaaatgcattttctctatttatggatttagtttttctattaagaaacaccaaagaactggacttaatgcttcagttttcacatgactatgtctgatttcttataactaaaaaacacagtgagctttccttttattttcaaactttaatattttttactattttagttcttactttcctgtctattgtttctgtagacttgaaaatatcatgactaaaaataccatatcctgaaatcttactggaacagaacctggataatattccaaatgctataggtctttcatgtgcaaaaaaaggggggatatcttttttcatcatttaagtagccaatcacaaagtaaattaaaaagacataaataaatcttttatttgccacatctatgctcagcttccaatgaaaagattcaatgtgctcatctgcagacaaaatcagctaatagtaaatggtaattttagttatttagaaagaggataaaatccttaagaacacccaataccttctgaggcatcagtaaaatttatcagataggaactacaaatagaaatcatgaattgactctgaataaaattataggtaaaacaacaacagcagcaactacatatggacggatgaaaacattcagtccaaaattctgaaaacctgggatcagatcagcatccttccaactccacagaatcagttccttcgcaggaaatggccaagatgtgaggcttacatcactactcataggttgaatagcattaaatgactccagagggttctctgcatgcggcagactcacgtgttccttctcagagagctgaggaactcctccactgagggacattcattatgttaaatggcacattggcacatgcccatgcccccttctgttttcatcataaccagggtacaggtacagagttatcagtgaggagttctccaccctaatgagaacaaactcttcacagaattacttagggtcttcttggatcctaaacttcccagcaatgtttggattaaatatcaatgttatcagtgacagtgctatgtatacaataaaatataggaggatttgatcgagaaagtaaatgcaatatttacttattacaatgactcattctaatttctttacttcatttcattttacaaacttctcatgaatgtgccatgaaccagaaagctatggagaacttctgaaagttctcaatgaaaaattgagtataaggaagtctactgttgtgaatgttcttgaatttattttgaaacattgactttgaaggcttaaaaaatatcttgaaagctagacccctgaaactaactactacaaatgtgaaaaccacaaggaaatatatagcaattcaatgtaagaagaatgtaataagtaaaatgaataaataaataaatttttacattttttttacagtctcaaatgtaattaacagcattcaaaacattactttataaattgttttcatattactatcaaacattaatacctaaatacccaatttaggaaaaaaaaagggtattaaaaggtttaacatggcggcggttccaagatggccgaataggaacagcttcagtctacagctcccagcctgagtgacgcagaagatgggtgatttctgcatttccaactgagctttgaagagagtagtggttctcccagcatggagtttgagatctgagaatggacagactgcctcctcaagtgggtccctgacccctgagtagcctaactgggaggcaccctccagtaggggcagattgacacctcacatggctgggtacccctctgagacaaagcttccagaagaacgatcaggcaacaacttttgctgttcaacaatatttgctgttctgcagcctccgctgctgatacccaggcaaacagggtctggagtggacctccagcaaactccaccagacctgcatctgagggtcatgactgttagaaggaaaactaacaaacagaaaggacatccacaccaaaaccccatctgtatgtcaccatcatcaaagaccaaaggtagtaaaaccaaaaagatggggaaaaaacagatcagaaaagctgaaaattctaaaaatcagagcgcctctccccttccaaaggaacgcagctcctcgctaggaaaagaacaaagctggatagagaatgacttttatgagttgagagaagaagccttcagaggatcaaatttctccgagctaaaggagaaagttcgaaaccatggcaaagaagctaaaaaccttgaaaaaagattagatgaatggctaactagaataaccagtgtagagaagtccttaaatgacctgagggagctgaaaacaatggcacacgaactatgtgatgaatgcacaagcttcagtagccgattcgatcaactggaagaaagggtatgagtgattgaagatcaaatgaatgaaatgaagtgagaagagaagtttagagaaaaaagagtcaaaagaaatgaacaaagcctccaagaaatatgggactatgtgaaaagaccaaatctacgtctgattggtgtacctgaaagtgacagggagaatggaaccaaggtggaaaacactctgcaagatattatccaggagaacttccccaacctaccaaggcaggtcaacattcaaattcaggaaatacatagagtaccacaaagatactcctcaagaagagcaactccaagacacacaattgtcaattcaccaaagatgaaatgaaggaaaaaatgttaagggcagccagaaagaaagcttgggttatccacaaacagaagcccatcagactcacagcagatctcttggcagaaactctacaagccagaaagagtgggggccaatattcagcattcttaaagaaaacaattttcaacccagaatttcatatccagccaaactaagcttcgtaagtgaaggagaaataaaatcctttacagaagagcaaatgctgagagattttgtcaccaccaggcctgccctacaggagcacctgaaggaagcgctaaacatggaaaggaacaatcagtaccagccactgcaaaaacatgccaaattgtaaagaccatcaaggctaggaagaaactgcatcaactaacaagcaaaataaccagctaacatcataatgacaggatcaaattcacacataacaatattaaccttaaatgtaaatggactaaattctccaatcaaaagacacagactggcaaattggaaaaagagtcaagacccatcagtgtgctgtattcaggagacccatgtcacacgcagggacacacataggctcaaaataaagggatggaggaagatctaccaagcaaatttaaaacaaaaaaaggcaggatttgcaatcctagtctctgataaaacagactttaaaccaacagagatcaaaagagacaaagaaggccattacataatggtgaggggatcaattcaacaggaagagctaactatcctaaatatatatgcacccaatacaggagcacccagattcataaagcaagtccttagagaactaccaacagacttagactcccacacaataataatgggagactttaacaccctactgtcaacattagacagatcaatgagacagaaagttaacaaggatatccaggaattgaattcagctctgcaccaagtggaactaatagacatctacagaactctgtaccccaaatcaacagaatatacattcttctcagcacatcgcacttattccaaaattgaccacatagttggaagtaaagcactcctcagcaaatgtaaaagaacagaaattataacaaactgtctctcagaccacagtgcaatcaaactagaactcaggattaagaaacccattcaaaaccactcaactacatggaaacagaaaaacctgctcctgaatgactactgggtacataacgaaatgaaggcagaaataaagatgttgtttgaaaccaacaagaacaaagacacaacataccagaatctctgggacacatttaaacagtgtgtagagggaaatttatagcaccaaatgcccacaagaaaaagcaggaaacatctaaaattgacaacttaacatcacaattaaaaagagctaaagaagcaagagcaaacacattcaaaagctagcagaaggcaagaaataactaagatcagagcagaactgaaggagatagagatataaaaaacccttcaaaaaatcaatgaatcaatgagctcgttttttgaaaagatcaacaaaattgatagaccactagcaagactaataaagaagaaaagagagaagaatcaaatagacgcaataaaaaatgataaaggggatatcaccaccgatcccacagaaatataaattaccatcaaagaatactatacacacctttatgcaaataaactagaaaatctagaagaaatggataaattcctggacacatatatactcccaagactaaaccaggaagaagttgaatccttgaatagaccaataataggctctgaaattgaggcaataattaatagtctaccaaccaaaaaaagtccagggccagatggattcacagacaaattctaccagaggtacaaggaggagctggtaccatttcttctgaaactattccaatcaatagaaaaagaaggaatcctccctaacacattttatgaggccagcatcgtcctgataccaaaggctgacagagacacaacaaaaaaaagagaattttagaccaatatccctgatgaacattgatgcaaaaatcctcaataaaatactggcaaaccagatccagcagcgcatcaaaaagcttatccaccatgatatagtgggcctcatccctgggatgcaaggctggttcaacatacgaaaatcaataaacataatccagcatatcaacagaacgaaagacaaaagccacatgattatctcaatagatgcggaaaaggactttgacaaaattcaacagccttcatgctaaaaactctcaataaattaggtaggtattgatggggcgtatctcaaaataataagagctatttatgacaaacccacagccaatatcatactgaatgggcaaaaactggaagcatttccattgaaaactggcacaagacagggatgccctctctcactactcctattcaacatagtgttggaagttttggccagggcaatcaggcaggagaaataaagggtataaaattaggaaaagaggaagtcaaattgtccctgtttgtagatgatatgattatatatttagaaaaccctatcgtctcagccccaaatctccttaagtggataagcaacttcagcaaagtctcaggatacaaaatcaatgtgcaaaaatcacaagcattcatatacaccaataacagacaaacagagagccaaatgatgagtgaactcccattcacaattgcttcaaagagaataaaatacctaggaatccaacttacaagggatgtgaaggacctcttcaaggagaactacaaaccacttctcaatgaaataaaagaggaccccaaaaaatcgaagaacattccatgattttggatacaaagaatcaatatcctgaaaatggccatactgcccaaggtaatttatagattcaatgccatccccatcaagctaccaatgactctctttgcagaattggaaaaagctactttaaagttcatatggaaccaaaaaagggccctcattgccaagacaatcctaaaccaaaagaacaaagctggaggcatcatgctacctgacttcaaactatactaaaatgctatagtaaccaaaacagcatggtactggtaccaaaacaaagatatagaccagtggaacagaacagagccttcagaaataataccacacatctacaaccatctgatctttgacaaacctgataaaaacaaggaatgggaaaaggattccctaattaataaatggtgctgggaaaactggctagccatatgtagaaagctgaaactggatcccttccttacaccttatacaaaaattaattcaagatggattaaagacttacatgttacacctaaaaccataaaaaccctagaagaaaacctaggcaataccattcaggacataggcatgggcaaggacttcatgactaaaacaccaaaagcaatggcaacaaaagccaaaattgacaaatgggatctaattaaactaaagagcttctgcacagcaaaagaaactaccatcacagtgaacaggcaacctacagaatgggagaaaatttttgcaagctacttctctgacaaagggctaatatccagaatctgcaatgaactccaacagatttacaagaaaaaaacaaccccatcaaaaagtgggtgaaggatatgaacagatacttctcaaaagaagacatttatgcagccaacagacacatgaaaaaatgctcatcatcactggccatcagagaaatgaaaatcaaaaccacagtgagataccatctcacaccagttagaatggtgatcattaaaaagtcaggaaacaacaggtgctggagaggatgtggagaaataggaacagttttacactgttggtgggactgtaaactagttcaaccattgtggaagacagtgtggcaattcctcaaggatctagaactagaaataccatttgacccagccatcccattactgggtatatacccaaaggattataaatcatgctgctgtaaagacacatgtacacgtatgtttattgtggcactattcacaataacaaatacttgtaaccaacccaaatgtccatcagtgatagactggattaagaaaatgtggcatatatacaccatggaatactatgcagccataaaaaggatgagttcgtgtcctctgtagggacatggatgaagctggaaaccatcattctcagcaaactatcacaaggacaaaaaaccaaacactgcgtgttctcactcacaggtgggaattgaacaatgagaacacttggacacaggagggggaacatcacacaccgtggcctgtcatggggtggggggagggtggagggatagcattagcagatatacctaatgtaaatgatgagttaatgggtgcagcacaccaacatggcgcatgtgtacatatgtaacaaacctgcacgttgtgcacatgtaccctagaaattaaagtattaaaaaaatggtttaactctatcattccaaactatgagctagacattcaatgtaggtagaggactcctaagtttttattttctgaaatgagttgctaaaaccatgacatttgttactggctcccaattttggtattgtcattataaacttttattttttgaccactatatatatcacccaatggtttatattatggcatgacagctgtaaggatataagtatcaccaatcaacagttaagaaaacagacactcacagaaattacatcataagtagataatagagagacaatatgagccaagggcttcaacacccaagtcttcttcttgattctgttctttctggcctgttgcattcatgactagaattcacatttatgagcagtgctagactcagtgctgaaatagactgaaaaatctttagttaccaacagattgcttgtcagtatagacagagcacaagtaataagtgttctcttcactaacagctgtaggttttatagtttagccacaagcttgacattctggaaaatggtttctaaaagtcttcctcggtgatcagaagaacatttgcaattaactcccttgaatgtattagaacatttacaacatcaaattgtttttcaccttgttcaccacaaagattttggaagattttttagaaggctgaaaaacctctgtgttgttgtagcatgtgactgaattcttgttcttgtttccatggtttcctgggatgtttagtccaaggactagactagatcgaaaacctaatgagccattcacctttttgctgctgcttgttaccacacacacatacacacacacacacacacacacacacacttatctcaaagggtcactaaagaaaaacttgatagttctattgattcgatgtatataagatgatttttaaatgtaacatcccaaatatattaataattattgaattcaaatattagtaactatgacattctatatgcttatcccccataaatatgcaagacaaatcagtattaatataataacaagaccatgattgacctcagaatcatatgatgagaacttttacaaaaatcaggaaaacacattagaatgctgaagatgatactctgtatgtctacaatactaacatgttttcaagacagtgtcaaatatattctccaatctgattctcataacacgtaatctctaaagattgtaatgcacgggtttgcttttttgtaatttgcacttacacataagaaacctgagtaacagtgatgtaaaaaaaatttcccaaggttactcctcttgtgacaaagccatgtatgaatctaagtttttagttcagggagttgtgcttcgttaaaggattgcattcttcctatatttgaattatctgttctcacatttaaacaaaatgagacacaaagatgaacacccccaataatcacaaaatggcaacacaagccatttatcaaatgcttatctgtattatggactggattaaaagtattacatacattatttctcataattattaccattatcctatgaggctattcttatctccattttacagttggacatcttgaagttagtatgcaaaagatccagaattcatatccagattggataacttttaaatctaagctcttaattttgattgtaattattttgagtaaagcaaacataattagaaaatttggggcagttattatttgaagtagtagatctttataatcaaggtgactttaagataatttcatcttaatttgatattcaaataccattagcgcatatagaaaaggtactgcaatagttgatcatttttgttttaataaatttcagtgctccactttactttctttcttggtagtggtaaaagatgatatcaagaatatattagggaatctgtttcaatattgtgatctgtgcttatgctaataaattactttgtctctccaaaatttcagtgaaaataatggtaaacaaaaatagagagacaaacaataaaagtgtgaaaaactagaaaaactgtatcatctgcaagccaaaagcatttcagaatttctgcaagatatgcatatgaagagcctagattgagagaaacaccaatcaactcattattcataatatgcaaagtaagagcccagtagtaaaataaatgggcaaaatcactagaggatttttattgccaactgtaagattatatctagcagttgcaggtagacttggacaatcatttggggccaagtcctgatactgcctgtgtcttctgtaattcacaaagttaatgagtttacacacagacaaaatacactgtagtcatcacatataacttatttttgggggacgggttttccctggaagcagattgagagacagagattaatatttataatatttattaggaaatgtctcttgaggacattatctgtggaggagatgagaaggacagcaaattatgcaggagaagttgagctgtgatgaaggcccaattatgactttagccaacccagtgggaagctctggagctagaatgctatttctgagttgtcctaaagggagccaagatggtcaggcctttatgatcttacaccagtcagtcattgaatatggatcttcttgggaagtgctgtggccttgagaacagtcactctgtgtaattaaggcaattcctggaggaactaatacctgaaaactgcttgctaaccacactcttcacgaccaaggccacagaccttttcttgaacggaaacctgggaagcacatcacagtgcttaacacactgactcagggcataacaaggctgctgcatggggtcaaaaaaaaaaagtggggtcaaaaataaaaacattttctgctgagaatacacattcatgagagaaggaaacagaagcagctatgaattacacggaagaaaaacacactggtccacagacgaagctatctgccacagctgcctccatttgtagctcaactctactctgcaaatggaggctaaaggacctctgcactagaaaaataaaacttcagaaggtctaaccttttctcttccctatttatgccaatataaaatattagaagagagtcataaatgtgatagaattcctcctagctcctgagctgtgtgatagcctatagactatcatatgtaaggttgatcaaagagaaaaaaaaagcactagccaaataaagagattcagcaattttttaaaacaagacacctctgaacaacaagagcaaatatattgacagaactgttgtaaggaccactagaaaattgttactctcaagatgtgagaggacactggatttatgaactggggaaaaggtgaaattagaaatgtatgcttggataaaaacacagttggagaaatttttaaaaatgaaataatgcaagtcatgggcagcacactaaacataagaaaccaatttatggaattgaacagcaagttaaaatgtattaaattcagtatgaaagaatgacaacatgaataggaagatacatagataacagacatagagtagcaagctaaaatagataccacatttatacaaggaaaaactccaaaagtaaagggtagagcatttgacagatatgtatgtgtgtgtgtgtgtgtgtgtatatctcatagatatatatatctatatgtgtatatatatatacacatatacatagatgaaatagtaaaagtatataaaataaatacaaaagttgaaaaaattaaacacaggaaagcccttttattttttcatcgtatatattttataattttgattatatatgatcattttataacaaaagcagtgaatgaaatacagaaacaatatttgaacgaattaaaatcttctagtcattggagtttttctcttaaaagttgtatgtggctgggcatggtagctcatgcttgtaatcccagcactttgcgaggccaaggcgggcagatcatgaggccgggagatcgagaccatcctggctaacatggtgaaaccctgtctctactaaaaatacaaaaaaaaaaaattagctgggcatggtggcgggcacctgtagtcccagctactcgggaggctgaggcaggagaatggcgtgaacccgggaggcggagcttgcagtgagcagagatcatgccactacactccagcctgggtgacaaagcgaggctccgtctcaaaaaataaataaataaataaataaataaataaaataaaaataaaaattgtatatatgcttaagtggcagaaggcaataatagcttgagagcttttttaaaaatatattctgagcatgtgtttcaaagattattattctttcgaaaaaaaatttaagatcaaaatttgtcaaattccatcactgtaacagctcattcagtatgccacctttcatccatagacctccacctgcttcaggttgggtaaacaatgttaaaaatttggcctcttaaaatccatattcagaccctctctgttgatgatatatattttacctcttctttcagtgtatatttattcttttgtttctcttaaacccaacttttagaattaatgtctaagcactgtaacattgaacagttttgttcctagggatataaggtccttttctccatattattctgttacaattgagaatgtaaagacggggaacagaattatagtcatgacaggttttatgtctcattttaacaaggctatttacaaaaattattttctaacactgtatttccaacaatcttaatttcaactcctgctctcaaattttttcaagattcattactttccttatctttagttctatggagaacagagacactagaaatatgatactaggttcattctgttttaacttttacagctaaaaagttaaaccaagctgaaacattgcactataaagaaatctatgaaactaaaggtcttgcttcaactgagtctttgaaaattatcaaacaatgaaaagctctgaaattttaagccgggaataactagaattaaaattttcttttttcattgttgccaaattctttcctatttccattaaaagtcacagatttatatgaggtgaaatgcagatattccagaaaattaaacatatgtttcactaacattttgctatttcactctaatggacacattctattttagggtgatggtaaaaaattcaaatctccaagcagttaaattaatcttaaataatttcattttcacagtgaagcaacttatgcagacagttggaagaattaaggatctcttctctttccctcattcttctttcttatcaaaaattacttgagttatgcctcattttaaacagaaaaagaatttagagggagctagtttatctgacaaagcaattcaaattaatttaataatgaatgtactcatcattaactggcaaatctgattttataaaaataataaaatttttcattttaaaatatacatctttcccagagacaattaggaatgctgcataaaaatcagggtaggtaggattaagctaatttttttctacttgtatatttcttttccactaaatctctaagcatacaaagcttaaaagaatggtttcaatgttgttagttcttatatttagacctgcagttcattgctaatacagtacaacactcaagtgctcttcgcttaaggaagacattgatgcagatataaacctccaagagggatttcccttgcctaggtgacaggactcatgagtgtatcaaatgtaatgactcagctcagacaataaaacatatgttccaggagcacatttaattaggacaggaactgttagtgtgcaagagagcagagcagaattaatggcacagtgtttctctgtggactccaaggggtttattttcaagtgattagaaaagatctgtcatgtacattatgccatcacgtttctgtcctattaccaagacacccttaacttgggtttgcattttcatccacacaagtttttctcttctatacttccccaaataccactgaagctctttgttatttttttccaaattctgtccagtgactccgtcatactgctgcaaacattattaaaagaaaagtcatttgcaagcaagcattgatggcttcatttaaaactcccccttggatgtaattgagaacattcaaaaatgtaaactgagaaattcaaaaacataaataaaaagatcattgatatgaattgggctaattgttaaggaggcatttactagagattatgccaaatatgtaaataacatgaaaaagactaagctaccttacggatacaatatgtttttgacctttttgtgtcttattttttaagcattgagggtttatggatgtttagtcaaatgaagcttatttcatgcagcaattggagatgtaaaaattattcaatttactatccataatggaaaaaatttgcaaatcttattactatggaatatttcccctaatttatatgatcaaagccctcaataacagtgatgttttttgggcatttttactacatgctaacatgctttggcacccaactcataccctcctctcttggcctgcagccacttactttatagtgtctaccttcctttctaacttttacttcatgaacataggtaattagcttttccttggattgctgttgatttcagcttggcaaatgcactttgagaatgccttgggtgtcttgcaaaaggggaatgatttggcatatcttaaaatgcttaagggaaatgaatagagagctaaaatgagaactggtatgagaactcaattgagttggggactttcatttaactgctatactaagaatgcgagaaatttaacctctccaaatttcatcattctttttttcccccaataactagatatacaactagttggcattgccccaaacacaaaccctacattagccaatttacttttatatatgacactttgttgcatttgaacattataaatgaagccaacccttaacttgttgcatcttctgtaacaaaggagttaggcaaacaaagaatgaaaaagtatgccagagaacaggaggggaaggtaaatttgaaaacagaaataattttaaaaaagggaatagaaagcccttacaattgattgtagaaagcagttttcagatggctcaggaagcagttttatttgagtagttacagcagttcaaaagctgttggtgaactcctatcaaggattgtgtgtatttataattcaatgaggaaacaaaagttaggaagtaaagaagaagaacctcgcagcagaaatccttaaaactctctgcctttagttctcatatggttgactaaatgtggcaagatttttactctatgcccctttaaagatatttcgtttcctcacataaaatcctcctaaaaataacccttagttatgtaaatagaaaatcttaatctgcagtccaaaaactccctagaattttatgtgaaactatctttgtctatattcacaccatgattttctatgccaagaatcaagacctgtattagtaagtactgtgaccactagacgcacatggccattgagcatttgatctgtagctgaattgagatgtcctacaagttaaaaaacaaaacaaaacaataccactggattttaaaattttaatataaaaaataaaatatctcaatgaccttttttaccaattgcatactaaaatacaatattttagacatattgagctaaataaaatattaaattttattttatcagtttttttttaatttgtatgttgttgctactgaaaacataaaattccacatgtggctcatatttatgtctcccattatacttctattggacagcattcatctaaagcttcattaatttcacagattccttggtctattaaagaagaagaagcaaaggctcccgaggttctctttatgttaagagcttctgtattcaagaagtgtgtcctattgtggatgctaaaacaatacttgctaatgtatgtgatctgtgaaaaatgtggaaaacactttgtcaaggggcataaaaaagctgtttgagtttttattaaggagattggtttctgacatatcaggcttttctgagacttacactactcagggaaaattgtcagtatgaaggaagatgcatgtgagaagttctgaatgtgccttggcagagacatagattcattaggggctgcgtgcctcactggtgagcactgagtgtctacctgtcagcatctcacacctcactgaactcagactcccaggtggccactccaatcattctctgcctcactctccctcctgctctgatagagctctctccttggttttgcccaggagcccacatagctcacttacatacattactgacttaataaagataatcagtgtggtcctcttgggatgtttgtttctctaggcaaggctgaaaatgtgtacttattcctcattaatttgtacatgactactgtttctagctgactcttggaagttatctatttagtaaagaatagaagagcaaatactttgatacagaatttgaaccttaaataaagaagcagaggtcggttgttaggttaggctgtgcaaaactgaaaaaaaaatcataataggagtttattaagctaaaaataggatactaagattataattaaaggactattaaataaatagaatttgcttttcactttgcatttttctgttcttaaaatagaatacaaaaatgccaggctacaatgtcaccaagaaaattctatactgttttatcctttctctcttttctctcttttttctttttaacaaggagaattatttgcaaagaaaatgaagattccataatcctctgaatgaaatactgtatctgctatactgttagcctatttcagaatgggagttcaactaagaagagagacaccgattgactgactacatttatgagaaaggtccagaagccctcattcattttaagatctcatttttagtgaactatgcctattatcagttgatactacattttgcatttactaaaccaatctataagacatatatgatatatattcacacatatataatattctccgtaaataattgaggaagaatatgcaaaaaactaagcacaatggttgtctgttaaaagaacagcctgggtggctcaggagcagaggtggttggatattattttcctttgcacattgtgtaccattgtttatattattaaaaataaattaaaataatattgctaatgcccaattactgtcatactatccctaccattatcaattctcagctgctatattttcttcccttgccatagtctttatttgttggtgtatttctccatcattaatttaaaattagttttcttctcttctcaccttccatttattcaacaggttgaacacattcatgcactgttttttaagttttactgagaaataattggtatacgaaaaactgttcgcatatttactgtgtatgatttggtaagtttggacatgtgcaaatacctgtgaaatcatcaccacaatcaaggtaatagactagactacgtccgtgtatgtgtgtgtgtgtgtgtgtgtgtgtatgtatgtgtatatgtgtgtatgtgtagtaagaatacttaacatgagatctaccctattaaattctggagtacacaataccatattgttaatggtaagtactatgttgtacagtagactcctcgaatttattcatctggcattgttgaaactttatactcattgaacaataactccccattcccccacaatctcaatcccctggcaacccctattgtatttactaattctataagtttgaccatgatagatgcctcatataattggaataatgcaatattatctaacaaatccacttttggttatatttccaaaaatactggaatcaggttctcaaagaggttcattgtagcattattcataatagccaaaatgtggaacaacccaagtgttcatcaacagttgaatggataaagaaaatgtggtataaacatacagtggaatattattcagccttaaagaggaaaatcctgctgtttgcgacagcatggatgaacacagagaacattaaactaaatcaagtcagtcagtcacagaaaaacaaagattgcatttcatgttctttttaaaacatcctttagggaaaagaagattggaatagacctaggcattgtgtgtaagtttagggaacagaaagatcttgtttgttgttgttgttgttgttgttgactataatgcagatcaaacatttttttaaaaaaatatttctcactactttcttattttcatgtcctttagtatgtatccaccttaatgtttctaaacatgaagaaatttacagcataatgtccttgcttttaaaggaattttaccaaattgagtatctcaaggaaatacacatgtaggcaagaaggatgaaaaatttaaccagcacaaaaaactgcaaagaagaatattaaaagttagatgtagctcaggtttctctgattaattttttaaattgatgactggctttatgccaccttcaccacctaacgccttctggtaattatgaaaggaattcacaaaagttgtgtgattggggcctgcaaaggatgtgaactactgtctcatggacattgtgtggggcctgccatttgaccccaagagagggcagagagaatgacattaagagtacttgtgttggagctacattttcaaggtgcactacccacttgatgtgggagtttgaacacatatcttcacttttttgtatctttttttttcagatggagtctcgctgtgttgcccaggctgtagtgtcatggcacaatctcggctcactgcaacctctgcctcctgggttcaagcgattctcctgcctcagcctcccaagtagctgggactacaggtgtgtgccaccacgccgggctaattttttgtgtttttagtacagacggggtttcaccgtgttagccacaatggtcttgatctcctgacctcatgatctgcctgcctcggcctcccaaagtgctgggattacaggtgtgagctaccacgcccggccacttttttgtatcttagtttcttcattcactaaatagagatagtaattatacttcaagggttttctgtgtgaactaaatgagcgaatacctgagaagcatgtataataattgagtaacaacacaataggtgctaagtattcatcatttttcttctatttaacccccaccctttttattgtaaattgacaatttacagttatataaatgtatgaggtacaaagagatgttataattttaagtacaatgtggaatatttaaatcaagctagttaacatatccatcacttcaaattcttaagattttttgcagtgagaacatttgaaattaactcacttactaattttgaaatgtaatattctataattaactatattcaccatgctgtgcaatagaactctaaaaagaaaaaaaagcatattccttctgagatcttatatccttcatctccaccctacttacagatatttattgtaagatttcctctgctgtccattctgcaccaaggtgactaattagcacctttaatgctcacataggacctcttccctattaaaaccaatactgagcctcctaacgaggtactgaggtgtgtcagattagtgctatgtacttaatagtcatctgtgtgctgcaactgtgttgtctgtagatgtgaggagaatgctttcctgcccacgttttctgtaatactttgtcacatactcaaaggcaaagctgcctttcttcctagatacacaatcttcagtgaagttagctctctgagtattttgcaaagctcccaagtttaaaaatctaagaaatactaacacatgcaaatttaatgcaaaaaataaagtgagtcattttctccctcttataaaaaccaagataaatacagttattaccatgaaaagaaatgtagaattgctttcttttattatgcctcaacttaaagggccacatgccttatttgaaaagctgagtttttatttcatgatgagatatgtttttatatcacttttcaggtaaaatattccttagagcaaaaagggcatttttagggctaataggttctgctctcattaacactaaaagttatgaatgcttttagatttttacctaggggaaaacatagcaaatgcaaactgtcaactcatatatatacatctgaaaatctcaatcaagcactgtgaagccttgtcaggaaaaatacttatcctcttgatttaaagagtgtaacttttgtccctagtgaaaaagaaacttttaattattaaaagcttatactggtccatagttgacatctaatttattttatcacatcaaatatgttgtaagatataagaaatattttagaatgttcagaattatttcacaggtgtttaggataactgagtactgctcttagtatttttgaattacaaacatctcaattactagaagtctaatcaatgtccatcaataccaaatgaagagaatttgtgggacagtgcaaagtgttcttaattggctttgcggatgcttgaatttatttcctggtgctccaatagaagttgtgacattggtgaatccatttagcttcttctctttctagtttccatgtctaacaattatagactttggctaaatatgctctgtagtccaccttagaggcaaactattcagagtttttttctttccctgccaaatttctgtgcatttgagtactcaataaagagaagaattttataaaatgcagctgagtaatagaagacatggtccacctcacaaggaatcaaataatgcaaatcactatgtgtttaatgatttatagattttagcatttccactgacaattagcaaagaagaaaaaggctaattataactagtataggcatggacataggaaaatgggcactttctaaaactgctgaaacaagtatacatattagtaaagtatttatagatagtaattttccaaaatgaataaaaagcaataaaaaatcttttaatctaataatctagattctcagaatttacgctgagatgataggtacatttacaaaggtaatttacatttatacttaagaatatttagcataaaattctttattatagccaaaggaaaatacgaaatatgaaaacataaatgaagaataggagattagttacatgaatgttgatgggtctctgtacagttagggcatgcatgggctttatgagtcaaagagcctgattcatttcatgactctgaagctttctagtattattttcttgtataaattgcttaagcactctaactctgtttctgaccctttaaagtggaattaacaatggtatctttatcagaatgctgtcattagaattaaagaagatatgatttgtaccggcccttgcactactaactgtcaattttagtataaatccacataataggcactctaggaatctgttaatagtgatcatgcaaagctatgtcaattcacatcagaggtcattcttaactacttgctaagtttaaaaaaataaacagttgcatggcagcaatgtaatacacaaagtacattttgattttaaatacagtgaaagagaataaaaagcctgcatataaatatttaatttttattttctattttttatatgatattcacagataattgttaaatttttataaaaatgaaggatttttttccttactaaattatatataagccaaaggtaaagtaagatactgatagtcattggattataaagaaaaaaatagaatttttaattatacctacttacactgaaatgatcgaaatataaagcatgtatttcctaatccagtctgcatttatatcatatgagacatcaccagggatagaatcaaacaaatgataaaatactttaaacattttcagaaaatacaaaggttgagataaatcaagattgcaaattctgttataaacacatagaaactttgaataatattatatatatatatatcttttaacacataacttataatacataactaatcaggagcagggtgtgggggagaaagaccttcctagcagacaggaatgaagaaagatatcaaagagagcaccaaagtggaacctgaaaccaagcagagaatgttggttaccagtgactctggaaggttacgggagggggaggatgggaagaggttggttaaatggtccaaagttacagtttaataacagaaatacatttggttgttctattgtattgcagagtagagtgactatggttaacagtaaaaaatatctatcacataacagctaacagggaaccttttaagtttctcaccacagataaatgataaatgcctgaggtaatagatatatgaattaacctgactgaatcaattttcaacataggtatgtgctgaaacatcagattgtaccccataaatatgtacaatttaaatgtgtcaatttaatttattttaaaaaaattaaaagagaaagatatagaaacccagactccctcactagtaaataaagtactctgaaaggtatatttatgtgaaaacagggaaggctgcattaaacaggagcactcagttaaaaagaattataatttataaacaccatgaaaactctaagagagagtatatttactatttagcaaatagaagcacaactatgaaataacagaataaaagctataagaatttaaaataattaaagaaatatatgtaaaacaacaaacataagtaaaagacacaatacaaaaaaaaacagaaaaaagtcatatttgaaaaacagaatttctagaaataaaatgaaatatgaagtatttgaaattaagattcatccacaggaaaatgattcaataaattatagtatattcaagcatgggaattgggatgaaaatgaaaaatgaatcaatcagagctttatgtagtaaaagggacattaagtttaaagaaataataataaatgatatattcagaatgatgccaataacataagactaaaaacatccaaaacaacaccatatataatttagaaatacatgtgcaatatcagtgccaacaaatgcatttgaacatgaaattcggggtgaggtagaaaaatgggatttaaagaaagatacaatgagccttcaacttttttttttttttttttgagacaaggtcttaccctgtcacccaggctagagtgcagtggcataatgatgactcactgcaagctggcctccctagcccacgcaattctgccacctccgcctcccaaagtgatgggactatagatgtgagctacagggcctggctcaacttcttactaaagcttttatttttttttttctcaaggtgtttagtgggccttttgctttttaacattttttacttttgaaatatttcataataacctttgttactattcaactaacctttaatatttgttatcaaacagtaataacaattgttattaaatatacaagttattaaacaaacccttaacattttaatttagtttaattcataaactaaaagatatatccaaggaggcattacttaacattagaaatcctagtaacacagagtcatcacattaatgcattaaaagagaaatgatcaaatgttggctaaaagcaaaggttttgcttgttcactgctgcataacaagatgtaaactgtagtacagtttttataaatggggaagggagaaagtgaagaaggaaggtaattatgaggaggggaatcatcatatcagtaaggtgtcaaaaactgggcaaagaattgcattagttagaataagctcagtagaatatggacattaaaggccaagaagataacattttaaaactaaaaatataaatacacataaatttgatgttgtatagacatcttgattatggacttgtttttcttgtttctgactttaaaattaatatttctatttcattattgcttataatatttgataattttataaaagagaaacttttcttaaacgtatgagtatagttttttttgatactgatatttaacttgatatacttgcggtcagagaaaggagtaacattctgcacttgactagaaataaacctataatgtaaaattcctatcttcctatggaatttttatctacatcttcttttcattattaagatatttatgtttgtgatccttatggaagaaaaccccaccacttgaggtcttgctgaaacgattgaacctgagtgtgatcaggactctagatgcaatgggctatttgcaggaaactcagggacagaggaacatgagctatattatgagcatgccatcagcagactccagactgtgaaactacaggtcaaacagctcgagtgagttcttcaacagataaattacaacaaaaagaaagggatgggtgggagagaacttctgaattaaaaaacattcaaaaggcgtcaagttaacaaaaatgggtctgactaaatgattgtgtctaggaatgtgttcttggtgaaaaaacaataaagaaacacaggggaaatattattgtaaatgtcagaatagtgattacttatggagagggagggaggaggtatggagagaggcttctggccaacttctctctcgaactgtgtggtggttgcaagggcgtttgctttataataattcactaagttgtatgtctgttctgtgtgctttccttttgtcttattttacaataaaaatgtcaaaaaatatagagatttaattttgtatttcccactaggagtgtggatttctcaatttctcatcacagatgtatcaaattttacatatgtggttaaaaactatgttcttagatgcatatttgtttgaaattattttatctttttggggaaataaacactttatcaatatatttggaatgttgcctgttacatttcaaatcctgttttgtatcaaacagtgacagcacttgtgttttgttatgtatttcatgggcactgcctatttttttaccttttttttgcaatattctgttttcttatgttttacatttatcttacaaatcaaatgtagctggactatatttttcatatagtctgataaattttgctattaagacaagcagtttgtctatttatattttgttgttttacatacatttggattcttttctatcttattttgtactagaaagtacaaaagttgaaacttgtcctaattttttctccctgcttgtcttttagtaatctaagtgcttttttcgtttttttttctattaagtgcagaactatacattatatttctattttataattgtacaataataaacattaacataggtatttaactttataattaattacatacgatataacaattatcacctgtcttctgcaaaatataggtatctcagaacgctttcactccgtgaatattcttgattcatatgcttgttatatttccccataacatagcttaatattttaaccactaaaccagactttatatcactgttttgattttaacagttgctaaatttgatgacattttattatttttctacatgaaccgttcatctttgcagatattttcttgtggaataaagtatcttatttggaagaacagctgacacttcaccaacaggtgatttagcggtgctaactccaatgtattcaaaaatccatgaataaattttgacttcccaaaaacataaccactaatagccacctgttgaccagaaatcttactgagataaacagtcagttgatgaacattttgtgtatgtattacatactgcattttttcaacacagtaagctgtaaaaaagaaagtgttattaagaaaatcgttggttggggagagggaggagggatagcattaggagatatacctaatgtaaatgacgaattaatgggtgcagcacaccaacatggcacacatatacatatgtaacaaacctgcatgttgtgcacatgtaccctaggacttaaagtataatggaaaaaaaaaaaaagaaaaaaaaaggaaatcataaggaagagaatatatatttactattcattaaatgaaaggggatcatcacaaaggtcttcattcttgtcatttttacattgagtaggctgaggaggaggagaaataggagggtttggtcttgcagtctcagggtgggcagagggggaagaggtagaaaaggtggaagaggaggcaagagaagcaggcacacttagggaactctatggaagtacatcatgatttctgtatgacttttttgctttttaaaatttctctaaaaatgtttctgtatggtaacaatccttcttccaccatttgctttagttttagtgcttatatcatgcaagacagaatcaatccatctgattgtgacagaatcaatctaacacaattcagattgtgtaatgtcaattgttttctggcactgcttctatgtcttcttcccctgtcttacactggtttggaagcatttatcttcatcaagtcatcttccattaatcactctggtgtggtgtctattcactcttgaatttctccaagatgcatatcttcaaacctttcagccctcaccttttttgccatgtccacagtctcttcaatgaattccttgattggctgtgttgaaaatcctgtgaagttctgcacaacatctggacacagttttctccaacagaaagttttcatttctggcttgatggctttcacagacttttatataacaatcatggcatttccaatgttgtaatcattccagactttcatgatgttctctctgctggggctctcttccagagcattgacaacactttccatacaattttgtgagtagtgagccataaaggtccttatgatcttctgatctagaggctaaattagagatgctgtgtttgggggcatgtaaatcacttcagtattttagtgttgaacttatagattccatatagccaaaggacattgtttaatatttaaaaaaaaaaactttaaaaggcagtcctttactgacaagagatttcctcacttcagggacaaagcatggatggatgcaatccagataaaagggtctcattgtccaaggctttttattgtacaatgaagactgacagcttgtgctttatttatttcctttaaggcttaaaaataagagtagtcttgatcatagaccagtctacacttgcaaaaaaacagtggagttggcctactctttcctgccttaaatcctggtgcttgctttgaaactgccctcataaaattaaaggaggccacacgattacaattatgttaggtgcctgaattttgctaagatattttcctttctgtctgattttttccttatccatgcatgattgcttgcacatagtcattatatgatatgtgacaaatgacagtcactaataactgattatcttcctgtcctagttccatggcagcctacatgaaagattaaggaatttgtttttacttttaaagaaaaatgatccttagatcatgcagaccccctcgatgacttccagaagttagatgaccaacagggcgccaggcagctatgacaagcagggacctcaccttccacagacttttctgctaagctataggcatagttaaacgataacccagcattttttcccatcttgcttgccatagtaaccagcagtcacaaatgctattgtgaaacctaagactggtctttgagatagttttctaccttggtctgtgagtggactgacgccaacccaaccagtgatccaacggaactgacttgactggtattgtgactcacctcctttctcaggaactgattcagccctaacacagcatccattccctatgcctctgccagtcaaatcattcttttaaaacccagcttctgatgcctcagcgaggtggctttgagcagtatctcccatcctcctggttcggttgccttgtgataattaaactcttctttatagtgatacttgttgtctcagtgtttggctctatcttggcagcaggcaaaaacctggtcaggtggtaacagcttttcttccttaataataaatgttctaggcattttgtctgtgagttttttcaaattgttgccaatctccaaaaaaaaatttccaatatattggaaaaacatccacatataagtggatacgtgcagttcaaacccatgttgttcagtggtcaactgtgaaattttttgcagtattttagagagggtctgtaggtaaactcttaatttttttttctgtgaaaatgtcttatttattttcttctttagtaaaatattatttcactgagttccaatgcaaatgattaaaactctagtattttgaggttaattaattgtctagtgcaattagttgaccaattaagagttcttcatggaggctccaagatggctgaataggaatagctccagtctacagctcccagcgtgagcaacacagaagacgagtgatttctgcatttgcaattgaggtaccgggttcatctcactgaggcttgtcagacagtgggtgtagcccacagagcgggaattccctttcctagacaagggaagccatgacaggcggtacctggaaaatcaggacactaccaccctaatactgtgcttttccaatggtcttagcaaatggcaccccaggagattatatcccatgcctggctcagaggatcccacacccacggagcctcgctcactgctagtacagcagtctgagattaaactgcaaggtggcagcaaggctgggggtggggcgtctgccattgctgaggcttcagtaggtaaacaaagtggccaggaatctcgaattgggtggagcccaacacagcccaaggaggcctgccctacttctgtagactccacctctgggggcagggcatagctgaacaaaaggcagcagaaacttcttcagatttaaacgtccctgtctgacagctttgaagagagtaatggttctcccagcacagagtttgagatctgagatggacagactgcctcctcaagtgggtccctgaccctcgagtagcctaactgggaggcacctcccagtagggaccgactgacccctcatatggcctggtgtccctctgagatgaagcttccagatgaaggatcaggcagcaacatttgccattccacaatattttctgtttggcagcctccactggtgatacccaggcaaacagggtctggagtggacctccagcaaactccaacagacctgcaggtgagggtcctgactgttagaaggaaaactaacaaacagaaaggacatccacaccaaaaccccatctgtatgtcaccatcatcaaagactaaaggtagattaaaccacaaagatgggagaaaccagagcagaaaagctgaaaattttaaaaatcagagcacctcttctcctccaaaggaatgcagctcctcaccagcaacagaacaaagctggaaggagaatgactttgatgagttgagagaagaagtctttagacaataggtaataacaaacttctgtgagctaaaggaggatcttggaacccatcacaaagaagttaaaacccttgaaaaaagattagacaaatggctaacgagaataaacagcatagagaagaccttaaataacctgatggagctgaaaaccatggcacgagaactatgtgacacatgcacaagcttcggtagcctattcgatcaagtggaagaaaaggaatcagtgactgaagatggaatgaatgaaatgaggtgagaagagaagtttagagaaaaaagagtaagaaaaatgaacaaaccctccaagaaatatgggactatgtggaaagaacaaatctacgtctgattggtgtacctgaaagtgatggggataatggaaccaagttggaaaacactctgcaggatattatccaggataacttcccaacctaacaaggcaggccaacattcaaattcaggaaatatagagaactccacaaagatactcctcgagaagagcaactccaagacacgtaattgtcagatttaccaaagatgacgtgaaggaaaaaatgttaagggcagccagagaaaaagtttgggttacccataaaaggaagcccatcagactaacagcggatctgttacagaagagagtgggggccaatattcaacattcttaaagaaaagaattttcaacccagaatttcatatcgagccaaactaagcttcataagtgaaggataaataaaaccctttacagaagagcaaatgctgagagattttgtcaccaccaggcttgccttacaagagctcctgaagaaagcactaaacatggaaaggaacaatcagtaccagccactgcaaaaacatgccaaattgtaaagaccttcaatgctaggaagaaactgcatcaattaatgagcaaaataaccagctaacatcataatgataggatcaaattcacacataataatattaaccttaaatgtaaatgggctaaaggctccaatcaaaagacacagactggcaaattggataagcagtcaacacccatcagtgtgctgtattcaggagacccatctcacatgcagagacacacataggctcaaaataaagggatggaggaaaatctaccaagcaaatggaaaacaaaacaaaagcaggggttgcaatcctagtctctgataaaacagactttaaaccaacaaagatcaaaagagacaaagcaggtcattacataatggtaaagggatcaattcaacaagaagagctaactatcctaaacaaatatgtacccaatacaggagcacccagattcataaagcaagtccttagacacctacaaaggacttagactcccatacaataataatgagagactttaacaccctactgtcaacattagacagatcaacagacagaaagttaacaaggatacccaggaattgaattcagctctgcaccaagcagacctaatagacatctacagaactctccaccccaaatcaacagaatatacattcttctcagcaccacaccacacttattccaaaattgcccacatagttggaagtaaagaaagcactcctcagcaaatgaaaaagaacagaaattataacaaactgtctctcagaccacagtgcaatcaaactagaactcaggattaagaaacccactcaaaaccgctcaactgcatagaaactgaacaacctgctcctgaatgactactggttaaataacaaaatgcgggcagaaataaagatgttctttgaaaccagtgagaacaaagacacaacatgccaaaatctctgggacacatttaaagcagtgtgtagagggaaatttatagcaccaaatgcccacaagagaaagcagaaaagatctaaaattgacaccctaacatcacaattaaaagaactagagaagcaagagcaaacacattcaaaagctagcagaaggcaagaaataactaagattagagcagaactgaaggagacagagacacaaaaaacccttcaaaaatcagtgaatcaaggagctctttttttgaaaagatcaacaaaattggtagactgctagcaagactaataaagaagaaaatagagaagaatcaaatagatgcaataaaaaatgataaaggggatatcaccactgatcacacagaaataagaaatactatcagagaatactataaacatctctatgcaaataaaccagaaaatctagaaaaagtggataaattcctggacacacacaccctcccaagactaaaccaggatgaagttgaatccccgaatagaccaataaccggctctgaaattgaggcaataattaatagcttaccaaccaaaaaaagtccaggaccgacagattcacagccaaattctaccagaggtacaaagaggagctggtgccactccttctgaaactattccaatcagtagaaaaagagggaatccttcctaactcattttatgaggcagattcatcctgatacaaaagcctggcagagacacaataaaaagagaattttagaccaatatccctaatgaacattgatgcaaaaatcctcagtaaaatactggcaaactgaatccagcagcacatcgaaaagcttatccaccatgatcaagtgggcttcatccctgggatgcaaggctggttgaacatatgcaaatcaataaacgtaatacagtgtataaacagaaccaaagacaaaaaccacatgattatctcaatagatgcagaaaaggccttcaacaaaattcaacagcccttcgtgctaaaacctctcaataaattaggtattgatgggacgttatctcaaaataataagagctatttatgacaaacccacagccaatatcatactgaatgggcaaaaactggaagcattccctttgaaaactggcccaagacagggatgccctctctcaccactcctagtcaacataatgttggaagttctggccaagtcaatcaggcaggagaaagaaatagagggaattcaattaggaaaagaggaagtcaaattgtccctgtttgcagatgacatgattgtatatgtagaaaactccatcgtcttagcccaaaatcttaagctgataagcaacttcagcaaagtctcaggatataaaattaatgtgcaaaaatcacaagcattcctatacaccaatgacagacaaacagagagccaaatcatgagtgaactcccattcacaatgcttcaaagagaataaaatacctgggaatgcaacttgcaagggatgtgaaggacctcttcaaggagaattgaaaaccactgctcaatgaaataagaggacacaaacaaatggaagaacattccatgctcatggataggaagaatgaattattgtgcaaatgtccacactgtccaagataattatagattcaatgtcatccccatcaagctaccaatgactttcttcacagagttggaaaaaactactttaaagttcatatggaagcaaaaaagagcccgcattgccaagacaatactaagccacaagaacaaagctggaggcattatgctacctgacttcaaactatattacaaggctacagtaaccaaaacagcatggcactggtaccaaaacagagatatagaccaatggaacagaatagagccctcagaaataatatcacacacctacaaccatctgatctttgacaaacctgacaaaaacaagcaatggggaaatgattccctatttaataaatggtactgggaaaactggctagccatatgtagaaagctgaaactggatcccttccttacaccttatacaaaaattaattcaagatggattaaagacttaaatgttacacctaaaaccataaaaaccctagaagaaaacctaggcaataccattcaggacataggcatgggcaaggacttcatgactaaaacaccaaaagcaatggcaacgaaagccaaaattgacaaatgggatctaattaaactaaagagcttctacacagcaaaggaaactaccatcagagtgaagaggcaacctacagaatgggagaaaatttttacaatctacgcatctgacaaagggctaatacccagaacctacaaaaaacttaaacaaatttacaagaaaaaaacaaccccatcaacaagtgggcaaaggatatgaagagacacttctcaaaaaagacatttatgcagctaacagactcatgaaaaaatgctcatcatcaccggccatcagacaaatgcaaatcaaaaccacaatgagataccatttcacatcagttagaatggtgatcattaaaaagtcaggaaacaacaggtgctggagacgatatggagaaatgggaacactattacactgttggtaggactgtaaactagttcaaccattgtggaagacagtgtggagattcgtcaaggatctagaactataaatgccatttgacccagccatcccattactgggtatatacccaaaggattataaatcatgctgctataaagacacatgcatacgtatgtttattgaggcactgttcacaatagcaaagacttggaaccaacccaaatgtccatcaatgatagactggattaagaaaatgtggcatatatacaccacggaatactatgcagccataaaaaatgatgagttcatgccctttgtagggacatggatgaagctggaaaccgtcattctgagcaaactatcacaaggacagaaaaccaaacactgcatgttctcactcataggtgggaattaaacaatgagaacatttggacacaggatggggaacatcacacactgggcctgtcatgggatgggggaaggtgggagggatagcgttaggagatatacctaatgtaaatgacaagttaatgggtgcaccagaccaacatagcacatgtatacatatgtaatatacctgtacgttgtgcacatgtaccctagaacttaaagtataatgataataaagaaaaaagagttcttctaccagtaaaattattgttttattatagggaatctgttttttccgctccgactgaatttaagataaatttatatttattagtttttgcaatacccttactttgggtgtttgtgtgcatatgtgtatttatgtgtgcatgtggtttaattctaaatggaatccggtgatctctctcaacttgagcattcatatgttctgtaatttataaaaagatttcatgtattattccttctcttttttctagaactcaaagtatacaaatgtcatatttttccttccattctctatgtatctttatttttctaacatattttagaaaatatttttacctgtatattgggtaattttttagctatattttcctgtgtgctgtgtctctccttttctacaaatcctctgctacttattatctcttttacatttctagttttttgttagctgctttcttatttatacataataattatacatatttatggggtgtaggtgatattttgatatatatgtacaatgtgtaatgattgaatcaggatgtttaggatgtcaatcacctcaaaaatgttttcctttctttgtgttaggaaatatatttcaaatcttttagatattttgaaatatatgagaaatgattgttaattatagtcattctacttttctatcaaacataagaacttattacttccaactgtatgtttgtactcattaaccaacctctcttcacccccattcatccttcccaccttttgaaaagcatcattctactctctaactccatgtggtaaacttttcagtccccacgtatgaatgagaacatgtgatatttgtcattctgtgcttggcttacttcacttaacataatgaacttcacttctatccatgtttctgcaaaagataatactccaccataatcaagtgaaatttatcccagggatgcaaggatggtttaacatatgcaagttaatatatatgatatatcctatcaacataatgaaggacaaaaaccatataatcattttaacatatccagaaaagcatttgatataattcaatatccttttatgataaaaaactctgaaaaagtaggcatagaagaaatatacttcagcatagtcaagatcatatatgacaaatccgcagctaaaatattaaatggggaaaagctgaacgcctttcctataagaactggaaaaaacaaggatgcctactttcaccattcttatttaatatagtactggcagtcctagccggagcaatcaggcaagggaaataaatgaaaggcatccaaattagaaaagaggaagtcaaattgtcagtttttgtgaacataattatatatatagaaaatcttaatgactgaacatttctatttttgaatttttttagaaattccattttgttcatttaaaatttttggtggattattttcacagtctttttctccttagatgtacttcctgctatggtttgaatgtcccctccaaaatttatgttgaaatttcattgacattgtgatggtatgaagagttgggtctgttaagaagtgattaggccatgaggattctgctttcacggatgggttaatgctcctctcctgagactgggttaattattgtggaagtgggttcttgataaaacaatgaaatttgacccccattctctttctctcttgaatacttgcctgccctttttccttatgccataaaataatacatcagcatgtaaacccttgccaggtgccagtgccatgtccctggacgtccatcctccaaaactgtaagccacataagtctctgttcattaaaaattacccagtctgtggtaatctgttatagtaacacaaagtagactaagacatttcccatactttttatgtttctttcagcattttaatcctcttcttcaatttgtgtaaagtttttttaggtctaagtttgttgtgcgttgttgctgctatcactcatggttacgtatttgttatgtctgtttgcaactttgaacttctagaaaattatctgtgtgaattcattgagttttatatggcaatggggcatgtgttcaaccaaatgatagtcctctaagatgttggggtcctaatctttggaacctgcaaatatgctaccttatgtgataaaagggacttcacagttgtgattagggttagggtgttagagacgagatatgatcctatattatataggtgggtccagtctaatcatgtgagtccttaagagtgggaagaggaaggcagaagagtagattaaagagatgtatgtgagaaaaactcaacctaacctttctagctttgaagatggaagaaagcggatatgagctgaggaatgcagcaacctctagaagctggaaataaactttatgtaaaaatcagcaagaaaatgcagatctaaatcctacaaccataaggaactagattctgccagtaacaccaatgatcacgaaatagattttcccatagagtccccagaaagtaacacaatgctggtgacaccttgattgtagtctagagaaacctgggtgagacttctcaccaatggagatcttagataataaatatgtgttgtattgttttaagacattatgtttgtagtaacttgtttttggagtcacggaaaactaatacatggtcatttttccaaagagagtttaaagttatttctggcagatatttggcagaaaagcatctttaaacttctgtttttgcacatggttttggagccaagcaggtaatgtgaatcagttcctaaaccaaatgttttatcactatatttataaatgatcataggaatttctttcttagttttttctatgtcactcaaaaaaagggtatgtatgtatgtttgtataaaaccttatatatatatatatactttatttaatttgtgtgtaaaacttcacatacccatatattatatgtgtaggtatgttatgtacatacataaagctatatttatgtattatatgtattatatgtacgtatactaaagtacacatatatattagctttatatatgtatatatattatatgcatagctaatatatacatatatgtgtatgctttagtacacacacacatacatatatatgtaaaccttacttactaatgttgctatcttttgacggtaccagcttaatgaggaaataagtttgggagataatttttgtgcaaatcaatgcttggtttcccttggaaagcaacgagatttagcatgctagtttacttctctagaatcatgacaatctgacaatttgctttatgttttttttctgttgttgtttgtttgcttgcttgcttgtttgttttttgagatggagtctacctctgacgcccaggcaggagtgaagtggtgcaatctcagctcactgcaacctccacctcctgggatcaagcaattctcctgcctcaacctcccaagtagctgggattacaagaggccgccaccacaccaggcttatctttgtatttttagtagagatggggtttcaccatgttggcctggctggtctcgaactcctgacctcaagtgatccacccgcctcggcctcccaaagagctgggattacaggtgtgagtcacggcgactggcctggtttatgtttttaagagcttaagtatgcatataaatataagatataggtcatatatttatatgatcagaaatatttttatttatattttaaattaaaatatatacaaaccaaaaaaagttaatatttattacctttaaatgaagataattgtctaagttagtatttcaaggcaactgtattttttaaatggcttataaatatttttataaaagaaaaagtcatgaaaggcattgctctttatataattagaattatgtcagcaaaacaaaggccactctagatattccaaaggggaagattttcatacagcaaatcacaggtttgcacaaactttgtaagggttgtacaattcagaggagtcacagttatacatgaatgaatcatatgtactcacatagtagccaaatgaaatttgaaatctcacatagtgtcgctgcgatcaacctcagctatcaattttcaaaatttgatgttatcctagatatctgcctgcaacttccttacaatttccttctcttatactttcaaattttaagaaatattcttcactgataaaaatctaaaataagccataaatataagagattctgaaaaatgtagttcaagaattccagaagaggttgcagaatagagtactattgatgaaatgttgggaatacatattcaccacaatgtacccctttgtttactcagaatccatatatatgctactatattcatttaaagggctaaactggccaggcgtggtggctcacgcctgtaatcccagcactttgggaggccgaggtgggtagatcacgagatcaggagttcgagactagcctggccaatatggtgaaaccccgtctctagtaaaaatacaaaactagccagacgtggtgggtcatgcctgtaatctcagctactccggaggctgaggcaggaaaattgcttgaatttgtgaggtggaggttgcagtgagccaagtcgtgccactgcactccagccagggtgacagagtgagacttcgtctcaaaaacataaaaaaaaaaataaaaataaataaataaagtgctaaactacaacatacaaacaatagcattcttttacctaattatcatcacacaatgaaaatatgcttactctctcccaaaaaaacgcatagacggaaattctcagaaatgatctctgcgtgacaaatatctgtgtgatattatttctaatctaccttagtcataatccccctgtgatgtatcactgagaataagtggggttacagcttagtaaaaacccccaaatatccgtggcttaacataaagaaggtttatttccatgtcatgctacatttttatgcttctcaacaaaggctgagaagataaaattaaaagataagtatgttcagataaaaaggacaacaaacatgggattcccctgtagatattctcaatgtctcagtaaagcaagggatgcaataatcagctgccaatgatgggcatgatggacaagttgtttaataaaggatgatacagcaaaaggaagatacgatcttgattaatatgagtgaaaagtttatcataaaaataaatgtaaataaacccagggattaggtggcagaatcctaattgaccttacagaatctgaaattgaattcggccatgatttcattttctttggtcagatcataatgattacaaattaatattgttgagtgaatgaaaaatcagtaaaataccatctcaagagttcagtttaaactcagagaaagaaggcttccatttactcttttatttttgatctcctcatagaattatagaatgtctgtttagaagggatcataggatctgactctcatttctaacatcttctgtaattttcctgacatatatttagcctctgcttagggatctcactttaaaaatggaagttacctgcctgagccctgaagattgggagtcacgggtggttgacagatagggtgatttgaacggtctttattaaattaaaccaaaaatctacgtcactctccttccactgtatactgtcctgtagtgacatattgccaccttcttctgtgatataaaactttctcagatgtttaaagtcagcagtaatagctcactgcagcctaaaactcctgggcttcaaaaatcctcctgcctcagcctcctgagtaagtgggactacaggcaccttctcacagcctccacgcccccacacattcccctgttccatcagccccttcccccaagatccttagctccttcatatatcagttgtttcctatcctagaaaaccagtgtttggagcagtactattattatctttgcttgaacctttttctaaaagaaggaaaagagctggcattgccagaatcttctttctttttaagctgttggctgtttacctacttagaagacatatcttaataggatggatgtctgggttttagccttggagtatcttttggaagcttaaaaaagcaggagttgtgctgccaccccctaaggagggaccctaactctgcccttgcctggctccatatcaccccatccagccctgcccaccaaatgcacctcccactatcaatcctgcccgtgcactcctcctcctcccacaactaggacactggtggttcttattctaggtaaggctcagattatccctccccttgatttgtttccctcctaggcctgtctggtagcccccaaatagacatagatgctgagcatctcctcaggcctggcaaccttaaaagagccacacggacattattcagcttttcaggccactgggttttggaggcagaagtacagagatgttggctctgccattctgtcatactaggctgtagcataggctttgagacagcacaggtgtatctctgctcctgttctaccaaggctttgagtgtagcaggggcctctgtgtggagaaatgccctcaaagggtaaccggtagttgttacatagaattggccaatgttagcatatgcagtcatcaccaagaaatttttctcctaccattgcctgctggagggccctttaagattgcagagggaataaggagggaggctgcctggttgttttttttgtttgttttttttatactttaagttttagggtacatgtgcacaacgtgcaggtttgttacatatgtatacatgtgccatgttggtgtgctgcacccattaacttgtcatttaacattaggtatatcacctaatgctatccctcccccctcgccccaccccacaacaggccctggtgtgtgatgttccccttcctgtgtccatgtgttctcattgttcaattctcaccttttaggagaggccacaggagtcatttaaagaaatcttttgtgcccggagcttcttttcactagagcagggaagtacatttcaataacttcttaaacatttatgtggaacagacgtgaatgtgagggaggttttaagccaagcacaaagttagtttcaaatgctagttaagaaatctatttttctttatttcttttttctttttttttttttttgacacagtcacactccttcacacaggctggagtacagtgaccctatctctgctcactgcaacctccacctcctgggttcaagcgattctcatgcctcagcctccagaatagctaggattacaggtgtgcaccaccactgttgggaaaagctgagtctcgggagaagctgaggcagggcttgcatgtctgacataatgtaaaagagtcttggaacatttccaggatccaaggtctaaaacccctcgtggcctttggaactccaagctctgtgctaaagggtggaaggctaccctgacgcaccataatctaagcccagggcataaaatccctcttggcttggatagaatccagggctcgtggctctggaatgtgtctagacttgctggctccttgctccttgctctcctaggattgattgtatcttgagttaaaagaacctgctctccattatctcaagcagcagagcaaatgctaaactatcacagctgtaaatcatgtacttgatgcaacgtgaccttttgacctccaccttctcaccacctgtttctttgttggattaccaaaaaataccatgggcccccagagttcagggcctttgcagcctccaccatcatgatagccccttggtcctactttacttcttaaactgtctttttctcaatcctttgactctgccagactttgtcacccccacacccgatgttggttctgatcacctcaacaaccacacctggctaattttgtatatttagcagagacgggttttaccatgttggccaggctggtctcgaactcctgacctcaagtgatctgcctgcctcagtctctcaaagtgctgggattacaggcatgagccactgcgcccgctactcccgtcttttttttttttttttaattttgcacagaagctggtaatgtagggcctacatgtgaacaagtttctatttggttacttgggttgatataattcattatatttaagttctttcgaacaccggagatccccttaatgtgtatgaatgcttgaggctttgtaaattagggatgtttgtgtgaataaagttatttgatgagattaaagcagccttatgtgatttgatataaataaatataaagtcagcaatcaggttaatgtttccagatgtgtgagactactgttcagtttatcaatgcctcttcatactggtcacccatcactttagatgccatttctgacctccgttaaggatttatacagattgtcaaattaggatgaccaatgatttcagtttgcctgagacttagaaggctcccatggtatacgacttatagtctaaaactaagtcagtcctgtgctaaccaggacaagctcatcatcttataatgtaggcattgctctagtggttcttaaccatcacaaggaaacaaaatctgctagatgcagtttcaatctctttctttttttcctgacaattcctctggaaatgatgctaatgatcaaatcaataatcaggcagcaggagggtgatggcgtgaggaacaaacaatttagatcatttagatcattttgcagttggattgtcaggatcaagatgataaaaaataataaactcttttatctactgtgtgacaaatttaggaatttaggaaactgattttacatattggttttatattttaggcattctgttgctcctgagataggaatctggcaggacttgttttaccagaaaccaatcgctaagaccccactggtgaaacaggatgaggtgaagaagccagtcaaaacctgccaaaacaaagatggccacaaaagtgacatctgcttgtgctcactggtcgttatatgctaattataatacattaatataataaagaaactcccaccagtcccacggcagcttccagaaattatcacatatggtctgaaaaagggaacaaccctcaattccaggaattccctacccctttcctaagaaactcatacatattaataattcactatttagcatatgatcaagaaataaccacaaaaatagccaaccagcagccctaggggctgctctacctatggagtagccacacttttattcttttactttcttaataaacttgttttcacttaattctgttcactgctcttgaattccttcctatgcgaagccaagaacccacatggtctcctgggctgaaccccagttttggggttcaccctgtgacactcgcaagccatagtcatctgcactagattcatgatgaacaaatagacagtagcagattatttttcatgtctcttagaatgtgtcttaggaccacgtttagaaaaatcattctctgtatccaaaatgtgaggagggaatccatggatatgtttcacaaactgcctcatcttcccaccatgctccatcctgaggtgtcttctatattcagaaagcttcaaagttttctccagtctcttaaaagttaccaaggtgcagaaacctatgtcttctacaaaagcattttcattcttcagtctacccatagtcatgaagaggtggttctctaagagaaaactgccaagtcagaatgctttcttatgatctccactgactaaataattttcatgattggaatccacactttcaaataagcaccacaggctccaggtgacattatgactgagtgatttcttaaggacttgattcttttcagctaaattagctgcaacacttgtgagtacagcccctcttcatactggaaggcagttgactcagctgatgctaccaggcctttccccagaccttctttatggttcccttccagtcagatgtctccaaaactcatgagaagatctgctgtcagttttaagcaacacaattccttttggggaacttttattacagtgagagatccaaaggagagatattctttctatgcttatttgtgctggtattattactatgtcaacaatgacctccttcatactcttcttcatgcttagaagagtgcctgacatacagcaagtgctcaaaagatgtcagctattattaactgctgtatctttagactatattgtaatgaataaatattttcttatttaattgttaatctgaatataaaatgtagaaattgcatgtaggaaaatataaaaactacctggaattattctgctcagagataactattttcaatactttggtgaacaatatgtataaatttgaaataattctgggtatacatttaaaactttatttctgctgggcgcggtggctcatgcctgtaatcccagcactttaggaagccaaggtgggcaggtcacgaggtcaggagttcgagaccagcctggccaacatggtgaaaccccgtctctaccgaaaaaacaaaaattagccaggcgtggtggcgcgtgcctgtattcctagctacttgggaggctgaggcaggagaatcgcttgaacgcaggaggtggaggttgcagtgagtcaagatcgcgccactgcactccagcctgggcaacagagtgagactccatctcaaaaacaaacaacaacaacaacaacaacaacaaataatacttttttctttactgtttccctatttcatatattcttttaatgtgtgtaaaaacttttcttatgtagctataaaatggtattatcaatcaattgttcctaatgttttattattgcaaacacattttggcattgactttttttacctaaactttacagcaaggtcttagttatttccctaatatcaaattctagagaaaaatatttgcaccaaaaggtataattttaaaacgtgattcatattgtcaaattgctctcaaaaaaggtgtggccaacttacattcataccagtagtgtgaacttttttatagcctctcaaatattaataaatgaatgtagatatcaatatacatacacatatgtagataatatctatggattcaatattagtcaaatcattgtattttagcttctataatctgtattttaaaaaccctttctatgagcatttttgcgtaatacaaaatgtttttaaaactcagttatggaggtaggacatgcatcactaaggcacagaagtgctacaggaaatctatggatgccccagtcaataagtggtaaagaagcaaaacttagatctttgaatgccaagcctaaaactcttactattttataagcagaattaacacgtcagcaagcaaattccctgaaatatgatggtagcagctaggatcactccattttaggaaatctaatttggcattgtacctaacagtaagtaaaaaaagtcaatgaacaaagtcagaataaatgtacttacagatgtcctgagtcagaggttcttgaaatatttaactttttcccttgtgtgttgcttgggcttttgctgaataatattatgtgaggtttagtaatcgtttgttcagttgactgacaggcattacattgagtaagtaattacttgtcgttcgtcagtatttcaagaagactgtgtggatgagagtaagtcacttaaggtttaggggtttaatgttcgattttccactgatttatgtcagattttactctattaaaaaaattagaccataaaactgtcctaataaggttgattcgggcttcagctggaggaaaaaagatgagaataagagccaacttgttttattactaagacaagactgatttcttatcagcataatcaccttacatccaggatgcaggtcttaatatagtcaaaattgaaaagcatcatgaccatagactagaaactgaattctttaaatcgcaaatttctctgacctttagaaaaacaaaagtaaaaattcaccaagaaacaacatagttaatcagaaatacataagtgtattgtataaagttataatagaattcaatgtttttcttttaaagaactcaaggtggcttatattcaagagctgaataaaaattattagaaagtggagggcaaaataaaaaggcactttattagaattgcttataagatttgatcttgtgttggatatcaatgtataagaagttagaatcagaaaacttgtcagaggcaatgtaaatattttgctgtaatgtaaaaagagttttctgggaaccttgatggactactatagtctctttcaaacaacaggaattacaactttgacagcaccagagagatattctgagtccctgagtcccagtacagttttcttgtaagacagcctatctttcaaaaatagggaatactggtacatagcaaactaaatcttatgacatccctgctggtctgtctaatatttctctctccccagcctccctttcctatctatattttgtatactttaaagagtacaattttacaactgtgcactctaatgacctgtgtttaaatactggctctgccactaattatttttgtgacctgtataagtccttctctttgccttaattactgcaacaataaaatggagatttagttcttcctatatcatagacctgttgagaaattcatgtaaaaccttcacatcaataaaatatacctttcattatcatttcctttccttagagagtttgtgtaaaatcatgaaaattactttttaatatcatcatgttgattatatgcctatttcatttccatttgtatttgaaaagaaattctgattgtctcatctatgccactgtactgtgaattgatgatatctacttgtcataagagctatgtgaaagagataccacaaaaacatttgaaaggagaaatcgtgaatctggaaggttacagaacattgtgttccaatctcttcagacgttgtatgcatactctcaggataaggcatgaatgataaacattgaattatacaatctttcagtacacttacatatattatataaattctaccattagaggtatatttcactctaataaagctttctaatcttttttctttaaaagatttagaaaaataaatatacattataaattgaaactatggtttgagtccatacttacaaatgactttaccaaagaaatataataatgagtagaaattgattctagcaaaggatgacataaactagacaaatgttttgagaagtgtctgtaaacaatactacaggtaagactgggatgaggtcagggtctgtgactggctgctcgaaggaaaataccacatggatataacaaaaatggtgtccaaaagacccatggacaattctattttggaataccagtttcatgtctgagggtgaagtacatgagggaaaggagaatgaaggagagctgagcaaatctcagtatcactaaagacttagagaagtggtccaggtaccagaagctacacagagcattcccatcccaggtctaaggatttgcatttgactgaatattgtggagcaaaaagcaacaaatgacttagaattgattcaaaggaaggacactggtacccttaggaaataagtgccatcctgccaatacaacaaaaaaggaatacaagattttaggtataaaagtaaaattactataaaaataaacaacaaaaagataagttacccaaccatagagttttcaaaaatgaagtggtaatttaaacacaagcaaataaaattgaataagaacagattgataacttgttagtattattaagtaggaagcagttaattctccctatcttaactaataaatttatgatgatgcaaaaaaaagcagtagatgtttaggaggggaggaaaggcaatttaacaaaattatttcgaagtacacatagaatgaaaaaaagctcaacctcactgatcactagagaaatgcaaatcaaaaccacaatgagataccatctcatgccagtagaaatggtgattattaaaaagtcaagaaacaatagatgctggtgagtctgtggagaaataggaatgcttttacactgttggtggcaatgtaaattagttcaacagttgtggaagacagtgtggcaattcctcaaggaactagaaccagaaatgccatttgacctagcaatcccattactgggtatatacccaaaggattataaatcattctactataaagatacatgcacacatatatttattgcagcactattcacaaaagcaaagacatggaatcaacctaaatgcccatcaatgatagactggataaagaaaatgtggtatatatacaccatggaatactatgcagccataaaaaggaatgagatcgtgtcctttacagggaaatggatgaagctggaagccatcatcctcagcaaactaagacaggaacagaaaagcaaacactgcatgttttcaacactcacaagtgggagttgaacaatgagaacacatggacacaggaaaggtaacaacacacactggggcctgttggaagttgggggtgaggggagagaatctagatgatggatcaataggtgcagcaaaccaccacggcacacatatacctctgtaacaaacctgcacattctgcacatgtatcctggaacttaaagtaaaattaaaaaaaacataatagcttaaggagattttgggctgagacgatggggttttctagatatacaatcatgtcatatgcaaacagggacaatttgacttcctctttttctaattgaattctcctgcctgattgccctggccagaacttccaacactatgttgaataggagtggtgagagagggcatccctgccttgcgccagttttcaaagggaatgcttccagtttttgcccattcagtatgatattggctgtgacaaaccagacaaaaacaagaaatggggaaaggattccctatttaataaatggtgctgggaaaactggctagccatatgtagaaagctgaaactggatcccttccttacaccttatacaaaaattaattcaagatggattaaagacttacatgttagacctaaaaccataaaagccctagaagaaaacctaggcaataccattcaggacataggcatgggcaaggacttcatgactaaaacgccaaaagcaatggcaacaaaagccaaaattgacaaatgggatctaattaaactaaagagcttctgcacagcaaaagaaactactatcagagtgaacaggcaacctacagaatgggagaaaatttttgcaatctactcatctgacaaagggctaatatccagaatctacaatgaactccaacaaatttacaacaaaaaaacaaccccatcaaaacgtgggtgaaggatatgaacagacacttcacaaaataagacatttatgcagccaaacgacacatgaaaaaatgctcatcatcactgaccatcagagaaatgcaaatcaaaaccacaaagagataccatctcacaccagttagaatggcgatcattaaaaagtcaggaaacaacaggtgctggagaggatgtggagaaataggaatacttttacactgttggtgggactgtaaactagttcaaccattgtggaagtcagtgtggcaattcctcagggatctagaaatagaattaccatgtgacccagccatcccattactgggtatatacccaaaggattataaatcatgctgctataaagatacatgcacacgtatgtttattgtggcactattcacaatagcaaagacttggaaccaagccaaatatccaacaatgatagactggattaagaaaatgtggcacatctacaccatggaatactatgcagccataaaaaagcaatgagttcatgtcctttgtagggacatggatgaagctggaaaccatcattctcagcaacctattgcaaggacaaaaaaccaaacaccacatgttctgactcataggtgggaattgaacaatgagaacacatggacacgggaaggggaacatcacacaccggggcctgtcgtgggttggggagagggggaatggatagaattaggagatatacctaatgctaaatgaggagttaatgggtgcagcacaccaacatggcatatgtatacatatgtaataaacctgcacattgtgcacatgtaccctaaaacttaaaagtataatacaaaaagataataataaaagtacatgtagaaaaaataatcagaatatatctagtaaagttcagaaaaataaagtataactaaagtataaaatatttcaacaatatttttaatgaaatatatgaaaacatattaaaaggaattctataccaaaataagaacgtaaaatcacttctacaactacagtctaatgaagtactaaaattatattaaatattaatgcccaaaggtttcaatatttttcttggatatttttaagtctcacagggaaggaagtggcagcaactaggctcatgcccattccttacctcctacaaaaatacccacagaaacagctaattgaaaactgagtaccgattccctataaaaaatggtattgaaatgagaatatcattgagtactcgattttaaaaaattcaaaagaagtggaattattgttcctgccctgctctgcaaatgtcactggcaatgccaacaataatattcaaataataaggattctacataaagcctttcccaaaggagttcgagtttgtccttagataggttctgggtcatcatgccatattactctattcgcctctgatccctcccagccataaataaaacaagcacaattcagaaaaactgatatctacataaatgttaaatttgtatctctttatataaaagtggaaagttattttaatcagaaagaacgttcaaatatttggtcctatgctattaaaactaaaaaccagaaagatactctggtatcttttttacttcttacaatgtattttgaaaataagatagcgttgatttggagaaacatttattccccatgttctttattttcatgtggaagaaatgctagtgcctgagccacagaccaaagtaattaaagaaactctttgttgaggtctctacatattgtatagtatcatctctacatgttgtacagccaggaatgaaaatcatggaccaaaattaatacttctggcctttacccatcaccatcactcactctgccattcactcattttctacagtgggaagagatatgtattatctatttagtaatctttggagaagaaactaagcatgttcagctcagctgcagcaagcttagaagacaccctgtactcaattccacatgttctggtctgctgtctgtcttgtgataagggtgctgctcctggtagagaaaatctacaattgtccagtgtcgttcttcggatgaaatgttagcaatcccacttggccatagatcaaagttgattttcaaaacagctctatcagtgataaaggtcatattttggtctccatccaccagatgcatgcatttatcactctattggatctagaagtaaatggctacaagggcgtttacttatatatcactcccttctcacacaactgcaagagtataatttatattttactttacctatacagcagaaaactaaggaagtgaccaaggtcacacagcaagcaaggtctgtgtgcatatttggaataattatgagggtcagcgttcatggttaagatggataagtcaaactaaagtataaacaagaatcaaactttaaattacaggaaagattgttgcttattcaagagtagttagttgcccataagccacatgcatcttttaaacctacactatcccctgagaattagtcaggacaaatggtttgtagtatcttgccatatttaggttcatgaaaactaaggtcaaacaggcctagtttgaattactgttcagtcatttggcaaaggtgtgactttaggaaagtcactaaaactctttaacttcagtgggctcatctgtaaaataataactcgccttacgtgtttaacatgaggattatgtgagattatgtttgtgaaccctttggtacagtgttcagcatgtagtaattaatagatgagtttgtaaatgaagacctgacacagaaaatcaggtaatatatttaacataacaaagctacagagtggcagaacggatctaatatattcattgtttttcatctttaatatcatatccactttcatttccatgaatttctatcaaactagttctcaggaacttaaattgggacttcccacctcgcttcctttgcacattcaagtctgtgcccctgagatgtccacatccaatctttctgctctttgatgccatttattaggtctagtgctgtaagatgtgacctccacgaagctctcagagatcaccaggagtgacttcctctctcattaacaaatataaccagcatctgtccagtgattcttatcaggggagatatttggttgaaatgcatgatgcacatgtctcagtcatcttgctggattttatgctcctgggtagtgggatttgtgtcttttgtttgtttcattcattaccttatatagaataagcacttaataagtgtttgccaaatgaaaaacagaattagtgaacttgccaatgtccacatagaaagcactgtatttctcaaaaaataaaaaataaaataatgagattgcagaagcaacaacaaaattaaatacaattaaaatgtcatataatgtcataaaaaggaaataattatttaggatgaaaacgtattggcatgaagcaacttcttccctgtgtgatgcttctatgatatttgggtttcaattatatgattccttcaactcatttatggagagatttatactgagcaaataataattggggtccagctaagagttgagagaagcttggtttcctcatactacaacgaatcttcagaccaaaccccaagaagctgccggtatgttttggagtcatcacacagaaacttcttgaaaaataatttacattttggtgaagataagaaaaaattattactgtcctgattaaaagacgaactagggctagatactaattcttttggtgccctaggacatggatttttccattatccattgcagtacaagtgcagctgcctcacacaaatctcatttactgcacatgcacccatctatggctgctacaatgcccagcaaggcactttttctacaacagggccaccatattcagaaatgggaggaaaggaagtctgtagccaatgtctggatgtttggataaaagccccatccttttgccttgaggtgaaactactgtggtgccattgatgctacaaagttccttgtgagcatgtgttgaacctcgatttcagccaaatcacatctttgcttggcctctttgcctgccttattctgtgccctcactgtatcacaggttttctcctgagaacacttcttcagcaaatcacttccacagaatcaaggtggaagagcctgagcctgcctatataaaagtcatattacaatgagaacacatggacacaggaaggggaacatcacacacaggggactgttgtggggtggggggagggaggagggatagcattaggagatatacctaatgctaaatgacgagttaatgggtgcagcacaccaacatggcacgtgtatacatatgtaacaaacctgcacgttgtgtacatgtaccctaaaacttaaagtataataataaaaaaacaaaaaacaaaatacaaaaaaagatatctattctggctttttcttttaaacagttccttattttttattttatgtttcaaaatttctcatcctgaaagcagtggtgattttagcctaatcactgaactgggtataaacaaaaataaaaaatatattctttacacaagcatgcagattaaaagcttttagagaaaaatcaagggacaaaaaattaaatcattttattttttcttatgaaaaaataataatggatacttcctatgaaaatatataaatacagaatgttatgttaaaacacaactgttacaaatactattttactgtagatattgttctatattttgttatctttttaagtagctttcattagatttaaattatactacataccaattttacatttagcttttagttcttaaaaattagtgtgatgactttgaatatattgactgtttactccctgtaactttaaactgctataccatcactgttctcacttcctttctgtgacaaaggaagcaagttgctctatcctatcaaagaccaatatttctacatgtggtctaaggctcattccttcttaccttcttagagactacactcatctcttgttttctactccacctttatttgctaatgacatacgatatttcccctctatggggaaaatgatgcaaaacaaattcttccttgctccaaaggttgctctggctactttcctttttctctactcatttcatttgactttgttaatttttccttcacattctctactcctagtttcattaatgaaacatatcattgttttccctcctaaatatttgatcaccgtttaaaaaatgatttggttcttcctcctactaataccttctacatgtatatttctgttgcagccgacatttctaggcaccagacccaaatattcattcttttattggcatcttcctttagatgcttcatccacacccaaatatgatccatccacactgcaacctcttccgccacacttgaaggatggcccccatccagtgggatggagacgataacatctaatgtgtgtgcttaattctctctgcacattcagccatcttttcaatagaatgtcttggcaatactggtctgctctgccctcccatttgcaatgctcttgacccttctattacaccaggtgctcaagtcggaagcatggggaaatccttgccttctgcctctaattctaatccaccagtgagttcgatcatttttgtttccaaaatatgtcttaaagttgtccactttttaaaatcaccactaccagcttctctatctcagtcttgcatcccatcttgtttggttgatagtagtaatttcttcattttatgaacatggaagccaattttaaacagctaataagtggaagatggtggatttaaatccaaattaatttttataattttccaacaattaaaatctctctatagcaaacaaatttcaaataaaaaaaaaacttttgatcaaatgaaataaagtgcttttagtaatgaataaaaagtaaaacctaccaagctctctagatatatttaaatcatctaaacaatttcaataaataacttacaaatatttgccctcaaatgctcaagtcaagacattgtctataacagaccatataacaaggatggttgaaagaaagtggattgattgcatcctcagcagttcttcattaaattgcttttgtgcctttttcatttagatgttcttaaagcccttgttatggactaaaggtttgtgtccctctaaacttcctatactgagatcctaaccccaatgtgatgttattagaaggtggggcctctgagaattaattaagtcataaggatggagcccttatgagtgggattagtgctcttataaaagaaactccagagaggctctagctctctttctgtcagatgaggatttgaggagctggaaatctgccacccaaaagacagtcatcatcagaacccaaccatgccggcaccgtgatcttacacttccagtcttcagaactgtgagagctaaatgtgtgttgtttaagtcactagtctatgctaatttgttatagaagcctgaacttactttatactttatatatactttatatgtatatatacatatacacacacacacacatttatatatacacacatctgactatacatatagttatatacataactacttataactatatacataaacaatatctatgtatgtatacacatatataactgactagcttttaataaatgtataaatactttatacttgactaatttttctgaatcaagggaggcaacaaatgtattttgagtttcagagaaatagttaaatgagatacaatatggaaaattctaactttaattcatctctttcctgtgttttaagtgctatttatgcctaaaatttattctcattttccaataactccttgagccattgactcactcttatcacctgcaggtcatttttctttttctttttgggtctagtttatcaatcattcaataagattttattcttagaaacttgattatcattattaatctttctatcaattcatttgtatattggttggagatggggcccataactaatatttttgcatcccaggttgttctaaacagagcattttcatctttttttttttttttttttttgagacggagtttcactgttgtcacccaggctggagagcaacggcacgatcttggctcactgcaacctccgcctcccagttcaagcaattctcttgcctcagcctcccaagtagctgggataacaggtgcctgccaccacacccagctaaatttttttttgtatttttagtagaaacggggttttgccatgttggccaggctggtctcgaactcctgacctcaggtgatctgcccacctcggcttcccaaagtgcttggattacagacgtgcaccaccgcacccagccaacagagcattttcttttaaactaggaatattagcacattgaactattcatccagtcagctggccatgcattctttcattaaaaatatggttgactgtcatgtgatagtgtactaattgctacaaatatatactctacatgcacacacaatacaaaatttgtaaatgcatacaaagcaaacagaatatgtgggctcactgaagttatggaaaaaataatatatacataaactgtacttagcctaataagtgttatgtggaggaattaaaggatactatggcagtgtgtagcagatacattcctaatgtagtatggaacaagtaatgttcctaaaatgctttctaaaggaagttctctttgttatgctactgagtttaatcaatattaggttggtgtgaaattaactgcaattaattttgcaccaatctaatacgtttgacttaatataattatagcaaactttctatctggaaaatagaaactacagcatttctagcactgtaagtttttaaaaacatgattatgtaagagagcaaagtctcagtaaactttcaaatgtacacataggacatattctttgaactcccacaaacagaaatgagtaataccagtttaaattcatgattaaaaaaacacccgaagtgtttctttcaaaacacactcctagataacttctcaatcagaaaagaaacaaaatcttaaataaggctaataaatcaaaaataacaagaacacagtatatggaaatttataaaatgtcatcaaaggcctaatctgatgactacataaaaactgtctcaataaaaaataaaaattcttaatatttgtttctcaaactttatttaaaaatatatataaggtagaaggcaatataaaagtgtaatttgaaattaattaaaaacaaaaaagcagtatttgacaagtttccttaggataaaagtcactaataccaattaaaattttaaattaaaactctatttataaatattaaaaagattaccattataagaaacactatatatgctaaattaaagaatatgtaaaaaatgaaaatttttctaaataacatgcaatttgtcttagctgacttagaaagaagtaaaaaatatgaataaataaattatcatatggaagatttgttgagaaaattttgagacaagattttttgtttttaaatttttagtactggagtacatgttcaaggtgtgctggcttgttacatagataaacctaacttaggtaaacataactttttctgattctctgccacctggaactataatcacaatatagctccacccctaaactttacaggacaaggataataatacaaataaaggtctgcatacggtacatttaaacactgaaaaggtcagaataaagacatccaactagtaaataagacatagtatacctcccacccacaatagataaactttccaaatatatgtatgtaaagctacaatttcacataactaaaaattggcaaaaaatcaatgacaattgaattaaatttataatgctgattctgtgtgttcgtgggttgccatgcttgtgagaataataaaataaaggcattctgtttaaaacctacatttttaattccatatatttatgaatctttcctcaatttcagcaaaataaagagctacattgtttgaatcaagatttttgctatacatgcattttattgaccagaatgttaacttaggcaaactttcttgtctcagtttagtttgttatttttgaattttaccataatgagcaattatattattgctaatttttactttctcatgaaacaacatcgggtacttcctaatttaaaaaaaaattagtatggcatactatctaaagaaataaagaaaaaaattgaaaatagcagtgtgatagttgactgaatcactcttcttttgaaattgagaaaaataatttttctaaaaaatgtaaaaataattttaaccttttttaaagtaaccacactaaacctatttttttggtaaatcattccaaataactgtagactgcacaatttccaaattaatttaattttctccccaaaacaatttgcttctagtagttttgtatcttatctacattaaatcaaattgtttttactgaatttggatggcattagtattgtgtgtccagatgtgatcttaagttgaaatttactgtgtgcttcataagatatttcacatttgggtagattcagaaagcatcatgtacaatattagaatttttcgaaagaatatcactattagcacagtagcacaaactataagccgtgcatggaaaagagaagtcttctgattttcagtcaaatttctggcaggtgcatttttttttcttgtctttgacaataagtcatatgctgcataaggacgtttctgtcaaggaaaaatcacatatctaatggtggtcccgtaagattataatagaactgaaaaatgtctactgcttagtgacatagccattgtgcctttgtgattcaatgcattacctttgtaatgcttggatacgcaagtacttacaattttattacaattgcctacagtatttaatacagtaacaggctgtacaggtttgcagcataggagcaataggctagaccatatagtctaggtgtgtagcaggccatgccaactatgattgtttaagaataccatatgatgtttgcacaacaaaatcaccaaacaaagcatttctcagacaatagtccaggtgttaagaaatgcatgactgtatttaaattatctaaatatagctaacatttaaattttattgttgaaaaaatttaaatattgttaaatacattttatgaaataaagtaattcacaattcttgtatttaagaatccatctagttgtctgtataaaaattgatatgccttgctctttttttttttaacattataaaatatttttcggccgggcgtagtggctcacgcctgtaatcccagcactttgggaagccgaggcgggcagatcacctgagatcaggagttcgagaccagcctggccaacatggtgaaaccccgtctctacaaaaaatacaaaaattagccgggcatggtggcacatgcttgtaatctcagttactcaggcaagagaatcgcttgaagccaggaggcgggcattgcactccggcctgggcaataagagtgaaactccatctcaggaaaaaaatatatatttttcagtcaccatgtgcaactgctgcacacttttaggacacactgacctgcgtttatatccggatcacacagagaggcaacaaaatggagactcatcccttttgggaagtgactatgtcagaaagcttatgctttctaagagaaaggaatttaacgggttaatttacttctctttcagctgttacttgcagtttcatagttctgaaatagacaatggcatcacccatacatcttccagtattcagttatagtcatcttttgctttgatggttattgagaaacataacggaatgcttccctggggccgagtgatgcttgtgtcataagggccttcttgcccaggtcttggagttgtgctgaagagaggagccagtctaagaaaatatgactatatcttgagtatggcagagaagaaaataaagaaaactgggtctttgatgatgtcatcaatcttctgaaataaatacctctagaacacacctatcttcacaactcttatgtgagaaagcaaaagtccatttgatttaggcctttttaattggtgtatcagttaggatttgatgacagaaaccactctatgtatttcaggtgtgaagcatttaatatgggaattatgaacacacttcgacatgtgaaagaatggagatccagaaagccaccactgaacatctcaacttgtaaagctgaagtgggagtttcctcagattcacatggaagatgctacaattctcaaaaatctctagaagtttctatcaagtactcaaacatcaacagaaaatcatgatattcttaagagcttgctggtaagttactgtgaatctcctgtctcatctggctacaactgcctccagaggaaaaaaaagatgtctttctcttaagccttataaatcttgcaaaacacctcttattagcagactctgacccctaacctatgggtaacaggacctgggtaacatgagcaggatcctgctcttctgtatctacagaagagggaagatgggggctgtgatgacaccaagttaccacagacaataacccaatatcatatttgggttttctttcacttacagctaaaggtactcacatcacagcactagatgcatttatattaaaagaaaaaaaaaacaaggaaatttattttgtaagaatgtcaattataacatagttataagataaaaatattgaaatattcatggtgttttctttaagatgctgaagttattaaaatatttgatagtctctgatgcaaaagatcccttgatatatcattaattttaaaacagaggatttagaacagtgaattcaacaatatccctttggtttcatgtatttactatataagaatccatttttttgaattatttaaaataaacatatctatataatttaagaggttgattggtgaggggaattaaaattttctcccattgtatttgctataatgacatgccactaaaatatatttagattgactcataatttaaaattcttaataaattattaacattataaatatttatagatttttctttggcactgtttcatagaaatatgcaacaagtgatttctggagggatgatttatagagaattttaaaacctaagcacttatagcttgaataaacaagaccattacacgtatatttaataaactttaacaagtaggaaaacttatcacctactacaaagaactatctttgaaactaaagtcaatagtttattcaaaatttatcaaatacctttactgcactgtatctgtatgcaagtaaagttgtaaatatgtataatggtaaatatttgtctttaagctaacatgataaagatatattatgtagatatataaaatcatgaaaccatggcagtcaaattgcaaactaaacaaattctaaaatataagcattaataatgtagagtggtaatacaaaaaataagattatctgtgattctaattttttaatttctagggtaggagtatgaccacataattaatcatccatatagaatgtgaaattctgttttgagaggatagggggtgctattaattatgatgagtcccaaggttcaaacaagggtgtgtggtcactgtacagaaggaaaaggcttcatagaagaggtagtatttaaaacggatcttgaagattgaatctacacagagaaaggtccgtatgtgtaagtaagctattaatctttcctgacaagaagaaactaatccttctcattattgccctccaatgatccaattaaaacccaaatatattaccttggaagaagaagatgtttaacatttattagtacattagaaataatggtatatttgtttggttattgtcatttaataagacggtggaagtgaagagaaatttatatgcttttttcctttttgaatttactttcttagtttggcacaataattgtacaaattcatggaatgcagagtgatgttgcaagatataggttagtgataagatcagggtaataggcatatctatctattcttaaacatttatcatttattcacgttgagtacattcagtattcttctagttatttgaaatgactcagaaactaaagggcactatgagaacattgaatatcataggacatcaaaataggacccagaagtaaacaaaagaaaaaattactatttaataactttaggcagttcaccatggctcatgcctgtaatcccatgtaatcccagcactgtgggaggtggagggcagcagatcacttaaggtcaggagttcaagatcctcctggccaatatggcgaaacctcacctttactaaaaatacaaaaattagccgggtatggtagcaggcacctgtattcccagcttagtaggctgaggcaggagaatcctttaaatccaggaggtggaggttgaagtgagctgagaacgtgccactgcaatccagtttggatgacacagtgagatcctttctcaaataataaattaaataaaataaaaaactttaagttgaatctaagatctattaaatttaaaaggaaataattgtgtttagtaccaagaacaatataagtatgggaaataaaccattttaaaaataatttgttgaaatgtcaggatggcctaagaaatagctctagcaccatgttatgtttttttaatttttttccagtttcaagtgcttaccaattttttcttctaatcctataactttcttggacttcttctgttggctctgtgagtttcattactaaatctgttaggaaagtaggtgtttttttctccattgatttcaatagactcatctattttaaattacaacatcttaaatttgtagactcgtacattgttgagtagtcatacaaatagtaggcattcttgcctctttcctaatcttaatctttgtactgaggatagattaagtaataaatcataaactagttaattaaatgtactatgaataaattaaggcatcccaaaataagtgtgctcctggaaaattatttttgtgaatattgaggacatgcaggaaatatgaaggttaacatagtaagatatattagtgaacttactttatgagaaaattagccttataatctacacatacaaaaaagtaaaatatgatagtaaaattgccattattttcccatatatctgtattatttgaaatgaggagcagcatctcttactattatttcagattgctgattttagagattattagacaaagaaaaagtacatcttacaactttctattctaacaagttaatataactaacataataagttattatttgaaagaattgaggtcaatctattatacacctaaaatactattctgtaaagttttgtattataattcacatattgaaagtgtaaatgagttgggaggcatatttttatgattttgcaaccttgagaaattaagcccttttagctgaccttcggtcattctatctatatagtgaggatatcttatgccgtaccctactctcctcactcatttgcctaatttatcattatgatacagagtgacagactgacctaagattaatatattttctttgacttactgaaaacttgattccttgcaaaggcatagagaaggttccatttttgtctctttgcatgtattatatcaaccaggggaaaaactgttttgaattatattttcattttagttttctttttcctgcttaagagacaaagaaataaacacacacacatgcacgactttatgttgataaatatgaatatcagttaggctagactaggtcatgttgcagtatagtaaaattctcaaaacctcagtagtttaaacaacaaacttctatttcgtcttcatgcaacttctgcactgagggctgctttgatcactgcatgttctacaagaccttgggcgactgaggtttcatctttatagcctcctattcactgcctcagtgggaaggggcctctgaagaatcctgcaaatgatccagtgctctgacctgggcgtgacacatgtcataccttccaccacttactggccagaacagagccccaaatcatcacagtagggctgggagttctgtcctttctcattgtgtcaaaggaagaagatctagacattgggaagcattctaagatttcacattagacaatgttattggctcagaaatcataaatatgttagcctctaatcattttaagtacaatgtagtcaagctgtttgaatgattctaacccttcccttatcatcagaaagaccgttaaaattaagattaattgtgattccatcaattgaagttgaacattttctatttggagataaaggaatgaaagtttagagagcatgaaaaacctagatatatttggtacagaatttataaaccagacttgcttttaagaataatatagctataaaaatcagtgaacttagctacttgctttcaatcactgacattttccaagctgctagctggccttcactcttcacctccaggacaaatttacctcctctacagagccttctgctaatgtagtcctccttgcctacttaggcaaacagagccagagcaatctctcactagctatcctaactactacattcttagtgctcatcatgttgcctgcatatattattttcttattacttgtgaccactaccttccgcagactgtaaatgctgcaggatcaaggactccagtggcctgttaccccttgtgtctttggatcctaccacagagtgacatctccaacttctgaattcctctgtgtccttggtatctgtagatctgttttagcactttggagccttgatcacaaactttcctgtgtttttctgataatacttattgaatgctaatttataaaatgcaagtaatctctatagggacattaaataaattgttctctgaacacatttagctaaaacacagacttcaatcttaataacagtatttaaaaaagaaaaaggaaccaactcttactatgcaccaggtaatcaagttttagataatttaacttacttggcccaaaccaccctaaactcatttacacatgagggaattaaaactataaagggtcaagaattgccccaaatcaaatggctcataactagtaaaatcaggaattgatcttagatatattggctccagagtctgtgagcttaaccattttgctataatgccctcttattggtagattctatcttcccttaaaggttctaattttggatttgtcatttttctctgttttgttttgttttgtttcctttgtatacaagaggaaaaaaaatgtattgagaccagatgatctctagatctcactttccattccagtagtctatgagtcatattaggaaaactgttttaaattgcaaacatttagttacaagaatcttcatagtgtctgttcagatacagctaactgaagtgacaaaaattttatcatgaacattctatgctgtcatgttagtacacttaaaagacaaggaacaattatagcatgctgtttaaaaagaaggcttcttcattataattaattactagtaaacataaatctgtttcaagaatgccatgcccaagataaatggaagtgtcacatgccataaccaagagaaagttagaaatcaaaggcatttgaagcaaccacatatagatacataatacatttccataaaaagctcaaaacttttgctaacttttgtttcaacaaaagttgctaagaattacctagacacagaatcttcaattttataaatcaaacgtgtggggaatactagattaaacaaagttaaacatgtgttttagaacatttactataaaaatagaatcatacatttcttttagaaggaataacagtgtttcccaacatacttggccatggaacccctatttcttttattaggcatctcttgtgattaatggtccctgaaatattctttagcaaataacaaatgctgatttgagatctaaggaaacatgaaatttaaaagtagtgagtttagtgtgaatgtcccagaaacttgaaagaaacataataaaatgttagctctcttactaatgtaactttcaaatcaaaagtttaatttttctgtagcctgatatagacatcagttgacaaaaacatttaaatacatttatatatgtgtgcatatatatggagatgcataattgttatgcatatatatgcatacatatgtcaaatataaactcttcttcaattcagttctgaacaaagcaattaacattctaaaatgtttatgaaaaataagaatgtctatattgggaagctctttttaatggacaatatgcatgttcttagagaaatattttataggggtgagtgttggtaagaatcattttggctagggtaaaaatgttcagtaaaatataatcttcactcattatttttttcacaagctacagctcactgctacaaaggtcagcagttatagtcctcagtggattcttagtatgtagaatgagggagtttgaaatgatttgttctgtcacctgttcccagaaaaactgacataatttaatatgatgactgttctcctttacctcattaaaccagtaaaggagagctgcatagaatcctaagtaatttatgacttaccacttgcaaaatatgagtttggaattctgaactccacctgccacaactgcctactcatgcccaccactagccaaaatcatttgtgtgcctagaatagaaaacctgcggcaaagtcccttttaaatcggacaaggcaagtgtacgtaagccagttatggtgtaaatatacaacacctttgcctttcatcaaaacaatgatttcaggaggggattctcctttatactgtcatgacttagaatcaatgagttaaaaaataggaaatattcaaagtatgaacaataatatagcaaaggaaaagaaagaaattaaaaacctttaaatagaagtcttatctgttggttgataatctggattcttacaggttagccacacagtaagaggagactgcaaagtatattttataatttcagaaacaaaaatgggagtaatgtactataggagtacccaagaaaagcaaactgttatatttccttgcttttgcctagagttagttaaattccatatgctaactttggttatatgatgtttatctctggaaattcagttctgtttctgtttcatataaaattaattcattgaatttttggaaaaggaaataattattacttaaaaacaatagtttggttgacaaaacattttcagaagctgtgacagagagatgtctatataagaaagcataatccaacttcagaaacagaatgcaaagaaagaagagatagtttttcaagtagaaaagactatactcaaaagaaaaggttagtgttcttttaatatacctagggaaataaattttaaaaagtcataagagcaaaaaatcaatatgtgccaaggggtaacattccatagcatttctgatatctttataatatttaaaaatcacagcttgctgggatttttattaatgacaaatgaaatagattataaatagccatgaacctaacctccttcaatttgtagagtacttatcaaatttctaaatgtgatttttcataatgcttcttttcacagacactacagggaaggatgtcatcgatgctatttcagatctgtcatatataatcttctaatctgccaacttttgcaactaaaagatgagctcatgtacaagctgacaagaggtggtaatgagtctaggctttcttgaaggttgttaaaagtttaagtccccggcattgtgcaggtgctctctgaattggcttggcaatttttataatgacagctgctgtcaggtgagaggataccaggaatgttgtcagtaacagtgaaagagtgttagaaataaaagtggccccagatattggcaaaagtgatttgtgtaaacttatcaaatttctttgggagtcctggatggttcatttttccctaggtatgctttaaaatcaccatttctgctgatgattatattatctttatatggaaattaatcagattagctgaaataggaaaaaacccagacacatcaatccggagtttatggccctgacatttccaagtctgaaaaaactcctaatgtataatattactaccaattattattagaagtagcagcagcatcaatgctcctataagtaatactacacgctttaacgtatatgtctataaatgtccacggctttcagttacttctttggaagtgatcaaccagactagattgccattttacattggaatttggataatttttttttttccagaaagtcgagcctaagaaggctgaggcctaactttagatccacataccagggtgctgtaaacacaagaagttatccaagctttgtaactcactgtgctatactagatgaatattactggagttatgtcagctttttgtataagctaaaggtcttaggccagttccaggaagctgttacagttatcacttttatttgtttgtttcatgttatattttgtcttctcagtattggtttttattatttctggattagttaccagttcttcaaaattggagactttgcctaaaaagcaaattttcatcttctaaggaaaagtagaatgtatgggaacaggaggatcatgttcaaacacagccagagtgaaatctaaaggagtagctttgagtgctttggaaggccctcaggtgaccgtattccccacctggctggtttcgcacattaagactacctactggtcttgataattatgtgaatttgataattttgcaaaagatcttcaagtagcaacaggttcttacagaggagtaaatatatatatatacacacacatatatacatatgtgtgtgtatatatatgcagtccctaactgagttccttagcagtgagaactttgaacatttacttttttacccaatttcctatgaggtccccagagagaggctgacaagacaaaaacaggtctccattctcagaaaaggaatagacgggtccctaaacggcaaaaacaagcgtccaaacaaaccctaagttatacaaccttgactcctggagatggacaggggatggtaattaatgaaagaaaaggatttcaagaactgggtcacatggtcactttcggaagagcagcacatacaacttgacactgaatcccagtagtcactgggcttgtttactactgactgccttaggtaaagattggtgttggaatttggcagtagggcccatcttaaagataaggatccaggaacccactgctactgtgaaggtaaaaactcaagactgagccaagccagacagacagccataagtgtgtgtttctgatcatcagaatgtgggtttagcaaatacaactattagtttaccttaatgataaagcctttaagctctggagagtgtatagaaaagagtcaagtgcagaagtgttgttcagaggcaatggatattcttcagagcagatgaatattttaggtacagccagtgcatggtaacacctctgtgtcaagaaactttttgttcaaaatgttctattgcaaggttaagttaaagaaacatactgttccacgagatatctataagagaattaaaactcaaggcagtgttgtggatttcagtctagaagtctgaggtaaagttcattttccttcttttaggtcacagagtaagtcgctatagcaatcctagacctgaaacgatgttgcattgtttagtgtctgttgccattatctgaaatgatctaggatccacaatgtcagtgtcaggccaggagacctgggcattaaactatgcagcataggtcaccctttgtctacattgacatgttacccatgttatgaaccaaagattgcatctcccaagcaaactgagtccagtgcaaacatcacagggagcagcagagaacagaagcacatagcactgagtagctgggtgggccagggtgaaatactgtgagcttcacttgctcatgtataaagaaaatataagcttagtgcttactgctaaggttgttatgaaaatttcttgactaaatcatgtaacgtttttaaaggtaactcttcactgaataaatactgatgatgatgacaatgatgatgatggtgataatgatgatgatggcagcaactagatggactacatttggaagcaaaccaactttttaacactgaatcaaatagaatgaagcattttaaaggctgggttccagaaactattctagttggggaattaggccaggtggatacttaacttctcctgactaatgcctatgtatctttccagtctcaggtttgatgctgtttcttcaggaagtcttccctatcatgctatcttgagtcaagcattccagctttgtatgccatgatattctgccattcccaaatcataacactttctgtgattcattgttaaaaagtttgattgtgtggtctgtatatattagtaatctgcaaactccatgaaggtagcagcctcttcaacttatgtcctacaccaggcatagcactaagcagataggaagggctcgataaatactcgctggataaattaatctatcaattgacttggtataccaacccacccactctcaactcaggtaagaatgtagtaattaaacccatcagatataaaatcagcatcatccagaaaaggggtgataatttttcaactatgatctaatgtggaagtattaccaagtgaaagtataaggctgttgctattatacagttacagaattaatttgaaagatttataactccctatttttggaaatcataagtgtgattacttatccgttggaagggtatgaacattttccagtgccggaagaaggcaacatacacatgtagtgcaacacttaatgatgtatttatatgaagatatttgagtaccacttatcttagatttgggggatgccccagtgaacatgataaatacagctttgtttttagttttgttttgttttcatggagattatagtcaagggagaaagaaagaaaacaaatcagaaaccaagaaaataggacgatatcagatattggaatgtaccgtggaagaaaataatattgggtaatggaatgcagaggactgggaggtaatgactggggttttcttcaattagatttcatagatggcctgaggacatggcatctttcagataggaacaatgagaagagctggcactactaagatctgggaggatgtcattccaggaaaaagtaatgacacacaacacatgaagactctctgaagcagatgtatgtggcctgtgcaagtgtccaggagagctacggaggccagagcacaaagaggaagagggagaatggagtgaagagaggtcagagaggaaggacaatccagggcctttggacttagagcacattcacagtctgtatattattctgattctaatggaaatccacgaagttttcgagcaggtttaggttattcgaaaaatcatgactatcatgaggagaatgtacccattatattatgattgctgaatgagcacattttatatcaacttcagacatcattaataatcatttgctaaagattgtgtctctttttgttttagagacaaggtctcactctgtcacccaggctggagtgcagtggcaggaactcggcccactgcagcctctacctccaaagctcaagtgatcctcccacctcagcctccccagtacatgagactacagacatgcaccaccacccctggcaaatttattttaccttactttttgtagaggcagggtatcactatgttgcccaggctgttcttgagttcctgggctcaagcgaccccaactaccttggccttctaaagtgctgagatgacaggcatgagccaccatgcctagctgtcttctttgccaatacactgtaatttcaaaattctatttttttttttttttttgaaacagggtctcactctgttgcccaggctggaatgaggtggtgcaatctttgctccctgtaacctctgcgtcctgggttcaagcgatttttgtgcctcagcctcctgagtacctgggaccacaagcacatgccaccaagtccagctaatttttgtatttttagtggtaacatggtttcaccatgttggcgaggctgaggctggtcttgaactcctgacctcaagtgatccacccacctcggcctcctaaagtgctgggattacagatgtaagccaccatgctttgcctcaaaaaagattttttttgagacagagtctcgcacagtcacccaggctggagtgcagtggcccaatctctgctcactataacctccgcctcccgggttcaagagattctcatgcctcagcctcccgagtagctgggactgcagagcacgcgaccatgcccagctaatttttgcatttttagtagagatggggtttcaacatgttggccaggctggtctcgaaattctggcctcaagtaatccatctactttggcctcccaaagtgctgggactacaggtgtgagccactgtgcccagcacaaaacttataaattttaatttaattgttctctattctccaaaatcctctaaatgattttgttgacagagcaataaaaacaaccttaattaaggcagcgtgggtcacatttcacatcaaaaacagctaatataaactagaacccaaaattaccaaacttcagaaaaatctcctacaataactccatcttatgtagcaccaacattcaaatcatctcacaaaggtggcaaagttattcatggataatttcatacaatgtctcttcagagcctgaaacattccctccaaaatgtgacttattcttctttcttttgtttgtaaccaactgaaatttaaagaaactcacatatattttatatttatatatatatatatatatatagaaaatttcaattgataacaaacaaaaaacaaaatgaaaccaggaaaaatatatacacatatgtgtatatatatatacgtatttatacacatatatgaagtacacatatatgtatatgtgtgtgtatatatatacgtatatatacacatgtatgtgtttatgtttttcctaatttcatatatgtgtatatatatatatatatatatatacacacacacatatttatatacacatatatatttctcctgatttcattttgttttcttaccagaaaactctgggacacacttagacattaccttctgttctccttgtagcatgtcatcagagtgagcttataattgatgctgactctcaacctggctgtgacttattgttcattgcagagttgagctcacagcatttggccatttgttataaattcatacaaagctttgcaagtaggtctccttgatgtctcgttatgctaccacctttaaatgcctataacaatcactgacaattctggatggtatgtagattttagctggtctctaggttctccttaatattttcaactcataaataaactatgtatgatatgttccatcacttatttcaaaataaattatattctgttttttccattgggatggaagagtttttgtatactctgttccataccagatactggtaaatgaaagttgaataagggaaagtggctttttttttttttttttttttttttttgtgagatgtagtcttgcttttttcacccaggctggagtgcaatgctgttatcttggctccctgcaacctctgcctcctgggttcaagagattctcctgcctcagcctcccaagtagctgggatcacaggcacctgccaccatgctcagctaattttcgtatttttagtagagacagggtttcaccatgttggccaggctgctcttgaactcttgacctcaggtgatcctcccaccttggcctcccaaagtgctgagattacaggcatgagccaccacgcaccccccaaggtggcttcttttaaggggtatagaatatagtggggaagacaaacaattgaatcaacaatcacgtgttagacataggaactagatgctataagggactttagccccctcttcctccctttctcgcacacagaaagagaagaatgtaagtcataggaagcctcctttataaaatgaagtttcaacaaggctttgaaaggtaaacataattatttgaagaaggaatttcttctatatacaagaaggcagacaggagtgaagatccagagcacatgtgaagatggtaggaggaatgatacttccactcactgagtgagaaaagggaagaagggaagcctgtgggtggaggctggtcaactgttggagaaggagttggggtgtcacacatatatatgtgtaatatgtatgtcacacatatatatgaagtcacacatatatatgaatgtatgaggtgaggttttctgaggatggagagagagttgagtcaggggacttggggaaaatgactgcttgagattgccagtgtgagaagtgtgagaccagaggtttagactagaaaatcaagccataagcaagttgatagttcattacaaaatgctgagctcaagggcctggaagtgtttataggagctggaacggtacttatatttgcataatatactaaaataattatatcttgatgtgaattaacccagttggctatttgtaccacacatgtaaataaaatagaattgtaaaagataccagcaggttttagacatataagtaattctgtgattcagtactcacttacaattaattttaccaggtgaaatttcaccccttatctaaccttcactcagccttcccctccctttctattgtctaaactacccaagctgtcctatcaccagcgctctctcctcacatggctccctccattccaatttccgagaggacttaagtaattaagactttgaatggttatcaagattataaactcaacctaggagagaaattataccttgcttttcattttgttttgctctttctacaacaaaaattcacaagcaagctgtacatgaaaacatactaatgctagggctccatgcctaagtactaaatcataattaccagcaactgaggactgggcatcagaatttggggaaagttacaaaggtgattttaatgtgaagacatatggaccacagtgttagctcctaattggcattcagagaaaagtgatgtgtttgagtggcttttgtaagaaaaaaaaaaaaacaaaaaaccaaccaatttataccagtcgcactgcaaaagcacaaaaattgcaattcttggttgcagtagtggggtcaatgtccttcaaatcacagataatgttttagaggtaggtattatcgacaatgttacaattcaaataaaaattcatttgttggaacactcacacatgttgtcaacctgcccatatacctgcatatgatttatttagccaaaaaatacaatgcaaggtttctagtgaactatataattttcttatgccattttctaaaaggcataaaaggcaacaaaacaattgcattgaaacaatgctctgacctgaataatcacacatagaaaatagttttatctggcaaaagccattaggagaaactgtgaacaaagtgaaaacagcttttgtgtattttggataatagtaactcagcaggactaaaaaagtaaagccctattaaatctacttcacgttctacaattcttgctttttcaaagagtaactctttgactcctgggttcaaatatttctgttcccaacacagaatacaattataaagctctctgcctagatttactgagcattacacttttcactaggatgtcagacactacatcaatgcattacaattacaattataccaagacctattttatttacagaaataattaataatgttgctgctgctgatttctgacacgccaaggaattgactaggcatttgaaggagaaaccaagagcaaaatagcgttagcttgtacctgatcatgtctgggcctcatgatgtctctttttcatcccattggaaataacatttctgcttcttatctcacaacacaaaatccttcctgccttttctagaaacttacagttctagaagttatccttttccatttcctcttccccaccctataaagctttcctttagctagttaacacctgaaaagaataaaatcctttaaaataaattaaaattcctaagacaagtcacatggcaacattaaaaatagtttaggaagtaaaaacaaaaattttgtatacattcatctttccaataatgcacacatcattttgttttccttttctgtctctgtgtcatattcatgaataatctttatatccattttatatccatttaattccccacaatctttacctgtctctgttgccatcaccgtgggccaaacagctgattcgtggtggaaataaagctccaatcaaattcagtttgactcctaattttgtgtgccatttttcccactgcgttttcagggtctggtgatgtgtttgaagttaccaaagaaattgagagcctgtttgaagttccacctgaggccattcagctaataattttccaaaataattttaaaaatcttcttctatcaggcaagttcaccaaatctgtagctgcaagagagacacatatggagcatgaacagaggcagagtgtactgtctgtagtgtcaggtgagtacaggaagctctgctgagcaacgggagatggatgtggtagcccgcccattacctggaatgtgtaatggatgtgaaagtgtagtcactgtacgctaatgactccaacagaaaaaagctcccctgtacccctgtggtgttcaaggcccatccaggaaaacagaacccaggtaattacataaaataattcaatatggggaaatagatagagaagtgttgaaaaagctaaacactaggaaaggggaggagggcaatgaaattataagcaactatagaaattgtcctaaactctacagttgtgaggacaaagagaaactattattaccagaaactagtgctaaggccatcctggaggagctggaaggacagataaggggacactcagcaagtgctgaaatgatgaaagagaagcagatactgcttaaagcagagagagagaattagaaatgctttggcttctcctagcctcctaatcacagcctcctgctggtgcttacattagagaaaactaataggaagccgctgggtgagagaacagagaaagggaaacaaatctgagagcaaatgggcaagtgattggcccaacttccaatccacccataactttattttgcaaacaaagtattttaaggaaaatcaaatacttaggatccttatcaataatatattaagagtatatatttcttgctagtttcagttattattatgacaatggttgttgtaagcctatcactacccttttcaggaaaatatggataggtaaattcattcatttttactacccatgatcaatttaatgccagtgaagccatcagaaagactcccttcccatagccatgtctcttgatactttagaatttgctgaagattttaagcgaaatatcagataattcaaatatttcaccaatttttaccttatgctgaatgtaatataaaatttaattattacattattatatatagctatatttcttaattttcccatgcaattaaaattttactgtgtactatattctttattaatttttcatgaatgtttttcccacttgataataagctctttgtggattaaaaacaatgagtaatatgtgtgttagtcccaatggcacctgagcatgttatgcatattgtgatggatttcagggttaatatacctcctttttcctcatcacaatgtacgttaaaatgtgcatgggatgtgggagactacttaaatgcaaggaaaaacatactattgagcattgctgaaatgacaaaatgacatatctaggtttcgaatatttagaaaaaaacattacttaaagttgattagttaacaaaatactatgttattaatgaaataacatattttgatagagtttctgagaaatgttaagcactatagaattttggaactattactaaattaatacaaagtggtttataatttgtgtaattctcaagattaactcatgatatatatatatatatagtgtcatatatatatatgaattttgtttcaaggtcaccaatcaatcttctattcaaagttaattgttctgaattagtggaataattatatatatatatatatagagagagagagagagagagcgagagagttaatctcgtgtatatatatatgtatatatcatgagttaatcttgagaatatatatatatatattctctctctatatatatagtcttcatttagagataaacaaatggtggtatagaaatttagatgaactgtcttacaccaaataaccgacaaattattgcactagtttgagaactttaatctattactttatttgaaattatttgctcctcactttataccaagctgtgtctgacgcaaaacctctgaggcagttaatgtatgcattacattaggcaaatttacctctaatacaattgtttatacaatcattttcttagttaaataaaagatatcgtatttattttgtgcacttagttcttgaaactaaggagaaatgaaacattttaggaatgagatgtaatttctgcacataaagtcttatttctttgtacccactgatcacataatgaacttcactgtacttcattagaaatacagactatatactctttgaagatttttatctgtcaaaattttgtttcaaggtcaccaatcaatcttctattcaaagttaagttaattgttctgaattggtggaatagtaattttcctagacagcagttaacaaccgtaaatgttaccaggaaacaaaagagactggtaggtcattctgtcaagaatgatgttcttacatataattttcattttcttttaaataccatcagcatgtcagctgtaaagtagggaagtgtggtcttgtgaggctgctggggaacattgccaagttgacagcaaatttcatggcagtgcagactccagaaccctggagttagataaactggatcttaatcgcaaccagctcctctactacttgttgtgtcatgtggtcatgtcacttaacccctatgggccttagattcctcatcttataaaatgggcatggtaataataacccctcatagaaatgtcattgattaagtatacataaatatgtatatgtatacatacacacatatattacatagagaagtacctggtacacagtacactttcaataatgttagctaccatcattatactgcacaaggatttgaaaaacaagccctacattattttccaacaacaaaagataagaaagacttctctgcttcttcatgagctatctttgcacagtgggtgactgaggtctataacatccaactttaggactgtcagaagtccatgtggagctaatgggataggttacactaatctcttctctaatatgccagctcccttcctttcagagatgctagagagacttggcagccttgggacggtgtaattgatcctttgtttgctgagactccagcaggaagaagagtgcttcactttatctcagtagtagagcagataaggaagagatatggaataaatgtggaaccaaaatgccaattaggcattcagctcctgcattaaaaaaaatcaaaacaaacaaacaaaagaaaaaaaaaacactgtatcctgagccctagaagaaactgaaatattagggactcacagttctcctgtggaatgatcaaggtctcctaatgagcttaaacattgagtctaaatgaaaacctgattttgttctggcaataaagaattcattccattttgcctttacttgagagtacatgatcttatgtggaagcaatatcacaatataattctaacatgcaaatgaagtcatagaaacaaagaccaataaaatgaatgcacgggacaaagttgtcacttgggaacaagagagacctgtgttcttatcctaactctgcatattacttattaattgcttggggttaagtcatctggattctctacttttacaaaagggatgataacatttctgtgcagtattgctagagttattagataatatactgctgcccagcttcgtgtcagatgcacagaaggttcacagtaaatgaggttattgttactttattagtttgtcttcagtgcagtgataattattctgtacaatggcagaacataactgaggcctccttaaataggctctgatatgctaacttattttgacattttcaatataaaaaagagctatgaaaagatttaatttattgagttcatagtttttcatgttacatataatgcttgtattattaaacctttccttaagtacaataggaagaagagataagtggcaaaaatactatttttatataaatctttttttttttaccattgctaacttgttaatatggacaatcatctccagccatctgttaactcgtctctgaaaaaaaatatttatttataattctaatggaatatagtttttccttgaattaaacagatgttctggtgtttggtatcctaaaaaggcagttctctcatatttattccagagtgatatagttttctgtggggtatcataataaactttttcttaataatttagagtccgccttctttagcttaaataaaatcaaagttccaatgtaagttaattgtcttatgctatacctagtaacattccaagtgtctcttttcagtaagaggataaggactagccatatattcccagatgtggcttactgtagtcaatttttgatggctgttactttgatgatcaattaagtacaatctatattttaagaataatctttcttcatttaacaatatgagaacctttacattttaactataattaattatgtaatgatcaaaagacacatttatgagagacaaaaatcctagaaaagaggaaggaaagaaaaaatgattatggaagaagatttcgaagggaatgaggtcagggtaaaagcaagtcacacttaaaacctgtggcctttacctagtaaaaaggtgttttagatgcttcattaatgagaagagtacattgtcccaaaatgcacttcaaagttatgtggtacaattggacacttgtatgcctagattcatcacttgcctttaagaaaatgtcatgggctaattaggaggtagtctaacactgtatctttaacaggggagaattatgacctatttttttttctttaactattcttggtatctcctcattaaatacaaattggcttattctatcatacttagggcaaaaatatattgaagacttatttttggggtgaaactttaatgcttagctcttatcaattttatttgaagtgactctgaggcactattttattcatcatagtagggacgtgcttcagaactggctaaacacccagagtttcctttcttttaaagtttaattgaacttcggtcagtctggtttctttggaatggctgattttaattgccactgctgaacaatgtcaattagagtaaaacctcagagattttaacgtctcagtcttaattagtgaagtctgtaataatgagtatatgtttataagtattatttctttttagaatcattattgctaatggcaacattgaaaaattctgggtcagtaagagctgcctcctccacatcatttgatacctgttcctattctttgctgtgctacctgcagaacgttagagctggtctaagaagaaagaggggtgccttctattttttgtagaaaagctgaggactatgatacattaactgcccccccacccagcaatacaactaatacttgaatacactagaaaatatttgtaaagcatcactaggatgtcaaaagggtagtaaaaatcttctggacagtcaggtgaaatatacttgacaccattgccagaatacaaaatggaaaactagggtaaacttggttgcaaagccatcccaaatatcttaaaataaatgagtgttcataatttttgtgcatatagtgattcgaaggcaagtctaataaagtattttagaaggaataataatgtgcttgctttaagaaatacagtatttgggccgggcgcggtagctcacgcctgtaatcccagcactttgggaggccgaggtgggcggatcacgaggtcaagagatcaagaccatcctggccaatatggtgaaacaccaatctcagctcactgtactccagcctgctgacagagtgagaatccatctcaaaataaataaataaataaataagaaatacagtatatatttataagtagcaatatttacttaaaatttctcccctgaagatagcttgttcacctaagcagttagaactgagtcacctaaatttgtgtttttcaatagaaagggtaacatgtgacattaacatagaataaaccttgctaggaagagcatatttcggcggctttcagacttagttgtgcatctgtatcacttagagaggtttttgaaaaggctgggcgcggtggctcatgcctgtaatcccagcactttgggaggccgaggcaggcagatcatgaggtcaggagatcaagaccatcctggctaacacggtgaaaccccatctcttactaaaaatacaaaaaattagccgggcgtggtggagggcacctgtagtcccagctactcgggaggctgaggcaggagaatggcgtgaacctgggaggcagaggttgcggtgagccgagattgcgccactgcactgcagcctgggcgacagagtgagactctgtcaaaaaaaaaaaaaaaagggagggcacatcctaggccagtgatttagaatttcagaaatctttagaactggtacccaggcacttatatctttctcttcttaaaaattcttcaggtaactttgatgtacaactattgttgacaaccattttatccttttgtagagagttctgtttacctaatctgtttactctaggcagcagaattttgaggttaacctactagagatattaacatttaataatacctacttggcttgtgtctggttattaatttaattatattaattaattatattaatttattaatttaattatattaattaattatattaattaattaattaatgatttgggctatatctccaaatgaaatatatatatatatatatatatatatatactaagcctttaatttaaaaagataatataccaataatataaattgtgtttgtagaactgggttcagattactcctcacttaagctatagctagaagtgtcaatgcaaacatggctgtttgtttgggggtcatgttggttctgctccatttgctgtgttgctgaaatgttccatgtcccatcacttctgttttgagatggtttctttattttctaagttcttgcataccaattacagataagtcataagtctttctatctgcagtacctaaaaattaattcttttagcatagtttttgccaatctcattttgatgtagcaatctgctttactcttgattgtactgagagcatggaacattcatatcttatataccttgattccaaaataaacacaatgtgtatgttattatattaaaagactatgtcttctttgttggctactacactcattgtgcagtacctagcacagaaaaagtttcaataaatattcattaaacaaaactgagctttatttttttttattttattttttttgagacagagtttcactcttattgccctattgcccaggctggagtgcagtggcatggtctcagctcactacaacctccccgtctcaggttcaaacaattcttctgcctcagcctccccagtagctgggattacaggcatgtgccgccatgcctgactaattttgtatttttagtagagatggggtttcttcatgttggtcaggctggtctcgaactccccacctcaggcgatctgcccacctctgcctcccaacatgctgggactgtaggtgtgagccactgcacccagctgaggtctctttttttctacaaaaaaacctaattgttcaaagttgagttattttggttatgttatgatagcttatttcagactttttttatctttgatgcaagttttctgcaaggaagaaacaacaagagtagagaagaaaaagttggctatttcttaccccataaatcccatctctcttaatgccatatacttccactccatgttctgctttatttatttatttatttatttatttatttatttatttattgttcctgggatattggaaatggttttaatgtctcaccaatatttaatgaaagccaaatagtttcaaagttgagaaagagttggagaatttctctcaaatatttgaaaacacaagactatgatccttccttggtggcattattgaagatttctcctaacatagtcttgaggtatctaatgctgcatatccagcttcacctgagcaacaatatagtaagctttaataaggtgaattttgcagctccatttgtgcaaactttgtgatgccttcattgaataaataagtgccagacccagactgagcattgttgatgctgaggttacaaaaaaaattaaaacaaaaaagattgggtctcagccctcaaggggctcaaagtaaaatgaggtagatgaaaacgtaaataaatgaaacaaaatatgtcatgatacgtgctaggcgctgccagagtacactggaatgacagagtattgaaatccctgtgagaaatattaaaatcagacttttgctacaaaattctttcttgataaataaataggcagggttaaaattgatttttccctactgaaatgtcataaaagaggcaagaacaatcctgcaatgtttagcctgacatctacttgaaatatttgagtagggggagagcttcaactataaattcttccatgaatatggatttcggagacctaatcctgtgagaaaagcaattgaagaaacatagagaaacaacttttgcaccatctggttatgtttgcatctactttgcctatataaggggtttgtactgatcatcatctgaattattgaccaaagagtacagcctgttgagtcactgaaacaaaaaacaccagaaggcctcaaatcccttcccccagaagtctgaatttctagagcactccttcatatcaggaaacatacaggaaaaaaaacagaaacacgatttaacaggtggggcatatggtaaacaaatatcggtacccttgtttacagtacggataacttctaagaggaggctgatatttctcatctctacaatcagactaataaaagttttgggaagacctttaccacagtgtaaagacttccctgacatttttgcatcttggaatcagggcatgatggaaagagatgtttggcagaaaagaacctgaggattcccgccattcttttacgcagcagctgtgcaacttcagggaggtcactttggtggcaataacagctaatgttgacctctgggggcagggcatagacaatcaaaacacagcaataacctctgcagacttaaatgtccctgtctgacagctttgaagagagtaatggttctcccagcacacagcttgagatctgagaacaggcagactgcctcctcaagtgggtccctgacccccgagtagcctaactgggaggcaccccccagtaggggtggactgacatttcacacggccggatactcctctgagacaaaacttccagaggaatgatcaggcagcagcatttgtggttcaccaatatctgctgttctgcaaccaccgctgctgatacccaggcaaacagggtctggagtggacctccagcaaactccaacagacgtgcagctgagggtcctgactgttagaaggaaaactaacaaacagaaaggacatccacaccaaaaacccatctgtacgtcactgtcatcaaagaccaaaggtagacaaaaccacaaagatggggaaaaaacagagcagaaaaaccggaaactctaaaaatcagagcacctctcctcctccaaaggaatgcagctcctcaccagcaacggaacaaagctggacgcagaatgacttctacgagttgagagaagaaggcttccgaagatcaaactactccgagctaaaggaggaagttcgaaccaatggcaaagaagttaaaaacgttgaaaaaaattagacgaatggataactagaataaccaatgcagagaagtccttaaaggacctgttggagctgaaaaccacagcaccagaactacatgatgaatgcacaagcctcagtaaccgatgtgatcaactggaagaaagggtatcagtgatggaagatgaaatgaatgaaatgaagtgagaagtgaagtttagagaaaaaagaataaaaagaaatcaacaaagcctccaagaaatatgggactatgtgaaaagaccaaaactacatctgattgctgtacctgaaagtgatggggagaatggaaccaagttggaaaacactctgcaggatattatccaagagaacttccccaatctagcaaggcaggccaacattcaaattcaggaaatacagagaacgccacaaagatactccttgagaagaccaactccaaaacacctaattgtcagattcaccaaagttgaaatgaaggaaaaaatgttaagggcagccagagagaaaagtcagcttacccacaaagggaagcccatcagactaacagctgatctcttggcagaaattctacaagccagaagagagtgggggccaatattcaacattcttaaagaaaagaattttcaacccagaatttcatatccagccaaactaagcttcataagtgaaggagaaataaaatactttacagacaagcaaatgctgagatattttgtcaccaccaggcctgccctaaaagagctcctgaaggaagcactaaacatggaaaggaacaactggtaccagccactgcaaaaacatgccaaattgcaaagaccatcaaggctaggaagaaactgcatcaactaacgagcaaaataaccagctaacatcatcatgacaggatcaaattcacacataacaatactaaccttaaatgtaaatgggctaagtgctccaaataaaagacacagactggcaaattggataaagagtcaagacccatcagtgtgctgtattcaggaaacccatctcacatgcagagacacacataggctcaaaataaaggggtggaggaagatctaccaagcaaatggaaaacaaaaaaaggcaggggttgcaatcctactctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagatcaatgagacagaaagttaacagggctatccaggaattgaactcagctctgcaccaagcagacctaatagacatctacagaactctccaccccaaatcaacagaatatacattcttttcagcaccacaccacacttattccaaaattgaccatatagttggaagtaaggcactcctcagcaaatgtgaaagaacagaaattataacaaactgtctctcagaccacagtgcaatcaaactagaactcaggattaagaaactcactcaaaaccgctcaactacatggaaacagaacaacctgctcctgaatgactactgggtacataaggaaatgaaggcagaaacaaagatgttctttgaaaccaatgagaacaaagacataacataccagaatctctgggacacattcaaagcagtatgtagagggaaatttatagcaccgaatgcccacaagagaaagcaggaaagatctaaaattgacaccctaacatcacaattaaaataactagagaagcaagagcaaacacattcaaaagctagcagaaggcaagaaataactaaggtcagagcagaactgaaggaaatagagacacaaaaaacccttcaaaaaatcaatgaatccaggagctggttttttgaaaagatcaacaaaattgatagactgctagcaaggttaataaagaagaaaagagagaagaatcaattagatgcaataaaatatgacaaagaggatatcaccgccaatcccacagaactacaaactatcatcagagaatactctaaacacctctacaggaataaagtagaaaatctagaagaaatggataaattcctcaacacatacactcttccaagactaaaccaggaagaagttgaatctttgaatagaccaataacaggctccgaaattgaggcaataattaatagcttaccaaccaaaaaaattccaggaccagatggattcacagccgaattctaccagaggtagaaggaggagctggtactattccttctgaaactattccaatcaatagaaaaagagggaatcctccctaactcattttatgaggtcagcatcatcctgataccaaagcctggcagagacacaataaaaaacgagaattttagaccaatatccctgatgaacattgatgcaaaaatcctcaataaaatactggcaaactgaatccagcaacatatcaaaaagcttatccaccatgatcaagtgggcttcatctctgggatgcaaggctggttcaacatacgaaaatcaataaacataatccagcatatcaacagaaccaaagaaaaaaaaccacacaattataccaatagatgcagaaaaggcctttgaaaaaattcaacaacgcttcatgctaaaaactctcaataaattaggtattgatggggtgtatctcaaaaatataagagttatctatgacaaacccacagccagtatcatactgaatgcacaaaaactggaagcattccctttgaaaactggcacaagacagggatggcctctctcaccactcctattcaacatagtgttggacattctggccagggcaatcaggcagtagaaggaaataaaaggcattcaattaggaaaagaggaagtcaaattgtccctgtttgcagatgacatgattgtatatctagaaaaccccattgtctcagcccaaaatctccttaagctgataagcaacttcggcaaagtctcaggatacaaaatcaatgtgcaaaaatcacaagcattcttatacaacaataacagacaaacagagagccaaatcatgagtgaactcccattcacaattgcttcaaagagaataaaatacctaggaatccaacttacaagggatgtgaagaacctcttcacggagaactacaaaccactactcaatgaaataaaagaggatacaaacaaatggaagaacattccatgctcatgggtaggaagaatcaatatcgtgaaaatggccatactgcccaaggtaattgatagattcaatgccatccctatcaagctaccaatgactttctttacagaattggaaaaaactacttcaaagttcatatggaaccaaaaaagagcacgcattgccaagacaatcctaagccaaaagaacaaagctggaggcatcacgctacctgacttcaaactatgctacaaggctacagtaaccaaaacagcatggtactggtaccaaaacagagatatagaccaatggaacagaacagagccctcagaaatgatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttacatgttagacctaaaaccataaaaaccctagaagaaaacctaggcaataccattcaggacataggcatgggcaaggacttcatgtctaaaacaccagaagcaatggcaacaaaagccaaaaatgacaaatgggatgtaattaaactaaagagcttctgcacagcaaaagaaactaccatcagagcgaacaggcaacctacagaacgggagaaaatttttgcaacctactcatctgacaaagggctaatatccagaatctacaatgaactcaaacaaatttgcaagaagaaaaacaaacaaccccatcaaaaagtgggcaaaggataagaacagacatttctcaaaagaagacatttatgcagccaaaaaacacataaaaaaatgctcatcatcactggcggtcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctctcagggatctagaactagaaataccatttgacccagccatcccattactgggtatatacccaaaagattgtaaatcatgctgctataaagacacatgcacacgtatgtttgttgtggcactattcacaatagcaaagacttagaaccaagccaaatgtccaacaatgatagactggattaagaaaatgtggcacatctacaccatggaatactatgcagccatacaaaatgatgagttcatgccctttgtagggacatggatgaagctggaaaccatcattctcagcaaactatcacaaggacaaaaagcaaacaccgcatgttctcactcataggtgggaattgaacaataagaacacatggacacaggaaggggaacatcacacaccggggactgttgtggggtggggggaggggggagggatagcattaggagatatacctaatgctaaatgatgagttaatgggtgcagcacaccaacatggcacatgtatacatatgtaacaaacctgcacgttgtgcacatgtaccctaaaacttaaagtataataataataaaataaaaaaaaagacccataactagtgtatgcggatgaacacaaaattgtgagaaaaaaaaaaaacagctgatgttggtaaagtgcttgcggtgtgcccagcactcaaaatgtgtacatatattaactcattttccatttttctgtgcctccataaatattaaattgagtacttgttaggtaaatagtgggaactgtacatggaatagtgttactctcacaattctcgactaatgttaattgagttaattagtaatacatatacacagtttagttttacactgtatgtaaatgagtaattattatttgcctacacctatatattctgtggtgaatgttgatgaaatacacaatatagccaggcacttaaatagcttaaatttacctagagaagaaaactaaaatacacatgaaaattgatttgagtggccttgccattttgtctttacttttacataaagtagcacattcaaatataatattttaaagagaaaacaattatatatattgttatttttctacaaagatgacatcaactgttgtttgaaaataaatagttaagtagctattatatttgataagtaatttattcttactgcgtggtagtaaaaataaagaacgtaaaaaatgtgtacatgttttatttaatattaaaaatattgtctaaaatgtataaagttatatattttataattattattgttttaaagtattttgtttattttctaatggataatatgtttatgtgttatgtataatttagaaaaccctaaaaatcataaaaaacaaaattggaaaaacaattacaattcctctatccaatatttcacttaaaatgtttcaaacaaagcagcctattacctatatctgccagagaattatttccttctactcctctcctgctctgggtaagatgagcacaggtacggtcagagaatcacaaagcaaaagtaaaaattaggagtggtcagaaacagcttctattcttttttacatataagaataggtctatgtttttgtcatgagagcatagaaatatataaaggtccttttatgttccatatccccatttaaaaagcataaacatgtaatcctgccattgttggtgtttgttttctgtctctcattattttctactgatgtgcttattacagagcaaattatatacatatatatatatatatatatatatatatactagtgtctaaaacaattattgcacttaatcatttttaaagaaaagttcactaaattatataatgttgtctcaaaaattaaataagtaaaatgtatttgttgagcttaataagtgaaacgtttgttttcaggtgtagatttttgttctcaagtccaacagacatcctataaacctctttttgacatacattgaatccttaaataggaatgtagtggggtagcctattctgaaaatagatgttttgcagaggcataggggaaaatgtactgatagttgagtgactttaggaagaggatgggttttagacagagtgcatacagtgtacctctaagatctgaactgagtcgcccaattcaacatccaatacctctctctctgtgctccaggttatattttcaatatgttgccttatactctactagatggaaagttaattaagtatgttctccactgactgttattcccagccatatctagggacaagctaagattgggttaatagcactgccacctggttttctagtttgcaatggtagttgttgctccatgactatggagcaatatctccattacttttgcagctccaacctcagttttataagtgttagcagcaatctcccttaagaatttaacacacagcctctgagaaacaaaaggaaagaaaataacacttttatgaatttccaaattgccatagctcacactcaatgtttattttattttaatattactgccaatgggttttgctgagtgaaataaatttagcactaatgagcatattttgaaagtttaaaaacacaatttaataaatgattcaatgtaatctctacaaaaatgactctaagaggctgaagagtcttagagcaggagagaaaccatgaggaaacaaaagagcaagaaaacagataggtgaagcaattatgatttttaaattggcaattaatcaaggagtttggttgtattttttttcaaaatcacaaagacaaagatgcccaatgacaaaagtaggtcaatttaattatagctgtatcccagacttgtgacttgattaaattaatctactagggcctggcacatagtaggggttacacctgttagtttctttccagtatctgcttccttcttgtttcacaacattttaaatacagattatatagtgtggtctggctaattttcagttagatttatcaattatgttgtgcaataactgttatctttttaaaatagttattctacaaccaggattgttttaataaatatagtttctagtcattaaaatatggttatactttccagcctttttcttatgcatatgtctacattattattttttcttacaaaatgagatatcataagactagtttgttccttcttactgttattatttaaaaagttattgatttgtaacaaatatatcatctacgagttatcaggaaaaataaaatacaaagggaatgagatattattaaagctaatgttaaagctaatattaacttggttttgaaacaggacacaattataaattcttatagcacaatgcaaacctgggcagggaaaatctgagaaaaatggattcaaatgtattaaatgttttctcatgttctagaacagaattaagatattattatttgggtgctgtccaaatccatgatatttctaacaaacttaattttttccacataataaatttatatttacattggtaagtgtgatctattctccttaattctatgcccagctcatcccttctctcttgaatccaatctaatctggttttgtcccaccttgagttaacctgaccctgactgatctcctgtagactggtcactcagcaaaggaatgggtttggcgaagtcccatgaaaattacataagctccagtgaatgaggcatttaatcttaagcctctccaaagctgagattcagccttcttgatcatgccagtggagagtctgaagcttttccaaccatgtctcctcatgtttgtgggaaatcttgctgccagttttctacattacacagttataagcccaaggcttggattccagcccacagatcactccagggaaaaagctggtgctacttccaaccattaaagctgagttagcaagattggctttcagccaaagttctgtcaaaacatattcttattgtgtcctgtccttgttcatatcaggagaagagctagtgctttcttaaagcaacataaaatttcaaagccaagaatcagaccgcttcacatggtatataatattcacccctactagacatctgggaattaccttagaataagtgtgcatgagggatccacacatctgttacctctcctgtctcccagtaaaccaggagaattagtagatgtgctctttgaccatatgaccccttctcttttttaatgaaaatcacaaactatccagaaaaagtgctggaccacctccaagtttacaaatcatgcgattgctcctctctctttatatcactcatcctagcagcagcatttggcagcattcatcatgccccctccctcctttaaagccccttcttaattaatttccaaaatatcacattcttgtttattttcctacctacttattcttttttgcttaatgatacttgcattcataaattgtaaaattagaatgtcctagtttttggtccttctttatacttttctatattcattccccaggtccctgttttatgacttcaggtatcacctgtaatcactgagtaacaacttagtatttccagccccaaactcttctctaaatcatatattcctttatccaaacaatttcttaactttctacgagagtcttaagcaaatgatttctaaccttctttgatatatgagaaaatcagatcactaaattactagttcaactttaataaatccaaatttgactacctgtaacgttgcgtctcaagtctttccaatatcattaaatggcaaccacattttcctgcataatcagaattacccggcatccttattgacctctttctttctctaacaccccacatttaagccatgagaaaagtatgttgacaactcttctgaaatagattcagaatcccaccgctgctctccagctccaccgctacctctgcagtctatggcatcatcatctcctgccagacttagcaatagtaatgtctcttcctggaatatctcaagtatacatgcggctcaggttttgtactagaagtttcttctgcctgaaatattttttaaatacctgaatatcttgctttcttattttcttcatatatctgttcacatatcactttattagaattgtcattaaattttttctatataaaatatatcccccacttgaacttttcacccactatcttgctttaaatttcttcatcgcatttaccaccactggaaatgttatactatggtgtgtgtcatctgtctttctctgaaaaacaaataatacaggagagcaagtctgtgttattcttgtaattcctctaatttttcagtgcctagccacctgtttattgacacataaaaggtactccctttggagttttcggtatcttgctgttaattttagtttcaaaatagaagattttaatataaacaagtcatatcctttgcattctttcaacacctatactaaacaaccacatcattaattattaacctaccattattaattattcaatgctagtaaattgttcaccaaatatacttttaatccatataggtatgagactgagctaaatactgttgggcatacaccatacacatagtaagacacaactgttctccttaaaaatactatgtaaactagtaacatcatcagagagaaaaagatatagagataatgatctagtaatgttccaaaggcataaataatttctagaaggacaatgtgtagtgatataaaactctgttgcataaccaattagatgggttcctgatataatttgaatataaaataagattgtgaagaaatagcaatcccatcacttgctaattataatctttttgacattctttcctaaaacttttgttgatgttttatttttaactctttgattcttagtttcttcatctatgtaatcgggggttttatgcataataaatgaggaaaaattgaataaagcacataactcactgcctagaacagagtaagtcctcagttattgttgtaataataatgtcaacatagattaaatgaacagcatgactgacgtagccaaagagacagaacttatctttaatatacatttttaaaagaaatagttatcactttaacaataagaaaaaaataacacaaactatcattaaaaatagacaaattaatttctattttgaaatggaaattttgtcattgttcttcaaaagatttctaaataaatacaagtagatttgccagatttagaaaatgctcggtgaagcttcaatttcagataaaaaataatttgcagataagtattttccaaatattgaatgggacatgcttataattttaaaatatttgtttatttttacctaaacttcgaatttaacgtggatgtctaaattttatctggcaagtttaaatatagtctctgttttatttttttaactgaagccaaacccatggcgtgaggataaacaggcccatgaagtacacatgcacacacacacacatgcacacacacacagatgcacacacacacagatgcacacaccacaaagaccagataggcaatgtttggcaatatgatccactgagctcataagagtcagctataatgtatcactgaaaaggaacttagaaaattataacggaatcttataaatcacattaagatctgtttaatatatacagcagagattagcaaactatatctggctaaatctagtccatggcctgtttttacagatcttgggctaaaaatagtttttacattttatatattttatactttagcttaatttatattttatattttaatttataaatggacatatatagagatcttatttagcccataaagcttaacagttattatctggtaatttatagagaaaaatatgttaacctatatagaggagaaattcattcttttattcatttagtgaataattattgagaacccactgtgttgcaggaatcctctcaggtgctgatatggagctcacagtgtagtgtataaacagagacaacattaaatagcaacaaaagaaaccgaggaacactcaaataagtcatatatgaaagtattcagtattatgtaaacacatgactctaacgttaggtattctgacttatttatactgcaagctactaatttagatccacccaggatgaaaaactgttttctgatttattcttttatattttctaagtggtcattttaaatacttaattcaaatttactttttatttaccttttgcttttcttcaaattattcctttgttcagatacattttcaaataaattctagcaaagcaaagttgttacatgtgtactaaccatagcattgttctctttgttttccacatcaacttcttgtatcaaaaaagtaggttccaggagggcacacattgggtggtaagacataaatgggaaaaaatactgaaacccagacctgtcaaatctactctgcctgtgagtgtgttggtaaatatcattgtctgaaagatttctgatcggaccttcctcttcacatattttcccaagtcatcaacatctttattcctttattatttaattttaaagaacagagattcattatttatacaacattagtatttcttcctaggaacagagtttgagtccttaaattctacttaacatgtatctttccatgttattcttgaaaagtgtgacgtccacagggcaactccaggcaagcgctacagagcatgatacaaaatattgccctgttttgctagactgggcttcttatgagcctcacaattttctcttgtgccttcagaatgaagtccaggtccttcttccacaggcacctaagtctgaatgtttagacacaaaggtttactttaatccgaacttctttgctctggttatgaaacaaagataggagaggatatctctgaaatttccctattattttgccaatagtataaatgtgacataatcttaaagttttataaagagcactatgaacgtattgttgcaaacagtcaatacttatgggtaagagtatttttctattactaaattagaactttaggagaaaaaaattaaaatgtccttgatataaatggttctacatggaagtaacttgcatcttaagatcatatcatttttcattaatatgtttgcagtttgaatcaaaacatatcttttagttctgagaggaattatcagatgaatttgttaaatataattacttgactttagaaaatgtggcaaaactataacaaaaaaatctttaaaagaaaattacatttgtgcaatataaattagtggatgaaaagttgttagataaagaaattgcattgcttgacatttttgagttccatgaagtcagagttttctagggtgattcacacataagaaatctactttttaaggtcacaaatcatatgacaaattagtatttccaattaaatccttttgtaggaaaacccagagtttatgaaatatttggaggattgggccttgctaaaagtgttttagaaagttaaaatctaccacatttctatcctttttgctcattctttaatcctctttggcatagtcccagctgggagactggttttacagctgcttcttgaaactgtgaagaactgggcctcaggagcctctgtactcccaactgggttataacagaaaagttgaaatattaaagttacctccataatattgagatataacatttctcagttaattttttaatagtgtaaattctggggtatcttggaattacacttttatgtatgtatatttattattttgatgtttttatttctaaatattactatattttgtttatttaattttctacatatgaaggtttatatttcaagttttctatatctcaatttatttacagtttgactacaacatttcagtgtttttctcactaataacttgctatatagttcaattgcttaacaatggaaaacattctatttaaagtgtatttttgtaaatcagaacctcagaggatagttcctattcatgaaacattgctggaaactatttgacttatttctgtttgttgctgttgttgttgttgttgtttgtttgtttgtttttgagacggagtctcgctgtcacccaggctggagtgcaacagcgcgatcttggctcactgcaacctccgcgtccacccctgcctccatgttcaagcgagtctcccacctcagcctcccgagtagctgggattacaggcacccaccatcatgtcccgcaaatttttgcatttttgtagagacgggatatcaccgtgttggccaggctgatctcaggtgatccacccgcctcggcctcccaaaatactgggattacaggtgtgagccaccactctcacactgacttatttcttaaagaccacttttagagtagcacgtatgtgccagatatacagtactagatgtatctgacaatgtgttggtaacatctattgaattgggttatgaaaacccaaatcatataaacgagatatatgtccttaatattttaaccaccctcattatttttaatattttgtgcagaccattcaaatgaatctcagttgatagcctacccaaccataaaaatagaagagactaaaggggttgatttaactccttggaaaagagatttctctccttagctcacaaaatggaatcactataatgatttcgaataatctgtgactacagtttggatgtggcctatggtagaatatatgtctacaagtgtaaaaaatgtagctttgcttagtttcactgtaaaaggtaggattaacaagtatattaaaaattgattataatatatttacaaatattgtaattatatgctaaaatttgttattttatataattgctcagatttataggatcatttggaattattagagcaatgactgatttaatcttgtctgcacattgaaaccacctgggcagattttttaaaattgcccataactggggctctgctcagatcaattaattaagaatctctggtggatgggacttggacatcaatattttattagttttctaacttctaaaaaatttagattcgggggtataagtgcaggtttgttatctaggtatattgtgtgattctgaggtttgggttatgaattttctcatcactcagataatgaacctggtttatcaacacttacctcttaccctccctccccatccagtgtctattgttgccatctttacatctgcttgtatccaatgttttgctcctgcttataagtgataacaggcagtatttagctttccattattgcagtaatttgcttaaaataatggccttcagctgcatccatattgctgcaaaggatattattttgttcttttacatggctgcatagcattctatggtggatatgtaccacattttctgtatccaatccaacattgatgggcacataggttgaatccatgtctttgctattgtgaatagtgccacaatgagcatgtgaggccagcatctgttggttttttactataataatacccattctgactggtttgggattgtagttttaatttacatttctctgatgattagttacactgagcattttttcatgtttgttggctgctcatatatcttcttctgagaagtatctgttcatttctcatgcccatttttaatggggttatttggtttttgcttgttaatttgtttcagtgccttgcagattctgaatcaagattcttttttgatgcatagttgtgaatctgttctggtgggggtactctgttgatagtttcttttgctgtacaaaacctctttagtttaattagatcccactgtcaatttttgttttgttgcaattacgtttgaggacatagtcataactgattttccaaggctggtgtccagaataatgtttcttgggttttgttctgggattctcatagatggagttctcacatttagatttttaatccatcttgagttaattactgtatatggtgaaaagtaagggtccagtttcattcttctgcatatggctagccagctatcccagcattatttattgactagggagtcctttcctcattggttatttttgactgcttttttgaagatcagatggctgtaggcgtgcagctttatttctgggttcttcattctttttgattggtctatgtgtctgcttttagtatcagttctacattgtttttgctactgtatccctgccctatagtacagtttgaagtcaggtaatgtgatgcctctacttttgtttttaagtaggattgctttggctatttgaattcctttttcgttccatataaattttagaatcttttttttctaattttgtgaaaaatgatgttggtaatttgataagaatagtgttgaatctgtagattgctttgggcagtatggtcattgtaatgacattgattcttctaatccatgaacatggaatgcttttccatttgtttgtgtcatctacaatactttttaacagtgttttgtttttccccttatagagatctttaatctccttaattagatgtcttcctattttacttttgtgtggctattgtaaatgtaattgcattcttgatttggctctcagcttgaatgttattagtgtatgggaatgccactgatttttgtacattgattgtgtattctgatacatcagtgaagttgttacattagttctaagagcattttggtggaatctttagggttttctaggtacagaatcatattttttttttgccaagagagatagcctcacttcattttttttttccatttggatgccttttatttctttctcttggctgactgatctgactaccacttccagtacgatgttgaatgggaatgatgagaatgagcatccttttctcatataagttctcaaggggaatgcttccatgttttgatcattcagtgtgatattagctgtgggtttgtcatagatggctcttattattttgaggtatgttccttcaatgtctagttgttgagtgtttttatcatgaagtgatactggattttattgaaagctttttctgcatctgttgacatgatcaaatggtttttgtttttaattctgtttatatggtgaatcacatttactgacttgcatgtcaaagaaaccttgcatcacatgtactaagtctactagatcatggtgaattagctttttgatatgctgctgaatttggattgccatccatattttgttgaggatttttgtgtttttgtttatcaggggtattggcctgtggttttctttgtttgttgtatctttgacaacttttggtagcaagatgatgctggcttcatggaataagttagggaggattccctcctcctccttgatttttttttcttttgaatagttacagtagaattggtaccagttcttctttgcataactggtagaatttggctgtgaattcatcttgttgggggattttttttttttttggttgctaggttttttcattactgcttcaattttataacttgatattagtctgttcagggttttgatttcttccagattcacgcttgggagattgtgtctttgtgtctttccaggattttactcatttcctttagattttctagtttgtatacaaagaagtattgataatagtttctgtggatcttttgtatttttgtgggattggttttaatgtcacattggtcatttctgattgtgcttattttgatattctctcttttttgcttttgaagtatatctaacagtctatcaatcttatttacagaaccatgcacagaaccaactttcagctttgttgattctttgtatggaagtttgggtctcaatttcattgagttctgatttgattttagttatttgatttagttatttatttccttctgctagctttgggggtgtttacacccacatataggttcatctccgtgatcctccaccaagtttattaataagattcagaatcacatagggcctggagaaagcctcgtttggtggaataaatctggagaaaggactgccattatggcaggaaatacacagagctctaactagatcattccttactatacaaaagatgcaggctgcctaggaaaagatagcaaaccctgttgcctcagggcacaagtaaagaccccctgtgactgaaggaagagcaaaataaaataacaaccctaccactggccatggggctggttctggatccaggttctttatatatatactcaaacatacacacaggttgataataaactggttgctatgggtatggggtggggaggaaatgaagacaggtaggtcaaaagacacaaaatagcaggtatgtagaatgaacaagtctgaacatctaataaacatgataaccatagttaattaaatggcattatatgaggttttttaaaataaaaaataagttggttttagctgttcttgtcacaagtaaagctattatatcagatgctagatatgttaatctgcttcactgtaacaattattttacgatctatatgtatcctataatatcatgttgtaagcctctaatatacaaataaaatgtattaaaaaataagtacaaaatttttaaaagggactatatcaatatcattggcagtgtcttaactttggaggagaacaggacactttcccttaaaagaacaccaaaaaatcaaaacagagtttgtctgccacagagaggggacacctcaaagaaacataccacctcaaagacacaggcataccgtgccttcctaatacacaaatgaggattagaaaaacagagaactacccatgttgccttgccctctttcctcaaaccacactagcaggcacaaagtaaacaagcaagaagagtctgccactgggagtgggtaaacagcacgccgagagatacatgtagaataaatataaaaattaaaacaatactggacacattgtattcaaactccttaaaaccaaagctaaagagtcaaagttacagatagccatccagaaaaacacatatacagacagaagagcaaatgtaagaattagaggaaacttctcataaaagaactatgcaaaccagaaaacaaaaaaatggcattattaaagtattgaaagaaaccaaaatgtcaaaccagggtactatattcagaaaaaaaatctttaaatgaaaataaatattttggggacaaactaatgctaagaataattcattatcagcacttatatctgcactgtaagaaatgctaaaggacattcttaatgtacctcataagtatataaacctacaaggtacccacaatttttttaaataaaaaaatttaaaaaatactataatatcaaagagaaatctgaactaaagaaagagatttagaaatggtcaaaatagaaataattgagcaaatattttcattcttacttgtaatcactctaaatgtaattgaatttccaaataaaaatattagcaagatatggtaggtttattgtgtatatgacaacaatagtgcaaaagaagagaaaaaagtaaatatactagtgtgcatactacatggagcttaatattatttgcaatataaactgtgataatgaggtataaataaggagcaaatattgtagtcaaaatgaaataatagaaatatacttcatcattctaaatgcatgtagttaaaaagaaaaattatattaacagtttgaacaaatagaaagctactagcaagctctagattttaaacccatcatatacatagtactaaatgtaaatgttctaaacactacaattaagaaagagattgtcagatgattggatataaaagtaagccccaactgtatgctgtccacagaaagttgttttaaatatgaagttatagataggttcaaagcaaaaaataagaaaagtatacctcacaagtattcttctaaaagaaaacttgagtagctatactaatactataggaatatcattagggataacaaagttaattgcagaatgacgaagagttcaatccatcaaggagatataataaccctattgttgcacctaatagtagtgctttgaatttatagaggaaaattgatagaattgaaagcagaaaaaataatccacaaatttggttgaggtcttcagtacttctatctagtaattgatagaataagaaaatagaaaatcagtataatcatggaagcccttaggaacattatttgttattcaccttattaaatcattacattaattattctaattgatgtttacagaacaatctactgaatatcagaatacacagttttttcaagtgcatgcacatgtaacatctatcaagatagaccatattctgggtcataaaataaactttaaaatatttacaataattgtaataacaaaaagtgtgtctctgaccaaaatgaaattaaattactagtcaataacagaaaactatctataaaatttccatatatttagaaatgaaaaaatactcctaaataactagcacaccatacaaaatgacacaagggaaattagaaaatatttgtaattgaataaataggtaaacataatatatcaaaattagtggatgcaatcaatgtgatagagtaaagaagaaaaaccatatgaccatctcaacgaatgcagaatatgcatatgccaagttaaacatcaattcattacagaataaatggattttaagtatttgctgaagaactctttaattcctcagcaagctagaaatgaaagaaaaggtttttatcttcaaaaattgtttcttgccatagagctatactaacatacctaagagtgaaaggcctcttttctaagataaaaatgtcaactctatgttgttttctcagtcttatttgataccatacttgaagttctttccagcataataagacaagaaaaagaaatacataaagaagaaatacagtggtatttatttgaagacaacataattgtctatgttaaaaatccctaagaatctaaaaaatgctaccgccactattatgtgagtttagcaatgttgccagttaaaaggtcaatgtatcaaattgtattgcatttttacatactagcaacgaaaaatttgaaatttataataaaatggtaccatttaacatagcaataaaactgaaatgccattaattattaaggtaacaaaatgtgtacaaaatctgtatgctgaataataaaaaacaataatgaaaagtttatagaatacctactttaattaagatatggatcacgcttatagacagaaagactaagtattgttaaaatgctgattttccccaaattgacctacagaatacatacatttttaaccaaatcatattagaatttttaaaaataaaattgagaagatgattctaaatttgtataaaaaagaaggaactagaaaagacaacacaattttgaaaaatcaaagaacaaagttggaggactcagatgacctgattttctgatttcaagactttcaataaagctagagtaaacaaaaacatggaattggaaatacacacacacacacacacacacacacacacacacacacacatgggtctagaaacaaacctaaatataaatggttgattggtttgacgatcgcacaaaggtatttgaatggaaagagaacagactttttgagaaaaggcgctggaaatttagatatccgtgtgcaaaatatctcaatgcataccttgcactctatgtaaacatttagtttaaaatgagtcagtaataagcataactgactatcataacaagggggtaaaaatgcaatatgatttctactgatggaagcttcataaagataaacaaattgaaaggattcacagcaaaacagttcatatttagtaaaatgcaataaacacataaccagcaaaagaaaataacctattgaatagagattaggtatggaatgtatggaataagctctggaaaaaaaccttttatctttgaatatacataattacaagacacagataaggggattagcaaatatataaatattcgctaatatattcactttattgagatacatacatctccaatccaatgtcataaatcttttctcctatattttcttctaagacttgtatagttttagcacttatgtttagatctttggtccatttttagtttgattttgtatattgtcttaggtccaatatagtttccccaacacaactggttgaaaagaccattctttccccattgaatgatcttgatccccttgttgaaaatcaattgaccctatgtgaaagggcttatttctgggttttctattctcttctgtcagtccatacatctgtctttatgccattatcacactgttttgattgctataatagctttataacaagtttgaaaatctggaaatatgaaacctcagcattgttcttccttttaaagattatttggttatttggggttgcttcagattccatataaattttatgatgaatctttctatttctgtaaaacaaaatcattggaatttggataagaattgcattgcatatgtagatttctttggttaatgttgacatcttaacaatattaagtaggaataaatttctgtctgtgacaccaaaagcacaggtaataaaagcaaaaataagtaaattgaattacataaaaattaaaaactcctgtgcatcaagggacacaatcaacagagtgaaaatgcaaccatccaaatgggaggacatgttcacaaatcatatatccgataagacattcatatctaaaatatattttaaaaactcctacaactcaaccacaaaaaatcttattttcaaaatggacaaataacttgaacagacatttctctaaaatacatacaaatgaccaataagtacatgaaaagatgctcaacatcactaatctttagggaaatataaatcaaaaccacaatgagacactatctcagcccattatgatggatactatcaaaaaaacaaaccaaaacaaaataaaaccaaagaaaagaaaagcaaaaaactaaaaccaaacaaaaaatataaaataactaattttaatgaggatgtgtggagaaattagaacccctttgctctattggtggacccaaataatgaaactgctatgaaaacaaaatggcaattcctcaaaaatttgaaagtagaattaccctataatccaagaattccacttctaggtatatacctacaagtaactgttagagtggtcttgaaaaagtatctatacacccgtgttcatagcagcattattcagaatagccaaaaggtggaaacaacccaagcgtctattgatagatgaatggataaacaaaatgcagtgtatgcaggtagtgaaataacattcaatattaaaaaaattctaacacatgctacaacatggattaaccttgaggaaattatggtaagtgaaataagccagtcataaaaaagataaatacggccaggcacggtggctcacgcctgtaatcccagcactttgggaggccgaggcgggtggatcacctgaggtcaggagttcgagaacagcctcaacatggagaaacccccatctctactaaaaatacaaaattagccgggtgtggtggtgcatgcctgtaatcccagctactcaggaggctgaggcaggagaattgcttgaacctgggaggcggaggttgcggtgagccgagatcgtgccattgcactccagcctgggcaacgagagcgaaactccgtctcaaaataaaaaaaaataaaaaaaataaaaaaaaaagataaatactatctgattctacttatataaagtaattagagtagttaaatttatagagatagaaagtagaatggtggtttccggcatctgggggaaagggagaatgagggttgattaatgggtatagagttttagttttgcaagttgaagagagttctagagatagttggtagagatggttgcacaacaatgtgaatgtacttaacactagtgaactgtacacctagacatggttaaactgtcaattttcttatgcgtatttttccaaattagaattttatttttaaaaagggataattgataccatatccctttttttttctttttcctttttttttattatactttaagttttagggtacatgtgcacattgtgcaggttagttacatatgtatacatgtgccatgctgctgcgctgcacccactaactcgtcatctagccttaggtatatctcccaatgctatccctccccgctccccccaccccaccacagtccccagagtgtgatattccccttcatgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtagatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggttaaatggtatttctagttctagatccctgaggaatcgccacactgacttccacaatggttgaactagtttacagtcccaccaacagtgtaaagcattcatattaattttcagttttatttaatgttattctaatgttattatcattaacaggcatttatacctagattaaaaaataattttgcaccagaagaatgggaaaaaaatgtttaaggagattggtagatatctgaaaatagagattatggaaggcagcttcagaaatagcccccaagtatgccctccaccccctcctgatacttatgtccttatgtcatcacctcccccatgagtgtaggctagacttagaagttcataagaaataaaatgtggcaaaagttatggaaaatcatttttaagattaggctaaaaaactgtgaatttcctcttgttctcattctattttgctcctccctttctcagtctgatgaaacaacctgcaatgtttttaattaccctttgaagaagcccacaggcagagaactaagggaagccaagaataaagggtctcagcccaaagttcatgagaaaacaaatcctggcaacatccgtgtaagtaactttgaaagcagatactttcctggtagagccttgatacgatgccctagtcaacaccttgattaaagtcttatgagagattttgagacccagaggacccagtcaagccaagcccacattcctgacccacctaaagtataggattatggttttataaaccactaatttctggattgttttgttgtaccaacatagaaaactaatacatgacaaatgctactgagagagacaaaaatagaagtgcttacagattatgagaaagttctaagaaggcaataatctacaagggcaaggaaacagatagaaataatactttaaatgtacaactcagtgtgttcttgaagttagaagttactgatgttcatggccaggccgggtgcctcatgcctgtaatcctagcactttgggaagctgaggtgggaggattgcttgagtacaggagtttgagactatcctgggcaaaatagtgaaacctcatctctacaaaaaataaaaaacaaaacaaaacaaaacaaaaatgagacaggagggtcactagagcccaggagttcaaggctgcagtaagcagtgataacatcatggcactcccacttgggatacagagcaagacactgcctcaaaaaaaaaaaaaaaaaaaaagaagaagaagagaagaagagaaagtttattgatgttcagaattttctgaagaaaccaaaaaacagctaggattcactttaaacactttttttttgtgataccttctagtgtcaacatgaagcaacttgcattttttctttctcagagcaaactagctctcaatctagcttatgaaaatagaggttatttttaacatctacatgtagcatgtgtgtttaggtttttgaagctgtggaataggaaagaatgaaaaggactgaaacagctttctcagtcatttgtagagatgcaattttagatggttattctcactccagtttcagagtgaacactggggctatgaagcaacatttgtactgcatgaatcttgcaggagaaaatagagattttgccaattgccaagaatctacattagtcaatcacataacatgattagccaattccattaatctcaaatgccactaaatacactgtaaatccttagctgagttacttatcttctctgggtttttctgatcccagtttgactagccatctttactgatgagtaagcaaagcttcctttactttgaaatgtgtgtgattctagatataaacatttgcaagtgacaaaacaatttatttctctaggttcagtggctgatcaacagtttgttttctacaatttaattgcttagcatttaggagatagctccatctgaatgtgctttctaatctctgcttccccataaattgggaattagacaaagtacttcactagcttcacagtgtgatcagcatgatgaaattactcagaaggcatgggtccaattctggtgacatttcgccaatatatacacactacaaaggtaaataattgaatcagtgtataaatgaacagtattgtgcatctgtgctgttcaaaattggcacatgtgaatattaacatttaaattaaaatcaaattaaattaaatatttaatttctcagtcacatgaaacataatttaaatgctcaatagccacatgggtttagaggctaccaaattggactgcacagatacagaacatttgcatcatcacaggcaattctattctagaaaacttctttagacattatcctctgattttcccaccttgaaaatccagctgaaattccctgcctacttcacaatgtaggtgtaatgatcaaatgtcataatcaatgtatatatggatatatatatggatgtgtgtacatatgtatagttatgataataatatgcctatatatgcatatatgcctatatacatatacatatgacacgcctatatacatgtatacatatatgcatatatagacatattattatcattatttttccattgttttatcttttttatcaagcaaaatataaaacttctggatgaatatatagtactattcccagaggcaaatatgccagcatatataaatgtgtttgcaaaaatgttttatatttacacccataaattactatttttaatactttcaaaatcacattttcacctctgtgatctatgcaatttttacttcattttctaaataaggatgaggtctgtttgttattaattatattgaatgaggtcacataacattttgtttaacagaagtgcagaagtgtgttataggttgttttagtactatagtaaacacttgacaatacaccagtcatcttaataagatatgaatgatttaataagatatgaataactatacaaggaaagcaaaatataacttcacaaggagtgaggaatatgtaatgtatagagttgagtacctgcagtttttattcagttaaaacttggtgtaggtgaattgaaggatcacaaaaccacactaccatatgacttactgaaacattttctctttttttgttacatacgtgaaaaaaccgtctgtctattttctagtttctagtaatgttgtctcctagacaggtgctttagaaataataggcctatttgttctttataccttgcactcagaacagaactactttgctgaattcattgccattttgaagatactgtacctgaaagttacaaactacctaataactctaaattgactcttatttttcataacttagttgctcaccacagctccctgtgctcattactctgccaacatctgtgattgctaagaggttggagagaaaattttgagcaacagaaaaatgtcatattgttcttccaataatacgtgcctaggaaacactaaagaaaaactattaggcctatgtctataataaaagaagtttcacataaaaatagaggtgaattagtattttgcaattgcacttttatatttagttcttcatgtaaatgcaattgatgattttaaaattatgacattgtttatattaatgatgtttaataatatggtatatgatattaataatattaatatattattagtatatcattttaagactttatattacttagagaatgttttcctttgtaagctggttatactagtacaccagaataatgattattagacattcagatataacctgtaaaaattactgcaaaattttcatgtattatgttacataaatatgtatatattaatttatatacacataaactgatttcagctgttcttatgaatatataaatgtatatatatgcattcatgtttataataatatatgaatacaaaataattgtgtgttttatgtgagtatatgtgtgtttgtatatgtttttaatatgtgtgtatgtatattcagttgcaaattaaaatatgaacacaaaatcagtatattttgaaacaataaaatagatataaatctaacaaagcatgtacaagatgtgaagaaaactgcaaattctgattaataaaatcaaacaagaactaaataaatgcagagatattccatgtttatggacagaaagacttgatattgtcaagatgtcagttcttcccaaatgatatataaattcaatgtaatgccaatcaaaatcccagaagcttatcttgtagatataaacaaactaactctaaagtttatacagacagataaaagacactgaatagccaacacaatattgaaggagaagaacaaatttggagttctgacactatctcatttcaaaacttaccatagagttatagcaatcgtgacagtatggtactggcaaaataatcgataaatagaccaatgaaacagaacagaaaaccctgaaatagacgcacataattatagtcaactgatctttgacaaaggaacaaagacaatataatggagaagaacaatctttccaacaaatgatgtcagaacaacaggacacccacatacaagataatgaatctaaacagagactttatactctttacaaaaatttactcaaaatggatcacaaacccaaatataaaagaaaaaatataaaactcttagaaaaataacatagaagaaaatttagatgaactagggttggtgataactttttaggtacaacaccacaagcatgatccatgatagaattgataaactgaaattcattaaaattaaaaatttgggggcctggcgcggtggctcatgactttaatcctagcactttgggaggctgaggcatgtggatcacctgaggttggtagtttgagaccagcctggccaacatggtgaaaccccgtctctactaaaaatacaaaaattagctgggcttggtggtgagtgcctgtaatcccagctactcaggaagctaaggcaggagaattgcttgaacctgggaggcagaggttgcagtgagccgatattacgccattacactccagcctgggtgacaatagcaaaactccatctcaaaaaaataaaataaataaaatgaaataaattttttggtccaccaaggacactgccaagagtatgaaatgagaagccacaaaccgtaggaaaatatttgcaaaagacatatctgacaatgcattgttattgaaaatattaaaaaaaaaactcttagatatcaacaataaaaaacagaacatagagatggcaaaaaagcatataaacagatattccatattccatattatatgtcataagaaaatggaaattaaaacaacaagaagataccaccacctatctattacaatggccaaaatccagagcgctgataataccaaatgctggcaggaatgtggtggaacagtaactctcaattattgctggtgggaatgaaaaatggtacagctactttggaggacagtttaactgtttcttacaaagctaacatacttttaccatatgacctagctagcagtcatgctcttttgtattcatccaagggtgtaaaacttacatccacagaaaaatttgcacaaaaatgtttctagaaggtttattcataattgccaaaacttgaaagcaactaagatacccatcagtagttgaatggataaataaactatggtccatctatataatggtatataattcagtgctgaaaagaagtgagctatcaaatcatcaaaagacatgaaggaaacttaaatgtaaattattacatgaaagaaaccattctgaaaggctacatactgtatgattctaactacaagatgttttggaaaaagcaagattatggagatagtgaaaaaaaatcataattgccagaagttagaagggagggaggtataccatggcagtgcacagaagatgtgtagggcagtgaaactatcacgtcataataaatttgctaaaattcatagaatggcaccaagagtggaccctaatgtaaattatgaactttgcgtgataatgattttctttgtgtgataatgaatttcaatatacatttgtccgttgtaacaaatatactacttaggtggaggatgttgaaaaaaggggaacatatgcatagatggagtagagggatatatgggaaatctctgtaacttctgtccaattttatagtgaatctaaaacttctctaaagataaagttattaaaataaaacactactgaaacgttacatatacactatgtaaatataatcatatactaatttatatgtacataaacaggtcttcttaagtggtttcataaatatttaaatgtacatatatgcattaattggtaaagtaaaatatgaacacaaattgtacagaaaaatataaaagcttttcagaaaggcaaaggcttaagcacatgggtttgatttctctttctctccaatattcccactgaaatgatcaaaggcatacattgtgtgcagcaggaaaatgttcacagattgtccttgtatacttaacctcttcttcttattttcaaaaagtagcagccgggcgtgatggctcacgcctgtaatcccaccactttgggaggctgaggagggcagatcacctgaggtggggagttcgagaccagtctgaccaacatggagaaaccccatctctactaaaaatgcaaaatcagctgggcatggtggtgcatgcctgtaatcccagttatttggaaggctgaggcaggagaatcccttgaacctgggaggtggaggttgcagtgagccgagatagtgccattgcactccagcctgggcaacaagagcaaaactctgtcttcaagaaaaaaaatatatatacacacatatatatgtatatatatgtgtgtatatatacatatatatgtgtgtgtgtgtatatatatacacacacacacatatatatgtatatatgtgtatatatacatataggtgtgtgtgtgtgtgtatatatatatacacacacacatatatatatgggctttggggtttttagccacaaattttgaattatcataaaaaagctaaatgcacttgtctattgtagatttttaagctcagcagagaggattgctaggagttccagggaaatggaggaagaaagagaacaagaagtcactacatgggaatggaattgagatgaaaaggaagctaagtaatatgtgtacttgaattcaccccagggagaatataggacctcagaagttataataaacaacgtgagtctaaagctagctatgtatcatatccctgctctgtgaacttcacctgtgtttattcatctaatctccacaaaaatcttttgatatcaagtattataatttaaattttacaaatgaagaaatctgagatgaagagaggttatataatagccaaggccatggaactaacagtagagactatatttgagccagaactacttagcaccactgcccttgcactcacccactatactctgtgactgctaatggctgcatggggttctagtcttcacatacatggtattttgttggcaaattcttcactgtcatgtcactaaataaaaccccaggaatttgtcttcctgagattgatgatatttgggtgggtggtggtgatcacaggttgagaattcccaggattggattttccataagcctactaaatgggagctcagaagcatgaatatgttaatttaaaaatattgaaaataaaatattccctacgacttgcagacagataacagtatgcaagaaactttgaggactttagataaagatatcattggttctgatgaaaagtcaacaaatccgtcattcaccaaactcaagacaatagttggcaccagaaatgtgtgaagcagattgcaatgggtcttgctttagaatatctaagacctgagatagggaagttgctggagcatgtaaggggtgtaaatcttgatccaactatagccttggggaaggtcatcagataccttagatgacacagtatagggatcctgcattggcatatatggtaccctacatacacttggggcagccagatttgctaggcaaagaggtttggtttttagtttgtcttttttctaacaaacaaggtcaacttaacctctgcgggaacaggagccatgccctaaccaacttagtgacacaaccaaaatggagacagaagacccatgctatacttgctgctatgactctatgtaaccaccctcctaagtctttttagattttagggcctctgaatcagaaaagaaaattaaagtgaatttaaacttttttgtttcctacctcatttcattttaacaaattcaaaccaaaacgaacccaatcttcaaggtgatccttccaaaatttcaacaaagtgcaagcacactggaagggcaaggagaaaagcatcactgtctctaaaagaagacggacaactatggggagggaaaagagtggtgactaagaaaaacgttgcgtgcctctgagatggggacattcctggatttgggggaggaaatgacatggagtttaaacaagagaaatttattctcttaaagttctggatgttagaagtctaagttcaaggtcttggaaagattgcttcttctcatgcctctcacctagacatgtagatggctgccttcttcctatgccttcatatggtcgttgtgttgttccatccctggcttttaaatctatgtaaaattgccttaaatttctcctgtgcccaataattctctccctgcctcccaaatctcatagtttctggaagaccaatgttttcccaagtgtccacgctaataccagggaggttacactctcctcaccttctctgtctcttgcattatttacttgtcctaatacattggccttaatataaaacatggctattagtcctaccattttcaaacataaaaaatataaataaataaaatgattaatcaaacagccatacactgaaaatgggaggatcccatacttttattcatactttagggttataagatactcttccctacttttacctgggttggacctagtagagagtcaggaatttaccaccactcagtagtaaagagggttctctcttctactctagctgtcaatagaggccaactagggaatctgggcttcaacctagcacgaatgagaagaactctcctaacctctgttgaagctgtttcagagaggccaccctgaactatatttaaatgatatctagagtctcctacccagtcctgcagttattcataatttaatttttaaaaaataccttgacatattgagaaccagaaaaatctcaacttgaaaaggaaatgacaactaacagatgccaacaatgagaagatgtcaacgtgagaagtatctgagaagcattttaaattgtccaacataaattttcctctatgagcaattatgatgtgatataattataaaatagaaggatttgtgaagaaatagaatatataaaaaagaatatgaagagagtataatcaaaagtatgtaatcttcattttttaaaaaaattttatgcaatctgaacaacagaaaaaaataccctggagggagaaagcaaagcctcaggaatctgtgggacgattacaaaagatctaacattcatgttcatactcctgggaggagaaaatagagaagagttgaaaagatagttaaagaaacagtctgaaaactttccaaaattgacaagatataaacttacaaattcaagaagagcaaatctcaatcaggacaatatatgtatgtttatatatacacacacatacatcatacatacatatacacacaactatataggtgtacacacatatgtatacctatagataaagtaagcatctgaaaactaaggaaagaaaaaagtattgaaagcagagagaaatggtaccttacctttagaggataaacattcaaatggcagtaaatttgtcatcagaaatcataaaggcaaaaagaaagtggtatcacattttttaaatgcctgaaaagaactatcatcctagattctatatcaagcaaaactatccttcataaatgagaggaatatcagcaattcttgatggaggaaaataaaacaaacaaaaaagtaaaacaaaacaaaacaaaagtgaactgttgccaaacttaccctaaaagaacagatttagggcattctctaaacagaatggaattaataaaggaacaaaccttggaatattaagaaggaaggatgaaaaataggaataaaaaatatgggtagataaaatggatctttcacttttctattgagttttctatattatttttgatggtagaagtaaaaattttaactgccaaatgcggttctcaataaatgtaaagagaataaatttaagataattagcttataatcaagggggagtaaaataaaataaagggataaatgttttctctacttcagttgagctattaaaatgttgatagcagtagaccttagtaagtcatgcatagagaaaatacttaaaaattctatacaaggagatatacttaaaaacactattgataaataaaaacagaattttaaacaatggtcaagtaacctgcaggaatagaagtaaaagcgaacagagaaataggaaagagagagggcaaacagaaaaaaaaaaaaaggacagtcataagcgatgacatatcaataattacattcattaaacgtaaataatctaaataaaacaaaacacagagatgaaagaagtgaatttaaaaatgtgatgctactacatgttgtctatgagaaactcacttaaaatatgatgatatatgtggtttaaaagtaaaagtatatataaagaatatgtgcataatcaaagaaaacagtcatagctgtattaatataaagtacacttcatggaaaacaaaactactagtaacagacaaagtcattacatagcgataaaagggcaaatccagcagaaagatattaagcctaaatatgcattcaccaaagagagatacaaaatatgtgaagcaaaaactgatagattgaaaggagaaataggctaatgcacaattacagtcaattcttccactcccatctctcaagcagtgataaacaactagacagaagttcagcaagtatatataagaaccagtatcactatcattaaactacaggatctacttgatatttattggtcactctacccatcaacaggagattacatattattttcatatgttgacagaacatgtatcaaatagattgtatcctagaccatgaaacacacttcaaaatattgaaacacattgaaattttacagagcatacactctgactgcaatggcatcagagtagctatcaataatagcacaataacaggaaaatccacaaatatttggaaattaaatcacacttctaaataatccatgtgtcgaatagaatatcccaagggaaatagaaaaaataatacatttaactgaataaaaatgaaattacatgtcaatatatgtggtttgtacctcaagcaatgacgaaagataaatttatagcattaaacaatttatagcattaaccaaaaagtctaaagtcagcaatctaaattcccacattaaggaactagaaaaagaaaagcaaaataaacccaaagtattaagaaggaagaaaataatgagacaacagaagccaaaaccaatgaaataaaaacaataaacaacagagaaattcaatgtaacaaaatttggttctttgagaaaactgataaaattgataaacctctagtttaacagccgagagagacagagagagaacaaaggaggaaaaacaccaatgtcatgaataatattggggttatctttatagtctctgtaaatatcagaaggttaataacagaatgatgcaaacaattccacaaaaattaatttgacaacacaggtaaaatggaccaattattgaaagcacaaattatcactactcggccaatttgaaatagagagtgtaacttgcccaatatcaattaagaaatttgtttattttaaaatactaaaaaataaatctccagtctagaatggtgtcgttggtaaactataccaaacatttgaagaagaattaatgattttaaacaagctcatctaaaaaaacagaagaaaagagaagacttctcatattgttttgctatgcccccacccaaatctcatcttgagttgtagctcccacaattcccacatgttgtgggagggacccagtgggaggtaattgaatcatgggggtgcatctttccagagctgttccatgatagtgagtaagtttcatgagatcttattgttttataaaggagagttgccctacacaagctctcaactgccaacatatatttaagacatgactttgtttctccttgccttccgccatgattgtgaggcctcccggccatgtgaaactgtgagtcaataaaacctctttcttttataaattactcagtcaaaggtatgtctttatcagcagaatgaaaacagactaatgcaatttgagaacattttatgtagctgatattattctgttactaaaaccagttgataaagtccatagggaaggaaggaagaaagagaggaagggagggagggagggaaccaaacagtgttcctcaggaaaaacagacacaaaaacccttaacaagtaatatataaaaagatgtatagaacatgacaaacttgggtttattccagcaatgcaatgctggatcaatattttaaaatcaagaaatgtaacccaccatattaataggctaaagaagaaaaattgcgtggtaacatcacttgatacagaaaacagctttgtcaaatttcagccctcattcatgacaaaaactcagaaaactagtaccagatgggaacttcttcaacttgataatactttttctaaaggctacaaaaatcctaccgctaacgtcatagttaatggtgaaaggctgaatgctttttcctaagtctgggaataaggcaaggctatccactctgaccactgctattctaaagagaattggaagtattaaccaaataaaatcatctacaaaaaaaaaaccctctagaataaatacatgatttcaaaaagttcacagagtgcaaaataaactttataaaaattgcattttaatatgctatcaataaatatgtgaaaaccaaaattaaaagtacactgccagttaaaaccactcataaaaggggaaatacatagttgtacatttaataaagcaggcagagcacttttttgctggaaagtccaactgctgatgaaataaaatatctttataaatggaaagtcatgatattcacagattagaaaactttttatatacttttcctttgctttaggaaagccttgacaagagcaggaaaagataagttatagaccgagagaaaatatttgcaaagctgagaaataacttagatcaaaaatttataacaaacttaaaaatacaacacacacacacacacacacacacacacacaaatccaattagaaaatggagaaaaacattaagtgacattttactgaagagaacacattaatggcaaacgaccatgtgggaagatattcaatagcaatacccataagggaaatataaattaagacaatgaagcagtcgggagttcgagaccagcctgaccaacatggagaaaccccgtctctactaaaaatacaaaaaattagctgggcgtggtggtgcatgcctgtaatcttagctactggggaggctgaggcagaaaaattgcttgaaccttggaggcagaagttgtggtgagccgagttagtgccattgcactctagcctgagcaacaagaccaaaactctgtctcaaaaataaaaagaaaagaaaaaaagaaaaaaaaaaagactacgaagaaacaccaccacacatctagtaaaataactaaaggtaaaaatagcgacaccaccaaatgctggtgaggatgtgaagaaaatgtcccttttactgccaatgaatatgtaatatggcaaagtcactgtagaaaatagcttgacagttttccaaaaagttaagtacacgttaccataccacagatcattgcacaatggagatatttatgggatgcaatagctctatatcttgattgtgttttgtattggtggtttcatgaatgtactcatgcaataaaatgacatagaactataatcacattttataataccatcatattactggatttgctgttgcatttacagttacataatgtataatccatgaggaaccctgaatatataatacctgagaactccctgtactatctttacaacttcctgtgaatctgtaattatttcaaaattaaaaattaggaaaaaaaaacaaaataattcaataaaacaaacatggcactgagatagtaaactcgtaaaccctttttgttatggttaaattattggttatattcaggaaaattgttaaaaacttggaaatagggcaaatgaatagctgcatattctcaccattcttatttttaaaaaaaaaatacaagttccgcaactcaaatagaaatctcagtgagacttttgctgaaacaagtaaattctgataaagttcacctattaattagaataatataagagtgatatttttaaaaacataccaggcaaaaattaaaacaaaacaaaaacaaaaataagataattgcaaagatgtataatatcttaatatttaaagaaggaggcctgaaggagcagggaatatggatttttactaggaaacatcaaaacacatttaaaaattactgtaattaagtgtgtacattattgaccagaaatcagtgtggagatatttgacactaatcagaatgctcaaacataaatataaaaaacttaaaaaaaaatttgtgttttttaaagtactaatattagtaacagaatatactgagtcaataatatgggcttaagaattcagtaaacttagatgtgaattctgactcttccagtaactggctgtatgacattgagcaaattttttaatctctcaaaaacatcttttaaacactcataaagtggaaacaataatactgtccttaaaaagtgttatgagtgtcaattgagacaatgcacacaatatgctgagtgcttgacagatagcaatttctcaatatatattagctgtcataaatcatcattatttataattttaattcattcaacagcatttttgagggctatctatgtttcaaggactatgtatcactacactggtgaggcattaataatcaagacatactcactttcgtgggaaatctaaaaaggatacagatgaatagacataaatagttatggtaaaataaaagaagtttgggaagtgtggtgttcaataggtaggaaaccagacccagggttaaaatgtaggcacaccctttccaaagtgactgttccctaaggttatatatgaaggatgagtgagtggtctaggtgaatatccaggaatggagaaaaatgagctaagatagtgagcatgattcaatacagaggatatatcatatgcaaggccaagagaaaataatttttacagtgttgatataaccagcttagttttcattccttccatatataacacctactcgtttgatgaacaaagaggttcaataaatcagcccatgtcaagagccttgtaggtcaaaataaagtcatgtctcttcaactgattgttgtgaatggtaagagaaacacagaaaggaaaggagagtgcattctatgtggagagttgcgaagtgaaaagaaaattagtgtcaggaggttttagatgtaaattaaaataaccagtctaatagatgatagggtttcttctgcaactagcaagatacaattctgtgttagatgattatagaaggtctttactagatttttaagagaggttatatttctcaaatgtacagaatactcaggtttacaaatatgtgggcaaggcacagcttatgtaggtaaagaataaacccatccaaaatttcttagaagaggttgaagatacagaaaatatgaacgagtaaaagtgcatagggcagtctccaggagcttcctgcattagattttctctaatacttcacctatcattgaagaaattggaagtactaccaaaaaatcgtgtgtgtgtgtgtgtgtgtgtgtgtgtgtgtgtgtgtgtagatagttgattggctgctatcaacgaacagttgtgatttataatacagtactatacaagtggataacaatatttagataccaaaccactccttaccacaagttaacaatatgttttcctaatagctattaactaccacaacattatgaaagagattctaatttgccatcatttagttcttgatgcaattaagaaaagtaaatgtagactgagtttgcaccagcatgcaacagctaattcaactaaattcaaaggcacacatgcaataaatgctgtcaaaacatagcatttttcataggtgattgggcatttacatttggagtgggttgttaaaattgtaattatccaatttagaaggcaagagaacaatctccttatgaaaacaaagtcacgccgagcctgatcaaaatgcagttgggaaccttatgtgaatgtatgacgctagaattggcgacaattttagagtaatgattccaggagatgaaccataggataacttgtgctaaggcaataacttcaaaataatagtctcctatattcacatatattatacttcttccatatttcctatttttttcattgataagtcttaggcagacacaaattggaggaagcatgagtattgtgtgtagcctataggtgaaaaattgagatctgcagtggtgttcatagttcctctagagaaaggattgagcatattgtcagcacagaatattaagcagagttcagaaaaacagagttctcaaatagcttgggagtagtaataaaaaaaaaagaaattggatgaaagtaagccaaagcgtagtgcagaaagagaaaatatgaatgtgtggtaaatttacactcaccaaatattctattattttccctacatttcccagtcctctcacagctagacacggtcatatatgctctagtcaatgggctgtgaagaaaagtggcattagacatttctggacaagggcagtgaaaagccgttttgtaaccatccatgatatcttttctcatcctggtgaaactacaacattgttcgagatggtggtgtcatgtgaagttttgtcagtcttggtccctgaataagaagattcccctagtgtctcaaactggaaatgaaacatgagaaataaataaagctggattgcatgaagtctttattattttttttaattgctaaacctagcctttcctgactaatacacctggggtcccggaaaagggtcccaggatctaacaggatgcctaacagcattaagataactgatcatggtggagagagagggttctccatcctggtctatggctcctattgatatttgtgtaaaaatcaaataaacaacaacaataaaatacagttccctgtatacacatttttaacttaaaattttttagtactttctgatttacttaacatctcattacagtagaggtcctatacaacatgggttcccaacccagcctggattacggactggtacatggcctgtaagaaaccaggcctcacagcaggaggtgagcaacaggtgattgagcaaagcttcctctgtatttacagccattccccagcattgccacctgagctccacctcctgtcaaatcagcggtggcattagattctcataggagcatgaaccctattgtgaactgagcatgcaaaggatctaggttgcacactccttatgaagacctaatgcctcataatctgtcagtgtctcccatcacctacagatgggaccgtctagttgcagaaagacaagttcagggctcctactcattctacattatggggagttgtataattatttcattacatcttacaatgtaataataatagaaataaactgtaccataaatgtaatgcacttgaagcatcccaaaaccattcccccaccccagtccatagaaaaattgtcttccacaaaaccagtccttgctgccagaaaggttggggatcactgctagacaccccttcctatttcccctattattaacatctcacattagtatggtacatttgttataactagtgatcacggatacattatgtttaattaaagtctgtactttatttacatttgtttagtttttacctaattttttttttctgttctaggatcccatctagaataacatttttttttcatgttttcttagactttgatagactgtgagtctctcagactttacttgcctttgatgacctttacaattttgaggggtactgattgggcattttgtaaaatgtctttcaattttggtttttctaatatttgtctcatggttaactcatggttaatatttgtctcatggtaaaacccatgattatgggttttgggcagggatatcacatcgtaccaagagtactgcaatattgcgacttatataataatgtatttgttcctaatcctggcacagatctcctagagctctgaaaatttcctaaatgatgagagtgataaaggtaaagggaaggtcttttgttattcagaataaacacctttcaaccatactagagtttatatcaatgaagtagcttttgaaaaaccctcgtgatgggaggttggttgccaagggaacgaatcttaggattacaagtgattagaaggttacaattttcagctccatcctcagacctccagggaggagacaggggctgaaggttgagttaatcacttaaggccaatgatttaatcaatcatacctaagtaataaagcctccataaaaaccctaaaaggatggggtttggagagcttctgggttgctgaacacatagaggttccttgagagtgatgcacctggagagggcagggaattccactcccttttcttcacaccttgtcccctgcatctctcccatctggctgttccctatttacgtcctttgcaataaaccagcaatctaataggtgaattgtggttttgagttctgcaagccactctagcaagtgattgaacctgagaagcagggaatagggacctctgattggtaaccaagttggacagatgttgtggggaatctggagacctactgctttgattcatatctgcagtgggggtatcttgtgaatctgagtctttaaactgtgggatctgacactatctccagatggatagtttcaaaattgaattgaatggtaggacacccagccggtgtcagaaaattggttgaagtggggaaaacactcatacatttggtatcagaagtaaagtgttaagtgagtgttaagagtattgtggaagaaaacagtttttgtttttcctgctatacagatacataccattaaaataatgtcactgatgatgttcttcttaatcccctggctaatgtagtgtaaattaagcttcttttactgtaaagttatgctttttctctcttcccctactatatcctatagaagaaagttacttgcttgtatgtttttatacctagatttcacatggtccaacaattcaaactgaagtctcattttcctcttgaggagtgttctaatgtttaatgataccttttcctgatggtgtctatacaaaggaagaccttcaggtattaaaggatctaacgtgttagagaaagatatgttaaaccgaaacttctttaagtttttttttttaatagaattttatccaatacttgtgtacctctcacagcaactcagaatattgctatttcagaattgcatatgggaaagtgtattactgagttcacgcatccataaaaaataccagagaatgggtggcttcaacaacagaaaggtaatttctctcagttctggaggctggaaatctaaggacagagtcagtttctggtgagagctctcctcctggcttgtaggtggtcatttttaccctttgttctcatgtggcctttcctcagtgcttatgcactaagaaagcgagagagagggagagagagagacagagagagagagagaaagtacaaccatgcatgcaagtgagcgctctggtttctttttgtataaagataattaccctatcagatccataccccatccttataaactcatttaacctcagtgacttctttagagatcctatgtctaactacagccatactgggggttagggcttcaacttacacattttggagtacacaaacttcagtctataatagaaagtaaagaaatccaagacaacttaaagaattcaggcaatatgttaaatacctcattcagtagaaataaaagaacagcaaatcactgggaaaagcattttattttattgagattatttgtctttggaaaagcaataatatttacctttcaaatgtattagatgtcatgacataattagatataaatctattcaaaccaaccctaaaatgaggccccttatataaacacacaacacaattagaatgaaatggtcatcttgatactgctgtactaataagaattgcctctatgaaatgactatattcattgaattaaaaagcccattatggatctcattcaaaatgctgttcactgaactcttcagaataaatctagtttgttttagtggagtgtttagcagtgtcatttttatttgttttcaaagatggtaaaacaacaggatcttggaaattataatgagccattcaccaagcaaagtcacagtgaatggcttttgtaagttgagaaagccttaaaccaaaagggcgatcatgtcactataatatgctaagaaacagacaaaaaagaggcttcacatacaatagaggaaaaatgcatcaaggctataaaaggtgattttatctatttcctacttgttcaccatattttcagttgtattttaactactttatttatcatatttgagaaggaatcagtacactaatatgttagctatggtttgaatgtgtccccaaagttcgtatgttgtaagctatccccaatacaacagtgttgataggtggaaacttgaagagataattcagtcatgaggtctctgccctcataaacaaattaatgctagtattctgggtgttagagtcttacaaaagaatgagcgtggcattttctctcactctctttctctctaccttcccgctgcccctgtgctgccatcttccaagttatgatacagcaaaaaggccttcactggatgtcatggatcttgaacttcccagcctccagaaccatgagccaaataaatttctgtttattataaattatccatctgtggcattgtgttataacagcacaaaacagactaagacaggactaatatagacactgttgcattagtaatatgtacaaagaagtgtactatgagattttacatgtaatttcaacagatttaatcaatataaaatcttgagaaaatgcttttcaaattggaggaagtatataaaagttttactatattaaaaagttagaattacacatttgtaaaacataatgaataataaactatgttatattagaatagttgattattttagaaaaaaatgcagtcagattctgacctaattttaccttacaaaataaatttcagatgacataagatttagatgtaaaaaggtaagcataacattacttgttgaaaacataagttagcattactgtactctagagcagaggttggtaaattgtggcccacaggccaaatttggtctgccacctgattttgtaaatgaagatttattggaacacagtcatgcctactcatttacacattgttgatggctacttttgtactgtaatagcagagttgagtagttaccgcagagatcatatggctcacaaagccttaaagaattactatattggtctgaatggaaaaagattgcttatctctgatctagatgtaaaggaagactctttaaaacatgacagtagagagacacaataaaggagtattattcagatgtcttggctgatgaagtaggtaaaatttctgcatgtaaaactcaaccgtttatgcaaattcaaaaggcaaagataaaatgagataataacttggtggaaaaaatgcatgagatcatatcctttcatttcccaaataccaaaagtgaaagtaagagaataaaaaatattgtcacaatgattagaaaataaagaagaagaacaaagagcagatatcagaagcaaaatattttaactgatgttttggggaaaaaagaagataaaaaagtgttaaatgatttagtagagtggaggaaattgcattccaaaggtctacagaggggattctgatgagaaaagggcctattagtcccaccaatcacctgagacagtgcagcagaagtaatagtgaatagtgggtgctaaaaatatgtctgaaaggcccagtgtttctgactgcaggaagcaggaggacagttctgcaaatcaacagaactgttggggcttcagactgcaggacttcaggcacaagagagtgcaggatgaagcttaagactggaacagggagtaaatgtaagtcaacatgctcaacacagagacctttccctcttctcacaacctgctcctgaaagcgagttggagaataaaaggttgttaaataattgtacaagttctgaggaaacaaagaaataagcaaaaatatggacacactgacatttgatcaaaggggtccttccccaccaaacaaacagaaacaaaaaaacaaaaataccctgctttcctcctgctctctgtacagttgaagccacaaggaaaaaacaatgtccccatacaaattttccaataagctttttagtgcctcatttattatctgcagaaatcccccagaaagcagaaaatgaagcaattgaaatcaagagaatagaatcgaatatttaaaggattaatccagaaggtccaacatattactaatctagaaaggccacttgccttagtccaattttatactgctatagaggactacagactgggtaatttataacaatagagctttctttctcatggttccggaggccctctagtataagatcaaggcacctgcaggtttgctgtctggttaggtcttggtctttgcttctaagatgccaccttgaatactgcatcctctggaggagggaaacactattccccacatggcagaagaacagaagagagtgtgaactcactcctgaaagttctttttatagcagcattaatacatttatgagggcacagccctcatgacttgaatacctcccattaggcctcactctctcaaaactactgtattcgggattaagttttaacatgagttttggagaggaagaaaacactcacttcataacaccattagagcccactttacctccctggttagtcctatttcaaactgttcttccagaatatttttttttgataatgctcctttcaagttcaaaaatatcctagtttggactatacattttatgattacactgtcacacaattagaatttcaaagaaaagagaatagaaaaattttaaatgagaaaaggtcttagtatgtgctggtgaaatgtcagagcactgaggctaaattgaagtcctaaacatgttcagaagggaaaaacaacactaaaaatgtccttatgaaaatgattaggcattataacatttttttcctttatacatctctggctattgactgtcagcttcctttaacagctcattttcttcactgtctcgtttttctttcataaatttatacttatgctctttcagcttcccaatctatactttacccttagataatctgatctataaccatgacttcaaattccatcaataagtcagtgactttctaatttctgtgtttggcatatattttccaattgagctccaggtccaaatatatccaaatgcccactagacatgtgcagtaaaaaaataacaaaatatcttcaatacccatcgtattcccctccttctttcattcccttcaactccagcttggcccttttccaggaatcttcttcactgaatagcaacactaagttgcagaagacagtattcttagtcattttttggcccttccctcttcatttcctttatacttaattcaccaccaagccatattgatttattccttctgaatatcccctgtgtctctctaagtctttgtatcatcactcttaccatcctgccttggtctcagctgaactcctggaagtcttctaactgcttttccaccatgcattcttgccttacctccaatccattctgcacgctgtatatcaagtgatctttttaaattacagatgtgatcacatcaattcctcacttaaagtccactaggttatcccagttgctctttttaaaaagctgatatacaatagttgtactcaatttattttaactctatgaaaacaaaaaaaaatcttataagggcttaagtaatctgtcttctccctacctttctgtattctgaatcactcgtatccatagttacactaaactagccataatgacttttcttcaatttctgtcatctagtggttttcaaagtgtggtttctggaccagaaacaacagcatacttctggcatttgtttgaaatgcctctccgggaatacttgtaccctgccccagtctgctaaatcataagctccacggcagggcccagaaataccttttttgcacaggccttccaggtgattctgatgcacactatagcttgagaaccactgaacctttgcacacactaatttattcccttataattgtcttctttctccctctttcttactttctaaaaattttctagatctcagctgaaattttattttttctgtgacattttctttgaccttccatcttttctatgtttagtttagaatttcttttaataaactggtatttatttgtgcattttctttcaaaacagctattacaatatatgattatatatttatatgtttatgtgattatttgattaaatatctatttccctacgtagatattacacaataggagggcctggagctggttagattgactcataaatgttcaagaatggtggcacataaaaaatgttgaataaatatcattaaattactgtgaataagttaaacatagaaataagataattacaaaagtacatgataaaaagaagacaattaacacattgcattgttaatgacaaatattcactgatttaacacaatagattatatgtcattatataaaacttactgaattaaactgtctgctaaacactctaagcaagtgccatttaacaaatacaaattaaatttaaatacaccaattgctgataatcactaataatttaatgaaagaaaaaaaggttttagttatacagagcatgattatacagggatcatttataaacaaggatctttgttaaattatttttcttaagttctttttctttcagtgcacaagggcctttgttcaactatgcttgttttgcatatgttttatataagaatattataatgttcaacaaaaagcaaataataaaagagactaaataatccaatgttttatccttggtaacagtgatttattggaaagagcttgaactaaactccaggatccctggttcctcacattctgaattatgttgcctggtaactaagtaacataggcactttcatggaggaccatgcttccaacattgatttagctgtgtgttttttgattgctgaaagacacagaagctgaggtcctctagccataggcatgcactaaagtagaaagatgatgatttaagatctgagctgtagcaagatgtctggatttattgataaggcagcacttatacatctacatccctctacggaggcttgggccaaagtaaaaacctctaccttaataagttatgtatttgggtcactggttttaagaaaggaagagacagcttagaaaagtgacctagaaaattgaaaagttaggacttaattggaagaaaaaaatgaaaaggtaataggtcttgctctcggtttgccaaagaaggttgtgaaattgtatcctcttgccctttctttacactcactaaaaggagattatttatattgggatctctctatgatgactcgtgtgaaaataaggttacccttgcttggttctcctccaaatgctcttttctgtgaaaaatataattctaatttggtatcacaataaatgtgtagtaaaaggcgctatggaattaacacctactagggtattttctaggagaaaatgtctgctcctttttataagcctgaaactcaaaggtcttctttcgtaatctctgttactattctacttcctcattcttatttgaccattaacatttctgatactatcctcaccctctcttatgatagtgacgaggcagccaaatgactaggcagataggggcatgtctctggtaaattcccatctccaagccaaagacagtttaaagcctgaaagccaagctacaagtcaaatccttggaccagattgagaatgtgtcttcctgtttggtgcactttcctctggtgggtcaccacccttcacctatttcatgtgtaactacctttttctaattggttttctacactgccgtgcccactttagagttgtgtctttgctttaagcttttttgcatattcaaaaaccaatcagcatgcaatccccattctgagtcctatgaagaccccaggctcagtcggtagagggagagacagcctgatttcagggaagagaaagcctgacttcggtgaagagacaacctgacttcagagaagacaatctgcccttgtcataccctctgcaggtcccctctccgctgacagccattttcatcagtcaataaaattcttcgccttcacaacccttcaactgtccatgtgacctcattcttcttggacgccagacaagagctcaggacccactgaatatgggtacccagaaaaggctgtcatataggcccttgtcctcactggcagagggcagccaacccatgagatgaggctaggggccaactaagctgctaatacaccaccatctatcggactgcagaaggtggaactaaaggagcactgtaacaccccatctggggcttccaggtctctcacttgcttgcttgcgcctggtctggctgtgggtcctgcatggagcttgttcctgtgccagcacctggagcagccagccagatcctgcactcgctcactcacgtgctccctcccaaaagaggttgagtgcggggggccaagtagagggggcacccctgctgtgagtctagcagaggggccaagaaaagtgctgcatcattagttcatacctctttagccacctagagtctacaccatatcatagcttcctaaagggtctttctgacttctgctgttccccctctaattaactttccaggctgctactcagattaaagtttctatattgctctgattatgtccatccttcctgttttagttaccacttactttcagctaatggccaaattccttatcagaagattaaattttttctctgatccaatagcagatttcttgttcattcttatttcctacgaaaatatgcctccacccaccatgtgtcatgcgtactcactccacaggcacaggtagttcaaacataagactttacttaagtgtctttgactatgtcgtgttgtttaacactttcaagccattatacttgctgtgttcatttgcccaaaatgtcctatccctttcctatggttttttgcttggttaattcttagtcctccttcaacatgtctcatattccaacttctttttgaaaccttacccatccatctctcctttcttctcagtgagcattataatcattccctctgtaacactcttattttctccatgcgtctatcaacatatattacacagattttggtaataattttggggttttattgataaaccttgccatttgtgacttttattgagccattttttagtggatggctcaggcaaattggcactttaataaggatgtcatgaacaatagaaagatgttatggttcaaagaatgaatcactaaaaattaatttcaagcaatataatgaacatagtaatagccatttttgaaggtgtgggatgttgggaaaggaagaagggagaagggaaagcagcatcaattcatcatgcctgagaagacatggagatctcacataaaatgaggtcattaaacaagtgtattgatcatcatttctaatttcttgaccattaaaacaaagtgagccttttaaatattaagttttattttcaagatagagattgctatagtttggatgtttgtcccctctaaagctcatgaagaaatttaatccttgagcttggagatggggtccagtgggatttgtttgtgtcattggggcaggtccttcatgaataatttttacacttggtcacagagtgagtgaattctcactctatttgatcccatgagagctggttattaaaaagatcctggcaccaccctcctttttttcttcctctcttgccatgtgatctcttgcacatactggagcatatgagccagtttaacctcttttcttgtaaagtgctcagcctcacatattcctttatagcaatacaatggaccaagacagatttattcagaattgtggagagccatatttttacatatgttctataatttgatagttttaaagtcatgtattttagagtacaaagaaattttgatggcagtacttttttagtgaattccatcttaatattttcattctgtgtggcataacaaattataatgggaccactttaatcaacttgttttttcatcctgttaatttccaagtctatttgggacatccattaaagtcaatatccttaatttaatggaagatttccttctgaagttgctacatttttttctgtctaaattaacactgaagatatgtaatggatgtgttaaatagataatgctattaatgggaaaaaatgcataaattacatagaagaccaataattttcagagcacctgttttactttcaacagtttagattcttttattgagtgaataagcactctgaagaaaacaaacctttaccctgtattctctattaccttaatttttaatcactatggcaaaatttttaattaatgtaattctgtttttattttagtatgaatttagcacaaggaagagtataagctaatagtcaaacccatttaaaccacactttcaaaaaataacccaaggatttgggtagaatataagtgggggttattatttaggaaacctataataagacaaacaggaatttcagaagtttctgggaatcagatgtcaggtttttcaaatgtttaaaggggttgaatgtacaagactgtcttcaaatttgatgcttcccctttgcaaacaaaattacatgactaatgtataaaatcagcagtacaaattttaaatgtgttgtagctttctgttttgtatttgatttttgacgccatttagaaacagacacaactagtaagattcataaactgttaatcatatatttatcatgtattgattgactttacaaaacatgtggatgtttacatattaccatattccttaaccagcattttcttcttactagtaaatgcaccacacatatttcttacttatttcagtagttagaaaattcttaggaaatgaccttcatgaaatccttttttttaagtgtctcctaaaaatagagagtaacaatgcttgagattcattagtttgattaccctggaatcctttatgttcactctgtggaaataatgccacattttatatttccaaagccctcacactctgttatgtattgctttctctgtctctcatatatgatcacatttacacacacacacatacacacacaattaagacatttggcaaccaggcaagatatttgtttcatttaccattctatatattaagatacccaataatttatcacgaaaaggttaatgagcatccagatgagataaaacccaagggttttaaatgttctttcagtgattttaaatgtagccttggcttcctgctatatctatatctcaaattgcagagaaacgtggtgaaaccacagatacaataaaggtcatggtgtttggatgataaatttgctcacctaactatccatatctcttatgggaagaatttttttatttaaagaactaacagatatgcttccaatgtcatatcagaaaataataatcctgtggcttttttctagtgtatttaaagactacaatttaggtactcgatcagtaatttcaaagtgacattaataaaaccaaatgagaatgtgtcaaaaggttttgactaaaaaatcccaacaactattatcacaattgtattaaaagtattggtctcagagattttttggctctacagtacaatagcttttgtgtttttaatagcatagctcattccaacatcgactaaaaccttcatatgggattattaagacagagataaaaggaaccacagaagagttaacaaataataactttcattagggtctccctccttccaaaaatttcaaaaaccagatattttgacagaatgtgtagcttgaagaagaaacagaacaaggatttggtagccctcattgtgaatgggttccatcacataaaccatgggcatcactgcatgtgtcagctctatgtgggccactaaggacacacagtcattagtgtgcaaaacactagaatcctgatggcaatagaaactacacgctgtccaaatgtaaagtttaactcttaaaaaaaagagggaagagacataagagaaaaaatggtaagtggtttccatgggccatttaaactcatcctgacatatgtaaagtactactgactataaataatctcttttcttaaaacttccatagcatttctctgtcccacacttttagtacccacctacactgatttgcattgttatttattcctgcaaagattactttgtaagtttttaagctagagtataaaatcctataagacaaggttggtggtttataaggtattgatttctccctacctccaacgtatttattaacgtcttgcataattagtgctacataaatacttactgaattatttttatagaaccaaatatagccttatgcaatcaatagaagctcagtaaatgttcttgaatataagtttaaaacataattgataatcaggcaaaattattctgtaggcaatgttattgtaaaaaggtccccaaaataaaattacgagcatacaaatcaattcaagaaacataattatataaatagacctaaggctttttaaaactactgtgtatcttgcttggctaccctccggtctatgcaaggatttaggcttctagggacctgcgatgtgttcctcttctgctggacctcacctggactggcctttactcaatctatgtagcagtactagccaagcttgaacattgcttttaaaggcaggtattagaaagctcctggaccctcaagagtaatgtgataccaaatcaaagagataaataatatagataaggaaatagagatgaataagataataagagcttttctcagtggttttctctggggaaaaatgttaaagtattcaatttttatgatgagcttgtatctgagtcctcacaattaagatgacaatccctttcctgtttaggcttcaggaaataactaattttcaaaaaatgggagttttggaactatgggaaacacataatcattgagtaggaaaagtgtgactgaaatgtaagcggtagaatcccaaaactaacaaacaaagaaaaaatgatattcaatctatcttcaacttttgctcacagggttaagtttattaagttaaagagctccatattctgctatacttttatcaataaattataattctaaccattaaaaataagtcactgattttggattggcccaaaagccccaaaattgcctatttcagagcctcaaggaaacactgcaatgtaaaaacatacgctatttttaaagcaagtgagaatgaaaggaagagaagaaggaaggaaggaaggaaggaaggaaaaaaggaaggaaggagagaaggaaggaaggaagggagggaaggagggagggaggggaaaagaaggaaggagaaaaagagagaaaggaagaaaaaagaaaggaaagaatcttgtcataggaaatatatataggcatacaactatagtgtgatatatataatatatatatgtgtgtatatagatataggctttgatttcctccaactccaatgcatttattatcgtcttgcataattagtgctaaataaatatttgttggattatttttatagaaccaaatatagcctgatgcaatcaatagaagatcagtaaatgttcttgtatataaatttgtgtacgcatatatatatatatatatatatatatatatatatatatatatatatgttttctttttatggagacatgtttatttctaaccctagctgctgaagtgatttctaaagggaaaaagcttagaaggaagaacagagaaactgaaacttttgtcttctagcgttcagaagacaggagagcttcatctgataaatgttaagtggggaaataatcaggaaaagagggcaaatttcgaggccaggaaaagagggcaaggtgtgggtaagtgtattagctgccttatttcacattgtccttgagataatggctgtatattctctatcagtattctgtgctcgcctatgttcagtctttaaaaaacactaggtaaggtcagtgacttacaactacacagtatatgtcagggcagagggaacaactcaatgtgtgcattttgaaatgattttctgtaatgtgccacatacctcgttgttctctacttttcactctttggaaacagttacatgcaaaaccaattacagatagttatcaacaatcccacagaggacataatttctgagaaaataaattttactatttttagtgtagctttgtatagcaatgaaaaatactttgttttagttcagtataagttttaactattctcttatatcaaatagaaaataatcatttgctaattgcatatcatttcacagaaaatttgaacttgtgtattataaaaatttatactatagagttataaaaaatagagattaaacagcaaagatatccatcttttattaaaaaatattttcaaatactcaagatattaaggtgatatatgtattcttcagattttccatttcttttctctaccagctttcatcaagagaaagtgaagggggatatcctcacagtttgattatttgaacctaagccactggagaatggtaatttggataatttctggctttgatagagcttagtgcactcttaaatttctccgttcatatgtaaaagcagatgatctcgttttcttaaatgacaaatgaattctgtgaatatagctcattcgtagtgaactttacaaatgactcacaccatacatgacttgtgtaattacatttacatttgcttgtcatatttactctaaaatgtcactgagtactttttaaagtagctctgtatggcacacaaaagattagaaaactgcagctattcatttcatattaattcttgcccttattaggtccataagaaaaatgaattaaattcatttgctagggttgactagagtatttcacttgagtttctctctgtctctttctctctctttctttcccccagaagaactgctgctgcaaagtcacactgaaggctaattaccatgttggagagatgtggcattttacttggaaaggtcacatggcatagtgaaaagagcactaaacttataattagaagtccaaggttcaaagctgggttctcctcctgtctagcacgtcttcagtcctgctcacctttaatcaacaatgtcaccatgggcaaagccagtgtgttttcatttcctcaggagccctttctatttttaacagttcttataatcaccagaaaaattttctaaatgtgaaacatttcaaaaatattaactttatccataaatgagattaaaaaccaattgttaagttaaaaacattttctttgcatgtaacattgtcctataacagctagaaggagcttaaaaattcaccatacttatgtccgtgaatgttgatcagtacttttaaatatgtatgcttttcattcttcaagcattttatagcaatgaataagagattaagtttgcctggaaataatggtggtcttcacatcaattgaaaaaaaaaattcccaaaactgatgttccccaaaaggtatataggaagaattggcaagaaaaattaaaagtaaaaatgtgactttcaaggcatggttaagttagagcaaaggggccatttatccccatatagctgaagaggaaggactcagatatgtgtgagagataaagctacctcactcacaacatcttactttaccaatttgtacatttcatgttagaaagtgtgtataccatgtggactctaccactttctgacttgttatcctttggcaagtattagattgtcctcccatgaccaccgtcatggccttcaccattcattacctacgactgtccttgttccactagcctgcatagtgtgccctttgtactttggctcaaaaccatgagactttacacatctaaaaattaagtgtgattataataggcaatgatgactctgtaaactgggaaagaaagtggagcatgatgcatgcctttggagattgttgctagctacaagggccaaagtttcatccattaccaaattctaagatgccctggtgagaagaaactataaacattggaggtccaacaaacaaacttgctttcatcttactcatgggatcaactgactcactgcatttcaagacagttccttttatcattggacaacttcaattattatagactccaaaatctctttccgtggacctactaaatacatattaagtcttatcaggggacagaaaaaataaatctacttcttttttatcatgatgattctttaaatatttggtaatattatcctagctttcgctgttttttgttttgttttgtttttggtcaagctaaacattatttcttcaaccaaatttatgtatattcatattcatacatcattttagctgctctcctatgcatatgttccagttgtctacatttctttccattgtggtattcaaaagagcatatcataattcatttgttgtttagccattataaaactatgggataacatgctttcttattctaggtattataattctattaatttagtacatattgcattagcttttattattctaataatatagctagctattacagggtctaatgaaacccttcagtctatttttaaattgctattatgaaaaattttaaatgtataaaaattagactaatataataaaacccccatatgtctgtcactcaacttcaacaatttcgacttacagagtattataataagacatgaagttggttgaatattatctataaggaaatgaagagagaggcaggacatatttaactaggatttgaactactgagcttgtgcaagtggttatgagaggaaaaaaacaatacttgtcttagaatttcactcttgccataacatagaaaatgagttataaggaatgtggtagatagaataatataatactccccactcgaagatgtccatacctaatctccagaacctatgaccatgctagtctgcatggcaaaggataattaagtttgcagatgaaaataatcagctgccattaagtagcgagattatcctgaatcacttgggtgagcccaatataataatcacatatgggaacagaagtcaggggaaaatgtaaatatggaagaaaagcagagagaaatacaccatggctggctttggaggtaaaatggggccatgacccaaggaatgtgggcagcctctagaagccggaaaaggaaataaatcagattgtcccctagagcctcccgaagaaatgtggacttactcacaacttgattttagcctagtgggatctgagtttgacttcaaaactacagaaatgtaagagaataaatttgtgttgttttaagccattgagtttgtgagactttgttataatagttatagaaaacaaatgcaaaggagctaactttaatgttaattgcattgctcagaatatcttctattacttcagatacagcttatggcacaattttcattgctataattaattaaaatgcctaaaggtgcagaacaagggaagtgatatatcacatagcggttaagggtgtaattttgaaattaaacttactgggtttgcagtgtgactttgcccgttactattcacaagaccttgtataaagtatttaacctcattttgcctcagttttctaatataaaggatgtgtataagatttcatagactatgagaattaagaatgttggagcatacatgtaaagcatatggcagtggcttgcatatgaataattctaaataaatacttatcattattttgatttttcaaattatttacacattatcatcaacttttcctcaagcagaaattgcttgaaatctagcttatgttaattgtcttgtcaacaagaaaaatatcagaagacttgtcaaatgcctggcttaaatccatcccctgtctgtagtgtctctaataccccctgatctattaagctactaaccctattaaagaataatttaaattagtctaacatgactcagtctttgtgaacccatattgaagcagagttgtatctgttttttatttcaggtactgactaataagttcattcataattggttcaagagtttcatctgaaatcaatgtcaatcttatttggctaagatttccgagtgcccctctatcctctatgctgcttaattccagaaaccatgtttagtgtttcttgtgataataggtcttgcaaatgcctacaagaagctcatggtctatcaaaggtcattcttaggattgaagaatctcaaattattcatgatttctgtagatggttatgatctacagtgcctagaatataacagtgtttccagactttataatttcaggatttgtttcttaatttgagcttctatctattaatatcaacaacattgtcctcttttgcttgctatctccaaacttctgaagaacaatgagctactgtgtcttaaatagtaatttattttttagacaaatgataaagctaaatttaaaaattagtaggggtgaagtagaaaatttcctacatgacttcactattacggtaaaagaaagaaccaatcacatttgtgctttggtaataaggcaatttgcagctgttctcaactgctaaattctcagtattaaaaaaaatgggcatggcagaatgataagtgttatatccaaatacctttagcctttcaagaatggggaggtacatgaaaatgcatgagacagaagcccagatgtaggtaaatatattaaggaaaacatgcaaataaagtcacaaaaatagtcaagaagagaaagtacacaaaaataaaagtttgaccatgtagactatgttagttttctggcttttggcatgctacataaaaaaattaaaataagacgcaggtgacaaatgtaaaaaaaatcattcacattgtagatttttaaatagaacatcttgctagttctgtgaacaaattatgttggtagtttgataggaacagcattgaaactgtagattgctttgaatagtatggccactttaacaatactgattcttccaatccatgagcatgtaatgcttttcaaattgtttatgtgtcatatgttatttcttttaagagtgtcttatagttgtccttgtaaagatctttcacctccttggttagatttattcctggatacttcattttttggtggctattgtaaatggaattgcatacttgatttagctctcagcttcaattttattggtgtataaaaatgccacttatttgtgtatacgcattttgtatcctgaaactttactgaagttgtttatcatttataggaaccttttggcagagtctttagggttttctgggcatagaatcatattatctacaaagagagatagtttgacttattcttttcccatttggacgccttttatttatttatttttttcttttccctgattgctctggctaggacttccaggattatgttaaatagaaatggtaaaagtgggcattcatatgaaacagaaaaagagccaaatcaatcctaagcaaaaagaacaaagccagaggcattatataaactaatttcaagctatactataaggctacagtaaacacaacagcatgatactggtacataaacagacacatagaccaatggaacagaatagaaaacccggaaaataagttgaacacctacaaccatctaattttttacaaagtcaacaaaaataagcaatggggaaaggactccctagtcaataaatggtgttgagatagctggctatccatatatagaagaatgaaactggacttctatctttcatcatatgcaaacattaactcaagatggattaaagatttaaatgtaagacctcgaaatataagaatcctagaagtaaacttaagtaacaccatttggggcatcagctttgagaaaggatttatgactaggtcctcaacagcaattgcaacaaaaacaaaaattgacaaaaagggagcttctacacagccaaagaaactctcaacagagtaaacagacaacctacagaatggtagaaaatattcacaaactatccatccaacaaaagactaatacccagattctataaggaacttacacaaattaacaagcaaaactcaaataaccccattaaaaatggacaaaatacatgaacagacacttctcaaaagaagacatccaagtctccaacaaacaagaaaaaatgctcatcatcactaatcatcagagaaatgcaaaccaaaaccacaatgacataccgtctcataccagtcagaatggctattataaaaagtcaaaaaacaagagattctggtggggctgcagagaaaagaaaacacttatatactgttggttggaatgttaactagttcagtcactgtggaaagaagactgaagatttctcaaagaacttaagactaccattcgatttagcaatcccattactgtgtatgtatccaaaagaaaacaaatgttcctaccaaaaaaatacctgcattcagatgttcattgcagcagtattcacaatagcaaagtcatggaatcaacctaggtgacacgcaatggtggactggattaagaaaatatggttcatatacaccatggaataccatgcaaccataaaaagtaatgaaatcgtatcttttgcaacaacatggatgcagctggaggccattatcctaagcaaattaatgcaggagcaaaaaatcaaaataccgcatgttctcaattataaatgggaacctaaacattagatactcatggacttaacttggcaacaataaaaactggggattactagaaggggagggaaggtaagtggcaagggttgaaaaactacctattgatcattatgcttagtacctgagtgatggggtcatttgtgccccaaacctcagcattactcaatatgtccattcaacaaaactgcacatgaagcccctgaatataaaataaaagttgaaaaaagtttgaaggcacaaataagtaaataaataggaaacaaatagagcatctcattcctgtgttgtctcctgtatatctaaaaataacacttttagatcccttagacgtattttgaaattgtgttgtgttcctttctttgtctaacaagtgaagctcactctgatttgagagttaatagataatagttacatatatcccaaatatttccttgggatgtgtttctcatgggaaggatgtacacctatggtcatgggtaaacacaatggtctgttagcgataattatcatagtatacttacatattgtcctataaaataatgttctgttaatatagatttactgttagataataacacattctattaatagaagcccaaatttaaactggctggtaattacattttatttcacaagtaaaatgttttgctttttgatattttgtcttttcattaaatatagaaagtagtaaaaaattacaactagatttaaaattccattggacaggtgacacatatacacttatttaatatctgtgaatcactaaaatgatgattaaatatatagtcagcattaaatacattcttgacaatttctagtatttcccagtcagatggtatctgatgctgtttctctattctgcaggtaattaagtaatttttcttaagatcaactagaagttagtgatggagttaaaaacgtaatttatttcttcaaagtccttctgtgctcctttcacctcaatatggtgcttgcttgcaagattttactgtagtgaggaagaggcaaattataaggaaattagaaaatgaagaaatcaaaggaaagtgtatgttgataatctcaacaacagtccttgaagtctgcttatctactgctaaacaagcaattcactcagaagctgaaaaaaacttaatatactcatcaaagccctctttacaattatacaggtattaaagaaagtgtccaacagtgagaggtgaaccttaagtagtttaaggattgcatttagaagatgaagattagagcaataatacttaatgctactatagagcctttattcctggcggttcaggatatttaactaaaggccaaatgatataaacctctgatatctgtaaaacttagctggaaaactttattctaataacatttttgtgggttgttttcctgctctttcattttcttgcaatagaaagcaaccctatacctatttgagagcatttcggcacaaattctctttaaaaagcaatggggatattttcaactcacagtaaaaggaaatgtcttagtactaagtttaaataattgttgagtataattaaatctatgtaaattaattctactcagcattaaatttatatatatatatatatatatatggccaatagaaatgctaaaaattatagtcacatgaggtattgcaagcaaatattagagaaatcccataacaaagagaaatactaaaaatagatcctggccaggtgcagtggctcatgcctgtaatcccagcactttgggagactgaggcgggcagatcgcctgaggtcaggagttcaagactagtttggccaacgtggtgaaaccccgtctctacccaaaatacaaaaattagccgggcctgctggcacatatctgtaatcacagttacttgggaggctgaggcaggagaattgcttgaactccagaggcagaggctgcagtgagctgagatcgtaccattgcactccagcctgggtgacaaaggaagactccatctcaaaaaaacaacaaaaaaaatcctgatagtctaaaataaaagaaaataagcaacatatatttttaggtattctataccttccaaattttaccattatgatatatctctatcttcacaatgttggataggacaagtcatattggttagtaacactaataaaatgctatatatctaaccttaaggaagtaattataaaaagtctatgctaccaaagtaataaaacattttccttaaacccaataactttatcttatacataattatagacatcaaccatatattttaaggtgtgctaaactgcactgaatatggccactgaaattattagaatctgaaaaactttggatagattcatcttctatatggcaaaattggatgtttcctgttattttcagagttgaaaaaattatggggaccagtcaagttgcctcaatcttgcttccatcatgagaattctgctggagtatataggttaaaatccagatttttgaattggttaagagtttgttcttcatacttatctcagtcaataattaaataaaatgaaaatatgcttttaaacacatacaatataacatagtcaaagctcacattaataaattataccaaatcattttatgatattaattttttaaattgttacttaaaaattgataattattaataatcatactctttaattaaaaatagttaaaatcttttaaaaattcataaaactagcctagctgattaaaatatactaaatgttaactaacattttggcctttaagcatctactattttagcattataaaatgcaaatgattttttctcaattggcagttttttcttcactaaattaccaccaacaaaatatatataagaaaaaaaaaaactctagcaaagaagaaagtcatactgtagaaactacaaggggtacacactaaacagaaggcttctatttcaaattagtatcttgatatgagactccagtttagtccaaacttcataaaagtagtcattaacaatacaaaatattacaataaaaaatctagctattgtcatgtttttaatgaataaaacaactctaattgaggattatgggctacctgaaggaaaacctactgaaaattaattttattgactgtcttagatttggtttacataaagaaaatacttcactcactccatagtatctgttctcagaatcacataataaattatgcttctctttccttcttctagtctgggagagtacaattgcttttttcttgctcaatactaacttagcctctctgtgtttgcacaaatggggagagtagataggaaaaatataaaataatgatacgttcgaggccacagtgccaaaagaaggacctctgtatcattcactgggtgtggaaatgtgggttacacaacgcagcatctctgcataggtaagcccgtgtaggttactgaggagacaagcagaacaggaggggtataatggaaattcagggagagaactagcacttgtgtttggcttgttcatgtcaccttgtgttgttttagaacttagagaatggagcaaggcatggggaaaaatgacagtcctaaaacaacaggaattatagtaaaaatctattacaaatggagagctcctcttatctactcatgctttaccttaaaatttaaaatatatattatatatctatcatatgtatatattagatattcaaaatcttatttaaacacaagtacagtagtccccttttacccatgtttttttcccccaaggtttgtgttacctcaggtgaaccccagtctgaaaataacaaatagaaaattccagaaataaagaattcatgagtattaaatgacgtgccactctgagtagtgttatgaaatcttgtgccatttccctctatccagtgcaggacatgaattatttctttatccactacagagtggatattacccacctgttagtaacttagtagttgagagagagaaaccacatttacataacttttattacagtatgttgttataattgtcctatcttacaattagcttctgtggctaatctcttactatgcctgatttataaattaaactttatcatagatacatatgtataggaaaaacaacatagtatacatagggtttggtactatccgtgccttgggcacccactgggggttttggaagctatcctccatggataaaggggcactactgtatacaacaaagggtaatgtattcacatcattcaacacatctgttgtctcaacattcttcaaggaaaaacaaacaaaaggcagccagccataacaacattggtctatggttagaaagaaaggaacaacaaaagcagtatgaactaatataaaagcaaatatgacccaagagaaattctagaaggaaaacacagaaaactgacttaccaaatagattacaatagagcatggccactattaatcagaagcagagtgtcaagtagaaaaaataatttataaattagataaaataatatatttataagataaacatagaagagataggaaagaaagttaaaaacaaaacaatggaattgaaatacactttgaagacaatacataaccgaatattgctgaaaaatgatatgaaaaacttgtttgaaaaacagtaaaaaattagattaatgaaatggagtgtgagaagatattgaagaaagaacaatatctgaaaagctgatctttctgaaggaaagataaatataaaaggaacaaaactgaaaagtcaatatcatcttagaagataatattcataaactataaaaaagactatacgtgttggttttaagaactcatcattttccaaggtaatgtgtccaacatataaacataccattgcattttatctataaagatataattcataagcacgcatccaggcaaaaaatacacacaaagaaataaacatttgtctgtcttcaaatttttacaggcagaatctaatctttagaagaaacttgaataatacctatgtaatgcttaggaaataaatactatgatatgttcaaactcatcctgtgtatcctgtttcccaatttcccagactttcttgcaattagagataacttttgccatgtttctccacagcagtatctcagcagaagccaattgggatggagccacagaaataaagttacaacgctattaccacattacttgctatctgaaacactgggaaaaaaaattcatcagttaatgcacctctcacctacatagtgaaaaacagtttgccctttgcaatattttgaaaaagaatagttgtttgctgatatataaatacacttataatacggagtttatgttttttaaagcaggttaaatgtctatatgtatagctgtatccttttattaaaaagataccatatgcatgaattggaccttgaccaatatcatcaatatgtgaaaggagtttacacagtggtagcattatgcatatttttatagttcctttcttaattcagccctttatccttttttttgttacaacaatatgtcctaatttaggtactaatacagaatagaggttttttatttttaaaaggaaaatttgaaaggtaatggatttatctatccctaacatttctaaatctgagagtacagaagcagttttttaagtgattgtacccttcattaactacatgtttatacttgaattgaaacatccatgcatgccttatatgctgtacaattaccagaatccctgagctactctcataaccctgattaacatttatattaaccatgggcttcagaatgcacagttaacaaagaaacttgttattttatctcatgccaataataacacaggcaggatcaagaaaatatgttagtggtttttttttagaaatggttatttggagtgcaagttaggttactaccgacaatttggactccaggcttctgctcaaacaggtctatttctggctacaatgtaggcagattgattgaattttgcattcaagattacatgataagatttttgccaatttaattgtttgaaattaaaaatatctcaatgtttaaaacttctgacgtgaaatatttgtttaatatgaagaatcacacaatatttaatctattttactgcccatgtttctcaaaatagtgtccctttagccttcctcttggcccctgtctcccagttaatttatctcttaattcctcagggaaaaatcaggaaaaacaaaaacatccaggaggaattattgtgtgattgtagtagtaggaaggatattacttcttctttaagtttgtttgcttttttttagtttttaatactttataagcaatcaaatattttataggctaaaacaggataaaaatcaatgaaacatataaaattgaaggagagttttcaactgtgtgactcatgaaacaaactagatgaaataaaaagcccagtccacactaatgtaaaccctactattaggtgaaactttcccagtcactatatgatattaattcaagacagattaaatatgaatctaatagttttgtttggatgcttgaattcaatggtgtctcattgccttcaaagtggaagttctatttgacatatgtctcatgttctcactaatatgtgggaggtaaaaataaataaactcatggagattgagagtagaatgatggttaccagaggctgggaagggtatagggaggggagcataaagaggagatagttaacggatacaaaaatattgttagacaaaaggataagacctaatgtttggtagcataataggtcaactacagttaacaaaaaatttattgtatatatcaaaataactaaaagaaaaaatgaaatgtttcaaacactaagaaatgatatatgcttgagatgatggatatcccaattaccttaatttgaggtattctgtgcttgtatcaaaatatcacacgtaccccataaatatatactattattcagtatctgtaataatgaaaattttaaaaaattaagtccaacctctaggattagcctctaaattccttcacaacagagccatacctgtaattctagcttccttttcctcttgtttttcctacagtttcatgattttttaaaaattttccagccatacatgattattttagagttcttagaatttgcgcttttccgagttgcatcagctccctgatatgttgttcatgcctccttagtgccctgtgatcttccagttcaagcatcttccaatctcaatatacataagagtcccagaggaggacattactgctgggcttttctgctcttacagcctacagataacctccatattctgtcctattgaataaggtaagagtggtgctttattcaatattatgttctcagtgcatatatttagtagctgccatagattttcttaatactagaaaaactgtttgagatttttattatacagatgagagatggaaataaactatagctgtgttaatgaaaataaggatttattatgtctctctggtatgcatcttgggggttaataaaaattgtaatagaattgaaactaatttggtataaaaagtgaagttttctgagaagaaaatggaagaaagttttgtcaaataaagtgttaaaactattgaaaagtgagaaatcaacaaagatcttagtattaatttaaactacttatttctcaaattctgccatgtgtatttttacagatttttaattcaaaagcacatttcaaaacttaagaagccatgaattcgtttgcatgtacataggtctgtcttatttaagttgatatcactagaaataaagattgccagtaaagttcaaaagcttgaaggtaatataacagcattcacatacaaatatttagcagagttccttcaaataagagaaaactgaaaatcttaatgagataaaattgcttgagaaaagaaaaattttttaaaagcattgtatttagtgaccattatattttagcaccatggtctgtatttttttattttgatagatcttagataaacctattattatgtttttattttgaatgacaaaaattatgtcccatttgattacttctctaaaacacatcatgtctaaaacaccaaaagcaatggcaacaaaagccaaaattgaaaactgggatctaattaaactaaagagcttctgcacagcaaaagaaactaccatcagagtgaacaggcaacctacaaaatgggagaaaattttcgcaatctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaaacacatgaaaaaatgctcaccatcactggctatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggactataaatcatgctgctataaagacacatgcacacatatgtttattgtggcactattcacaatagcaaagacttggaaccaacccaaatgtccaacaatgatagacttgattaagaaaatgtggcacatctacaccatggaatactatgcagccataaaaaatgatgagttcatgtcctttgtagggacatggatgaaattggaaatcatcattctcagtaaactattgcaagaacaaaaaaccaaacaccgcatagtctcactcataggtgggaactgaacaatgagaacacatggacacaggaaggggaacatcacactctggggactgttgtggggtggggggaggggggaggggtagctttaagagatacacctaatgctaaatgacgagttaatgggtgcagcacaccagcatggcacatgtatacatatgtaactaacctgcacattgtgcacatgtaccctaaaacttaaagtataataataataaaattaaaaataaaataaaataaaaaataaataaaacacatcactcgttaatagcagaattagaaacctaattcagatcgcatgactttaagtttacattgctttaaaaatacctaaaacttaaagtataataataaaaaaatatatataccatattgtgtcaagaggaaatttttcagtttgacataaaatcagtacattgagcttgtatacttgatagcttcccttgtcaaattctcttggaaatgtacagaaaacatctgacatatttggaaagtagaatgaaaatgtataatcgggaagaaaaaagtgtcattaaatatgaaactaaggacttttcacaaggtacagtgcaaataaaacccaaatgaagaaagttctgactataaccaaaagtagtaagaacatttgttgagaacttattttatgccaatacaaacatacgtaagacagaaagaagtatttaaactttgtgattcattagacacagcatgtttcaagcagttatcaagacagggctcaacccattaagagaaatccaggaaatggggtaaatgaacaaagcggacagtttttccagaaatccctataacggaaaaccagggaaccactaaaataataaagatgtctactttttaagacaaaaatatccggtattattattgacattctcttgatcaacacacaaataagctaaagtctaagctcatatgcatttttgacagacagacaagaagaaagaacacaaaaagaaaaacgaacatacatatttttgtgaaaaaacattgtgattgtccttttggtgctgattcacagccacttactctcttttcaggctcatgagaggaatataattttcaatcccttgcaattagacaaggtcatgtgactaacttaagggctatgtccaaagaatataattgctggtgtgggacactaatcctcccttccctactatggtaagccctggaccctcataatgagaccgtgatgtcatagaggtaaaactttatcagcctatggtccctgaatgacaaaagggaccaaacacttttattaaacagtgttgaatatatatatgaataacaaataaacttgttgttttaagtcattgaaataaggttttcttactgcatcgtggtctagaccagccatgtaatgtgtgtgtgccaaaaacatatatgtataccacatagatgcatgtgtgtatgcatatatgcatgtgtgtacatcaaaaacatgtttttcttatctctggattgtagacccttacgtattattttataattattctctgtttttgttttttggatttttattaaagtatattttctacttcagatggcacgcagtatatttggaataatataatcaactattcgatcaatagtgactttttttggaaaatcaggaggaaaatgactctggaacattgattttcagttatgtgaagagccataattaatatcagttatcaaatatagatatttttatttccctgctaaacaaaaattagaatttacctaatatttagatatagtaagaatgcatgcatttggcagaatgtattcatataggttaaatattttgatttagtatttagaaaggtcaataaattgcaaccgttttgtgtttgaccagatcttggagtaacaaaagcagatatatagtttaaagacagtcttacatatgtcttcagaagctaactacatggaatttatcttttgagtgggcaggagaatgcacattaatggataccagtgagagattcttgccctacttgtaataagactcaagtgtgacctgaatggctccctgctgcttagatttatgttcttctcagaggtattggatattgtatttcactacaaagagctaaaaacattgcaatcattatttataaatcttttagaaaaatgtatcttctttgcagcaactatggcaacagggaactcgaaatgacactggaaaagaattgagctcagttgcaatgggtaatgtacataggatttatattttattaccatctatattttagaactgaaaaaatctaaacagtatatatgattttttctgtatttaactcatgtgttacattaaagcaacatttaaatataatgcaaatcacatttatgtaactatcatgaaaaatttataaaaatgactccaggtgaatcaaaatcatctcatttcaagggtactgccagctttacatattagcaataatactagcatttctagccatagtgcttatattactgcacttgttataaatttaatgagctttctggaaatgcagatatggtcattctttttaaatatttaatttaaagcaaacataatttcttttattttacttattactttaagaacacacctacagtaccctcttatattatattggatacagtaggtttttgtcttagtaattgttttaccccatgttaagattccttttttgatcaggaaactttctgctatttataatatttcttacaaagttatatttttcccttaaattaaaagcatacattacttaaagatatagatagttaggagctcttacgtttgtcaccacgtttatgcccacattagcaagtccacgcaaattcctctcccaaggaagatattggaaaattgctatatttgactgtatgacatgaccatcattgcattagtttgctaaggctgccacaagaagtactgcagattgagtggcctcaacagcagaaatgtattttctcatagttctggaggtttagcagtccaaaatgaaggtgtcgagcagggttggtactttctgaagactgagaaaaggacctagcccaggcctctcccaggcttgtaggtggccatctcctccctttcacgttgactttcacgttgtctttcttctctatttgttgtatctaaatttcctcctaaaaggacaccaatcatattagatgagggcccactctaattacctcattttaatttaattgcttctttaaagacttagtctccaaatactgagatatttggacattctgaggtgcaaggaattagtaattgaacatatgaatcttaagggggcccaactcaggccatgacaatcatttgatttgataatataacctgtcgaatatatttgtttccagtgctcttattgttttacaaattctacagcaaatatctgagtagttaattcttcgtataaatccttaattattttgtatactgttttgctctgacagatatattagattaaataatgcaaatatttcttaagcctttaaacttgttgaaaaatttcaacctgaaaatacatggcaacttgtagatacgatagaaatatttgagaaattattccccaatattttccccaacactaaatatattttaacaagttaatatttcctctcataagaaaacaaaatagtatatcatcatttcaatttgcatttctaaagtatcaatgacattaaatggtttttatataagtaatttgtatttcttttttgaaggtgggagatagcatcttcgatttttttggcctatttattcagtaacagtatcattaccttctttgtaataagacatattacagcatttttcttgggtttttggtatgcctgttaattttatctatggtacgttgttcctgaacacaattttttaaatttatgaattaaattcagaaaacaacactctttttccttataacttctactccatttggtggcatggttaatttatataaaaggcatacatttatttgggacaagtaaacaaggtataattggattttgtctcttgtcaaaataacaacatcatcatttttaaattaggaactttacctgctgtaagtaagtgctttgcttcaggaattgcactccccagagtgagctgggccaccaccagccacacctccttcttacctgtgtcatggatattgcttttctcacatgaatgtagaacgatgcccaaggtgagaataagcagtactttggtaaaggaattcctgtccacttttctcgttctgagttaagatgcatagtgacatagttaagatgctaagcttctgtgcctctcattttgtttctgtttcagaaagtgagatctaggctcagcacaggggagcagattccctaaagctcgactctcatcatggctccctggggtaatgaatggagattcctccagtatgccggcattagtaaatcttcttattgttttcttgtctgtttctttttgtttttgttgttattgtttttttgttgttgttgttgatgttgtggtggtaatggttgtttttgtttccgttttgtcttttgcatttacatggaagttttcttccagcattttagaagccacaagggggccgtaggaggcccttctcatattttactatttagaagaattttcctcctttatgaattttatatcatagtaaaaataattgactattttatttatttaggtctataaaaagttaactaaaatttaatgagactgattattgttttgatttacagagaccatcctaattattttatagtcactatgctctattgtgcctctaatgaggctactggttccaatttagaagcattatctataaagagagagttagaggaaagacagaagtacacacagactttagaagtttgatcttcaggcatcttcctcatgcgtgagctagccaatgttttcttctttatttctatgcctttggacccagggattaattaagtctgggttggtctttggtctattttacaccatggggttcttctcctaccaagcctgagtacagtcttcccaggagcctctctatgctgtccctatggcagtaatatcagggattctcagattttcactcttctattaaaagccaagagagtagagctttaaagtcaattaataatgatataatgagagaagttttccactttatgggtcttcatgctcttaattcatcaatttgagcttctccaaaacatccacctttgttacaatgctgctttaggactgacacaagatcacatggtcaaagacttattcacctacaaagataatttttgttttgtttttaaatcttgcattgtttccaaagaaaatttatatgatgtaaatttcaaatcataaacagcaccttttcgaattaagcatgatggatgagcatgtgatgtgtaagaaactaaaagagagagagagtaaagagagagtaaattctgcctctcacttatccaagatcaagagacgaatggattaatcagtcagtaggaatagtatcccccaattttatgtctgaatctattatcaaacgaatacattctaataaagtcagacaagtagttctaaaaattacttcacttgacaaccactaaaggaacttttttgttttgttttgtttttgagatgaagtctcgctctgtcgcccaggctggagtgcagtggcacgatctcggctcactgcaagctccgtctcccgggttcacgccattctcctgcctcagcctcccgagtagctgggactacaggcacccgccaccacgcccggctaattttttgtatttttagtggagacggggtgttcaccgtgttagccaggatggtctcgttctcctgacctcatgatccgcccgcctcggcctcccaaagtgctgggattacaggcgttaaaggaacttttaaaatcaatttctgagtctcacatcagacttactaaatcactctctcttttaaatgatggaacccatgaacagatgtctaaaattctagagacaatttttatgccctgccagagatgaaaagtattgtgatagatgataaaccaaaatcatgaactagcaatgcagtttgccaatactctccctaatttaacctcatgacatttgtaattaactaattaatcttccattcatcagaaaatatcctgctgctatcattagagaggaaaaataacttgaataaaagcaatgctattttctgcatttattctccaatacaaaattgaattttgttgatagcttaaattattttttcttactactaactgtaattctaacctcctagtgacaaatatttactattgatcaagctctatgagaaacacttaagataatttttaggatatatagaagatgatgcataaaatcgtttatataaaacacaatacaaaacagtatacaagaaggtttacataacgtataaaaatgttctatatttaatgagacacagggagattcctttctgaccaaagtatcaactaagagcacaaatataggaatagcaattacattttaatacgacactctacatggtccctcgcaacaatgcagactagctttagtaagaaggaagagaaatactaggtagttcttcctacaatctctctctctctttatctatatatatatacacacacacacacacacacacacacacacgtatatgtatatatacacgtatatacatatatatgtgtgtatatatgtatatacgtatatatatgtatatatgtgtgtatatatatacgtatatatgtgtgtatatatacgtatatatacaaacacacacacagatatcacagtcttatttacattttcattatttccatattataagtggtaaaggataattaattcaacattaaaataattcccagaagatttctgaactaaataatagactcttcaaaactcatcatcaattctaagaactgggaaattgttttccttttgtatggtagcagaacgcttgtttattttagtcatctagttccaaaatagaatgaaggaaaaatgaaagcctaagtaaaactgttgcattctctattgtaagacacactgacactctaagaagagggcaagaaatctcaaggagtttatccatcataagttattgaaaagaaacactttcagcctttcaaagaaaacatgttgacagatatacggaaatctaacaacacattgtcactgagtgtgaggacatgatgtaaggtaatgattttttttttttttttttttttttgagacggggtctcgttctttgccaggctggagtgcagtggcgcaatctcggctcactgcaacctccgcctcccaggttcaaacgattctcctgcctcagcctgcggagtaactgggactacaggcatgcgccaccacgcccagctaatttttgtatttttagtagacacggggtttcaccatgttggccaggatggtctcgatctcttgacctcgtgatgtacctgcctcggcctcccaaagtgctgaaattacaggcaagagccactgcacctggccaatgatgatttttaaaagtttatttcaagccaacagttcaagagagtacctaaaagcaatgacttctaggaaacataggttattttatatctaatttgcagaagtgattactcaccattttctttcattagaactgctatcatagctataacatttgtactaatctttaatgctactatctaggtgaaaaattagaaatattttaaactttggtcagagtcctcaaagaagaggacaaaataactaagagttaagagactttagcattagaacctaggattgagactgagttctaccaaagactagatgggtaatttagagctaattgctttgtatgcggctcaattctttatttgtaatatagagtttataataaatagtatatgtagtgaagaaaaagttataacaagtatacattacatttaacacacctagcacataggacaccctcaacaaacagctacagctgctgtaaatcatgtgtatataatataacatgcaagcatatcttcatgtattgattaattactacttcttggaaaaggatctgaggaacatatttaatatatttaatatgcctgctcatatgttcatttagtgcttatcaattatatttagtgcttttctattagcttcatccatttgattaagatagcaacttgtattatttaatatatgttactctgtgctgtttcttcatagttaaaaattccaatacatactaagtaaaaggaagatgtaagtcattaaggtgtttttccatttatcagttgtgctaaatggaatttttttttacagttgtggtaaatggaaaagcactttaaatgactctagatagatgcactttttttcttttccttttttttaaattaacaggatatgaatccatgctatatctcttttaaagttgctgggactttctagtttatctagagttaacagcactgatataaacctatcatagaaaaatacattttacacatattcaatgtacttcaaaattagatgcttcatggaatttttcaggttgcttttctgttcaaccttaaatatttaaacagttttataaaaaatagataattttgtgcttcaaaatatcataactgtgtcaggaatttgttattttgagtttatcaaatgacataattgaatttgagatatataacaacaccatagttgataaaacaaattattgctaaaaataatttaagcaggcactaccaacataaaatattataagatatttaataaataagaatggcatttcatgaggttttccatttggatggtgcatgtcctgggaagaatttctttatgtcattatgtcacagagactatattaagtagtaattactactaacaaaaagtaatactgcacaaattaccagagccatcctttttattaacacaacttgataaaaaataagaaagctattgctaaaactatcacattaatattcctctgagagttgaactataattgcagtcgcttttattctgccccatgagacaccagaggaatgcaggaggcagctggcaatctactcatgtaattatatttctccctatgtttgaattattaggcagaatttttgctaatagagctgcaaatgaatagtatcctattctctttatattaaattcagttattagtgggctgtggagagatttccaacacagcacagatatcacatattgtatgcctctgacctccactcataacttaccagtaacagagaagttaaggaattgcaagaaataaagaaaatttaagatattgcctagcaacactcgaaaatattaaagtcatagaagactcaccaggaatgagaaaaggtgaaatcatttaaaaactattttagacatagtttcttagtttctttgtcatctaggtagaaaaagagagctaagcagaaattggctcattttccatgcatcagaaaagcaatagaggaatagatagaaataaagacatacttttctagtcatcactgcaaactcacatcagggcagtaaaatttccatcaaaaatatttctaactgagtttaaatttaaagtaataaaatatgcatctaatacagaaataattgagccacaacaccatgcagtcttgcttcagtgtggcatccatgatatcagttccaggcctttttatttatttcaagaaatagtaaatagatctactttttattttaaaaattaaacatctttgttatttcaaatatacacttatttttaatcactgaacatgacaattcagatgctgttttccttgcaaatggctctctaaagcacgaatactgggattcaagagttcctcaaaggcatggaatataatgaaaaatatcacagggttgcaagtaaaaatatgctttagcagtgttgttttgataattaaataaaaaagtaaaccacacagcctctttgtgtatgaggaggtaatttcagtaaatacttggtcaatcttactgatttataatgtcccatgggaattatttcaacagcagaggtatttgtgctggttatagtagaagaagctacttgatgtatcaaactacctttatgtgtcttctacagtgcttttgagtgaaacatccacacgtgcacacgccccttcctgagactgtggaatgaggttgtgggaacttctatcagtgagatattagggaagggaagagaaagggctactttgtgtgaagacaatgtcaggataaagcagtctgtcttaatatagcctaatatagaaagccattttgcatggcatgggtgggagggtaaaagaggaatacaacttagcaaagtaggtggaagctcctggaaacagaaatgacaaaactgtttaatgttaaaataaaaagatctatctactaatatatatattaggccccaccattgctcaggccctgacaatttttgcttttcctggatgagcactatgctatgtatctgcctcactccctctataatattcccagaaaaatcttcctcaaatacaaaactgaaatttttagtcatctgcttaaaacccggtgtctcggaggcggaggttgcagtgagccaagatcgtgccattgcactccagcctgggcaacaagagcgaaactccatctcaaaacaaacaaacaaacaaaaaaaaatggtgtcctttcttgttttccagaataaaattgattgtcacaggttgattagtatgtacttaaaagtagacttgactgaagccagcggattttagcagagaagacatttataatttatatttccaacaaaataaaggcttccatacaattcttttgatagggaagaaggaaaactaataaattagaacaagcatgattactttaagtggtgagtctctaaaagggtttgattgctggctcagactttatcaaacacaattagtgtcccaaagggcatactactctgtcctcaacactttttaactctgatcacatggtatacatttaataaaaaattgttgaatgagtaaccaccattcaattatctacttctatgatatcaacttttttagatttcacatgtaagtgaggtcttcaggtatttatctttctatgccttgtttagttcatgtaatataatgttctccagattcactcatgttgtcacaaatgacatgatttccttccttttatggctgaatagtatcccattgtttatatatatcacgttatctttatccatttatctgttgacagacacttagattgatttcatatcttggctattgtgactagtgcttcagtgaacacaggactgcaggaatctcatcaatatactgacttcatttcctttggatgtaaacccagtagtgggattgctggattatatgatcattttatttttaactttttgagaaacctccatactggttttcataatggctttattaatttacattcccaccaacagtgtgcaagggttcctttttctccatcaatacatgttactttttgtcttttggataatgggcattctaacagaaatgaagtgatatcttattgggattttgctctgcatttccctcatcattagtgatgttgagcacttgttcatatacatgttggccatttgtatgtcttttgaaaaatatctgtttaggtcttttgcccatttttaaaatcaggttatttgacttcttgctattgaattgtttgaattcctgattttgtttggatgttaagcctttatcacatgtatagtttgcaaatattttatcttataaagagaagtgaatgccaagttcctgaatccagaaagaagaggtattgggtttagtggcaagtggtcctccatctagaccacttcaatggaacttcttttatccatgaaacaactgagaataaatggaaaaaaaatagtcagctggcaaacctgaaaaaaatacttgagacataggatgaatagaagtcaaacagaaagcaagaggggaattgctcttgtctctgatttatgacaatggctatcagttatgtgtactaatgccccaatagctaataattgagttaatataataactagcatgtactaagcaattagtatgtgatcagtcattatgctcagtgttttccctacattatctcatttactcttaaaccaggtgaaattggtattattatgtccattttacatataagtaaatttaggcttcaagtaattgattaccttttttgggatcacacagttagtccaaggttcaagtgaatgcctttctgagtccaaaacttcttaaaatattatggtatatttaatgttgttaaaacgatatcatttaaggtccctttataatataacatgaattatgcagagcctaaattagccaatcttttcattcattcattgtagattaattcatcatagaagatcatgtcatgtatatgtatgagaaaaagaaacattttaatgcacattaatctctgagaatgttggactatataagctgaggttgaaaaactacacataaaacttaattatttgagattatgatttaattatttttttctaaatccaaaactagttaattcaacaccaaaacatcaattatctagttttctgtgttgatatacagaaattaatttttccaatttcttatatatttatgttataaacacaaatcctatacgctgtaatttttaatttataaaaattaaattgcaaattgttttgagactcttaggaacatgttaagagatgtgcttgaatttaatttaaattctcaaaatgttaaaatactaatctcagtttcaatataggtagtagctaaaaagttgattatacaaaaacaattttgtgattaactttcttctcaaccttgctcttcatttattaagacttgtgcctttaaaatcgttccaaagtttacatacattttgctgaatgaagtgctttaggcactagcaatttcaggtgtttaatattcaacaggcatagtcctaaaactcaatgcatgttttaaaattttcattgcatatccatgtgttactgcagagctcttcaaatcgttgctttgttatactactaaaagttggcaagatgactttttgatatgatacctcaaatttaaagtaaaaaaggtggatgttatactttctgagaaatgtgcaaagtattatgtttaaataatacaatcataattatctattttatattttaataataaaacaataattctggaacatcttaaacttttaaaaatatattaatgaaattattatcactgattcagcatacaatattttgaaggcatacataagccaggataatagtatgtacatttttatgtatacactggattacatcattttgcaacccacacttcacttaaatttaaccatgtattatgaccacatgtccatgtttacatcttcttaatgtttacatgttattcattgtatgaatgtgccataatttgtgaatccaatcccagatgtttgggtatacataattaggttcaattttttaatattgtcttccattccttaattttctaattatatacagaagataaactatcttaagtggaattaccaaatcaaaggtatatttttaaaggaattttaatatgtgttgcctttgtgatatataagaaaccgaaataaaattttgtgttcttttgcatactttggcatctaaaatgtcattgaacaacacaacctcacaggttgcaggaacaatggcttatatcaggttggtatgtaacctccttgcaatagctctactgcaacttagcatggcttttggatattgctgattggctctctattgccaaaccctaaacttaatagtttctactaagtcacacctgagactttgggagcagacatatcccaaaatgttatgcaaatgtgatgcctctagcattcaaatgattattcagcttttgctgcttataaatccttaatatcgctctcctcttcttcctaaagcggttaacctgagaccaattagtgataaagtcattgcaattttctgtgatgctgatacctttccaagttgggatgtgaaaaacaattatatttgaggatgggttcaatatattgaccctgactttcaaatatgctgtttttcctcctctcaatcagtttataaagtaatgaaatagagggaaaaaagttaaatgccagtaaattataattaatgaggtgaaatgtttgcaatcatttaaaagtaaaattaaatgctattcattatttcatatacttttctaaaatagctatatactgcttttccatattttttttttttttttttttgagatggagtctcgctctgtcgcccaggctggagtgcagtggcgcgatctcggctcactgcaagctccgcctcccgggttcacaccattctcctgcctcagcctcccgcgtagctgggactacaggcgcccaccaccacgcccggctaattttttgtattgtttagtagagacggggtttcactgtgttagccaggatggtctcgatctcctgacctcgtgatccgcccgcctcggcctcccaaagtgctgggattacaggcgtgagccaccgcgcccggcccccatatttttgtagtctactttgagttctaaaatttgatagagtaaaatataaataaattaaagaccaatctgaaattttctctgaaatgtgacttagtagtcacatttttgcctttcagctgtgcttttctcattatatttatccatccaatatttcatatttcaggaattcacacattcattaagaaacatcaaatagattttttcctgtatatgatatgtaatgtttaggatttgtgcttgcttctgaaatttaataattcaatgtttatatacatacataatacatgtcacttctattacacacacactacatatagatatataatatatagatatatctatatattatagaaatataaatatatagatatatctatatattatagaaatataaatatatagatatatctatatattatagaaatataaatatatagatatatctatatattatagaaatataaatatatagatatatctatatattatagaaatataaatatatagatatacctatatattatagaaatataaatatatagatatacctatatattatagaaatataaatatatagatatacctatatattatagaaatataaatatatagatatatctatatattatagaaatataaatatatagatatatctatatattatagaaatataaatatatagatatatctatatattatagaaatataaatatatagatatatctatatattatagaaatataaatatatagatatatctatatattatagaaatataaatatatagatatatacaacatatatgttacatattatatattatatatctatatatctatataacattatatatctatatatctatataacatatatagatatatagatatatatgtatatgttatatattatttatatataattttatctatatatagttttaccattttatttgcttctgcataggtaaaggattgaaaagaatgaacaataataataaaatatttggtatgaaataaagggatttatcgttaataaaatgaaattcaaattcatgttaaaatacccaaatggtaaagactaacacaacacaaaaattgaaagatactaatacctttgttttacaatttaagtttcaatactcagcaccattccatcttgtcatgattattacattagttactgctgtaattataaacaatcgactaacacctcaactttttaaattttagctcgaatattatcaactgactagccccttttaatttgaggaatttagatcatattttctttcctcatgtgagttttgtagataggcatttttttatctttatcattttaaataacatatataagcctgtatgtattcttccgttatcttgagataatgtctcttaatccacactatgtaagtgaagaaataaataccattttatctccccatttttcttctatcattcccacttcctgacatctatcaccacagcaatccatgtacattgacaaagtttgctaaaagacctactgtctcttaggccaaattgttttgttttcttttttgttcttttgttctgttttatttggtttgtttttgtttttgcttttggtagcagcctctatccaattatgctttattggggcatgggggtgggggttggggtcggttaagcaaactccacgtctctgtagaatacacaaaccatgactcaagaaacaacaaaaacaaaaacactaaccataaactcagtatcacaaaagaatctcattttcaaacccagaatttcctggcatagataatacaaattgcaaaacaaacagaaatgtaaataaaaggaaggctgtctgagcccaaacaatcctattaacctattcaacaaaaagaataatgtgagttagaaataaaaaagcagaaatagagcaactttatgacaatcttttcctatcattttcaactcagaaatgcagaccctgaagcacagttcaaataatgcactttcaaataacattagcatagaaacatggactaaaaaaccaaatggacaggtctttcaggaagagtagagtgacaaatgtttggctctccctcctgtacttaagactcaggaaacgtgaaaatatgagaaataaacttcgttgaccttctaagctatgtaaaaacacattcaaatgctgaaaaatttgcagaatatctctaaaattggtgcagatatggccataataaaacagcacaccaattaaagaatgtcttgtaatcaatctctttcataaagtggtatacatttcagacaattaatggaggtaatccaaggctcaccaagaccctttggctgagaagggaaaggcctgtaagtccaatcaggttggaagagttcttaatgggcaggaaagctagccccctgggatactagccactgcactgagcaacatgactgcagtagaatccttagcaggccagaagtttagatagatagacagatgatagatagatagatagatagatagatagatagatagatagatagatagatataacaaaaggctaaaagcacgagaaatatctcaccacagcaaaaagctaaaataaaccgtcccatctccatagtatggaagattatgcagccattaaaataataatgtaggccaacttgggtaatcatgacacacaggccaattcttgcacattttctgtttgtgtcaataaagttttattggaatacagccacaccattttttttaactattgtctgtggctgcttttaccatacaatggccaacttgagcagttgtgacagagactatctaggcaacaaatcctaaaatatttgctatcttgctctttacaaaaaaaactttttttggctctgggtaagaaatgtatacttgacactaagatattctcatgagttagtactaagtgaaaaatgaagttataaaactatatatgctaagctcatatgtttataactaaaaaggcatttgcatgtgtatgtacggggaaggacaaataccataatgttgacaatggctatctctactaggattattaatgactcctttttgtcataattatctgtttttaaaatttatacacagcaacatacacacacatatatacacacacatacatatatatatatataaatttgaaaatagcaaagaaccaaaatctttgaggcagtttttatcattagttgtcaatcattggttgtaacagctgaattttcagaaaaggaaaatggactcttctgtgtgtctgtagactagagcttgccagcctcacggactatgtgggcctcattttagtgcagagcaggctgcaaattatttcaaggttctgtgggtttgataacagttgtctggaagggggacaactgctcattttcaactgtggtctcacaagcatggagagactgttattttcatctgtgctccttcaatcgaacatgaaacatctgtcacaaaactattgtctgatgtggcagcaaaggcttctctccatctaaaagcccagcagctgctgcgggaaagatcagacaactacaagcaatgtgtcaatacctgtacagactaccatgattttttaaataatactgagcactgcagcactggtaataataatcacagcaatattctgtgatgtcatatacacacacacatatatatttagagagagaatattgtgagtgtggtgtgtgtgtgtgagatatatttacacacatacacacacatatatatagagagaatattatatgtgcatgtgatgtgtgtctgagatatatttacacacatatatatatagagagagaatattatgtgtgtggtgtgtgtgtgtgagagatatttatatacacacacatatatatatatatcatttgacctaaaatagacttttaaagtaggaatgtggtaatgtatttgaaagatttaaatctcacataattcatgtgtttttaatttcttcaagaacttaggtcttgaagtgcaaagttggcttttcactggtaagcagaggtttgcaaatgttgttacaggaaatctacctcatttgagggtactgagttttcttggaaaaaataaaagaacaacttagaccagttgaatttgaatgcatttttaaaacatttttcttctggggctcaggaggaattatttaatttaaggcatctaagggatgaatgttgatgtgggagaaaatggagtacctgggtgaagagcatagtctcaggagtgggaacacaacattgaatcatgtttaccagccgtgggaaattaggcaagcttcaagtccttgctttgcacatcattaaagtgtgggtgattgatggcactactgcctgtctccctcataaagttactttgacagtcaaatgggttaaaatttgtaaagcgtttagcatagtaggtggcatatatgaaaggttgtatgaattggttaaataaatagcagcaggtgtgatgctgatctgaaagcccatagtgagctactgcagtaaagccactagaagaagtgagcaataatgatgggaagacaaatttggctgcaaacccaagacacaggtcagacacaaatttaagaaagagaaaacaaaaaccacaaaagacacaaaaccagtgagaattctggctttgttaaaaaataaaattagagtggtcaggagacttgggagtaaatttggttttacttttaccctagcctttctaaatggatatgaggcaaagcatgtggggcttaatggacgctggttttgtttcctccttactaccccacaaataaatagcagacacagtatattttcccttttgtcatccctcaatattggagtgttgatgagttcccatagcccccacccactctccacacccccaccttggacccataaactgttgaaacatgtggtgtttcttttgtaagtcatttgacttcaatccttttcactgcccacaaatccctgtcattaatatcaatttttctcatctatttctcaaaatatattctcttctacaaaagtgtgtaattccacagtattaattgggtgtcacttaaatctttctaatgatacacaactgactcttttattcacattgcctttcaacctcttttggactgtgattgtttcaatgactgaaaaatgctgctattgaatcctatttagttgtatcaacgaggtaccacccataattatgtaaatataattttattttgctgacatgaccagataattttagatcagtaggcttggcttcaatgatttactttgaacttcaacttaaaaatctaaaatttaaagacaaatacatttaatggatttttgttaattaatacataaatattcattgtatttatttctctttggtttgtgaaacctatacttcaattagttcaactctgcataattacgtatttggttcttaaagcacaccacacgcgtgcacacacacacactcacacacactcttccattttcaaatcatggcttaactgttgtctttcctaaaatcttttctaactaaatggaaactagtcattcaataagcctgacctacactgagtaaaagaaaaaaaaagcaaatacccactgaaataagtctaattatgatagagatttggtataaccattctagaatatgttaagggagaattttgagatattgaagtcacacaaatgaggtcaagtgagtggttagcacagacgcctcttatttgatctgagttctgggaacagagggaaaacacttgagaaagataagggtgcatgccaagagttagagtaaataaagttatataaaaattgagtaccatctctttaggatattttatttccttccatcactagaaaacattaacccatagacatagattttgagaaagttaaaatcaaaactttaaatgcaaaaacagcctgctgggacctcgtgctgggatgtgcctccctatgttttcctgggacctgttgctgtgacgtgcctccctattttttcctgagacctgttgtggtgatgtgcctcccgatgttttcctgggacctggtgctgggatgtgcctccctactttttcctgaggcctgttgctgggatgtgcccccctaacttttcctgggacctggtgctgggatgtgcccccctaccttttcctgggacctggtgctgggatgtgcctccctacccttccctgggacctggtgctgtgatgtgcctccctacgttttcctgggacctgctgctgtgatgtacctccctacgttttcctgtaatcctgttgctgtgatgtacctccctatgttttcctgggagttggtgttgtgatgttcctccctacgttttcctgggacctggtgctatgacgtgcctccctacctttcccttcatcccagcacccctgagcacccttcctagttttcttctgccctatatttgttttcatctgctttgaagtcatagcacatattatccctcttgttaatcaattgttatgatcatctgtgtggtaatcctgtccccaatttctcctcctacgtacaattgatagagtgttcttcctgaagcctaactctgaaaataccaacactcttctccctgaagacaaagttattcctaaacatcaatgattcttcaaagactacccattgtcattcaaattccttaggaaaccacaccccactcaaaatcaaatattttaatgcattattacattttccttaaacaaaaatctgttttttaaattttttattacaaaagtctatgataaaatgaagacacgttgcaatgggaatcattatgcccagttttgaaccaaagatcccttgctatcaccaaatagtttgtaatgcaacttacaatatcctatttggctaaagaggtaatttttagaggatgtctagatttcagatcattgtaaggagcaaactcacgcatattttagatcaagcttgtttatcatattcaaagcttctaagagcttatttgtttttcttaaatgttcaaatactgaaaaagttgcagtagatggtgtccataattatataactcttcatactgtaggtacatttttcttggtttgttttatataattttgctatgttttagtattcagtgaatgaagatgcatcaatcatctattttcaaaaataaatataagtgcattccatgcttaaataataattaacaaaaataataaaacaaaatgcatatcaacagagagaagcactgttcagatcttgatttatagccttttatacattttatagatatatctaaactagttttctaagaataggatcttatcatatttaccgcttttcaatcagctattttcatttaatgtatgtcttatgtttggcaggattactaattaaaagttattcggcaggattatttcactagctgtgtgactctaggggaataacttaatatctctgtgattaaattttcctatctgaaagatagagatgaaaatagtacctcacccttagggatctttagaggattacatgcaaattacccaggatatacagaggatccccagctaaacaatggtttgatttttctactttatgatagtgtgaaagtgatacacatttagtagaaaccttacttagaattttaattttgatctttttctgggctagcaatatgctctacaatactctctagtgatgctggaccacagcaacgagccaaagcttccagctagccaggcaatcacgagggtaaacactcgatctctgcagcgtactatgctgtcaaatgattttgcccagctgtaggctgatggaattgttctgagcatgtttaaggtaggctaggctaagctatgaggctcagtaggttaggtgtactaaatgcattcttgacattatattttcaaattacaacaggtttattaggaagtaaccccatcgtaaggagagaagcatctatttgtacactgttgcatgtattaaagaataataataatatgttattatgcaaagttaaaggtttttttctggaatagtgtgtgacatctacacatttatgactaggttgacaccaatctatgtgaactagtaaagcttgcttaaaaatcataaaacactgataaagtgtcaaaatgaaatttaggatgacattgtagaagtgtttgttcacaaggaataatatttaaaaggtattgctcattcatataatacatacatttatatataactcatataacatacataactagtatagatagtttttgtcactgaaggttttatcatttttctataacaaatatagattgctagtgctgtaaaatttactaaattgtaaagtaaaatacagcttttaaaaattatttgtaataattatgactaattatgagcattaatttatttgaataacaaaatttcttatgaatgcttgactaaactttactcaggtttcttcctgactctagaccctaaccttcctttcctttgagcaatttttttttggttgggggtggtaagagcaatataattgtacattctctctctgcccttttgagaagtaaatatttttaaagcctcttgccagttttacaacccagggctgtctgtctttctcaaggatctgggaactaactcttcaaaatgtgatcatcacagaagatactgccctttctcttagcttctatgagagggtagaagccaactttggctggagccttgctccaatttgtcaaactacctcctgccatgaagatataagagcatttacttttcctttgggcaaagtaattagcaaacataggtaacctgtcagccccctatcctggttcttaaaaactctccagacttttttctcactggaacagggaatctaaatttggtggtctgtcttctattgttggcaataaaatcaacttctgtctgtccatcttgtctagtgtgattgttctctttaacagaggcaaaatggttctagattcttgctgcttgctttataatttggggccagtgacatggtaaactttaatttccaatttgtaaatgggaactttcaacacctcccaagtacagcagtcatccagatgaaaggagataatatatgtaaagcactttacagaatgatgcgtaagttctcagcaagcctgagaattaaaaagataatctgagagattaaataggcaattatgaaaagactttgctaataaacacattaaaaatgttctatgtcaactgtaaagttttttaagtaaattgaaacaacagtacaatattagttttaaacaatccatgtgacatagatttttttaaatgtctctacagagctggccagtgtttggcaaaacatatactcctatataccagggctgaaaatataatgggaatataaattgctatctttttttttttttgagacataagtttcactctgtcacccaggctggagtgcagtgcgtatccccagctcattgcaacccctgcctcctagattcaagcggtcctcctgcctcagtctcctgggtagctgggatcactagcacatgccaccacacctacattttttggatattttgtagagatggggttttgtcatgttgcccaggctagtctcaaactcctgacctcaaacgatccacctgccttggcctctcaaaacgatgagattatatgcgtgagccactgcaccttacctattctctttttgaaaggcaatttgccaattaagtatcagaaatctttaaattgtgcctgccttgcaattctacttttagataagaaatagttgaacatcagtgaattttaataaacacataagtttttcctaactatatttctaataatgaaacttggaactgacctaagaaatcaaatcatagaaaacaaataaatgattgtaaaattatacaagggaatatactatataaacatttagaatcacatttaagagccttttacagttgagacaatcttcatgataaaatgtaaagtgaaaaaaagttaaatagcttatatattgccatccaaatattctatatcaaagaagttagggttctaaaataacatatgacaaatattaagtgtaattatcatatttgcagttttttgcaattttataaataatggacaaataatgtgaatataatcaaagtaatcagttttgttattcattctccagttaaaaagcaaggttttcttttaggccattttatctctatcaggaattaaaataaatatttctgtgttgttttctgtcttctctttaggctcttcttgctttcttttagcttttctgactttattcctatgaactttcattaacctttatacgtttgtcataaattgtgttatctctgaataaatataatattttcccctgttttttatttgaaagattatcgtaaacactaaatagaaatttttcccccatgtgccttttcttcatgaagatgtcagtgttatacctaaaattagatgacagtatttgatgttgttcacacagaacaggcagactacagtcaatatggccagtgcactgtggtggggtgaggggaatggtaaggggctggaagttagtctgcttgaatcttgtaataaatacatttggcttattggcttatttctgttccctatatagataaaacctaccactgactgaatattgcctattgattaccaaaagaaaaagcacttcacatctaagaactatcaaaaaacatggatttactatagctcagtgagaatgttaacaaaggctcacatgaaggattttattttctcaaaagatataaaactaatgtattattgtttttatctctaaaccaacattttcctttaaattcctaacactttttttttttttttttttttttttagacggagtctcgctctgtcgcccaggctggagtgcagtggcgcgatcttggctcactacaagctccgcctcccaggttcacgccattctcctgcctcagcctcccgagtagctgggactacaggcgcccgccaccacgccccgctaattttttgtatttttagtagagacggggtttcaccatgttagcaaggatggtcttgatctcctgaactcgtgatccaccagccttggcctcccaaagtgttgggattacaggcgtgagccaccgcgcccggccccaacactcttatttttatttaaaacacatttgcatggtaaatcagttggcataaattacatattttttaaattgttagatctgactcatgttgaaacacacaggaagctcaaagtcaacatttatggacttcacaacaccttgaaaaagcaaactcagacccaaaactttcatagaactgctgcaggtcacgttatcttctggctgaaaattaaaatgacacctggaaaatataactacccttttcaaggcacaaagcccaaatcaaataacctccttacttaataccattgtggcttgaaataggatagtttatctaatttgggtaaaggaagaggcaatatcagttcatttatgtggcatgaatactgttttatttgcatacaaaagtgatcattataattttagaatgggtagtttcttaaaggagaataacactcatctttccatcaacggactctcatttgaagctaaaccaatataaacatttataagaattaacactagaaaactaaggtaaatctgattgacttctgtaaaattctgagtgttgtagattttttaaatacctacttgctcttttttttttatcttgaaacaatgtttcaagataattgcaccctctgtatacttagggtgcaatttatttttttcaactgagatagtcaaggataactggacacagctattttctccatttatagatagagaaaatatttttaacaggattactcaagggctacagttaattatcatgggtatagcttggtacacatctatattgatagccagccctgggatgggcgtggtggctcatgcctgtaaacctggcactttgggaggttgaggcaggcggatcacttgaggttgggagttccaagaccagcctggtcaaaatagtgaaaccttgtctctactaaaaatacaaaaaatcagctgggtgtggtggcgggctcctgtaatcccagctactagggaggttgagacaggagaatcgcttgaaccctggaggcggaggttgcagtgagccgagatcgcgccactgcattccagcctaggctacaagagcgaaactccacatcaaagaaaaaaaaaaaagccagcctcaagtttcagtaaaaattaaataatttagctaacacctacctgctacttgatttcactcaaccatctcttgctccaccccttcaagctgatttggttctcactgcggagcctaggggagtaagtggttcaggaaccagggagtttttgaatgccttcagcttatccttatgtccccttctcctacatcttgtaaaataaggcaatatgggattttatgggagtaaatatctcagattttctggcgtacaggcttacacaatttctcaaataggagtgtatgtcgtacaaatgtagcactttctgaacaattaacaattggctttaaaactaaggacacctacattttgaaataaccatactacatggatttgacatccactgaaatcaagatttgttgtctattaaagatgtgttatttttccccaaaggtgaagattcatatatgctttacatctgggattcaaagtctaggcttgtatatttggataatttttctgagaaccatcatagaacatcccttctagcgttgttcacttagaagttaaactacttttttattaactttcaataaacagtgaaaaagaaaatgtaacatgcacctctaactgttgttttttttaggggaaaccggcctattaatttcaggcttcccgagtcactctccattgtccctactttggtctttgttgagccttcttagatactacgtactctgaggcctctgccctcccttttccttactaatgtcagctctgccaaatccattcatactcaagtcaaaaatgaaagataaaatgactaccacacacagacatgagggtactttaacaagagactagagactgaaaggaaaaagaaataataataaaagtagtctcatattacaactggtacatacgagttatgagttgtcagataatctcacccacacccttaatttcccacaagggaggtcccacctaatagacaatggtaatggaaggagaatgaaactcttcatggatattacaatatggctttttcttctctgttgtgctcgcatgagatatttgaaattacaattattataaaaatactgcctagtgttatttgcctacttattttaaattaagaaagtctgtctcaaaaggactcaatgtggctgaccagaagaagaacatcataaggcaattaagtggatataagagaaatggaggccagaaccaaagaaagagaccaaataaaatatggtaagaacaaatgttaataaagttattgttatgaaagatcagaaatcttatattcatggttattatacctatatgagttatttaaaatttttaatgtttattatttaaaaatattaaatacacagagaaaaaaatgtattaccaaactggcatgaattaaaacaatagatgtgaatctatatgtaatgggagttatattactccaactatataaacatagaacatttaaataaattattaagctttaatatttatattaacttcagcttttttgatatttcatctctgtcattatttgacatacctgatagggatattgaaaaaattgtactgagatttgcaagtacacatgttaataagaataaaaaatatagactttgcattatgtcatggcaaaatattatccttatttctggttagttttatttttttaaaaaaaggacaaaaagaatattcaagtaaactcataactttattactaaaagcaccatctggtggttactagaaatggatgcatttcaatctttctgtcctcagatcttttgataaaacaatagaaaaatgtttctctcttgcatgctgacagagattcccctctgcatattgaaattataagcctagagaaacagaaggtggattttattggtagaatgctttagtctatgtgtgtgcatgcaataaaatcaatttttcagcttcccttttattagaaaccttggtatataaataagagtattttctgatctaaatcagttttacataaccagaaggcaattgtgagttcaggaattagaaaggtctcccatacaggggacattagaaaatccaaactgaagtgttttaactttcccaggttgttacctgattctcgcatgcagtaggttccaaataagtgttggctaaatcggggaggggggggggtgtgtgaaagaaaagaaaagaaaagaaaagaaaaaagaaatgaattgccatgacttaatgtgagataagacaaaaccggggggaaatatcctcatattttatattagatagatatttttaaccatgccaaatttgatgtgtgaatttaacattagcaggaaaggagtgatgatttttatttttaaggaaagattatcgtgcaatgaataaatttagaatttttttgagatttcaaaaatatggcaaggtattaattctgggagctttaaaagactgttaatatgagcatttgacctaatgaattataaacacagaacaaagaaatcctctgttgctacatagctttgttgtgaattcaatagaactcattttctacattctcttgagaggattgaagaagattatttcaaattgaaatttaagatatgaaattctgagctgtaggagggtaaaaggtttttacttttttcttctttgaaaattaattttccccattacaaatgcagaaattgagtttcaaaggtaatctagtaaaatcaagtcacacaggtagaaatagtggagttgtcatttgagttcaagttctttgtttccaaagcactgtttctcagcattgtgaagaaggtttgcaattatacgaatagatttttctgatggtttgggagatgggtagatgaggaagaatatgactttctttatatatgggtaacttcctctaaatatcactgtgttatttcaccactccttctatgtgatccaaatatatctctttaagtaacatagttgacatgaagactgtttactctgcatctgactcctctaaccactttgaggataaactcttagtgtttcaagatgtgatctcatatcacagttaaactaaaaattattctgctttcactacatgatagggaaagtttaacaattcattcaacagatactttcctaagtgttagaacatttctatatccaataaggagaaaaatgcattcatacaaattttgtagtcaatgataaaaacaagagtttggaatggcttcgggggaaaactgcttctgccaggaacacttacttagttctagggtaaaaataagcttcacagatccaatatcagtaagcgatcctcatcaaacagatgccaaagtttgttttaaaaagtgatatatctacagttcacacacaactttaaaaatctatttgattttgttatgcgtataacagagaaagtccaggattgagggttgggatgttggaactacataaactctctctctctctctctctctctttcttccaccccagcttattgtatgtaaccagtttttcaaaatagaaatgtcagcatctgataactgttacatggatatttatattagtaataaaaacactacaatagtaataatttttggtcaaattgatctgttatccatccaacatttattgtctctcaataggatctagatgtttcatggaggcgtcactttttcttcacaagtcatagacaaaagatgttggctcctggggggaaccatgattatgatacacctggctctgtgcttctattcctcttgctccagtgggcagtcacccagacctaattgtcatatgacaatctcctgtccactgtgattgctttctgattaaagttattccaaacagattaaatgccagaaatttttccccagaattttttggtggtcagcggaggaacagtctctgaactggaaagaggccagcattttattgtttgctgccatcttgagaacgtaatgggatctagcctttgcattaagctgttactgtcaaaggttagagttgggagaaaacttgaatgctgagaaatactgttgaggctctaacatttttttggagtccaccctacgtttgaacttttctgttgggtaagccaaacatttctgtttgtttcttatgccagtttcatgtagctttcctgctgcttgaaaatgaatacctaatcacaatggcattgatagcagttattatttaagtaatttctggtcaaaaggcattgtgctaaatggttcattgggaggcagatactttgattacctccatttcatagctaaggaaacagatttggagaggttaaatggcttacttaagatcacacatttaaaagacatcagagttgcaattcgaactgcatctttctaatgataaatttcatacatttgaaccttccaccatggatgagacaatgggcttaaactttgatgtcacactatctagctgtgtggtcttgggcgagttacttaacttcagtagttcttaatttccttaaccataaattggggacaataatagtccctagctgatataagaattaagggagctaacatgtataaaaattacctgtataatagaaaattacctatataataattattagacaataaatattagatcgtcataattactaggcttgcatttattcattttcagattaggttttctaaccaacagaatacagattcttcaggcacatcaccactacctccaaacagacctaaataaacatagtaacatggggttttcatttttatagagctcaggcttaaatggttgcaatatttctggtgttctctccctatcccacatgtatttgactttattgatattttttctcgacaaatatttattaagagcttagcttgtgttgaggtgtattggagatgggaaacagagtagcaaacataaagcagataaggtttttaccttcttgggacttaacagtcctgtgggctggaggaagagacagattattaaataggtaagctcatatgcacacaaatatatttctgacagaagtgctaccaaagtaaggaatagtgtgagagcatataaatggaggctcaaatctagtccaggaaataaggatcccctgaagatgtgatttttatctttcccctaaacgcttttctagattttttttaatccagaaaagggtttaggagaaggacaacagcattcacatcagccctgagacaggaaataactttgtgctcttaggaaactcttaacatcttcttgtagttataatagagtgaggtatggaatttatatggttagtgaagtggctggagaggttgacgaaaacaagattatactacattttgttggccatcttatagattttgggatacgtcccaagattcttaagtaaggccatggtatggtttcattttgtttaagaagtcactgactattttgtgaagaattgattggacaggcatacaggcagatttgcaaagaacaattgagagaagagtttattagtcttgaagagtaaaaatacctgtaggtgattcgaaccaaggtcatggtagactgataaaggaaggtagctgaatcaacaattatttaagaatttgaattaatgaaatttggtaatgaactaaatatagttagttgatggactagatgttatagtattccatgcacatcccttccactgaagcagctactatttagttgtttgcttggctcacaatttctcctttctgcagagaaacacaagaaatttcttagaagtgatataccactctacattcttcatacctatactcccagacaataatgaaatcgccaaaggactgccccccttcaaagagaatattttctatatccaaatccctgtatcagcctctggttctagggaacaaacaaacaaaaaaaagatagttgagcacttggcaaaggacaaaaagatttccaggatgattctcaatctttttatcaaagcaacttttactctcactgtgggtggaactggccaagacgtgagttcagtttgggaggcactgggtttgagacctataagaacaaaccaagtagagatgtcaagttgtcacttagctatatagggctctggatttcagaaaggactggaaataaaattagagtgtattgatatcataaaaagtaaaggcagcgtgggaatgggagagagagtagtgtgagagaacggtcaagactcctcttgaagatatgtaattggcagtgagccatttgctaacacaattctctctaattcctctctaagggcccttttatgttgagtgtgggaactttacccttttggtttgtttgggtgtggaggctatttctgaaataatatcaagtactttcacagctttcagttctttgtactatgtatcggaaaaaagatgtgtgaaagcttttttccccacctctgcagcccatcagctttatctatggttgactctaaaggcaaaaccattatggatcatttttaaaccattcatagtttgcttctgaagagcttcaggacacattatcccaaatatggcaccttggcatttgagaaaacagtagaagcaagaaggctactcttagctttgctgtgcttttttcctgtgaggcaggtcacaaaacctaggaaggtaattttctgacctttcctcactctgctcccccagagcaggtcacaggatcctcatttgagaaatgcgctccctttatctggaggaaaggagccaaagacacagagatgccgtgagaaattccaacaaacagatcttactaagttgtcccagtttattatcattagatcataccattttgttccatgactgctcacttttaatcaaatttaagcataaaaacaagtttacctatttctttggtgtttctttccttacgaagtttctcacatcatgtaaaacttgtatgaaataaatgtatctacttttctcttgttaatctgtcttctgttataggagcctcaggcacaaacctagaaattgcaaggaaaataaatctttcttcccttatacctcttcttaattttacttttattttagttttagaattgggatcttgctctgtctcctaggctggacagcagtagtatgatcatagctcactgtggcctcgaacttctgggttgaagcttccctcccacctcagcctcctgagtagctaggactacaggtatgagccaccattcctggctattggttttttaacttttgtagagacagggtctctctattttgcccaggctggccttgaactcccggcctcaagcaattgttccaccttggcctcccaaagtgctaggattacagctatgaaggactgtactctgcctcacctataactctttatagtcaaaacggattactcctctcatcatctctaaattgaataggatctatagaatctaaccttatttccagccaatgaatggaaagacaacgtgttatatcctaccagcctactttcccttcctctgttgccatcttgtcacaaaaacgtcttcacatgtgtttgagaccatcacttgacaaaattttttctttgatgctgtttatgtgcttccattttcctctcatgcaattttaatttcagaattcagagtttcctaaaccagcggctcagctgtttctgctgcaggaaaggttgtgggcaaaaggatgtttgttttgttctttaatctggagttttctcttctatgatggatacagtaaaggagcagggaaaaagattttcctcctgaaagaaaggagtaggatagctcttcacttgggcaaaaggatagcggtcaagctaattatttatattaagctacttatacctattgtggtactaaagtataactttgtatgaattccaataacttgtaagcctaattatacggtataaaatataaaaatgctatgatagattttaaaaagaaaatggagtaacccaagaatgtgatgcaaattatgtttatatataattttgagattctcagctcctacagctttccaatattacataccacttacgtgggcatagagttcagtttttacagggtgatttgtagcctatccataacaatgagaagctatttggccatgtataataaagattgttatgcaaaactgttcctttggcatggtacatttttttatttaaagaaacaattcaaattccctgtaggtaaggaaataaaagaacaaaaggttatatgttgtacaggtaggaatgaaaaggagaaaaattgagggatttcttattcttttatgtaattacaggatttgagactgatgttatttgttgccttctgttttcctccatttaattatagaaaggcctaccttctctagacagtacatttccttgggagaaggcgacccagtgatattcacagggttatcccccttgaaaccaatacaatagctggtgtgtagaaagaaaaatgtaagtatgacttagaaaaaaaggaagaaaaacagaatgaaagaaaataagaagccaagaaagaagaaaagagtaaagagaggaactgagaaagagggaaaagcagaggaaatttttgaaagggagtgtgggggcaatcatagaaagagggacagaagacaacaacggacaagaaactgaaaacatatagggaaagaaagggtccttcgtggatttgtcatttcacagatttacaactggaatccaccttttatcaaaatacgtgtgttgagagacatggcattgcatttcttactacatactgtgctaaaccctaggtgacctcttatttttggtaataaaagttataatttcagcaaataggttttatccattaactccatagcctccttgatataacctgagattaagttaaatttaaagtccaagtgagctcaaaggtgtaggtgaaggttgttgctattaggtctaactgaataatagctctctgcaaaatcccagccacataaaagcactgctctggcagtcatagcaaccttgccagctttggatgtgattgctgacagagagttcactgatttttccatggagaatcctgaagcttgctgttcgggttgacatttttacaactgtgtagttgaaaagggagatttgcagtcatgccccctcccttccttctttcttttcttcctttcactcattgtctcatcctcatcctctttctttctttcattgattacaaccatttcattagaaaatgttcaggccacagtttgaggatataaggattagagctttgccatgacagtttctaaaactataacttctcaaatattttatacattcatgtgcaaaatgtgaagccctgggggagagtgcagtgagctacgatctatggtttacaagtgctgtcgttgggagaagttacacaggactcttcacataactcagcaggtgatttattcctatttagggatttcgggctgcactataggcacataaattgaaacaagctgacaaatggcttctatgcttcagtgctgatatctcgaaaggcattgcacatgctccaggtatagaatcctttggagcagggatctctgagagctatgtgaggcagtaataggctgaatggtctgacagctacctggtaaccttggtctggcacctggggtgtttctgaactgagttttctcatctgtaaaatataaggaatagccaggatttcatgcgtcttgtccgagatggctgctgaacattgatatcaacagagtctcctgagcttacagtacttaagatagtttgtcccaagctaagactaaccataggtcagcaaactgctcatcacagaggagtctgtggtgtttcagttactagttataatatactcagctaagaatggcttttcagaattcagctcaaattaccaaaaaaattgtttacataaaattgtacctttaccttctgtgccctctgaatttctaaccaaacaggttttcattcagcagatatttagtgaatgcctaatgtgtgctgggctaggaatccttctgggaatttccttacatcattaaaattctttgtaaatatggttttggatggcaatttatccgtgaagaatactaccatgaacacgttggaaacaaaatcttatcctcaaggagtttacatcctagaagggatgactgtcaattttaaagaaagaaaagccagcttggtaaatctagagtatgctgaacagtgctaaatactaagaaaaaaataaatctggggaaggctccctgcactccctttgcacagagactttaagaaagtatacagcatggcccctggactgaaggtgctcaggttagtaagggagtgtcatgcaggtcaacacatgtcgcacatggaccacaaatgcctgccaccagcaggatgcacggggacttctgggaggggagtggacaggatacttatctgtgactggaatgtaggtgagaggtggagaagagagtgaaggataacttatagagggggcagcatttgttttgggtcttgaaagaggtagaaaattcttccagatggccaaactgacaacggtgaatgcgttacaggggtagacaagagtcccatcaatataatcatgagctgaattcagccagaagttgtgaattcatttaggcaaggataagccagtaaactgaagaaaggagctgacctgggtttgattggcatatgagagaggaggcaaaggaccatggaaggcaggctcagatcacacctgctcctcttctctgtgaaatagcacacttgatttggctggaaccttggatgatagagtaactggctcagatttgtatttttgaaatgtcacttgataaataaatgtcacttgaagaggagtaatctgggggggcaggactgtaggtggggagaccatttgttcagtgcagaataggcattcagcaaaagtttgagagttgtttttttactcttaattgttggcttccctaatcttcattacttacaatgtgcccacatggttcaaatgacttgctaactactcacagaaggagctgacatctatcaaattaataatgctttattcaatagtgctgattgcaatcaaaagagtgatatttaaaatattactaattgtttgtattttgttgagtggggagagaagagatccttcaatgagtttcatcctacactaaataaaaaaataataagctgataagctgccatccaaaactatatttacgaagaattttaatgatgtaaaaaaattcctacagcattggaaataaaacgaaaaaattgcatgtataatctgagttctattttatgtgcatatgcatgtgtatatatgtttattttatacatattaataaaatatgacaaatttaatcattgctgtcttcagctatttggatgaatgggttgtttttgcttttatactcatcttttttgttgacaaaagtatgttctaaacattctatcagtaaaactattaatttgaaaaaataaaatataggaagtttcatgtatttaattctcctcaatcatgaaattgttttcatatcccagcatttcataatgcttcttaagttatgggtatagaaaatgattaacttgtcaaaatgtcaaaagggcacttttatccattataaaataaagcaggatgactcaaattaagatttatatgtatatatattgttattcattaagtatgtctgtgtgaaggtgacagcaatccatttccaaaaatggtttatgtaatttgaaagataaaaggtgcaactggtgggtggatctagagatgcaaagaaaacacaactttaggaatctaactcaggagacaatattcttatcttgtttcttcttattctatttttctatttctctttccagtttgtatttttcttcatgttagcattattctttcttatgacagatgtatattctttccataatacaggcttagcaatcccagtaggcaaaccaaaagaaaaccagacaaagtgacataaaatctcccaggattatatatcaatccaagggatgccattgtttgggttatatacccttcattgtgccaagcagtgttgctggggtagtgggatagagggcagcgattatccaggcctactctaagaattggacagggaaagacactgtaattgaaagctatgtactaaatgattaagtagtagtcctgccatccattctctccttttattgggggctgcccttggaagagataggacacatagcttatgaacatatctaaatgaaaatagtgaagttccatgaacaaatcaactactcttctgtacgttatttgaattcataccatgtttcaaaacctcctatgttaatctgggcctggagtaaatcctgatgtggtaagaacagatttgaagaatggtgtttgaggttctagatttttccatccttttattgcatctcatgattacttctattctgacactttaatagcagttgatactgagtaaaatctctgtttttttctagtgttatatgacaatccaatccttcgtgttaagccctgccagaaacatgtgcaatggtggttggatagttccctaaagaaaaaagtggatttacacaatttaattatttttgtaaaaattttctgaataccagtcatatactgaagaacttatagaacaggaagtataatttaattaattaagatcaattttttatcaaggcaaagtgacagatattatcataaataatagagatgcaaatatgtttcttaagaagaactttcatccccagttttctagaaaaatccttttcatattttaaactgtccaaatttctggattggatttctttgaaatgcaaggtaaacttcttcaaaattcaatctagtaaaagacaaaacaactttttttaggtttacttgcactctttcctccaacaggacttggacaatgggaatttttacataaataaaccaaacaataaatatgtatttcacaaaaggcaattggttgggtattttagaacttctggtgagagtcaacagaagacagaaatcaggagctacataattagtacattatagtctcaattattcatacacgttttagaataaccttcctctataattataaacttgatttatcctgcttgaaaaagtagtgctctagaaactggggtatgtatgcataggataatatgagaattggtcatgaggatttcttcccttagccaaatcagatacccaattccatctggcttctgtctttagattggcttgaaggaaaccttgctaatcatatttatttttagagatcaatcagagaataatcagattatagccccaaatatattatcttcttcagtaataatattaaaagtctgcttcattcctaaatctattacatatttttaacacttaattgggtttatactcacatgcataatgtaatagtcactaattgttttactgcatgttgtcctacacctacactatagaattctatagtttcaacttgtcacaattgtaggtattcacattttaatttttggaagctctcacctcacagtactgatatagattgactgtgtctccattcaaacctcatcttgaactgtaactccacaattcccacgtgtcatgggaggaactaggtgggaggtgattgaattacaggggcgggtctttcctgggctgttctcacgttagtgaatgagtctcatgatatctgatagctttaaaaatggcagtttttgtgcataagctctctgttcatctgctgtcatttacataagatgtgacttgctcttctttgcctttcaccttctgccattattgtgaggacttcccagccatgtggaactgtaagtccacatcttttgtaaattgcccagtctttggcatgtcttaacagcagagtgaaaggaaactaatacagtgaattgataccaggagtggggttcttctatacccaaaaatttggaaacaactttggaactgggtaacaggcagaggttggaacagtttggaaagctcagaagaagtcagaaaaatgtgtgaaagtttggaattccctaaagcttgttgaatgcctttgaccaaaatgctgataatgatatggacaatgaaatccaggctgatgtggtctcactgggagatagggaaattgggaaatggaacaaaagtgacttttgttatgttttagcaaagagactggtggcattttgaccctgtcctagggtgcaagccccaagccttggcagcttccatgtggtttgagactgtgggtgcagagaagtcaagaattgaggtttgagaatctcagcctagatttcagaggatgtatggaaatgcctggatgtctaggcagaagtttgaagcaggggcagagccctcaaggagaacttctgctagggcagttcaaaagggaaatgtgggattggagcccccacacagagttcctactgaggcaccacctaggaaagctgtgagaagcagaccaccatcttccagaacccagaatggtaattccactgacaacttgcaccatgcacctggaaaagctgcggacactcagcaccagcccatgaaagcagctgggatagtggctgtaccctgcaaagccacgggggcagagctgcctaagaccatgggaacccgcctgttgcatcaacatgacctgaatgtgagacatgaagtcaaaggagatcattttggagctttaatatttaactgccccgctggattttggacttgaatggcacttgtagcctctttgtgttggccaaattctcccatttggaatggctatatttacccaattcctgtacccccattgtatctaggaagtaactaacttgcttttgatattacagactcaaagccagaagggacttgccttgtctcagatgagatgttggaatgtggacttttgagttaatgctgaaatgagttaagactttggaggactactgggaaggcatgattgcttttgaaatatgaggaaatgagatttaggagtggccaggggaggaatgatatggttcagttttgtccccacccaaatctcatcttgaattgtaattcccacaattgccacatttcatgggaggaactaggccagaagtgattgaattatgggggcatggtctttcccgggctgttctcatgatagtgaatgagtcttatgatatccgattgttttaaaaacaataattttctgcacaagctctctctttgcctgctgccatccacataagatgtgacttactcctccttgcctttcaccttccaccattattgtgaggcatccccagccatgtggaactgcaagtccaataaatctctgttttttggtaaattgcccagtcttaggcatgtctttatcagcagtgtgaaaatggactaatacaaatacagttagatttcttcttggtatgtttatcttcattctctacaatttctatccatccttcttgtagcatggtactcggagatgaactatgttttagtcaaagataggatactagtctttcactttcttttagttttctaacccccactgggcagttgccctcattttcaaaatagaaataactctcttgcatgtgtgttttggccaataatatatctaaaatgcttgtatgcctagcatatgatagacatttagtaaatgctagtttctatttgaatactctcactcccactctctacattctcatagttccttctttagctttttccttttcctttctcattttaatgcctctaagttgttatagatactagtaatatgttaccttttgcaactagcttatattaatttggatgttatatcatattttattttgttatagaatctaccaattgatatagcatggaatttgaacttctggtgcatttatccaggttcgatctgtctattttatgaaagcctccaaatcacttcccacttaagcataaaaattattagcttgaaatggctataagatgctgaacaatctggttcctgtaatgattttatgacctctatttcacctacccttcctcttgttcagtcaccttcattcaggctgggttcttccttgttgatccttcaacaaacaagcatgctcctgactcaggacttttgcacttgctctccccactgcctgaaatgctaacactttggatttccccatagccaatgctcatcttctttaagtacgttctcaagttgcacctactcagaaaggcccatgtgtatcttactatttaagctgaaccttgccccagcctatccacttactcttatcttttggaatttgttcttgcatgcagcataaataatttgcttattttatttgttacttctaaataatattcatttatcataattattgttcttggagcttaaaccacatgggggcagggtgttatatctattttgaacattgatgaatctctgctatttgacttatagcaggcactcaacaaaaatattttgaatgcatgagtaaatttgcccaaattaggctcattcttataattttcataacagttttgtaggaatcagcaaactatttctcagaagaggtagatagcaaatattgtaggcttcatggaccatacagcctctagcacaagtcctcaactccactgttgtagcacaatagcaactgtacacaatacaaaaatgaatgggagtaactgggttcacttaaagaaataggcagtgggctggatttcatctgcaggtcagagtagttgcaaactactgatccagtagttttacttattcttgcatgaaattattttggaaggaaggaaggaaggaaagaaggaaagaagggagaaaagaaggacagaaacaaagaaggaaggaagggagaaagaaaggaaggaaggaaggaagaaaggaaagaaggaaggaaagaaggaaggaagggagaaaggaaagaaaggaaggaaggaagaaaggaaagaaggaaggaaagaaggaaggaagggagaaaggaaacaaggaaggaagggaggaaagaaggaaggaaggaagaaaggaaggaaggggcacatttttgccacatcctatgagaggcttgcacttttaccagttagctcataattttttaccaaaattatagttttaaaggaaactacaggccaacaccccagatgaacatagatgcaggaatcctcaacagaatactagcaaactgaatctaacagcacaccaaaaagataattcactacaattaagggggctttattcctgaaatgcaaggatggttcaacataggcaaatcaaaaaatgtgagtcaccgtatagaattaaaagcaaaaagctatatgcttatctcagtagatggagaaaaagcatttgataaaatctaatattacttaatgataaaaaccctcaacaaacctggctttgaaggaatacacctcaaaataataagagctatcaatgacaaacccacagccaagatcatatactgaatgggcaaaagttggaagcattcccctaatgagtggaacaagagaaggttgttcattctcatcactcctattcagcatagtactggaagtcctcaccacagaaatcagacgggacaatgaaccaaaagacatccaaataagaaaagaagaagtcaaattatgtgtctcttttcagatggtatgatactagacatagagcactcaagattctgacaaaatgcttttagacctgaggacaaacaacttcagcaaagtttaaggatacaaaatcaatgcacaaaaattagtagcatttccatacaccaataacattcaagctgagaaccaatttaagactgtaattacatttacaacagacacaaaaataataaaatacctaaaagtacatctaaccaaggaggtgaaagttatcttcgaagacaattacaaaacacttctgaaggaaatcatacatgacacaagtaagcagaaaatcatttcatgctcattgtttggaagaatcaaggtcattaaaatgtccatactgtccaaaggaatctccaaatttaacgctattcctttcaaattatcaatgtcattttttaacagaattagaataaaaatattattctacaattcacatggattcaggaaagagcctgatatggtttgactgtgtctccactaaaatctcatctagaattgtaatcccaataatctccacatgttgaggaagggacctggtaggaaatgactggatcatgcagtgttttctcccatgctgttctcatgatagtgaacaagttttcgtgagatctggtggttttataaagggctcttcccccttagctcccactctctttcctgccaccttgtgaagaaggtacttgcttctcctttgccttccaccatgattgtaagtttcctgaggcttccccagccatgcagaactgtaagtcaattaaacctcttgcctttatacattacccagtctccggtatttctttatagcagtgtgagaatgaactaatgcagagcctgaatagccaaagcagtcctaagcaaaaagaacaaagtcggaggcatcactttacctgacttcaaactatactacaaggcaaaatatagtactggtacaaaaatagacacatagaccaatgcaacaaaatagagaacccagaaataaagctgccaacatacagccatctgatcttcaacaaagttgacaaaactaagcaatggtgaaaggaatccccatagaataaataatgctggaataactggctagccatatgcagaagattgaaagtgaaacctttccttataccagatacaaaaatcaaattaagatagataaaatacttgaatataaaccccaaactatacaatccctggaacacaacctaggcaacaccattctggccattgaccttgagaaataatatatgactaagtcctcaaaagcaattgcaacagaagccaaaatggacaaatggcaccgtattcaactaaacagcttctgcacagcaaacaaaactgtcaacagagtaaacagacaacctacagaaagggagaaaatacataaactatgcatccaatgaaggactaatgctcagaatctataagaaacttagacaaatccacaagaaaaatcaaataaccacattaaaaactgggcaaagaagataaacagacacttttcaaaaaaagacacagaagtggctaacaaacattatgaaaaaaattctcatcatcactaatcatgagaaaaatgcaaatcaaaaccacaacgagatatcatctcataccagtcagaatggctattactaaaaagaaaacaaaaaaacagaaaacagatgttgatgaggttgtagagaaaaggaaacactcatacactgttgatgggaatgtaaattaatttagccctaatggaaagcagtttggtgatttctcaaatacctaaaaatggaattaccattcgactcagcaatcccattgctaagtatatacccaaatgaaaataaatcatcgtaccacaaagacacctgcactcgtatgtttattgcagcactattcacaatagcaaagccaaggaatcaacctaagtgtctatcaatggtggactggatgaagaaaatgtgctacatattataccatggaatgtcatgcagccataaaaagaacaaaattatgtcctttgcagcaacatagatgcagctggaaaccataatcttaagttaattaatgaagtaacagaaaaccaaatatcgcatgttcccatttatgagtggaaggaaaactgtaggtacaaaaacataaagttgggaacaatagatacagggactccaaaaagagggaatgaaggggaacaagggttaaaaaaaaacctaccttttgagtactgtgttcacttttgggtgatgggatcaacagaagcccaaatctcagcatcatgcaatatactcaagtaacaaacctgcacaagtacctcctgaatgtaaaaattttaaaaaactgtaattgttttaactgcaatttacttaacgtatatttaaattttcttaagaattttttcaaatgactttctaaaaatactttaaatataatttataggcaattatgtttcctaaatttgtttaattttaggacgactttttttcttttctcccctttaattctataaagccaccacagtgaaaacaaagatttttctagcatttaaattagtactggcatgtagcaggtgttcaataaatacttgttaaatgactaaatactttgtcgattgataatgcatatattagtgccttcaattagagatgaagaaatgagacacttgaagtaaaaatgaagtggtgaagaccatacagctaattactataatttccagagtcttagtccttaaatcccccgactgtattacactgattccctctcttgaatgtaatatgcatcaaaggcagatatatgaagaaaagatggaaggtaagaggaagacagagctacatatcctttttcataggccagacataatgtgaggagtgaaggggaaaaaggggctcactctcctgagcagaggaaaggttgtatcaggggaagcttgcgtacttttatccctcacacctaattttatcctctgcaatgcatgttgcttcatatgctaaatagaatgacgcacgttgacaactgagaccaagaaagaggacaaaacttaaaggctataaatctatattttgaatataaaagagtctacatgaaaccgaaggaatgctaggataaaacagatgccatgaaaaacgtgatgtacattatactggtagatttttaaaaaatgataacatattttcaatgcagttttcaaaaggaaagattgcatggagtaaattttcttttcactaggtaattagatatgcatctgtttggtatcactaaaatatatattttaaatataaagtctccaccacgcattgctggaggtggcaacatagagtggtggttgagaacctggcttaagagtcagaagtgcataggtccacaatttatgagttcacagatcttgggggtaaaaaaacaaaaacaaaaacacactccaagttggtattttcaatcataaaattggcataataatagaatctgttctataagactgctataaagattacatgacttaatacatttaatgagtttaatacactacgtggtacagtgtaagttcttactaaacattagatatccacatttggaacatcaaatataaacttaaatgctgaaatagcaagttaaccacaataaaactcataaatggattgttgacctttaaaacacttttattgtcacatgcagagaacaaggagtaaagaagaattggtagggatggaattatgagccaggaattcaagttagtgtagaaataaaataatttatagtgccaccgtgtttgtattctcttgatttatcatttattgagcatgagaaatgatttcattttggcctccataactcatgatttcaatattcttttcaggcatttgacactacaagttgtttaatagaataaaaatatagaccttgctcagggaacatgatctaaatttcaaagtaaagaagatgttttaaaaagttagttggtgagagtatagacagaaaatttaacagtgcatatcacacaatctcataaaatacctctgagtcagagaaaattcaagcaggtgtgaaaccctgatataaagcatttgcaattccaatttttagatgttctaccagagaaatgaaatcctccatggacacagtggctatagtggatgtctcctattattccctggaatatctagaacagaagagtccgtttactcaaactcctttattaatacttaacatgagtcactcactctgctacccagagagggccataaagactgggacagagtccttaatgtctagctgaacacacccaggtaggaaaaatatatcctcattcttattagatttctcttctcatgttcaaaatctatgatcaaattttcctaggctttttgtgttgctcagtacccatgaatgaatcatgttctctcttgcttttgagtctttgtttatgttttggctttgtctggtatataccccctccatcatcactgttctcattttcctggtgaactctgcttagtttgactctgcttaaacgttattccttcatgtaagcctttccttaccatatcccacattatttcagctgctattgaagagtccatatttcctctaaaacaatgtttatcacatttccttggataattatacattaacttttcccttgctgctggctattgtgccctacgagacaagaaccacgcatgctgcggtttagcgtaagagaatggattcagtaactatctgttgaatgaatgaaaaaattaatgcccttgcaatttaggttaaatgccgagagacttctatggtaaaataatttctttttggggaaaactaggaagtttatattgagtagtgaccttttaatatgagtgttttaggcatggatgggagtttctcaatttgggtaaaggagaagggcatttatgggaagaaagaaagcatttgtaaaaacaaaactgtgtgaccagtttcacttggaaaggtccctgtaagaataaaagtctgtgaaaggcattgtaaggggcttaatagaatatacaaaggcattgggatcaagatggatgaagtaatacagtatcacagaatttcaatgtcagttagtgggtgtatcagagacttaaaaacatttaagttaaataaatttgggtaagttttattactgcacaatttctcagagccttttgctataccaatgtgctataccaatgtactataccaatacactctgctatgaagttatagtatgtagaaagtattttaaatatgtttgcttatagagcactctttcctggagcatcatgaatgattgatgtacgtagaacaaatgttagaagtcaatagtatacgtcagtggttttcaaccagggtggttttaccctgagaggatatttggcaatggctggagatattttgggttattacaactgtgcaggtcaggaatttttattcattactagtgagtagaggccaggaatataattaacatcctccaatacataagagacagcttctacaacaaataattatctgccccaaactatcaatagtggcaaacctgagaagccctactgtagtgtaaagagcaacagctgtggatacagatggggcttaaagtctccagtttgccaattcataactgttagatcttaaacaaattttttaatatctagaacacagattcttcatgggaaaatagaaataaaattacttaatttggagaataaagttattttttcaaagacaatatatacacaattgtataataaaatatcttccagagaacagtcatttaataaattaaaactgtcaaagctagatggtgtaggttgttttgtttgtttgattttcctctatacccaggaaatgtaatgtttctgcttctaatataaaagcagagttgtctactgcaaaagcggctactctgtaaatacatcagtggtatgttccccaggcaggttcaaactgaggactctatgccatgaactacaattagaatcctgagactaagtagattatccaaactgggccataagcacctctctcaaggattccaaacctggcataatgatactctttagcttttgtcaaaagactgtgataaagtggttctagttatgactaaagctcttttgcagtaagacagtttgaagttggtattaagaggaaagcaaattaattcactatatccagtcatcattgaagccacttcccccaggtcgtttgaggtaagtagaaacatttcaacctctattttactttagctagctcattgagtttctgtcacttgcaaccaaaagagctctacagacacaggtaaagatatttttttccgtagaaaatggaaagctctcatactttttaacacatgctacaaaacagttctcctaggtaacttgcttggtcttgtcataaaatagatttttccatggaaaacatattttaatgtttcacagaaaacagaacaaattttattattgaattaaaacattaggatttctcaaaccccaaattaatttttggattttattttatgtatattaactcttgaagactagttgctctgaactagtagtaatcagtatcttgtattctgcattgtacttttaaaatttggtttttaattttagtcatatctggctatttgtacttgggtaacctgtactaaattttccaaaaaatatttttaaaaggcaaaggatatcaattattatagttattatataatctaaaatcactaaagaatctccagctgcatttagcagttttattcattcattaagtacttgtttatgaagcacctactctgtcatttactgttgtgaaaagctgatatgtttatattaacagtggtgatatataataatcaagacaaaacctttgtagtttgtgctataaggtaaatagataagagattgtgatataaatatgcaggtggtcagggacagcttctctgaagaaaaattaagctgctatctaaaaacaaagaaaaagctacacaagtaagattgttggaagagcattccaggaaattggaatacttagtactaatgtcctcagggaattagattattgcagtggagaaatagaacgaaggatacgatggctttaaagagaataaaagatctggaaaaaaataaatagatcaatattaaaagctgtgaaattctggcctctgatttgtgcttatagaagtgtgtaaaacaaacaaaaaaggaatcaacagatacatgaggtaaacagggcctagaattccataacataatattaacatattcaagaaacaagtcaaaagaacatgaaaaataacaatgaaaatcttatttcataataaaacacacaattagcatataccaattaattctgagatggtacaggtgttgaaattatctgacaaagactataaacagccattacaatgatgctttaggaagaagggtaaacactcttgaaataaagacacagcaagttcaagcagaaaatataaagaatagctaaatggaaattttagaactaaaaacaatagtgtgaccttcatagaataatggaatttatgcaggaaaaaattcaatgaaactgaagatatgtaataaaattactcagtcagaacaataacaacaaaaaagatcaggggaaaatgaacatatcaagccttacgaacctttaggtcaataccaaaagtttaacatttgtgttattgtagtaccagaagaaagattatgatatggaaaaaaaagctaaacaaataatgactgaaaacttccaaaatttggtgaaagtgataaacttacaaatttaagaagctcagtgaatcaaaaataggataaaagcaaataagtctatgctgagttatatcccaatcaaaccgctgaaaactaaagagagtaaattgtagagtaaccggagttactaacatgagtcagtctctctgcgacccacagagacagacatgaagactaggatacaatccttaatgtctcgatgaacatacctgggggtaaattatgtcccaatccttaccagatttcttttctcatgccccaaatctatgatcaattctttctagacttgaataattatataaatagatagggaaataattatataaatagttattgataatataataatcaataactaaaataatactgtaattaattatacaaatacctaaaataattatataaatagtaaaacactcaataaaaattcagtaaaattataaaaatatacaaatagtttaaaagaataaaagagcaaggaatgaacagaaaaaaatgaataaagataaaacaataaaatggcagacctaacaaacacatcaacaatcatattaaatataaatggtgtaatcacaataattaaaaagaaaaagggaatgtcaaactctatttttaaaattggtaaacgggattttatcaaagctcaaaatttatgctctgagaaatgcaggagtaggagaaggaaaaggcaagccaaagtgtggaaaaaatattttcaaatcacacaccttaaaaagaacttttgtgaagaatatataaagaattctaaaaactcaacagtaagaaacaaacagtccaacaggaaaaaatagacaaaatattagaaaagacaactcattgaaggagatatacagatggttaataggcatatttaaagatgtctaatcttctttgtcattaggataatgcaaactaaaactataatgacatactactgttatacatgtagtaggatgaaacaacaacaatcacctcctgacttgctggtaagaatttccagcaattgcaaccctcatgcattgcaggtgggaatgcaaaatgataagagttactctgaaaaccatttggaagttttttttaaagttaaatatacattcaccatatgaatttgtgatctcactgtcagatatttacccctgaggaaaaacatatatatatatgtgtgtgtatatatatatatacacagacacacacatattcaaagaaaaaatatatatattcaaagaaaacttgtacatgatgtttatagcagttatatttaaaatcataaacattgaaaacagtccaaataccctttctgactgaatggataaaacaaactagtattttttataatagaatactacttataaaaaaaagaataaataaactataggtacttgcgtcacccttatgaataaaaggaggtactatggtgagtaaaataagccattctcaaaagtttgcataatgtatgattccgttatatggcattctgggaatggtaaaatataggaacaaagaacagattagtactttgcctaatctagggacaagttgatacaataataggcatggggcagagtttaaccacaaaaagtggtacttggtgaggtgatggaactgccatatctcccaattatacccaaataaaaaaggggaaaattcacaataagataattcatagaaaactaaattagaaatggctgatatatgatcaatgtttcatctcactatcaattaaatataaatttaaaaggtatatttgccaaaacaatgacggatagaaatgtatatgtgcaagtacttgtgtacacatgtgtgtgctgggggggtctatgtacttacatggggacatggacactggaatgtggaaaaagagacattcatatattcatataactgtcagcaggaattttacattggtacaatattccttaaagtttttcaaaaatttgtagaactctacctctagaaataaaataagaaaataatcatggatatagacaaaaatgtagcgatgaggtttttaattgcaaaattaattttaacattgtttaattccatgaaatttaactaagaataggggtttcattaagtaataataatataagaagcccttgaaataatgccaaaaatcattacttaagtgaaaataatcacaatagattgattttaaaaaaaagttacagaataaaaggatggcttgaaaattttgggaattaatatttatatttctttaatatgcactactcaaaacatgaaaatttatgtgtgtgatgcgacatattctccattctctcccacagatgcactctgcactccctcttccctgccctgggacagcatcgatcaactctctggcactccagctctcaactggtttggccaatatagggtggccaaagaagcaaagaagcaattaaaatgtttattcctcaattctctctctactgtctctgatttgataacacttacacgccttgacaaaagaccgtaactcctatcaagtggctaaaccttaaagcgatagttttgacagacttcccgtcactacggcctcctgttcagacccaggagctgtgatagcttcacactggttcaatcctaggggttttcaatatcccttgtcattgtgtctctctgcctttgtaagtagcacctttgtaaatctttctttaatcacttcatttaaattaatagctatttctagccaggatcctgaaaaatacttacagaaatgtattaccagaatatttggagtactattggactatttatttatatcatactcttatttggaacattgtgtataatattattaataaactgtagaacactatattacagtattaagtggactcatcacaaaataaaaaatacataatttaccaaaataatatttctcaaattatctgtagtgacagattagttgtgttttttaaataaatcatggatatacagttttataaaatataataaaaatgaattgcaaaaaataaagttttaaaaatatacaagtcttcatttttcatattcaaattccacagacataaaattactctgttaaattgctataaaagtttctaaacttgatttttattgtgttcatgaacctgtatcactttgcagcccatattcttggtagctctggtctaaaatatgaacacataaatcatcaaataatatggcacatatatatctgtatctacatcatctatttctttatatatctacttatatctatctaagcatgtacataattaatgatgcttgaaccgtgtcatattacataattgggtgctcaataaatatttgttgaacataaaaatgctcaaacttgaaaaaaaccaaacaattaacaaaacacaagtacacacacacacacacacacacacatatttacttatatatgtttttttatttccaaagtttcataggtaggcctctttcatatacttctgcagggctggaaaatagtcaaaacctatctgagtggttaagtgagcatactttttgacctgtatgctcatttaaccatttagataagttgtatatactgttaaacttaacagtattattcactagactagacaaaagtggaagaaattataaaaggattcagagtttgaaaggttttcataatacaatacaatacaacaaaattaaaaagaaattttaaaaaaggaaattttctttttaattttattttataccctgtatcgtgctccattatatttgttgaaaatgaaatataatattttcaagaaaaagggaaaattatatatacacacatttaatattataaaataaaattttataagcttatataattttatatatacacacatacaatgttatgaaaagataaaaaataattgtcaagtgaaatataccttacaaatatacaaagttaaatataatattttaaagaatatatctgtaagaatatgaaaaacatttatttctgttattggaattatgatttttttaaaaaatagcattttgcttatatataatctttaaatttcttcaatgaacctatattttaaatgaacacaaataaataaattataaccacctcttatgtacgtttataaaaattacaaaaataataacaaatagaaaacattaatacaaaatatatatatattcaagcagaactcattattacatgagtgcaaaagtggttagatataaaaaaaactatcaacataatcttacatcaacaaattaatgagaaaattaaatgaaaaggcatttgataaagtatagcagccacttataataaaaactctaaagaaaacaaaaatagaagaccattaaaactgacagcaaatatgattataaatgtcaaatcactaaaagcatttccagtaatatcaggaggtgggcagagatgctggatagctccattttttttaatcaacagtgttttggaggacatagtgaatgcaataagaaaataaaataacatcagagaagtagagataatacctattttggtgatgaaattagagattagtgaaaagccattaaaattaattattgacttttgtaccttggctgcatataaagtaaatacattaaaaaataaaactctagctcatctctattctggcagtagttacttagaaaaacagatgggaataaaacatctcctattcacaactacaacaacaataaaaaaaaaacctagaaaatgcttatgaatgaattttatacgaaaagtctagaagaaatggtaacagaaacactctaacatctttttgtaaaacataaataagatttaaacaaatgggaagtgatactatactactgactggaacttatttccccaaaatgtactaaaaatgtcatataactatgaaggtaactgttagagttttgttgtcgtttgttttttcattgggaagggagagataagagaatcttaaagtttataataaagaataaatatgtaaaataatatttttgctatagaacaaaggaaaatgagtacatatgttttatcagacattagaaaacacataaatttactgtagtcaaatccatatagaagttgtaaaaaataatgacacattaacggattagaataagaatacacacaaataaatttccagcatatatgaaaatgttatgaaagtagtgttattccaatttagtacataaataacagattataaattacttaactagtgtttttaaagctagctagttagctagctaggagaatataatattatacccctatcttataccatatacaataataaattccagttagttccctggcactaggttcagaatctttataaatgggaaatttaacttcaggaacttcaactttttcactcgtaaatttttatcacgaagaaattggaaatgctggccgggcgcggtggctcacgcctgtaatcccagcactttgggaggccgaggcgggtggatcatgaggtcaggagatcgagaccatcctggctaacaaggtgaaaccccgtctctactaaaaaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcaagactccgtctcaaaaaaaaaaaaaaaaaaaaaaaaaaaaaaagaaattggaaatgctgaggtgttacaatatgaatttagaaaaaattgataaaaattaatacatttgaaataaatatttaaatggctttctaaaatttcttctagaatttttctaaaatagtatgtatagtccagtgttaaggtataactttgtaatcaagacttgaaatccaaaaatctatgaaaggaaatggagatatatttgagtataaaactaattaaaaaccatttatggaagtgcaatagaaaagtcaaaaggacaaacaattgacttggaaaacttatttttaccagcaagcaatcctttataatatctacaaaatagaagaactcttgtaaacagactaaaacaggacaaacaatctaaaggaaaaataataaatgatatgaattggcaattactgaagaaaacaatctaaaatattcagaaaccatatgaaatattgctctgactcaccagtactcagaaatatgccatgtataaaagacttcactgtagtgaaataccactataagcatatgactgaaaaaaattaaaatattaaacaaacgaaacttttttaacttgcattttaagtttaggggtacacattaaggtttgttacataggtaaatgcatgtcatgggggtttctttaaatattattttgtcacctaggtattcagcctagtacccattagttactttccctgagcctctccttcctcccaccccgtatgctcatgtaggctccagtgcctattgttcctctctatgtgctcacgtgttatcatcatttagctcccacttataagtgaaaacatatagtatttggttttccatttctgcatttgtttgctaagaataataaccgccaactccttttactggaggaaacacacattgatatagctcactgtgaaataaagtaggaaaaaaaaaaacacataaaattcagaaagagatgcctagtttgacaaggtattcccaacttaagtgttgtatttcatagcaataacagcagctatatttgaagatgtaagtgtaatgatgtttattgcagtatttattaaaatataatggtgaaagacttgaaacaaattgaattcccaccagcagtaggatagttgaaaaccttatgatacatctgatccatggaatattaaagactacgcagaaataaaccaaatgatttggaaacatttccatgagatatttttaaagaattttaaagagcaaaaattaacatgcttttgtgaaaccatgacaaatttatatatatatatatatatatatatagttaatgtgaatgagtgtgtatacatgtatactcgaacataattacatgagcatagagaaagatatagagtgatttatattgagtcatgaattcagactacttggtagttaatgtgtgtaaagaggaggaaggggccaagtaaaatgaggaacaaaaagatcacactatatatcacaaacatttttttcctgtgtgtgtgtgtaattgtgtttggaacaatatttttaaacccaaataacaattactgtgaaatgtatgtagaaatggttgataatactctgcttttcaattctctgagtatcctcttttcttcattttgtacaactttattaatgaagtcaccttcatcacatgtttgaaatatgtgacagtgtaaattaaagtgagaaattaaaggtcaagctgcataaagatgtcataatccgtagtcaatcatgagcatcaattggcaatgagggaagattctattattataggacaacttttcttttcttctgcttagcattcataagaagctgttctcgccttttgatgccgagcctaaccttccattttattgaataagagtttaaagctatttgtttagttattcttatctatgtttgaataataattagattttaggagtgaagtcattttactgatttgatgtataacccatcagatggccagaggaaaatttgttagtttcctacatttgactgcaatgaagagtaaattcaagctctctctcagttacctaacacaccgaagacagattattctggccattattaagtgatcctcattactcttggatcattttgtcaactccaggaattgcaattaattttatacatggcccaccttatttaaagtactcactatcccaggaaattgcttggacatagttgtaatcagaagttctcattgctccaggtgttttcatttgaggagagaccaagtttgtccctgcttgatagacctatattttaatgtgagttattggtctaaatatgacaatacagaaatcccttaagccacacaacaatttcattttccaaaccaagataaaatttttttgcaacctggcttgcaaattccagagaaagagaataaggaagaacaatttttttttgttgtttttccttagtacaagctattataaatgccttttcagtgaaagaagactaatagagaaacaaaaaataacataaaaactaaaagcctattcaagatttttagcaagaagcctaattggtaatattaaacaaatcaaaacaagtagatataattaatttacatatttgtccttatgaatatttttaaagattaaaatttatggctaattttattctaagaatatgaattgcacatttaaattaagcattataaaatgctaatttctttatttttaagtgccaaaagtttaacacatgtgataaatgaaattcaaactattatttaaaatgcttttacttacattatgaaattaaggtaagatgtagtaatattagaaaatgcagaactcaacagaatttacaaacaaaagtataatcaagataattttattttttcagttaataggtgttaacatctgttggatagttctcaaggctttctttcccttttgatttgcacaaataaaataaaattaaaaagtgggtataaatatgactacagaactgcctttgagttgctactctcagcacactgcctgtggggtagccctgctacaaagatatacctttgttgtgcattgtatatctcttgtttgtaaattcctcaatgacatgcttgaagatgaaatacttttctattgtatggctaactcataatacaaaaatctattacctattattaggctttcagatgctttccactttttctgtatttcacataaaactgtaatgaacatccttgcacatatgtctttcctgaaccttatgtagggggataatgacaccattggtgaagttacataaacatctatattttcatctacttattttataatccttttttaccttttgaagctttttcatgtgtaagaatgctgcttaatttattattattattattattatactttaagttttagggtacatgtgtccaaccaaattattatctaagtcctaatataacattgaataatgtacccccaactgatatgaaatgcagctgatacaaggcaggtgagccctaaagctggggcttagcccaggaaggttcttggcttcgcaggaaaggattcaagagcaagccagtggtggaagatggaagaaaacagctttatcaaggcagcagtgttacagttccatgactgcatctgtagagcagggctattccgcaggcagtgtgctgagagtagcaactcagaggcagttctgtagtcatatttatacccacttttaattacatgcaaattaaggggtaggttattctacaatttctggaaaaggagtgtcagcttctgggtcactgctatggaaaggggcagtaacttccaggtgttgccatggcaatggtaaactgatatggcaccagtggtcatgtcttaaggagagatgcttttgcctctttcctgtttcagctagtcttcaatctggtccaaagttccacctcctacttcagtagagaagccgtgagtagaggagagaaataaagctataaaagagctccaggctaggagtgaagggatgcatatccagataagtggttcttaaattttagcatgtataaaaatcacctgaagatcttcttaaaatgtagatatcttagacgtacttcctagaaattgtatttattgggtgggggtgggtaatgcttcagcggttagtttgagtagcatatttcaaacttggctatcactaaccaactatgtgactcggtaagtttcccagaagcaaaccttgaaaccagtcatcatgggcaagtattttattagggtactcccaggagactggtaagggagtcacagaagcaggaccatgaaagtaaaaaaagacagcactcgtgatttcaggcaatctcagctttatgcaggtatgatgggggtctctaggacattaattatgcctcagaggtactttcagctctagacaaggaagctggcctttcatacttccacactcgtcagccattggctaagggcagggcagaatatgtatactcccagctcttctacctctcaatctacaggcaaatggcagtgctcagaacagagttacagatccacagcaccctgggtggtacacaaagcccacttttctctgtccctcattggttaagggcccctgtttcctcaattggcttacactggttttacatatacataaagatagaagggaatgaaaacaatttatacaactgcacaatcgctcatcactctgtaaaatcctctattttaccgaaatgtactattgaatatgagaaagaacatgatcctctcatgcatggattccatattacaaacattccagtttctaataacttgccactgatgtttaccatgtcatggtctaatgaataaaatgaaagtgttatttattataccatatgtatatgtaggtaagtaatgtaggatagcatcttttggatgtcacccctcataattccagttcatatcaaaataacaattgacagtgtgtttttgaaattaagtacaaataatataacatcaaatatcccctccttaataacttaaattggacaatagagagtaaatttccagtagtttgctttctgtatccagaagccctcatagggttgctttgaggacttcttaccactcagagtaaagtatccatattgaaaaagttatttcctatgccaaaatgattcattcttactaatcaccggttgttctgattactttcagggcaacaaattgctacaataatgctatcactggagaacaatacaacactcaggaaaaggacaatgaaaacatggattccatttgtttttctcagtatcaaaatgttcaaccaaggagaataaagctaaaaagagaaaaatcacacccttgtgattgggaaagatactttgaaggagcaaaggtaaagataaatagtccatcaagtgacacctgctgagagaatccagtttgtctaattggctctggtgcagtgcagtggaacatgtgtcaactctctttggagtttatattggaaataaattataggtgggaccaggcacagtggctcattcctgtaatcccagcactttgggaggccaaggtggacagattgcttgaactcaggagtttgagaccagcctgagcaacatgacaaaagcctaattttacaaactacaaaaaaattagctgggcattatggcatgtgcctgtagtcccagctacttgggagactgagacaggagcatcacttgagcccaggaaggtagaggctgcagtgagccattaatgtgccactacactcctgcctaggcaacaaagcgagaccctgtctcaaaacaatgacaaaaaattataagtgggcctcgaatgccaggataaagtggtttttttaaatgagataatagattaattgaaacattaaagatcttactcagaacagtaacatgatcataataatattttaggaatacttattagacactatcctttatgataatctgaagaacatttcaaagaaaattagaccatttggagattccagaagtaacccaggcttgacgttgtaagtatctactagtgtgatggtgagatttcaatgaaaggcataagtaactcaatgagaaataataactgaaaatacataaatatggaagaaactaagagaagggagcttcaaaactcactctgaaattgacctcagagttagaaaaaatgcagaagtatcaaagggaacagaagtatcaaaaatcacataaaaggaagaaggtatcttcaattttggtggttaaaatcgagtacaggattcaatttgtttagagaaatgctgttaaaatgaatcattaagacaatttgtccatgtgtctgtagcgcctatgctatcatttcagcatatagattcacataaatgtgtataatgactacaaaggtcaatgggtaatgctaagtctaagtttccacttggaattgagataaaaccaaaaacctgaaatccagtccaaacaccagggccaattagtattgtgattttatatgttatctctcaaactttcagcgtgtcggttttcctatatgcacacaagggtgcgtgctatgttctagttactaaaattgttgtgaaggcctaattaattaatgtatttgatttttttgaaagagtataatgtgtcttttaatggtcataattatgaaacactgatacttaggaattcactataccttcctcttctcaatttgaagtagtttacaatggcatcctaagttattagtgattcaaaataatacctagatactatactttacatttacttttcatggttatgaactcaaaccagattaaattatgtcatgcctgagatattttattatgagtagtcatgacacttatattcctgttttctaatttcaaaaaatttaaatcgacttcatttttgtttagataatggaagtgaaggataatttcaaaagtctttgaagaagaaaaacaaacaaaatgaaaccaaaaataagaataacgtcttacaaaaagatgtcattatactgctgcaaaatgagttatgatgatcctgacctttttctatttcccacaatgcattataaattagcacagctggaacattctatagaaaatacaagatcatggccacatattcaattttactttggtattttaatcattgcttagaaaaatccttccccaatattcctggtcctcctgaatactaattaaatgaaaagcatctagttaggctaaatgtctgcttcaaatcttcccatgggttatgcatataaatatgaacttcttcatttgccaaaccaaatttgattgttcactctatgctgggagctatattaggtgttaagacaaaggcatttaaaagacatggtgtcatcacagcacacttggaaacttaactaaaacttttataaatttaagattaaaatgatgtatggcttactttattaaatgactttatatattttttaagaaaaatcttgtactttttaatgagtgtagcattagtgtgcacatacacatatatgcacacacaatgttttaagtaatgaaggctcactataaaatcttaataaacagagatgggtaaaaaataatagaaaaaataacttcccactcagagggattcttattattttatttcctccctgaacttttctatgttcatgaataatgtgtttaaatatatatactttggacaaaattagaatataaaccatatatactggtttagaatcagggtttccctcatctcatatatacttaaatcatttctttaacctttctcctaaagcatgatgatttcatattaagaaaaacattgtagtgttttgtttatatttttaatagtataaatttctgtcttagttttgtgttgatatgaaagaacatctgagcctgggtaatttataaagaaaagaagtttacttggctcgtggttctgcagacggtatgagaagcatggtgccagcatctgcctggcttctttgctgagtaaaaacatggtggagaagatgaaaggcaaaatgttcctaggagagcaaagccaagaggcatcctggctttataacaatccactcttgcgggaactagtccattctcttccttccttcctgccatccgcaaccaaccaagtctcttaagagggagaactcaccacgaagagcatggcaccaagccactcataaggaatccagcccaaacacctctcattaggccccacctccgacactgggaatcaagtttcaacatgagatttggaggggacaaatatttgaaccatagccgcttcaacgcataattttcccacatatttgaatatttttaataagataattattagatgttgaagtactatgtcaaaaaatatgaactctgaatgtacaataacaaatttcattcatgagagacatttctgatatatcatcccaacaacagtgaatgaaattccccattaccttatggcttcggtaacagatattttaaaactttgaaattgttgccaatttaattaaaaatgcattttcttactagtgatgtacaaatatttagtacatactttatattagggcttagggcaattgtgtatggtggcagatccaagacttggccaacacatactcttttatttaaattatctctcttgaaacttggtttatttcccctattaggtaattcaactaatacaactttttcttattgaatgatgaaagaattttacattttaattatattaatcctttattttcatctaattacaatattttcctagtttactatctttgtttttgatgcttttaatcaccaagtttttaaagtcttacataataaatgtatgaacattttatcattttctgtttggacttggtcgtagattttcacacctaacatcagataactatccacctttgtttctaattattttatgttcttgttttatgactttataaccttttagtctaagtaagagaaattcattttgttgcgtgttttaaagcagaggtcttctagatgtccccccaacccaaactaattattcaaatgagatttttatataatcaatcatttcctctctcaggtaaaaaggcatatataaaattcttagacattttcagtccctctatgagtttgtcattctatttttcatcaatactacattatattaactattgtagttaaaaagaaattatgttgccctaacaatttccctcctccatctcctgatcattctaagcccttttctaattgataaaaaatgtgatgctctttactgcatagtacacttaggttttatgaaatatagtgttgtaaattacatgatcattaaggtttttcagtccttctgcaaactaacagcaatgttgcacagtaggaaaagctgagattttgagtcacacatttttcattggccaaggattgaatcttggatctgccactatacacaattgccttaagcctaattttttcttttcaactaatagatgtggacagtcatacttctctcagataatgtttttgtgaattaagggagacacagataagatacacaaagtgcctggtacacagtatttgctttacaggttcctttgcacttctattcaacaggataaattaacttgagatacattatgacaaatttaagacagttaaaggagacattaatgataccaaaatttttacaagtgctaacctagttactattatagaacatgaagtcttctctgaattcttttttttaaaaaaagtatatttgttaatatatttgagcaagagaaatcttatgttttttagataagtatatgataactcataccaattttatcttaaactgtaatgattgtatacattcattcattcagctgatatgagttgaatgccacccaataataaatagtgcttgtaggccgggaacagtggctcacgcctgtaatcccagtactacggcaagccgaggtgggcgaatcacgaggtcaggagacagagactatcctggctaacacggtgaaaccccgtatctactaaaaatacaaaaaattagccgtgcgtggtggcaggtgcctgttgtctcagctactcgggaggctgaggcaggagaatggcgtgaacccaggaggcggagcttgcagtgagccaagatcacggccactgcactgtagcctgggcggcagagcgagactccatctcaaaaaatacaatacgatatgatacgatacgatacgatacgatacgatacgatacgatacgatacgatacgatacgatacaatacaatcattcatacatacatacatacatacatacatacatacatacatacatacatagtgcttgtaatttgtggataatgaactagcccacaaaagtaatttgacttccctaaacgtctccttagtagagagcagcagagcagaagtgagatcttgagattaagactttccaatatttcaaggcattacaatgtaactaaatggaattgaatgaaattcaacaaataaatcaggaaggttaatttttaatagtcactattgatctctccaggatactcttattctattacctgtttttactttgtaattttctccccaatccattattttccctcaatatttaattcagaaactatcacataggctgccattgttatcattattactgagcttaactttcttgtttacatacccaccatttatcccagactaggatgaatcaaaccactgtgcctctctgtttctggtcttggacagctgactgaatacattaaaaaaactcaccatcttattacagcctcataaaattaccaattttatctggattctaagctatgccagatcctcctcaatatgtccctagttggttctttatcagctccttcagtaacccttctaaatattgatttcttttctcaattctcatgtgtttcacccactcacttctcttagcacatgatctctcctccttcattaaaaaaaaaaaaaattgggtagtaactttttaaaatttcctccttttgccactggtaaaagaaaacaaactctgtgcattattccattcttccttctcatttaggttaaagaaacttcctccccaagctaaactctacccctttttaaaacttttccttcctgttgctttctaagacattgtgctattttgatcgtcttcattcgcttcatcctttttcctgtctgttttggcttaatctcttagacaaattataatgctcaaatctcatccttaaaaaaactgttccctcacatctacgttctctgctaactgtggtcccacatatcctcttcacagcttagctaattgaaagaattgtctaaaaaacatgtcctttatcttccccgtgaaataactatgcctggtataaactagctataaaaataaatacaaatagacaaaaatggcaaaatataggcttggtgatgtaggttgaagtctggatgcccccttaggatcattccactttaacatcagatattttacctttttaatacttcttaactctatctttctttctccctttctatcagtacaaccattgacattttacaggtgacaaatctgagattcagaaagaattctttcactagaggccaggagttcaagaccaagcctagccaacatggtgaaaccccatctctactaaaaatacaaaaattggctgggcatggtggcacatgcctgtagtcccaactattcagtcaggaggctgaggcaggagaatcacttggctccaggaggtggaagctgcagtgaaccaacatcacaccactgcactccagccttgtgacagagctagactcagtctcaaaaaaggaaaaggaaagaaagaaagagagaaagaaagaaagaaagaaagaaagaaagaaagaaagaaagaaagaaagaaagaaaggaaggaaggaagagttcttaatgtcctgaaagaggtgaaagaggcttatctcagatttaattccgaggcagactggctccggagtccatagtcttaacaaacacatttcacctctcacttatgttcattatttcttggacagaagaagttctagtatatgagactggtgtgcctaagtaagataaagtacatagttctaagtatatagaacgagatatatttcattctgtctgagagaaaataaaccagtcagaaatcaatccaacacctttgaaggagaaactagttggtttgaaagacaaaagctaaaaacagaatattagaaaaggttaaactatgatcacaagctggtgctgtggtccgtgttaccccaatctgttcagatatcatcctaaaactgatcctatgcctccttccgccccatgaacagtaatctggggactggtccgattcgtcttttgtcccagagaagcccatctaatgggaagtaaaatctgaccagtgatgaggatagtctaactggctctgtcctttcatcagggccataagactgtggctactccttcctttcttttactttttgttcgtaaaaatcaaataactgagtccttttttaagtatctgatttacagatttcttaggcaagaaaaaacatgcctgtaggattgagagtactgaaacagtcatctgtaaagaactcaagctgaccgagtcaatattagcccgtttcttaatttgaaaagaaaacataaatttaatttaatttttaatgtttgattttatgtatttaaccatgactctttataaacatccatatgggtagtattactgtccaccatttttctgatgagaacattgaggcaaaaagaaaaaggttaaatagctggtctaagatcagtaagggttaagcaacaaaggtgaggattggaagccaggaagtttacttcgtgaatccatattcttaactacagtgttatttgtccctttagaatttatactatctccataattaaaattcacagtaaattttaccgtggcttatcatttaaaacttacacaatggctccacattttataatatgtagttgtcattggctatataaatattttcagtccttggaattgaatattaaaaagaaaaaaaggaataggaggtaaggaaaacaataataaaactgtagtcaagaaagcagaaggaaaagaaaaatatactcccaagaatatagcatctcgccttgaactgacagactccagcgttgtccctaatgacaacaatgagatggaaactaacaaagccaagtattattcctgtcatctcactgaacagaggcagtggtggtaatttcccttatgtcctttaaggaatcagggccacgcataattgcatgtattctgtgtcctgtcatcctggtatggtttactgagctttgcatccaatccgaaattctattctgattcagaattgtgaaataaatagtaaatgactaatgaatgtgcgcttcaaaatgctttctcattatcatgaagtccttgataaaaaggggagaatttaccttaaataattgattccctatgtgaagaccacagctctaactaaacacagattatgtatataatatttatctcctccttttcaagtaggtattaggaggagtgctttggaattttaacaaaacatattatataactctctgaattcaaaaatgaaaagaaaaatctttaaactaattgaactgaagtactttttggcataatggaaagcttcaattacaagtgatgtataattccccatatgattgacacatttaccacagttacgaaattactgaagataaatgagctgcatgtgttccctctcaacacacctaaatttgaatcccaaaagggaaattttcattgaaaaaggctctcttctcaaccatatatttagaagcagagaatgccatggatgactacaaaaaaaaaaaaaacaagttcttgtttatccctctgtgtttgtatgaatatttgcattcaacatcagcacacctgccacatcatagcaggacaagtggcttctgagcacatgaatgtttaccttctgctcctctgtacacatttgtttaaaattcctctaaaaattgagtcttcaaaataaatgctgtatataagggctgtatttggagaaagctacaacgttgattcaattttaaaggacttagagaactacaggaaattgtggactcaagtcaaacaagaaaggatgtgttaccagcagaggactaaatgctcacttacaggcaaaacctattgccggacatattttaaagggacaactctctaacagcctagcagccataatgaaaattggatacacctctccctgaatttagggtgctggttgaattcctattgcatcctctataattcccatagtgccctttcactccctccttttgctataccctccatctcctgtcagtttgcctcaccctctgtgagtcaatagtctgtaatgcagcttctacccccagaaggaagacagcagtctaacgaaatccattccgataaatactatcttaatagtaagggggcatataaaatgagtctagagatcatagaatcacaatcataagccgaaccctctctattatttttgttattatcattgttatagtaatttttgtgtgggaaaaacactgcttttagattcaccagagtagaacaaatccccaataattacataatcctacctcttatcagataaataacgtttatttaaataaaacttccaaaacaaacattgatcctaccagtgagaaggattccacttttatagattccatcaactctttcagtgcccaaacctctacatactaaattttctatcttcagggtagaagttgaacactaatgagatataagaactaataatctttaaaggaaaaaataataaaagagtaacatcttctcttttcacaggtaaaatccagatctatattctgactcttacacataaaaatagccttaagtggaacaacatttacccagaacatgtttactgaatactaacgttctcagagaaatgctgcagtcaatgaacaaagtttcatcacctagttatgttccatatatcacaaagtttagctctatttccagaatataatgcttaactacatccttctaagcctgtgttccagctctgtgaaacacttacattttttaattacataaaataactatgaatatactaaagagtcattcagtaatcaagcaacgtgaaaagctcttatggttttcttttggcatagatttttttaataaaggtaaataatctaagtttggacatctctctaaaataatttgtaagaactccacgtatgtaggagagaagagaatcaagaagaatttactaaagttactttatcaatatataaatacaaatattacctgttaatatatgcaaataaaatatattttatacatgcagttaatggttatgcatcttttataacattttggtttaataaacttgatggaatactatgatgccattaaatatatatcagaaaattttactacagtaggataaacattgggtatgttagtgaaaaaagcttaaactagaattatatctttaaagtagcgtaaacctatttgatggaaatgtgtatacttaagactaggagaagccaaaatacaagcaatgttttagaatgttgggattgtgaaatttttaatatttatttttcctatattatatatatataataatatttatttttcctacattatatatatataaaatctaaataattaatttctacttcttggtagaatagtaattatagacacttgatagatataagggaaataaaatatgccagattgatgtatttctttgaaagttaagtctagcatataaacatcaatgaatataatgaatctcctagtcatagacaactttattagaagaatcattaataatttctacctctattgctctacctacccctcaaacattcacccaatccaatctggcctcttctgctgccctccctgacaacagtattaacagatctaatggtcatttgacaatactccacttaatttcctagttgaacttaacccgattgaccactctttttaccttgacttccaagacacgtttttgtccctatttttctctagttattccttctgtctttgcagtaatggtactttttacctaatcactcactactcaaatacttcaaggcttattcctaagtggcctcctttccttactttgtattatttccctgggtattcttgtttctaccccaagctttgcttgtctctgtaagcaaatgactcacagatttatgtctccagcccagactactcctaaaagctttaaccaattatattaactttcttatatctcacttggatgtctcaaaagccacactcatcaaaaataaatccataatccctcttactgcccctaaaacttgatcacttccagtgacccttatctgagtaaaaaataccaccatccatgcagttagacacagaaaagtgatcatttgtttacctcacacatttacaatattcaatagactctctagtctcaagaactatatttattaaacatcattcgtatgcattaattaatctctatcttcacaacatcctgggtcaagttatcactgtctctgtctcagatactgtgttggtcgtttagccccccatctgtctgtccaaactccaaagtcactttttaaaaatcacaaatacgtctttctactctccttcattaatgaactccttctgaagataaacttattaatttgggattacctttccattctcttctttctccatccctgccacataattccctttccatttaatgcatactggctatttgtcaatctctcatattctctatgtcctccatcaccattagagcctgaatgtattgatttctcggcttggaatgaccttccttgccttcgtcacctaattatcttgtgctccttttgcagttattagctaagaagttttcctatcctcctaacctctgtgaatgcccctcctgcccccaaataggtttccatggcactcacacatattggtgtcattatttgatttttttaatgtcacttactagataataagctacatgaaagcaggaggctgtcaattttttttcatgattacaacaccagctattatctaaaatgattaattataaatatctaattttctacttgaattattaacaacttgtttagaatttaagtccttgaccagagtacttgtgtacaaagcatatctcaggtgaaactgtggaataggtaattactattattccatctgctgttttcacccttttttgctccaacttctgaacttctgacaattccctttactcttggaaactgtgtttcagtcagccttcttctagctctactctttctgagcattccaaggatatttctgtttccaggtatctaaagaacagaggaaattacagaaaaagtaaaaataacagaattgattgtttccatttctgaatgataagagacggtaggtaggtcaatttgctttgtggccttcaaggtctggattgagagaggctcatccattcaatcatttatagactcattaaacaattagagattacctcatattaacaaattccatttgttgattacaagattctgtagctgcactgttcaacacagtagttactagtcacatatggctacttaaatgtaaattaattaaaatcaaatactttttatctgtttgcattagctacattttaggtgccttttttcatcgttataaagctccattggacattgttgttctataatctgtgttttaatacataaactctgtagtggaaaaatattgctttcttctgccttaaacctagatttgccttctaatctgtatgctcttggtggtggcttaggaaaaccagctttctgttgtgttcctgcaggattattttcctctctcatccaggaacaggtgtgggcaggtgccctagctagaagaacccaccttttatcaaggaatttggaaaagaaaaatcattttctgtataggtgactcaactatgatttctacattgtggtttggagaggcagaggaactggattcaagggataaagaagaaaacatatgtgacatagcccattattagaggggcatccagtttggttttagttctttcttttcccttgtctttgaggtaccatgaggtactcctgaatcctcaaacataagccgcctttttagaaaacaaaagctagcttgattagccttcatttaatcctcataataaatcatgagggatagttcaatattcctatttacagatgaggaatctttgggttcagtgagattaagattagtcgtagagcatggattcaaatctatatggcttacataaattgaaaacattattttgcattatgttataatatttgtaaggtacaagtttatgctggaatctgaaaataaagaaattaataaggaatggctcttggttagttacagtcttactccattgtggtccaaacgaaaggaaaggaatagagattaggaagatatccacgtatcggctgtagtgaataatgctgaagtgaatgtaggagtatagctatctttatgaggtggtgattttgtttcctttggcgatatatgcaggggaagaattgctagatcgcatggtatttctaattttaatttctttaggaacctccatactatttttgataatggcttcaccaatctatattcccactaacagtgaacaaatattctcttttctccacaccctcaccaacacattatctcttatctttttgataatggcgattcaaacaggtatgaggtaatatctcctagtggttttgatttgcattaccctgaaaaatagtgatgttgaccacctttttatgtacctgttggccatttttacattatctttggaaaaatgcatatccaaattcttacttcattcttttaatatggttttgtgttttctcactatttccaattatatattttcccaatctgtaggttgcgttttcattttgtcaattgttttttgctgtacagaaaattgttagtttgatatagtcccatttatttatttttgcttttgtagcccatgggatcttaaaaaaaaaactgtcaaataagaataaaacagttgttaccagtgtctgggtggagtggagaaaatggggagatgtaggtcaaagaatacaaagtagcaaatatgtaggataaataaggcaaaaaatataatctacaacatgaagacgaaagtggacaatagtttattgcattcgggattttcgctaaataagtagatgatagctgctggggtggtgagtagataattatgtgagataatagatatgttaatttgttccactatagaagccattttactatacagttatgggtgcttaactacagatatatgttctcaaaaatgcatcgttaggcaatttcatctttctgtaaatatcatagattgtattttcacaaacctaaatggtagagcctactacccacctaggctatatggtatacctattactcctaggctagaaatctttacagcctcttactatactgaatactgtaggcaatagtaacaaatactgtaggcaattgtaacacaatggaaagtatttgtatatctaaacatagaaaaggtacagtgaaaatacagtattataatcttatggtaccaccattgtatatgcagttcatcattgactgaaaagttgttatgatgcatgactctctctaaatatcttaatcttcatgttgtataccttaaacatgcacaatatgatttattttatttaaaaattgatattaatgtaggccagtgtgcataatgcaggggattcctggaaaagtctgactcggggaaaacccaaacttttctgacaaacacaagcaaggttgttgcttgtgttgaagttgagaagactggagttgagaaactcacagaagacagtgggtcagatattaggcccagttacttacaacctggcatttccagagagatggactcccctaaggctaattcaaactcatgcctggaaagaatcaaaaaaagaagttaatcttggcttgatgaagtcatgaaaggagtagaaaatagagagcccactaacttaccaagtttcagcataataactactgtcccctagcaatgctttctaaaacataaacctttgcagaaagttgatttgatagtaatctcaatgcttctaatttgaggaaaatagagcattgtttcatttctcagtggcttcactcattttcaaactgtaaatgagagaatatttatatggctgctgagcaaaaatgaaaaaaaaatgaggtttgatttgtttttgaagtttagaaatatgtctgtggatgactagccaaagatggcagaatttagatatgatgagatggattgatgtagctatctgccaaacagcatgattaaaaccattcagaccctgaaaatggagcagagaacattggctttatttctataaactaaactgtcaccatcagacttaagtgctcttgtcgtgtcagaggatttattattattaagaatttctctgacatgcattcgccgagtgcctctttgaagtttccatcagtcacagctctttagtgacatggtctggctagttttcaatgataaaaggaactgaggcatccatacaaattaacactagtttcatgccataggcccctcattaatatgtgatttcaaatgaaggtggatttaatctgtaatacaattagttggttggggaggaccacatcaagcagtagaaaaatgtcagaaaatgtatgtcgaactcaactcttgcaaatcaaaggtgagtccctctataagggaatgttattcatccattatttcaatggtcaacttacatatgtgaatgtaccattagttaagatgtgagacagacaggtgactttcaggtttatctcaagatactcaataacgaatattattcttactacatatcaggaaagtaaaattctaaaattgaccttctctcttatttcagagcaacttaattctgccaaagaccatcatagaaccatttgtattaaaaactctacagactgatactctcggaattcagctaggccttcagcaccacctgccaattctgttatctgtcttttgtcagctacttttaccattcccttcctcaaaatttcagaactgtcccctttcctcaaattttctctgtaccaaatttctaccccacttctttaagcagatagcatgacaacctagacacttgtggctatcaggcttgatttacctcaatattccacctctttatctattacacttttactgccacaaccatcctttctctcttttcatcaatgacatagaatgaagtgaccttcttcttgctctaagccatgctttactccggtttttggggggtcctcctttctgctctaagtcctgactacactaattaaccttatttcctttacaaatcttcaacttttttttctattggctcctccctcttaacttcatctccttaatcctaatgaccttccttggccccacattctccccagctactcacacagtcaaaatgtgctccacggtaaatggtcatgtcaagaacctttgaagggaaggagatttcactgtacttgaaggctaacaagctagtgtgctagagtttcatacttactggcagaagacacaaaatttatgggtaagaaacagaggacttcattcccatgaaacaagacacatgaagtttatgtttgcattggttctccatgcccctcaagtcccacagcagtgatgcaaatggtgcatgtggtactgtgcacacagtagatttgtgttacagctaaggagacactaaagctttaaaaaaatatgacaataggctgctggcaaacttgtctaactttgtgcaggaggaagacattagttttgttattctggttaggaacaaacctgccatctgtcttagagggagaattaatctctaccttccaaggcattttgttatataaacatccttgaaaagataatgtaggacaaaactgtccagagacatacacatgtgccatagaaaattgctcatccataggttgcctttcatttatttatattattaacaattttttggtaagttgactgaatgttctctatctgttatacattttgctaggtgggaagcacactaccagactttaagaatcctatttaatttttaatggacacagtgaacctcatagcacatttcaagaataatgctgattttggaatgcccttactaataaatcataaatcacctgtagtcatttcattacagactgctggaagggtactaggcattgtggtctggtaaaaaattttccacttacattacaattgatccaataaagaataaattgcaaataatacttcagcattaatggtgttttcttcactctataagacatacaaatggaccttcatggaaaatatactgttgtagttgctataagcctctatttcattttaagccaagactcaaaatcacatcatattaaataactgtgtgtgtttggtcttttggggtagggatgagaaaacacattttgccaagtttagcattgtgagttcagagttcagaagaaaattcaattctttctggaaatgagtgtaatagaacagctggtcagacacaatttacttgctcacagaaacaaacttaatgacttctgaataaaaaaaaaaggcttactaaaaagggtcataaggaatatcaccagatttaggatactctgggcttaaaatggcatctgcttataaactctgatgcaacacttcccactcctcaaaagcaaaccaacaattaaaaaaaaaatatatatatatatatatatacgcacacacatatatatactatatatataaactcaaaaacaaaaactaggaagatttttttaaaagatgaagagtaacttaaaatatctagaatttcaattgataggcaacttgtaatagggatttttgaagactttttataaactaaatgggtaataaacagattgtgaaagaagtaaataatatatttagttgttacatcttagaaaacttaaatatgttttctgaaataaagttcacttgcaaaaacaatactgaaaaaaaccatttgtcttaaattgccgtttgcctccagactcagaaatccaaagctagtacaaaacatagaatggggcagctgtccttctataaaactggtgctacattttaaggtcttctccaccttcatttttttacctttttattttgaaaaacaatcagacttattagaaattgtaaagttagcatagaaagttttttggaaccctacacccggcatcccctaatgaaaacatctgatataaacatgggatatcaaaaataggaatttgacaaaggcaccatatgctatcaacaatatcacagatcttatttggattccatcacttttctaaccctccttcatttttaaagctatacttagatataaaactcagaaaatagccaggaagtaaggtgagaatgtgacagtagaaatcagggggtttcttgcggagatacattcctattaacacagagctagaaaagtctaggcaagagtggaaacagctcaggttaacacctaatgaaaagcctatatttttttcttatgcccttcagttgacagtgccagaaaatcatatagtggaaaatgaaaatgagcttgctaagttaacagagtcaaacaagacaaagccttgctggaaatgagagactggacagggagattttgaccttcacttttccactggctaagatctgaagctagagggcaagcttatatctgcaacctgcctgtctaccatttctactgctgcataaaaataaaaaatttcaggaagcttggcacagtcaagagtataggaagatgcgaagatgtgatatgggaggaaatagctgtagaaaataaaagactgaaattaaaagtgaacaagcatgggatgtaatttgagactgaggaactaagaaagaatttaagagtaaatggaaataaatatattgaaagcagaagagtaaactgacttgcagaaaatgcaataaaattaggcagtggatttctctccatatttcacaaagatgttaaaaaatgatatcccaggttctaacacacagtacccatttccctgtggttttcactgtagacagatattgttttcacagacaaataaataaacactttctcttctcaaaagtatttattagaatgtgagtgatatcaatatatttgcatagattttcatcatctcttctaatatggaactagatggtaattctagactttacagtgagactttatttttgtatgagtgtcaacccactcctcaagccagaatggttccagcagagcgattactttcaaaagctgtataaatttattggtaaaagtttaatgccagccttaattgccttcaaaattcttgactagagaccatctggtctcaaagatttatctatacctagtttacaaatgcagtatcaaatattctgtggttgtaccactacttgatctcattgccataaattttaagttccaaaagtcatcttaaagtgaaaaactctctcatctctttttgtgaaatgggaaaaagttactaatttttttttctctgtgaatttcagtttccagaagaacctcctccagaaattattgaacaatcctactagtctatcagtcagttttctaaatttcttctagtcttctaagctttctacctttcatatttcctacttttttctgaatcttagtccaaaatttttgtaatacattttaaaagtcatacattcactcttttcttctttcttgccttttttttctctctgtatgcttcacccatcagtgagagtttaagtagtacaaatttcagatttctgcattttcaaatttaggaggaatgttttaacttaatttttaaaatgtactttgtaaattctactaggaacagttaatatgatatcctccctctttttctattatcaggtttttataagtatttttgatatacaaaagaactatacatgtttaattaatataatttagtgatttgggacatatgcaccatacccgtgtaactattaccacaatgaagataataaacatatccatcacctccaaaagtttccttgcacaccttcttgtttgtttgttctgttttgtgataagaagccttaacatgagatatactctcttgacaaatttaagggaacaaatagtactgttaactataggcacaatactgtatagcagatctctagaacttaatcatcttgtataactgaaaatatacacctgaataacaacttttcatttccttttttccccagccccttgcaagcaccattctattctctgcttccatgagtttaactattatagaaaactcatataagtggaatcacgcagtatttctccttctctggcctataacatccagcataatgtcatccagtttgatcactgttgttgcatacggccggatttctttcttttccaattttgaatagtattcattgcatgtatgtaccacatttcctttatctacttaaccatctactgacatttaagctgtttctgcatcttggctatagaaatcaccttgcataactgaaacttcatacccattgaatagcaattccccatttcccctttccctaaatcctggcaaccaccattctctctgcttctattttaaatcgttcatacaaatagaatcatgcagtacttgttcctgttgtgactggctatatctgttcctagaaaatagaagttgttaatatcttgctacagttgtctttagctttctctgaaagaaaggacaaaactaaactatttttgtataatagctctacctattgtgttagatttagtcttaggtataaagattttctggttatgagaaattttccatttaacagtatatctaactaagtgttttatattagaatagttttggatttacaaaaaaaaattgttgaaaacgtcataccaagagttccagtataactcttatctaatttccccttttgatatcttttcacaaaacgatattacatttgtcacaagtgagaaaccagtattgctatgctactattaactaaactccacagtttgtgctgatttcacaagatttttttttttttgctaatgtcctttttcagtccccatccccaataccatcctagataccacattacatatcctcatatctgcttaacatcctgtaatctgtgacagttcctcagactttgttttgatgacagttttgagaaaaaaatggtcagttatattttagaatgtccctcagttgatctcaatcttatgccgattgatctctctcttacacttttctcatgattacgctgaggttatgggttttgtaagaggaggctgcagaggtaaagtgctattctcataatttatcaactatcatgatttatcatgctatcaacaatatttatcactagtgaagttagtcttaatcacatttctgaggtaatatatgtgaagtctcttcactgtaaagctatttttcaccactttcaatactctactctttggaaaccaatcactaagcacatcccatactcaaggaatgggaaattaagcttctattcttgaagtagagagaataactacaagaactatttgtaattcttccttatgggagatttgtctctttctccatatgtttatatttatttattcaatcaattatttatatcactaagggcatgtttattttatattatgagtgatgatataatatcatgttatttagttagttgctgaaactgttgcagctttggctagtgaaagtcaatttacgttgctcctgtatcccactgagatgtctccatggttttgtgttttaaacacttttattttctggcattaaaagttattccaggctaattttgttcatttttccaagaatcactcatttcttttcttgaagaatggtattagaaatcaagatctgggcactgggcactggaaagccattattttaaaattaaattttctatgtttttatttatattacattagctcactattgatatgtgtatattgatcttaaaaatgccaatattagttctaaaattgtatgtgtaatattattctgcagataatagttggatatactataggaatacttacactattcttgacaactttatttcttctttctaattcttacatcttttaccttatttttagtcttattgttttggataggatctctaggtcaatgtcaactgtggcatcttttctgtgtctctgacttttaatgaatgttctaatgcctcctgttaagtgagacattttctgcaactgtttgataatactaatcgggttaaataagtaatctatctacaaacagctaaaaactaaatcttacagaggtactgaatattataaaatccttttctgaatctctgaagatcacttttatttactctctttaatcagtttatgtgataaattatatgaatagattttgtaatactaagacattccttcatgtttcagataatatctatttggtctgaaggtatttatttcttcactcctctatcgaaaatgcaaacacattattttgtcttttcacactgaatttcttaaaaaaatcaacctattaatcttttaaaaaccaatttaatttctttaatgtctgtattcctgtcaaaattgtacatcttttaaaaatactttggtaatttaggttctctagaaaaagttcattttgcacaggttttcagacttctttaatcataattattcacaatactattttataatttttaaaattgtatctgtaattacaaattacaagatctactctcattcaatattattttgttgaaatttcaatcttttttttctctttggatcttgccatatatttatctgttgtattttactttctaaattacaaattctggggtacgaattagtctctatatttcaaatcattctccactttattaacctgcttttatcaatttgtttctagtttggggagtatctccccttgtcatcttgtgataaaaaatttgtttgattttctatctttttctattatatctaaggctataattttattttgaaagctactttaaatttattctagatatgtgtatcttttcaaaatgtatctctatataagattttgggatccatcatctttcaaaagaaaattcactgagagcactgaaaacacattatatgtattttcaacaattgggtaatttttgagactttatttgtatcctgggacctaatttaggcattaaaagttcaacttgtgcttggatacaatctgtattctttcagatgtgaggtaaaagtctcctgctgtgattgaggtaacttcaccttatgtcctccaccagcccaagctttgaagccaggcttactgggtacacatggggggctgtgcccatggctagatatgtaagaacaggcagggcatttaaaatttcacctgcctcagtgttctcatgtgcacaatggaccctcctgtctggttatggtaaatattgagcaaatgaggccaccggaggtttacctggaacaggttgaggtgacagtgttcacctttacacacaagtgctcagaaatattaaatcttcctgtttaactcttccttttgtcattatgcataaatgatgttcattatcactgaaaatgttttttgttcattttgtctaatattgttgtcatttgtccataattgcttagtgtatttttcattattttgcttttaatctttatatatttcagagatgttctgtttcaatgattgtacttatatagtgatatgtataatatattcatctaatatgtatttctttcaagagtagattttattttacctattttagttactatttgggggatttatttttgctctatattgaacttttattggcagtggttattctcaccctcccctgttttggcgatctagtttttcagggaattttctttattaacgattttttcccccgctatcttttcactggtttgaaaataatacattacgtttatgtgatattaatgtttaggtgcattttatgataaatatttggcacggcaatatacaaagaaaatatacaactacactctctcctccaattatatctgacattcagattagtttaactccagtggctcttcccacacacggcatgttgtcgctgttctttattttacctccaccttgaattcaatctccctcactagtttctgctattaatatttatgtttacagttaattatttataaatttcactacatgactatcgatatctttgttaatttttatttaaatatattctctattgggttatttttcttcttgctttttaattacgcctttgtgataattctttagataaaggctatgaataaattctgttttgttttgttttttatttcgccttctttcttcaatggtagttcatttagatattaaacagaaggctggtaattatttttctcaacaagttaaaaatataatttcagtattttctgatctttcttttgaatttcagaaatctgctctcagtctcatttgctgctaacttgtagttggtctatctttatctcaggttgtttttaaaagttttatttattgtttcataatttacagtttcataacaacatatttattgcacatagcaagcaataagaaggcatatgtagcttacatttcattaggtaatactttttaagccagaaagctatgaaggtataattcttagaaataaaagcaaatagtatatagattttcttatgactggttattttatgactgattttgacttacagattatcttgtgacttactttacaacaagggcaactattgcatgggaatctataattagacttaaatatactatttgcatattaaattttcaaagatttttattgctacatatttaacttttaaaacactattaagtgttggcaaggttttaggtaaatggaaagcctcatgcacagttcatgagctaacagtcagtaaaacatcttttgaggacaatttggcaacatctggaaaaagctagaaatatattaacaaaatttgacccaggaattcagcttccaaaaatttttcataatgattatttcattgagtagtctatgtaaaatgatattaaacacaagtttagtaaaatggcagaaatttaaacttgcagtagcatgtttaaaacttatggtaggccaggtgtggtggctcatgcctgtaatcccagcactttgggaggccaagatgggtggatcacttgaggtcaggagttcgagaccatctggccaatatggtgaaaccccgtctgtactaaaaatgcaaaaattagctgggcctggatgtgcgtgcctgtaatctcagctactagggaggctaaggcaggagaatcgcttgaacccgggaggcagaggatgtagtgagccaagatcacaccaccgcactccagcctgggtgacagagtgagactccatctcgaaaaaaaaaaaggaaaaagacttacggtacactatataattaagttcgtatgtattttctaaagtaatgtttctaaggaatgtcaggtgaaatgagatatatcatattttaaaaacttatttagaaaacaatattttaaatgagacaacagataaaagataataaacgaataaatgaagggaataatataaaacaactagtggcagtttagtacctggttgttactattatgagtaattctaatttttcttttttgaattttctaatctttttagtgaattatccatatgatagcataaagcagttattttgattaagagaaacacaataaacctattcttttctgtaaattctggctttttggaactgaagcacaataaacatattaagactagatataaactacctctttgtaatatataggataaattattattaatatattgaaagcaccaaaaatacatttataagagattacagaagtcaatgggctttccacaaatgttacatataccaaaagcagaaaataaaatattagtgaatttgattacacaaaactttaaatctcttgtatagatgatatcattaaccaagccaaatgacaaatgacaagcaagaaaaaggagcagccgtataacagcaagggagcaaattgctttaacactaaaagattttacaaatcagtaagagtcatacagactagtagcagaattggtcaataactatagaactagcgaataggcatacaaaatctgtaatctcagccataaataaataaaattataataaacacaaacatttatcttcatatgatgaagattttaaaaagtattaatacctactatagataatgagaatttggaaaaataattgattatcttaatgttttgatgaaagttcaagttgtcataagctttgtagtagatgatatagtgacattttgaaaaataatatccattaaacccacttctagatatttattctacagctacacatacacattttatgtagataaaaagtatatgacactaatcttatatccttatgacaggataatgtatttttattgttgtctctcttcttttggaaaagaaggaacttatttatatgccatttataatatggtacatataataaataacaaacatatgagacattttagtttttcaattgggatattaataagctatatgatgcattttcatctacatcgtttccatgtgatatggatatctatttagatattttccagatgagaatgtttgcatgaggagaacattctcctaaaattttgttcttgtcttctaaactatggtcaaggctcaagtatctaggcttattatacactctgaatatttttctatactgaacctatggcatacataaaaatatggcagatctgctaaatataaagtaaagcattgtttaccgtgtgctttgttctctcagcaaatatattatcactgatggtgtgtttaatttatttgcacactttaacctaaagaaagaaaatgtaatttgcttttaaccatataatttctcccagaaaccctgcgcttgtcaacatcagatagctacaggctctggataaagggaattatctgtggaactctaaagcaattaattgatgagcctacacccaagaaattgtaagtcagtgggccttacagatatcccccaaaatttttcacaaacatcttatgtcattctggggtagacacccagagactacattctgaggaaaactggtagaagtgttagttctttccacaagtcttggcaaagttactctgcttttattttcctattgtctgcttcatgaagtatgcaaaaacaattaggaacttattctcacaacagtgacgataaaatgaccttttacctaaaactgtttagtgggaaatcatgcctctgctgaattttctgctcagatcattttagattagaataaattgatcttgttaaaaactgaaggaaatatttttcacctttttaaattttttaactaaattgaaatctaagagtacatgaaatctaacctgaaaatgggccggttggtgaaggacgagccatacgaaaatccacatccttcatctcttaagcatttgctatttaaaaaactaacttgagtggagcactgaaataatctagtctgttgctaagaaaatatgcagattcagagctgctggcgttttccatttggagtggtaaattgcaaaaattcccccagtttctcatgttattgctaacatatacagaggatagggagaatatttggtatagtttggtacctcaaattaagtacagaaattacaccaatgtcatgtttcatgtttcatactccaaagaaaaatggttgagtaaactaatattatgttactatttgtaaagtactaataattttatgcttaggataattcatctttaattgtgtacctttcagattgggtaccatgttaactaaaattttcttgacctctgctctgtttcattttaaatcattctgttttctgcttcttcttacagacactcttttcctgtggggttttctgtgttctttgtacaattgttttggatctaaatatccggatgatctttcttctactaaggcctttctcatacctttcttatacgtgttccttttcttctcctctattctgaaaatcacacctctgcatctatttgtcaaagctttgatttttccactacgacccaaaaggcagtctaataaggatttggtaataagtttgcagttaataattatagttaatacaaagtaaatatgattaataattattaagtgcttatggatgttccaggttctgcttaaagacatttgcatatgttgtgtcatttaatacacacaaaaattctaatatacccttcatagagatgaaaaaaactgagacccagagataattcatcgcttgctcaagttcacacagcttataaatgatacagctaggattctagcccaaactttctgattctggaagcactgaccagcagttcttaaagacctcaaatctactgaataagacctcaaagacctcaaatctactttagtggtggggcccagtaatctgattcattaagacctgaagagaattctgatgcgagctcaggtaagagaaccactacactaggctgtactctttcagagcttaatttaatacagagctggatataaatgcatgacagatacatttgaataagtaaggctaacagaatattttattatcactcttaatatttgccttttgttaaaaatgagttttataactaactatatcagttgttcaattaatgacttcatattctttacggatttttagtatataagaaattaagctctatgatagagccagaaatatatcagacattgtgatttccctcaaaaaacttgtattatattaggtagataaagttttttttttttaaaaattcactaaacacaacatatagtttgatagtttagaatgtgaagaagtcttgaaacaaaaaaataaggtttcaatttgaatttcagtattgataagctgtgtgatgttatccaagttatttgactattcaaaaactcaatatctcaatatttcttaaagaactcagtgtattaggatattataagaaataagaaaatgtgtgttttgtacaatgtctaacatacattaaactcttaataattacttatcactactttgcttactaatgttactgttaccattagtaatagtattactaatagcaatagacaggtttatactaagatcctcatgaccaaaataaaatgaaaaaaatggcatttagaaattgaaactgaaagatcattgaaaacttggatgttcaaggaaaagattaaagaaaagatagaacccaaattggcttttatctctttgtatctctctctggcaaaaggaaaaggaattggtaaaaagacaaatctgaaataatatttctgggaaagtaaataaaccattgttgatggaacaacaaatctgtaaaggaaagtaagcgaaaatggatcaagctcagatttaaagttagtatatgtgaactttatcttgctataagctaaaatccacctctagcaaagacaaatttcatgttatacaaatatgctatagcaaacccacaaatattataatattcaagcagcaggtatttacagagaaccaattctttaccagttataaccggagttatgttaattctctaaatgccatgccaagctaaaaatgtgcaaaaagaaaacataaagggaagaatgaaaacactgttagaaaggtaaataataacattgttattgtaacatattttacaaagtaacgatcaccaatcacagtgaatatctgtaggctaaaacttgcccctgagaaacaaatcacaaaataatggaaaataaaatttttcaaaagggatctgcagtagattatactctaatgaaccacttgattttataaattccattaataattttaactgtacatttctcaaccttttgtccttagggctcagccaacattaagtcaactaacaactacattaacaataggcaagagaaaagaatagtgtttactgtggttccaaagggattttccaagcagattcactggtaaggaaaaatcctcttagccattgttggctttgaaaatgtttgtgtagtgtgattctttgcttcttaattaacccagtcactgactacttaggcagtgtgctacggcactgatgaggtttaaaatagtagttttctaacaaaaaacttcagactgaagaagtataatttctgatatccttaaaatgatcaaaaaatcactttaaagcatcctttagaattgtattaatctcaaattttcacacctgttgtaataagtagactgtattttttgttttctcttctttttctaaaaaataaaaatatataatatatttatgtagtacatggtacttttttttttttttttttttttttgagatggagtctcactctgtcacccaggctggagtgccgtggcacgatctcagctcggtgtaacctccgcatcctggtttcaagtgattcttctggcccagcctcccgactagctgggattacaggtgcctgccaccactcctggctattttttttttattttttatttttagcagagatggggtttcaccatgtttgccaggctgatctcgaaatcctgacctcaggtgatccaaccacctcggcctcccaaagtgctgggattacaggcatgagccaccatgcccagccacatggtacaattttagcagttctgaaataaaccaattatttctttaaaaaatattatatgttattaaacataatttctcataaaatcatccacaaaaataatcgcatttgaagactaaaataccaaaaagagagaacaaatagtgttgaagttagatgcataagctttctaacacaaataagagtggctgattttataaatttatacatccaggttgatcttatgctagtacatttacataaggaacaatattacctcttaagttaattacataagtcaagtatatctaataagtgaataaaacaaagagaaatgctgtgatcgaaagttggttattttgctgagaaggatggttccagcttcatccatatccctgcaaaggacataaactcattattttttatggctgcatagtactccatggtgtgtatgtgccacgttttctttatccagaaaataggcatttgggttggctttaagtctttgctattgtgaacagtgctgcaataaacatacatgtgcatgtgtctttatagtagaatgatttgggtatatacccagtaatgggattgctgggtcaaatggtatttctggttttagatccttgaggaatcgccacactgtcttccacagaaaaccaaacaccgcatgttctcactcgtaagtgggagttgaacagtgagaacacatggacacagggaggggaacatcacacaccagggcctgtcggggagtggggggcaaggggagggagagcattaggacaaatacctaatgcatgtggagcttagaacctagctgttgggttgatagtgcagcaaaccaccgtggcacatgtatacctatgtaacgaaacacatgttctgcagatgtatcccagaacttaaaaaaaataaagttggttattacattcactcaattttaaggtctcatgccaattacttctcaatttactgtactggatttgaagcccagtgccactatggaacggtttcatgactgagaggcaggcaatattccttgcatgaagtgtactttccctacctatgcaattgagaatagtataatattccttatggagacgctttaagaattagaatgaaagtatatatgaaaatgccatgaaatatcataggcatttatagatgttagatatgataatatttggttaattatagcatttctgtgtgttttgctcaggaaaggggacatactgatatatataagcttgctgatttgtaaaccaaaggaaattttctaagtttttgtttgcttgtttttgctgactgtgggaagcaatccaccatggacttctcatgttcctgtatgtcttctgagcaaagggcaggctaaccagtatgtctccctctgtggcaaaggtttggcaggtttgctagcagccctctttacaaggctggggtttcttacactcaaggtctctcagttgtcatgcaaatccagtacatgcacaccattaagttggcctactttgcattacttttgggattcaggggtggacaaggggagcccacgtgaacacacaattcatgctgcctgctttgcctggacccttcatgtgtcttctgccagcttgtatgaaagttgagaaggctaacttgtcagcttgcatgcaggctaacaccgcgggcccttcacagttcttgacaaggactagcttccctaaaggcaatcattctacctgatgaggaaaattacttaaaaagcaggaaaacggtaatgggttggaaagcatacagctaatagttaatgaggttacttcaccatattatgttttttgaataaagattatactattaaaatgccctcacatttttattacattccacttcattgatagtaaaaaaaaaattgatcaggatatttaaatattctccacttcatatttacacatgacgggataacatcaggctcttgttctttttctgctcagatcactcctttgatgcaggcttcatggtgtggactagaggaaagtctttattgtcattgcgtggtaaattgatttgcctgagagtgtgatgcaggactgaggaacatgaccatcttcagagaaggaaaagtcagattagttacttcaatctttaaaaaaaaaaaaaagtcagggttcctgaaagcgaacagttatttaggttctacgtgtggagaagtgaacaaaatgaatcgtcacagaaaggattagattagatataaatatcatctagtccaaatccctttaaggtcataccgtgcagttggtggaaaagatcttataactacaaggccagcatattatttctctacggcagacattcaaaactgtgacagcaatacagaaggagtctgcactcatagttacattgacaaggaggaaataaatctgagagagcttctcactttcattcattgtctcttttcttcactttactgcggccattaaactatttttttccatgcaattgtgttgcagttaaatgtaagtgtttttgaaatttataattttttttcctttaggatagtttatgaagtatttattttgattaccattatttatatgtatcaaatcattcatagtcctattaattaaatagtactgattcagtttggtgtaaattatatttgatattttgatcttagctggatgttttctgtaagtcttgaccatcttttccaagacagccatgctggtgaatctgttttatgccattaattgtcattcactgaaatatatatagagagagatatatagataaaaaatctgtatgtatttatacatgctattttgcataaatatatatattcttgcatatatatttttactttaaagtttcatatataatgcaagtattctgtaaacagtaatgtgttcatccaaatatctattaatataatataaccatttcactaaagttatgacttattgagaagttctaaggatagtatggattcagaaagagttagatggtaaacaatggaggattttccataatgtcaaacaaaatattagtgtattcacaggtattttaagttttatgaaaatcatgttattaagcattaaaaaatgctgagagaaaagtttacaatcttactttgaagtgtatcactgttttaatagctgccaaacatattgccaatccaactctaattaactatatttttattatacctatattttaatataactacagaacaacaggatagataattaaaagggctgaaaactgcttgattttgtttcaaaaagaaatttgtaaagtctgaggaacttaattagatgttaaattctacctgccaaaaaaggcaccgaagtctttctcagagccaacaccaaagataaagctaaataagttttgtgataaggtagaacagttaaactgtgttaaaaagacaaaagtaactagtaggtgagtaacttcaaacagttgattatcaggtgattatttactaataagcactttgtttagatagaaaacaaaaagactataaagtccttgttatttgtgaattgttaaatgttattcatttagcagagtggattgataatttgaatatatttcctggctgattatctcaaagacactgatagttccctatattaaaaattatctactatcaagaagagcttaaaatgtctatttcaagaaagcaccgccaaatgagctaagagatgcctcccaccccatcaccccacaagcaggaaaagttaatataatagccaacctccctttctcccttcgtcctcttttttcctccttccttcccttcctttcttcttttcatttcttgagcacctaatatgtggcagacactgctaggttatgtgaatctaatggagagcatttatggaaattgtacccaggaaaaacagacaatctgatgatcacatcagtgctacccttaaatctggtcaggaagggtccctgtcctgggtccatgaccttaaaggaatacttgacctttcacaaacaacacattcaggacatgtactaaagaacatatggccaccttgtcactcagaatcttacattcaaattcagcataagataatgcttagtcttaaacatctactttcatattaacactgctcagaccccaggaaacacttttcaacatttgtcctattcattttaaaacaaagttaagtgtaactgagtgctgaaaaaatgtgtgtgctgtactgcattggaagataaacaacatttaaacactatggagagagtaaagcagtggacgggcttaggtaggaaaaaagacacacatatttactagtaaagttaccatgaaggcaatagattctagcataacaaaatatcatttctcaaaattgaggaacatctatttgttttatcttattgtattttgttaccaaaagtactgaaacactcatgcaactttcatacaaattgcacattgcagtcaagaaacatcttgaattataaaataattgatatccgctggtaaatatgtatatatgaagatttagacataacatatgtgaagcatcatttcccctcttaacaataacaacaaaatgttctttgtattctagaaaggacaaattataaatagctttattattattaaatatgctataaatttaatttatctttaaaacgttaaataatattatatatgatgatgatgattttcaaaattaaaattgagaggccaaaacaaagtgtaaaatataatattaaatattttacaagaaaaataacttattttcataagttggtacttttattttcactaacatttttgatgaaaatatatttcatatactttgtaaacaactatactttaatttttaatctttttgagcattgaaaatgaatgcaaagattgttagagaaataaaaagttcaaaaatgcaacacagagaagaaataactgaaaaaaagaaaatatataatttttagagagtctgtctgcttaaatttttaagaacttcagacaatgaaaaggagcttatttttggggagcatgacccacttaaaatttgcaatcaggacattacaaattctttactaatgaatatttaattacttaattactgattaaaacagtgaaaccaagtaaaaaataattattcttatgaaatctactgcttgaataggacagatgaaagctttataactttatattctttattggttgaagatttaattacccttagaaacaatggaaatgtgtatgtgcttctatttgcttatatttgcacaaatggtctctggaagggcacttgggaaactctgcagatggttatctctgggacaggcagtaaatggctgggtgagcaggacaaggtgctttctgtactttttaaacactgtgtatattttattcattaaaaatgcattgttttatgtcaaattttaaaatatcctggttagaagttaaggaattctttctctgttcatgttattcagttcacatctgtcttcaaggcttattaaaatgagatattgttacttataaaccttttcagtatttaaacaaatgattggaagttatttacctcgtatgccaagaagtgtgccacctgtacatccatgttcatggaaagaaacatcattcactatagccaagatatggaatcaacccaaatgtccattgcaaatttataattccttccactgactgaatggaccacccctctcagccaaggggacccaactaaacccaaaaactagttcaggccatgattattactggaatggggaggtgagacatgcctcattatactcttctccttttggagttcaggcacaattaactggcattttcattaaaacagagattctaagactgacagaacagactgtagcaataggataccaactccagcctgactctggtacggcaacatataatagataacagaccctaaaaagagatcaaagtattttaccccataacatatttcttgacatattttgaaatgacactgcaaagctatctcttgggggaaattgcattctttagagaatctccttcccttactaggtccctccaaagagtctgacatcttcgataaaagacatttacatctattctctctgaagcttgttacctggaggcttcacctacatgacaagaaccttggctaccacaatctccatccctatatcttaactcaagctgttttcaactcttcaggtggagcttattcctttcaaccaattgccaataagaaaatctttaaatacacctatgacctggaagccctgccccccacccatcccactttgagatttcccactaaaatgtacaaaactaaactgtagcccaaccgccttgggcacatgttctcaggatctcctaaagccttgtcatgagctatgacccttaaccttggcaaaataaattctaaattcactgagacctgtctcagatactttttggtttacaccatcaatggatgaatggataaagacaatgtagtatatatacacaatggaatataatttagccttacaaaagaagccagacagaagtaaatccggtcatctgtacaacatagatgaacctgaatgacattatggtaagggaaataagccaggctcagaaaaacaaataccacatgatctcacttacaagtggaatgtaataagtttgagctcatagaaacagagagtaaaatattggttaccagaggctgtgggctgcagatattgagaagatactcctcaaaggacacaaaatttcagttacacaggaggaatatgttcaagagaactactgtatatcatggtgactaatagcatagctaataacagtacattgtattgaaaactgctaagatagtagattttaagtgttctcatcacacacaaaaattataagtagggattatcatatgttaaatagttagctttagccattagacagcatatacatatattgaaacatcatgtatgccataaatatatatagtttttacttttcggttaaaaaaagaactatgccaccaataaataatcaaaggtagacaaaacattagagcacactaaaagttttgctttatttttgctattacagcttttcgtaattctcttttttcatcttatcttgctatcctaatatattatttaactagaaatctccttcttcattcaacacacttaaaagaactgtcaaatagtgtgtattaaagattagaaaaacaaattagaaaaacaaaaacacatggttatatttagccatgtgtcctatatttaaccctcccacggcatagagtctaccaggcagactagagagtagaaaagacaattgcagtcctattcgacaactgttataaagtgctaaaattggaacactatgggaaaacataagagaaaaggtacataattcagattggcaagtaggagtctcaccaggggaaaaggtgaggttgagaagatccttccaggcaaaaggatgaagttcattgcgggagtttaattttcaccaaactagagaagaaggctgacatagaccacctaagactttacattatttactaaagagcttatgttttatccggaaggctctggggaaatattggcaagattttagcagacaagtcactgtgatcaggtttgttttttggaacaatcactttactacagtgtggaaaatagattggaagagggagcatgtaaaaccagaggcagttaggaggctactgaaattgttagggagagaatgactatagtctaaataaaggaggtggaggcagggactacaacaaagggacagagctacttgttaattgatttgtttttggtttagtacattggagattagtgtatttcttaagagtccagggttgccagatttacaaataaaaatacaggatgtactcattaatttgaattttaaagacaaacaaaataatttgttagtattaacatttattcgaaaaaaagtttttctgatttatcagaaatttatatttaaccatgtgtcctatatttaacctggcaatcatactgcaatgaagtattggatgtaataccttcatttttgcaacattcaggaatccctctgtattgtaatgtagctgtaggtttatttatgcaactcaaaattttacatcaagaatcacagaataagcaaattacagactataaacagctgctgaaaaaaagtgaaaaatgtgtaaaaagaaaataaatttaaaaatttaatgtacttattctgttgtaatgtctctagcttccactcaggttttaatgcaggaaaagaaataatcattatagcattagtgacaatcaattttcccatgtcagtgttttctccttccttcccttactgtcaagattgtattttcacttttggaaaagatagttaccgagagttaatttctgagatgatgctattcttaaacttctgtcaagtaaaaaatcatgagagctataaatttggaaaggagattttatttctcataaaggataacagcctgcaagatggccattctgacaggctgggaaaagaagcctccaggagggcccagaagcaggcacttcaagcgatgtgagggtgaaacagggatttataccgaacaggttgaccaagtacacatacacaacaagttacaggaggagccgtgaatattcatgaagggcgtcctaacacatgcatactgaatgaacatgcaggttacgtacaactcatattcactttggggtagagacttaatgtttaaatatattacagttaggccccctatgtcaaaaggtgaagcaggaacacgaaggcattcaagagtgcagcctatgtaaaccagccagaaccaggccagggttggtggtctcttatcagaagaaagtgagtgaaatccgtctcttgtcccatcaaagctgtagttatggcttgtggaacagggggtggagggtcagattctggcattgagctcaagttgtcttaatttgcttatcttgaggccagtgcttatttagctgctagacagaaaaaccttgtggcagttagaatttattctttaagtgtaagggtgtgtgaattaacccttgcctggcatggcctttggtcttgtttatactttggcatcttactgggccacaaagagtctgttctatcagtcttatgatctctaatttaacattattgctggtcagttgtgcctaaaccacaaaggaagccaatataagaggcgtatctgacctctcatcctgtcatggccaggaacttctgttgataagggttttctgtggtctccttagccaaaagggagtctgttcagtcagttgaaaggcttaggattttaattttagtcttacttcatgtgtatgaattcatttaattttaaaaacaattaatgaggtaggtattaatgtagcctgagatttaagatatctactttctgaaggtggttcaggaagattacagaattttcttgaaaacacagagctagaccccaaagtagccagtgcttgaatttagctagttttggttgtgccatcataaattcccttgaggagaccacctaatctacaacttatctcaagcctctttagccaatttatagaattttataagttgacagttcttaataagttgctctgatgctttcttcatatttaggttgttttaagaaaatttataatagctaacttgagctcctcttactagacctaaattgattttgcaatctatacactgagacaaatgagactagctggccagagtcatttttgaaatatctatgctttaagtccactggaccaaagccttgtttcaaattatttaaaacactcagaatattttgatgctttcacattcactaatattcatttcagtattacatcagctactctcctttgattttcattcttaagtggtccacttttcttcataattttagccaggttttaaataattacatgaaaatgaatgtgattctatgacatttgccagggagttaattttgctcattattatattttatatttttcaggcttggaattaatatttgcacagaaacatttctttgaacatttaaagcaggatcttgttctgaatcacttaggtgctatcattaggatatgtttaattttgttgtttttttaattaaaaccaccaaaaagatttgttcattttacaagctgattaacattttaaagactgattagcatataacaacccccttaatcatgtatgtatgtgtgtgtttacacatatgtattctatatttgcatatgtattctatatttaccttcagcaagaaagtaatctccaccaccgctgaactcaacagacattgtttatgctcccctcaaggcattcatcatttccagcttgtattctagcaatttaggcatgtttttttatctctgctaaggtttttacaggtaggaagtgtgtttaattcatctttatatctcccacagtgcctagacagctttgcatactgtgagaacttgttaaatgttgttaaatgaatgacagaagaaagtaaatttggcttatttgactcttgagtctacaaattttttaaatccaaatgcagtaaatttagtctttataaaagttttccctcattatatctttcactgatataaatgtatatttatgagaatttaataaaaagcagtgtcagaggtatatttcaaccacgtagtagacagcaaagaggctatttattggtggaactaggcaatatattggtgaaaccaggcaatatgcacaatagtttttttttctcaacaacacagacagcagtaaagtgattaaacagcattgttgctgatagagtgttgagcaacaagttcaattgagatcaatgtttgaatatacgtttcttaaaagaatctatatttgaagagtggacattgctaccatcttctcttactgtgattctttattttacccatggataaatcacatgtaatagcaactcttgacctgtggcttccaatgcagcaagacacgattaacagatggcttgactcattgattcactttttcattcaacagatgtttactaagtgtaaagaggatgcattgtatgctgtgaactaataataatatatacaatttcaacagaattttgtgtttctcagatttctttttacatgcattgcctagctgattatcaaaacaagtatgtgataccaagatcaaaatatttctatttgcataatagaaatttgcagtaatgactcccatgttagaataacttataaaatggagactggaactcaggttttctgattacatatttcatagccattatattttcaggcatttcagtcctttctaggaaaagggagtatcttgaaagtatcataaaaaggggaggaggagggacattgtctaagactaattactgctaattaaacatagctatcagcagatagtgaatcagtgaagagacattttaaagagacttgatcgcccacaggacagcaggaggtgattatgacctggtcaaattatttataatctctaaaaagtaatttatcaatctaatagtagtttacagggcatagactacaaaagaggcacacacaaaagaatgtgctcattacagagttgtgcagagctgtgaggtgccctggcccaagaatgtgatttgcctcctctgtctctagattactgatagctattatctccattattttgtcctgattctatgctaaataaatagagttatgcatatggttttcttcccacgtgctggactgaatgtactgtcctcttatcagtaaatttaaaaagtgataccttgagtataatttggttttccacaccccttgataatagggagactctgcaccaagtgtatacgattccattggtagtgatggttcccattaaaaattaccaggctggcattacagtttacccttcattaggtgagtcaaactacagatgactcacccattcttgaaaaggtgctggcagatttcaaaggttgcaaagcttaaggccagactctggaatgacaaattcctatatgtcatctacccgttaggctttaagaaagccagctgactagcctgacccaaaagaacctcccatttcattgtgccctactttgaactcctaattcttctctctctgtataattattccagtgcaaataattctctcaaatgcaaatcatgttcttctaattgtattatgacttaaaaaatagttttcttgaaaggaaactgggtcatttcacagaattgcatcaatttacaatacgtcttcataacagataatacataagaatgctaaaacaggtctagaacatcttcactgaaacctgtgggaccagatacgtttaggatttcagaatattttgaattttagagaagcaattaagcacatattatgcatattgcatattacatctcagaggagtctgagctgcatcttgcaatcaaacacatacttttttttcagataaatatatgaatatctacaatataggagacacatgaaagtgaaaaagagtcatatgtaggtttaggttgagttttgatgatgaattacagaacaacttcagttttcagaatggtcatatatcagaattggaaataatggattgtgtgtgaaattattttagaacagttttgttttatttattaatttattcatttttaagtgaagtatgctgggtatatggcagatccaccttacagcagtaacttacattaagtataccctgagaatgaccccgtatggcagatgtacctgacagcaataatttaaacataccctgataatgaccttatggtctaaaaacaatgtgtgtttgcagttctgagctaaggaatctagaagtggccaacccagagattcattccttatctatgaggagcatttgattcatggcccatcccacaggggaaagaggtgctttgttttgggttgaatgaaggttgacaggtggaggttggtagggggaaggtagatactaattgaaaatgctatataaactgcatatattttacaaatggtagcagttctcctgtccatcctgccatgactagactggcctttatgtaagtcccctcaataaactctatgtctttttccctggctcttggtctccctctgcctctcaaacgtgatgccattcctattgaagtcaataggggtccagaacaacagcagggctttttttttttttaattttaaaaaatatttttaaattaattacttttaattgacaaagattatatgtatatttattatgcttatgttgttttgaaatatgtatacactttagaatggctaaattgagctaattcacatatgcattacctcatacacacatcattctttgtagtgagaacacttaaaacgtactctccgcaattttcaaaaattggcacaaatactacatgatctcacttgtatgtggaatctaaaaacatttaactcataaaaatagagagcagaatgttggttactaggagctggttgagctgttgcggagttgtcagaggttacacaattccagttacacaggaggaataagttcaagagacctattgtacaatatggtgatggtgactgtagttaacaacaatgtggatctttagtaactaaactaaactaaactaaagaccgtttagtgagtgctcgttatattttcacagtgatcgtatgaattaggttcttttgctatcttcatacaaatcaggaggaatcaaacacctaaaacattttggcaacctgaccaaagtcacacagcaagttgctgagaacaaggacgaaatcattgtcctttcccttaaacataacacacactaactttgaaagggaaattggaaaagatgtgcattgaaattgggaaatctttttgctccctcctcacttcgttcacttagaagcagttaaaaggacagaccatgaagtcagacatctgggcttgaaagcgatctcagaaaatttgtgtaaggcactttaaactcgctaatggctaatttatgaaatggcaggctagcagtccctatattatagtgttaaaatgactaaatgagataatgccatctgacgctcccctccacctcaccaccctattctctggaaaccactattctactcactgcttctatgagatcaacttttttagattccacatatttatatgtctttctgtgcccagcttattttcttcttgaaatgctttcttgacttggtaacatgataccgtattcttttttttctccattctaaatattcctgttttttgcgatttttgatttttgctctattgcctacagctgagtaattggctctacaatttgctctaatgactacagctgagtaattggccctacaattcactcaggttccaacactcagaactgtcattgatttctttatttctctttcatctcacagctcatatatcagctcgtgtaagtggtttatagctcaaaaaaccttctaccacctctataacacggtctgagttcaatacccaaagtatttacctggataaccaagggaggatgctgacaagtctccttgcttcttctcttgctctatttctccacagattagtctcatgatgatatagagcagccagagagggacttcaaaaatataacagatcatgccatttctctgccagaaattcggtgaattatgtactcctccgggctagatatgatctagccctgaataggtgctcaagttcggcagcctctttaatctctttgctctctcctcttaacacactgtctttcttcctgatcctagaacacagcaaataaaatcctgcctctgggactttttatcttcctgtttacccaacccctatttcctgaatacccaacccctatctgttgttgtagagcccatgaaataaaaatgatattaacattttgtaacgattggagaaaatcaaaagaatagtatttcctgacatgtgaaaattatacaaaattcaaacttcagcgtctataagtaaaattttgtttgctcatttgtttacatattttccgtgctacttttgcactacagcagcagagataagtaattgcaacagcgactatatggttcacaaagtctaaatatttactatgtggatatttatagaaaaatattgctggttgcatggtctagaagagttctcaaagtgtggttgctgccatcagcatcacctggaagcttgttaaagatgctaattcttgggtccctctgaatacctgctaaatcagaagtgctggggtaaggcccagcaattgcaccttgttaaaacctccaagggattcttatgcagactaacatttgagaatcaatgttatagaatacttaaatggttaatctcttaccatgcaggtaatccaactccttggtgaactatttcttgactatgctatttaaaattgcatccctgttttcttttttctctgctcttcattttccttcatatcataaatcactatgtaacattacggtaaatataattttccttattttattttcttcttatcctctctagaatataagccatagactttatcttgttcactattgaattcctagcacatagaacagttcctgacagataagaggtgctaaattttgttaacaaataagtggatgaataaatatttaaatattgtatttttaaaattaatgttacttcaaatagctaccgccagccctaagtgtaataatttgccttcttctattttgccataggagtaaaaggaaaatcatctttctagtttctgactttgtaaataaattatatatttttgtattcagaagcagcccaggtctatcttcaaagacttacaaaagtctgtaacttgtatcttctacgattagatgtagaattcaagaatttgagctataatgctagaatataaccaaaatgctcacaggctgagaatctctggtggatttcattattttgttaagtgtttgaaagaacgactattttagaacgcttaggcaatgctttaggattgcttataaagagattacttaaacattttctttgtacatataaatatattgtacataggtgtgcataaaatgagataattttaatcatatgataattctaaataaaaatattatgcatttcaccaaaatcatctgttgatcaggaattgactctaaattctttaatttttattctaaaaatgtatgagacagggtctcgctatgtcacccaggctggagtgcagtgatgtgattataggttcctgcagcttcaaactcctaggctcaaaagatccttccacatcagcctcctgaggggctagtaatacaggtgtgtgccaccatacctgattggtttttgaaaattttttgtagagatgggggtttcattatgttgcccaggttggtctcaaactgctgggcttaagcaattttcttacctcagccttccaaagagctaggattacagttattagccactgctcctggatgactcaaaattcttatcttcctaaaccaactttccagtcaagcattactgctttcagctgtcatgcacactggcattgaacatcaggatctagtaatgttgacttgtacatagttatttctgtcctcattcagtgttacctgaatgttttctttcatccattctggatcataatctagtctttgttctcttggctatcaaagttgttcctttacgtttttttgtttttcacttcttactctgttttcacatatattcacagctgggcaatgactttatctcaccttacatgaccctgcttgattcagatcccccatcctcagcccctcaattactatgtgatcttggtcacccttggttaacatttcattttcaatttacatcccgaaactagaattttctaaaattcttgctttactccattcatggatatctatacttgaaaatctgccactgtatggctctgcattatggtggtagataagaaaaactcagacctttctctcataaagatgtgtacatttctatttcccactatctttattgtgattaacatcattttttaagattcctgtattttcatgttttatctctgttaaactattctcaacaatgaaccataaaaattcttctgaaatacaaacctaattatgccatttttgtgctgaaaacctcctaaaaaaatgtctcccagttaacatcaggtaaaatgtaaagtacctaatctgactgggaaaaaaactcttaataatcaatttgccttcctatactgactttttaatacctattttttcccactgccatcacccgcacccccagaaaaatccaaaatatttcagtgccatttggtttcagggctccaatcctactgaacaaattttatgtcatgtctttttcatatgatgggaacttctttgaggccaggagctattcattattttagttgtatttccaggacttagtacagtacttgaagtgaagtaggtgcttaatagttgaataaagagggaatgaatgaaagataaatgagaagtaaagaaaattgagaaccttaaatatatataatatgtatataaacatatatttaaaaataagttcaccatcaaatatattgattttttatttcttcatctcctgttctactgaataaatatttaatgaatgttttctaacttctcagcattggggctgtgatgtggcaggtcttagctaattgaggtgggtcttagaaaactcctcctttgaaaccttgctctatatccactcttggatttgtgtcacattttgataccattgtcttagaatttaatctgaccctagccccgactctaccctgtaatggccaatactaaatatgactaattgttggtttgggttttcttaataggccattatgtctttattcccccacttaaatgagaaatatatatatatatattttaggaaaggcgatttcattgagaggcttttcttttttattcactaaatggaagaaaaatatatatgaccatttaaagaatcatttaaaaattttaaatgtctcataaatacaataaaatgtactttattattctagttttaaataatccatcttgacatttaacacaactactttcgagtcataacttgtcttgcctggataaatatgacaatatcatttctactgtagttcattctttcatatacaagagtaatccttagattagttcttattacaggaataccaaagactatattccagtttctaatttagcaagtcactccagtttataatatagtcacctaactaatttatagaataaaaagaaaatttgcaattattgtaattgtatcctagggaaaaagcacactcttctgttgtcactatctctaattttcccatcatctttttttcttcagctggctactacaaaatgcagtacagacagagtttcattcaatttgatgtctcagcattttactatagtaattttgtgatctttaatttttttaatattaagtctttctctgttgggcactacatttcagaaaatgacacacttaaatctttcaagaacaagaaaagacatttgcctttatgcaaacttaaagtggcaaaagaggcccgtagaaggacaggaaaatgctgggataattttgtggctagatatactggatatacagtggcttaacatatacatcataattatagtttgacctctcactaccttagcttactgaagtaacaagtggaatcaagatatttgaagtttctttcaatatcatcataacccttgaatttctatgaaaaaaagtgttaagccatagccagattcagttaactcaacacattatttgatccgcctatatcacaggagtggtgggaaagctaattaaaaatggccacagggaacttctaaatacagtaggtagctgcatagagtaaaagtttttttaaaaaatagcatttagttaagcaacaggaattattgggcatctgtaatttaatgtttctaatgtttttcatgaactccccctttcctcctttttaaatcattgaactttcacattataggtaaatgtgatagtcattttttaagataaatttataaacttattaaacaatcagcaatcagttttactaaatagcaagtgtaagccatgatttaaattactcttataatgtaattttaaaagtctaatatgaaaaaaagtcagcttccacagatgtttgagttgaaagcttccacttatcagtctcactctaattgcaaccaaattaatactattcattttgatttatgggcaaaatactaattttgacttggctgcccttctgggaattacacaaagcccagcagtagtgttactttttcaccaaccaaaactgaagtgggggtggaggtcaccccagaacatggtagaggcaagacatatccaggaactagcccactgcttaccatcctaaccctttaaaacctgatttctgttttatggaacaacatgcactttcttgaatgtgatatacctctcagactttgaaagttagcataaaacaaggagaagcttctttctttttctaagctgttcctcttccccaatgtcacttcctgcatttttttgcctctcacactttacctagctaacatctatttgtgtttgatatttggttcaaagatcactttccagttatcctcttctaatcatctgcaatgaatttagtaaaagaactactcctgaaacaaaaaaagtgttgacgacagctataattgataagtgatcttaaagggaaacttgagagctaagaatcaggtctcaagtccagccatcgcatgtctgtttttagtgttgaataccttggattatctctgattctctgtactgagaaaggtggctgtgtccttatactcttctcattcaagtaaggtgtttctctgttggttttcaaaatttctatttatctttgccatgtttgtgtgttcacatgtctgactctcacactaaacaatgagcttcttaggaacagaactatgtcttgtttatctttgtcctataatgaagcttaacacttggtccatctccaggagacattagataaagaagtgaaagagtaaattaatgaacaaaatccccatgtcaaaccaatatcctcagtcatgttttcatagactgatattttctatagtgtcctgtcttctttcagtggtggtagtgggctgggggaggagagtggcagatgacaaaacaggaaaatgagaaaaaaagatatacctgaaagctgttgactagagtctggacaaataatcaaattgacacaatttattaatcaactatgaaagtaaccaaccaattaacgtgtaatagactctataacagggactcttacatgcattatctattattattattattagagacagggtctcattctgttgcccaggctggaatgcagtgatgtgatcatggcttactgcagcctctaactcctgggctccagtgatcctcctacctcaacctcgtgaataggtgaccccactaattttttgttttccttttttagagacaaggtctcactatgttgctcaggctggtcttgaacgcctgggttcaagttatcctccaacttcggcttcccaaagtgcacgattatgggtgtgagccaccgcacccagtctgacatgctctcttttagtaatattaaagttagtggaatgaaaatcattttatattataacagtaatataggtgttactattatcattgatagtcacacacaactttgcacagtgcatagattgaacttaaatatgttcctttagtgtgatgagagattactttcatttaatataaagagctgaagtagaaaacatttcttttcctgctctaaattttcaaataacaagaaaatactggaatacagtaatcttgtaccttaaacaaatatgaccacaaaaaaatacgtctttccatcctagtgggaaataactggggaaatatactgcccagtgcccagggagaatttaattctctttcaggaggctgctgatgcatatgctacaaagttaactactgtaaagttggtcaataaagccaatgttttaaatagataatttctaattgtaagggaataatttattccttacgacgagattatcgaactcacttataattagaagtaaatcctttcaaggaaaccttacaaagaattggtatctgcccatttgctttctggtatccataaggtcagatgaattcacacatatatgctgatcttccatgtgctcatttgaaaacaatttgaaaaagggacaagtgaaataatatttgattagaagaaaacaaaacttatataatccaagtaaatttacctttatattattttcagaatgtgccctgaaatatttttatatgtatgagatgtaatattactgcattaaaattttgagagctgctgattccagattgacaaatactctggggagtaaagctttacttttgaaaaaaagaacatctagttttgagcgcaggttttgttatgtttaatttggggcttatttttagtttatatttttggggtttttttgtttgttttggcagttgaaggtcaatggtaaatcttgacagaaaaagctatggtaaatagtatacatacataatatgatatatttgtatacataatataatatataatataatatatgatatattattatataatatatattatataattatatataataattatataatatttaatataatatatgatatatataatatatcatatattatattatatattatatattatattctattatattatgatattatatatatgcatttgaaagacttcaaggagctccacctaccagtctcagggctatgtcaatgtctccaactgtctgttaacagtcttgctcaggtcatgtttgaactttttctctttgatctgagtgtagcttttgaagaaatagtgattatcaaataacctggcaacagaggaaacaaatcacaaatgcctaatcatttgtttctttgattcaaaccaataacctgtcttcttaaccttgatattttttagaaggaaatttgcaaatcaaagtctatagtcacacacatacaggaatctctatctccacattcagaaaatataaccagtcttataagaaaatattaactcttcaatattttccattttaaaaatcagtttttggcacagatactttccattcctatcctttaatcctgccccccagggggagtgctttttcctgtttacgtttgttttttaagtgtgtggcctctgccatattcgtgacatcctgccatggtgctcccaactccatggttttgtaatctttgctttcatatctgctatctaatttagtaattctttcttaatagctcaatatttatcatggtttaagatatttatctagacataatttttagagacaaaagtgaattttgaatcaggtcataaatcccaatttaaaataagtcattaaaacacgctgcttctaattaggactttcacctatctgttaagtgtagaatttaactccttaagaaatataaaatcagttcttaacttgtggaaattctgttcacaaataattttcattttgtgttttctcataaacattagtaattacagcaactggaccactgactgctatgttcatccacattaccagttagctctgcaagcctctgaatccccccaggaaggataggtgcttctcctctgtcaagctctgattccccattgtggcccttgtgctctgtattataattgtctgtttacttctctgtatccccattagactaaattttatcaaaagaagaaattatgcctgtattcaatcccccggtgtctaatacaggtattataatatctgtttcataaatgtgtttcaaattataaatgaatatcaattaaacagtcaaaagaatgtgtcataaatcacatatacatgttctactatctgctaagactgatactttgcacttattgagactatatcataattcagccaactactgtagggaaaaatattgccgttttcatcccattatgcaagtaacattcttccactgaaagtgtgtgtgtgtcttttaatgaacattgaatcctgctaaatgcgattttcatcacgatagttaatgagagaaagaaaatctagataacaatagtttttctccacaggattaatattataactaaatataataatatgtgtaagagtgtctgatatacaacatcgtttattcagttggaagtctttttttttgtctttgtcttaatccatctgtgctgctctaacagaatacctgagtttgggtaaagtgtacagaacggaattctattttcttacggttctagagggtggaaattccaacaccaagtcagcagcatcttgtgagggccttctttatgtgtcctcacatggcagaaatcagaaggacaagctaggtgaacccttcattaagcctctttactatagccttaatcccattcacaagggaagagccttcatggcctagtcacctcttaatgtccccatcttttaatactgaattttgatggggatgttttcaaactatagcagccttttagtaggttcaataattgttcttgtttctctgtgtgtgtttgtttcactttaagactttttttcttttgaagtacaaataactggctaagtttctttaataagaaatatcatttcttcaacctttactcttctagaaaatataccatgacattcacttaccaaggtgtttgttaagtaaaagagtttatttttagttttactggccttaagttgaaactggggttgactgaagaagtttaaggagcaatgctaatcaacccagaatagaaaataacaagtatttgcaaccttctcgtgaagctcttctcctgtggtggcagttctgcccccttcttgccccacttaacatcatgatggggaaagtagaaaacatctcccaacaagtaaaccttgacctaattcctgaatagagacagcccagattaataaacctgtcatcaccaaacctttatagaagtcatgatttcactgagattctggaaggatgacttttctttatatatatataatgatgtcaatatcatctatatctatattcacatctatatccatatctacatttatctgtatatttgagaagaaaaaacaaacaagtcttagaggcttttaaataaaatataaagaagagaaatctacagataaatattttctaacatcagggctttataattcagtagaaagagaaccaccagaaactttttcatgtcaggtgtaactagagtctgatattgggaaaatgggaccaaccacatgagtagggagccagttctgttgtgatttttaaggtctattttaaagacctccgtgccctgaaatagctcccacactggtacttgaaacccctgttagatatcttaagccctaaagattttggtcctcatatttccctattaaattgaaattgctttacaggatgtaacaccataggaagcaccagctaacacctgatcagggaatactttccaatctggcagacagctaattaaatgagatagatcctatgggaaagtacattgaggatggggtgcttataaaggggagaggcatactgattgagaaggcaggatgctgaagaaaatgtggtctaattgaaatttatcctagggatacatgtattggaaatcaacactattttcttttctactcattccatcatgattataaccagggatgtatattaaaatcatctggtgaagggagggttattaaaatcacatcctaagctctaaaactgactgagcacatcagtctctggaggatagcctgggtctgcatatttctttaaacctctcaaggtgattctgttacatacacaattgccataaaaaccaagcaagttaactatcttgggctcaattccatttgccaaacatttgttggaaactttctacatagaaggcacaatgttcaggtaatgtgaatgtaacagatggacccaacgagaatcttattttcaagattataatctacctggaacaataaatcctgagcattagaaacacaggcataatctgttagcattataaaatgctacaaataaaatgtagaggggtagagtacctttgaagagaacattcaggaaaggcttcctggagcacagattcaggccccttcttcattttccgtaccttcgcctggtccctcacacaagagtccactggcagtctaccttatagccttaatcttctttgtgtccctaagctctgctaaactttacaacaataaatagtctcagcaaaacatgattcaagtcactctttcttacatcttgccccaggataaggataggctaaccaagtattggatgccggggtcttcgatttctttctttctttctctctttctttcttctttatttctctctttcttgtttctctctctctctctctctctctttcttctttttttttttttttttttgagacggagtcttgctctgtcgcccaggctggggtgcagtggcgtgatctcggctcactgcaagctccgcctcccgggttcacgccattctcctgcctcagcctcctgagtagctgagacaacaggcccccgccaccatgcccggctatttttttttttttttttttttttttgtaattttagtagagacgggttttcactgtgttagccaggatggtctcgatctcctgacctcgtgatctgcctgcctcagcctcccaaagtgctgggattacagatgtaagccaccgcgcccggcccccagggtcttggatttctaacctagctctcatctgatcaacacaccaatgtgttcatttagacaatttaaaaaaggcagtttgcttgctctgaaagacaagaatacataaaatctcatctttatctttgaagaacacttgaactactgtcagtgagaccttggttttaggttctgaggtcatgctttcctcttgcttctctcacttgattttaggaatgaactgctgtggcatcagccatgcctcaaccccagtcccccataagtacaactgtggtctttacatgagttctttaagaatggaccacttgtccctgaattccacaggctgagttctacctttgatttgcattattcgtaagggcctccaagacccatcaacatgaatatctcctcagtgccaggaatagaatgtaggtaagtggattgaacaaggacactagacataggtaaaaaatttaggggcagcattttagttcgcagtacaatcaagattctagaaggatgtcatttgaaataaataaacttatttctgagcaaagactagcagatggtgggataaaagtatcctctcttaatatgttccattcctaagagttccctaaatctctagcataccacaattgcatctgttcagccatctagcaaatattctgtatttgcaagcgttttgcaagcagctaccagtgtttaatcttgggataatgccttcttgatgtgctaaccccaagagtaattcaaacagcctaaatgtgaattactccttgtaaaaaggaaatgcggctgcttggaatcatgtctgtctgtaactgaagatatgacaacattgaaacacacagccgtgtctgtgcaatcacagtctgtaagtgtaaccctggccacaagagtattaagagggaaagtgtgtacaaaactaatcagaaattactgtcactaataaaacacaattttcaatattattccacactttaccagcgagtgagaactattctgttgacatatataaaaattaaaataaaataagcagcatgggatggctgacatattggatagtaaatttaaatatcttaatttaactttctaccatctaatttttgtgactcagtttttttagtagtaagagggaaaaaataatgctcattctactctacatccctgaggtttcaataatactctcttatcattgttcagcaatttactacttaaaaagcatttttgtgtacatcttctctactgaggctctgaatacatttttgaagtaggaaggaaagacttctccttttttggagacagctttctcaactataggggtgatttgctcccatgtgcagttggttaatggcaagaacattgactcaactattggtgtttattattcccagttcagtacttgcatcattaagggtccttttgcttgtaattggcagaaatcctacctcaaaatggcttgaactaaaacgaaatttgttgcttgatagacctaaaaagaacatgagtaggtctggctttagttgctgcgaaggctcaaatgaggtcactgagatccatgtctcagggccctttcctctgagtgtcggtttcatcatcaagctgcctctcttcatgtaaccaattagctgtagcagtcccaacctcctaaactcatcctacgcattccaaacagtgaaaagttttctttttcagaagctacaggagagctttcttttgatcttcttgttctgaatgtagtatttgccctattctggaccaatcattgttacctgtggaatggacagtccatctggcttaagccaacacagtaaatgatggagaaaattttacctaaatgtaacaattagaagggtgatttctcacagcaaatatgggaagctgttgccagaaggagggagaattgatgttaagaagcaaaacacaaataaccacaaaagagctcctcttctctcctctcctctctcccccaaccagaaaaaaatgcacactatcacctaatggaatgaaattatgcagtacatatggacataagtttcataagtagaaaccaacaggcaaacattgatatttctgtctagttttatacacacacacacacacacacacacaaaaccccatatatccatatgttaaggttatgttaattccttcagagatcttctggattgtgtggatagctgtggtccttcaaacatcaatgagactttcctgtaagcagagttcactacaaatccgattcattacactggaaaagtgaggagatatttgcaatactcctaactgacaaggcacttgaggttatactgttacctcaaatcaaaatgcttctaatcccacattattatgtcaggtttccttttatccttctgtttcctttcttcctgtatctctctctttttacttattttcttcctgtatatctctctcttttcacttttttttaaccttcctttcattcaacaaacagatattgaaggcttcctaagtagtaggctctatattaagagctgagaaaacaaagatgagtaagccaaatctttggcttcaaggcaagacaaacagctacacagagagttgtaatttagtctggtacatactacaaaaaaagagcgaaatacttagtactatgtgaacagtttatttacttgtgtcaatcatccttcccctgccctctccccagaccttgtcttgataatggtagtgatcttcttctgtgttcccaatgagccctgttcatacttctgtttatctcagattattttgtgtctttaattatttgccaaccacagacactaccagcaacagaagcaattagatagaattttaggtataatttgccatcagtaacggatgtgctttttcctacagtttctcatagtgatggaggattgttcttacccaaccacactttctttggaaacaatgcttactggggagcaccaaaagtgaaggctgtagtgtactgctcatgcaaggaatttatgttttagtttatgtgatcaatgagcaaatattcctgtgcctcctgccccgctctataccatcttccctcgcacacaatagcaccaataatccactttcagtgtctgagcttcctggctggaaaatcaggcatcaaaactaaaattgaaagtagagtttgacactttccaatgccttttttttcattgcttttggatttccacacataatacaaagaagggagagaagatagcctctaatgtcctactgaaatctaatcattccaaaatagccttttgaaagattagatggtagtgatttaggaaggagtaaatattgattataattctaaattgtactgctatgtttgcactccagtgcactacagatcatattcactgaaaaattacttaagaagacataagtttgctcactttatccaaatattttgtatacatttttttctgaaggaatatttttgggaaaataatacttctacatacaattctgataatggaagaatgattatgtcttaattacatgtaacagacttctcttagagaaatacatttcttcatgctaataattattcatttttactgtattacaggctctaccctataatatatctgccagttgaaagttgctttctactcttcaaggtgcaagaacatattaattcctcaattttattctttgtcagttttgtaactatcaagatttcttactgaactcgaaacttattcatatagccttcttaaattccatggatcaattaaattatttaaaagtatatttagttcttctaaaacatcatgttctctggactctatggaaacttttgcacatactgttcattttgcctggagcattctactgctcccatctatttgcctgtttaatttcctttcaatatgtagcttccttagaagtactatttttttccaggagtctcctcttgaattccttttacaggttacctcctaaaaatgttttctagcacctttctcttgtctctatattttgtactatggctgcctatttatttgtctgtactcaactgggcttaattccttgagagcagaggtaggttttgtatcatagaccttaccacagtgttggtatataagaggtattccctagatatttgtcacatgcataaataaataaaacacaaatgattgtcattgattacatgctagctaacttgccaaatccaaacatgatggatttatttttggttactagatggtgaccaaaatcctatgtagtaagtctatataattggctaatatttcccttaatttatagtatagaatcaagatgtagtgtgaggatatacagttattttcttttcacagttcatgtcacatctctttttctttaaaataaaatatgttttgcactttccttttgtttggtgacaccatttattcaacctgctttaatatgggatagaataatatttctttaattttgtcctttaagtcttgtggactttcaaataatgactgcaaaattaatgacagtaactaataaacattcacctccatgaggtgattttgtaggctcataaggagcctacaaatgaacaagcctgatgttattacactttgggacattttgcaacaaatattattctgtggctacttgtagattgttcagtccatcagtaaaattttttctgaaataaatatataactcatggtaagtactaaaacatttacttgtaagaggttttatttcatgctttgagtttgttcatgaacatatgctactattagaaagattgataatcgcccaacattaaaatggctacaaattcattctcaatttaaaaaatcagatatttctggccctccataaaaataaacacaggaaattactattgtcaaaagttatctctaactaaggtgttcattaatataatcttagcaaaatcataccacttcagacaaaaccaccagaaataggcatcccatgtttaataaaaaaaggcttctttcttacagaaaaagtaaagatactgtgtcaaagaaaaaatgatatataaagaagttaatagggtaactgcataaatgggtccttaaaataaagaggtccagtaaaatactgtaatattttatttttttaggtctatttataaaacaacaaaagccaaaattgacaaatgggatctaattaaactaaagagcttctgcaaagcaaaagaaactaccatcagagagaacaggcaagctacagaatgggggaaaatttttgcattctactcatctgacaaggggctaatatccagaatctatgatgaactccaacaaatttacaagaaaaaaacaaacaaccccatcgaaaagtgggcaaaggatatgaacacacttctcaaaagaagacatttatgcagacaaaagacacatgaaaaaatgctcatcatcactggccatcaaacaaatgcaaatcaaaaccacaatgagataccatctcacaccagttagaatggcagtcattaaaaggtcaggaaacaacaggtgctggagaggatgtggagaaataggaacacttttacactgttggtgggactggaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattgcgacactattcacaatagcaaagactcggaaccaacccaaatgtccaacaatgatcgactggattaagaaaatgtggcacatatacaccatggaacactatgcagccataaaatatgatgagttcatgtcctttgtagggacatggatgaagctggtagggacatggatgaagctggaaaccatcattctcagcaaactatcacaaggacaaaaaaccaagcaccgcatattcccactcataggtgggaattgaacaatgagaacacatggacacaggaaggggaacatcacacactggggcctgttgttgggggggaaggggggaggaatagcattttgagatatacctaatgttaaatgacgagttactgggtgcggcacaccaacatggcacatgtatacatatgtaacaaacctgcacgttgtgcacatgtaccctaaaacttaaagtataataaaaaaagaaaaatataccactctatctactgtttgaataataatagttcccaaaagagagagaggactaaagagagaacaaaatcatattaattagatgactagtcttcaaaaattagtttaatggcataggatgatttttgaaggaaacaaatgcaaactttcattagggaagcccttgtgctttaagaagatgtaaatagcacacaattgtgctatttctgtgtcaagggttcttagcgtagaccctaactaaatttttgatattttttttgagcacagataatgaggacttgtggagttctccaaagtgattctgtgaagtaggaacaatagcagtgttacacatagtattcctgatgacttctaaaaatactatgtgacatgatctgattagttggtatacttttgtccatttcaatttttgaagagtttatacagacattaaactgagaaaaataatatgtttgtatatcaaagatacctacaaatttggggtcacgttagaaaattattacatggtgctccatccccgagcatatgcccttgacttattttgaatcacagagactgaagtaaggctttggttgtcctaatttactaataattctgtgctcaaaaatttccagtgattctccactgtttgcagaggaaaatacaaaatcctcttaggcctatttggcccttaaaaagccagtgccacctcaatatctctttcaccttctgcttttcttcattgtatcccagcaacacgactcccttgctgttaccagaccatagcaggtgcactcctgcctaaatatttgaacttgttgttcttccagcctgagttgtttttctcctgagtcatacacatgactttgcacaaagtcactttgttaaaaagatcttcactatctatcttgtttcaatttaaaccaagccacatctgtgtactccttctcctctgaccaactttatttacctccatagcatttacaggcttccactatacaatggcatttatttactgtggccaacagactttcaaggtggtcctaggatccctgcctcctgatgttcacttattcatcatgtttattgattatatgtttctgctagattataagtttcacaaaggcatttttaagtcttctttatttactcatatatattgggtacttagaatagtacacaatatatagtagacacaataaatatttgttgcatgagtgaacacataaatacattatttttgtctgccctgtcagtggatttatctatttattttctttggcttactccctatgctgtgattacaaacacttgaggccaaagttaattccaagactcatgtgcttggttaaggaaatttatggctaagaaacattaatgctgtgtcaatagaatgttccacattttggcatgtgttatacatttgtccctcggtatctatgggggattggttccagaacttctcacagatactaaaatccatggatgttcaagtcccttatacaaaacagcatagtatttgcatacagcctacacaaatattcccaaatacttttaatcatctctagattacttataatacttaacgcaatgtaagtgctatgtaaatagttgctagttgttatactgtattgcttaggaaacaatgacaagaaaaaaaatctgtacatgttcaatagagatgcaatttatttctgaatatttttgacccacagttagttgaatccatggatgtaaaaaaatcatagatacatacagagggatgactgtattttgtttggggttattactaatttatgaatttccactttgcacagtacctagtatggacatttcataataaacttgggtggggtttcaaataaaagcatataatattttataagggagcttcaagaaaaaaaaaagaaaactaagattaatcacacttgaccagatgccttccagaaatacaaaggaaaggaacgattaagtaatcatagaagaaacatgatcggtaaacatagaaagctgcagcttgtactgtagccccattccccacctggggacagtttctgaaggtgggaatctgggtgcaacttaactgagtgtctgcacttgaggtttctcaaaaggctgggatgaaggtgttggctggtgtttctgtcattagaattaacccaagggtgagctgtgaaaggatctgcttcttagctcactcacatcattgttggcaggattcagttctttgtgggctgttcatctgaggacctcaggtcctctccagctgttgctgggagatctccctcagtgtcttgtcatgtggacctcaccatagggcagtttataacagaacacatggattacctcaaagcaaaccagcaaagaattacataaagccagcaagacagaagtcatgctcttttggtaatgtaacctaggaagtgacattctatcacttttgtcaaattatattcattggaattgagtcactgtgtccagcccacactcaaaagtatgggattacactagggtttaattagcaggaggttagaaatttaaacgcagctttattgtctgcccaccacaagtataaaacaaatgagtgactatgttagtatcattgggtattaaaatttgcagcactggagaaaggacgtacaggtataaggttaaagaataaggaaaaagctattcatactgaaatggaaatggaaatatgacttcgtagtgtatgtgatatatatatatatatatttctgcccaggcctgtggcccactatttctccaaggagccttgtcttttttttactaggaaatataattcagagaatataatctggatgtttgaagtgctcattagtcttaaggccctttcagtggacaaaatgggaatgtatatatatatataatacatatataatatataatatattacccttaagacttaagtcttaaggccctttcagtggacaaaatgggaatatatatatataatatataatatattagccttaagactaatgagcacctcaaacatccagattatattctctgaattatatttcctagtgaaaaaaagacaaggctccttggagaaatagtgggccacaggcctgggcagaaaatataaaaaattagcttgaaagaacttggtatagcaggaaacaaggccactagaggtatcaaagaaatttagaaaccaactagaaaaggctttcacagttcaaaaataagaaaatatgagcataaatagaactagtagctatagtgaatacaaagacataaattccatttaaaattatgagttattacgtctcctctaaggaaagcttgagaactaactggtcatttggaaaactgataaaggaaaagaatcaaacatatatcctgcttttcatatacaaatcttaagataacccagtgtttctcaactgggtttttttatctttgcccccagggtcattggcaatgtcttagataccattttagttgtcacatctagggaaatgcgttactgccatctggaaggaagagtccaggccgggcgtggtggctcatgcctataatcccagcacttcgggaggccgaggcgggcggatcacgaagtcaggagatcgagaccatcctggctaacacggtgaaaccccttctctactaaaaatacaaaaaattagccgggcgtgttggcgggtgcctgtagtcccagctactcgggaggctgaagcaggagaatggcgtgaacccgggaggcggagcttgcagtgagccgagatcacaccactgcactccagcctgggcggcagagggagactccatctcaaaaaaaaaaaggaagagtccagacacgtgactgaatatcctacagtgcacagaacaactcctcataacaaagaattatctagtccaaaaccgtcaataacaccagggttgagaaatcttgagataacgatatacaatcatgcaatgaataacgatatttttggtcaacaatggaccacataaacaacagtggtcttataagcctataatactgtgcttttactgtaactactctatgtttaggtatgtttagatacacaaatatttaccattttgttataattgtctagttcagttcagtaacatgctgggcaggtttgtaacctatatcgtatagcctattataccgtagagcttatgcctgtggtaggctgtgccatctaggtttacttaagcatatactttatgatattcaaacaatgacaaaatcatctactgatgcatttctcagaatggatcctcattgttacgcaatgcgtgactgtagttgaagagataaagtttttctttgtgcaagtattccagctaatgaaagtagaaatatttaaagtaaaataccattttttgtaatctctaataaaaggtggattttggtattcattattatggctgttaacactacataaacatgaaagagcaaaacaccatataagccatactttgtcaataaactgcatccatgtctgatgcagaaatgtaataaatggtaccagcaagttgcaatttgttaaatccatactttaagatactctactggaaagatgtcacagttttttcaagaagtaaattgcaaagaagtaatacgaggcaatgtgacacatcaaccatttgcaagagatggaatacatttgctttcttattgatataataagcagaaaacaatttatgaaaccatcatagaaatttgaaaaaatagaatatttgactatgatattgagaaactatttaggatattctaggcctgatgatgatatagagtttatttagtgtttatttttttaaaagcattctcctgtttctaagacacagactaaaattgttacaggaatatggtatgatgttggtagctggttcaaaataatctagagtgaaaaaggaagaaagtataggaatatatgtgaaacaatttgaatttatcatacagcattctctttattgtatgttttcaaaatttggcataataaaagtttttaaagtttacaagtttctatttaatccctactgtagtcatattaagggaaaaaacatataatgaaatagcaacaaaatattccataacatatatcaacttgacacaaaccttaggattacttgctttaatgtggaattttaatcatattgtgtttaattttaaatattaatttcttagtgttctgcttagattgaaaaattttttagcactattcattttaagagttgctttattgctagataatggcccataaaataagcataacttgtttaatttacttttcatcgcctacttaccatttaagttttttctacttttcagtgttataaataatactgaaataaatactttttgcatgtaatttttttttaaccaagctcatttattttagggcacatgggtcttttataaatccatctctttggaataattcccaaaatttaaataactgaatataaggtctcatcattctaaatattactgatacatgaagacaaatcactctctgtagatatgaaaaatgcatttggtaacaaaaaattgaactttctgtaacaatcacctaaacagggagtgttctgtttatcttacataatgaaaagttcagggctagtagcatggcaccatgcatggtgtcatcagtaacaagtcccttctatcccttctgccatctctaatgctaccaatggtcatgattggttgctgaagcaccatatctgagggccagactggaataggatggaaggggcaaaactttctttcaaagcattatctttctatgcagataggcggctaattcctaaaagacttccaacttctcaacagtcagaattgtgttgcaaagtcatgcctgactagaaggtatgtaggaaaatatgagtttcattttctaatctgcataaaaaaagataaggtagatgaaaatggaccccgagtgagccaattcatagtataagagcctgggttcaggaatcccaaagtgcaaatgacaaccagtctttggtacaatcagtcacattccacttaataattacatataaaatgctatcttgtttttcagctgtatccattaagctgtcaattagaataattttttatctttattaattttattatttattttctaaattacctatacatgtgttttgtcattacctaactaggtaatttttaaaacatttatatcaacaactttatgggtggcagatgttactgtacttaagaggactgagaggtcagaatctgaaattaagttatctggttttgtgttattgctcaacctcttagcaatcatgcaaacttggaattctcctgggcatatagcaagagttctgtacattttagtttattgttattttcattgtttttgaaataagaagcaatcactagaaaactgaatttttagaaaaaaatgttgagaatttctcgaaataatgttttctactcatcctccatggaaagagctttagctctggatatattttcctactttttggcattcgcaagtttttcataatatactccattatacagtgaactgatgagctcagaaaataccgggtaaactcttcagttttaaagtgttaataatagacatgaagtatcatcattctgctatagaatagtttgatttttaaccaaaaccacttccttattccaatggaatgcatattttgcaatttgatgtctttgttagcaactttctgatgggtgaaccattttagcgaaggacaatttccagaaaccatcaagtaatactttagtgatgattgtacaatttgccatcacagttcatataaacttcttgaggttatttaactaaaaatgaatcagaacaaacaagtattttgaagatttgcttcaaacttgaggaaattccagccttaatcacatatacactcctggtggaagttatactatatttggctatagacccagggatccttatagatgacaaaggcaagtgttaatgagtccattattagtgttggttgtttttattaaaatttctcagagctccaggaggtgaactagtatattctttttattttagatgcttgatgttttaagtggaatatgaaacatctttgaatcacagcggcagactcttgaggatgattaagcatggtgtctattaaaaaactattccaattacaaaaagacctgtgctaaataaaactacactcacagagtgaggaatttggtatttaacaatctttaaagattttcatttatattccttaagtttttcttctatattttattcattcagagtaaaccaacatctgaaaattaaggaccaagttagagaccttccagtttcaaagacaagtttcttgtaagaactctctgtattcagtctctccatttcctgactttttatacatttctcagcctagtcattaatttaatctattattctacttccaaatgtctcatgattatcaccaaacacatttttctaaatccactggatattctccaaccatcatattacttggcccctaagtagcatttacttttgttagcctggatctatatttaccttggtttcctggttatctatcttttatgtttcttctcttatgttaggcaatccattttctgccttgtttggaatcttaccttctctactgattggaattcctcaaggctccctctaaagattgttttcttttcattctataatatttccctagataatcatatatgtaccaattgacacctataagtggataaacaagaagtttatttcttaaggccagatcttacttttagcccaagatatgtatatccactgcctccttgacaaagtcttttggatatctcaaatctctacatggtctatatccagctctcctttcaagccttggctcctcatgtaatagaacctgtttgaatctagcttctaagacagtgattaaaagtcaatcctggccaggcgtgggagctcacacctgtaatcctagcactttagagaggccaaggcaggcggatcacttgagaccaggtatttgagaccagcctggtcaatgtggtgaaaccctgtctctattaaaaaaaaaaaaattagctggcatggtggtgcatgcctgctgtcccagctactcaggagactgaggcaggagaatcacttgaacctggaaggccaagttgcagtgagccgagattgcgccactgcaccactccagcctgggcaacagagtgagacaccgtcaaaaaaaaaaaaaaaagtcatccctgatatccatctccctatttcccctgttcgattaatcaaaaattctcttgaatctacttgttaaatgctactcaagctcatttacttcttagtgtctttcactaactaacaccaattttcttagttcagctgtgatttaaccttttcccttaatgtatctacaataggaacctaaatcatctacatacatgtaccccccagcttccctgcagtccattctttgcactcagccagagctataattccatcacattgatcagatattgatattccttgagcaaaacacttacaggctttcctttccttttagagtagcacaaatttgccaactttcccatttaccaactgatactgtttggctacatccccacccaaacctcatcttgaattgtagttcccataattttcacatgccctgggaggcacccagtgggaagtaattgattcatggagcagttacccccatgctactgttcttgtgagagtgagtggtttctcacaatatctgatggttttataagggccttcttttcctcccctactttgaattccctttttattaactttcacttattcctcagatttctgcatgctctctgtctctctctttttctctctctccatgtgtatgtgagtacataatatgtacacacacagaggtgtatgcacacacacacacacacacacacatgcacacacacacacacagagagagagagagggagagaaagagagataaagaaatctctccacagtgacaaatgcatattttcttataaggctatggatggctgcctgtattcccctttattctttaagctaaggctgtgactgtgcctggcttttttttttttttttctgacggagtcttgctcttttgccagactagggcacagtgctgtgatttctgctcactgcaacctccgcctcctgggttcaagtgattctcctgccccagcctccagagtagctgggactacaggtgcgcaccaccacacccagctaatttttgtatttttagtggagatgaggtttcatcatgttgatcaggatggtcttgatctcttgacctcatgatctgcctacctcagcttcccaaagtgctgggattacaggcgtgagccaccgcacccggcctagctttattcttctctagaatttagcaaagtgcttgggacctagttaatatctgagaaaaatttgttgaaaaaataacaaataaggactcttagtccacagtacagttatggatcactacattaattctacttttatgtaaatatttaccctttaccaagttaaagtatttttccctataaggacatgtttgctaagtgaaaagaagtatagatttgaatgtacacaaatgtgtgtaacaatgatttataagcacagagaaaactctcatttattgatagtttgaaaccaagttttagagcaatatgagttttgcagattaatattccttgtgaagcagttatatagttgagttgttgatttaacatgtattttcaccttaaaatatatgatttggccatcagctggccatagggaaagaatatgggagaacactgtgggatttggggacatacaatctttacttagatcttataaccaaggctccactgaagagttaaaattctttgcttattgatatataaatcaatgttactaatatttagaatcccacataccatataacatttaaagaagtgaggaagagtagcataaatttgccaactttcccatttaccaactgatacggtttggctgtgtccccatccaaatctcatcttgaattgtagttcccataactttcacatgccctgggagggacccagtgggaagtaattgaaccatagggcagttactcccatgctactgttcttgtgagagtgagtgagttctcacaagatctgatggttttacaaggggttttccccacttttgcttgacacttctccttcctgccaccatgtgaagaaggatgtgtttcctttcctttctgtcatgattgtaagtttcctgaggcctcttcagccatggggaactgtgagtcaattaaacctctttcctttataaattacctagtcttgggcagttgtttacagaaacacgagaatggactgatacaccaactacagacattaaaaatgcccacattcctcgtccaataaccacatcaacagtagagacaggatatattaacacacacaaaaatcagaaggacattaggatacatatggcaattacataaatgtaactttttgttaaactgtggttaatgttcttattttttattatttcactttggcctggcaaaactttcatcaggagactggccctgttccataattttatatttgagaatcactcatttaatgtgagaaggactcttagcccacagtagaatattgccttttcccattctcagtaatatttttaaaaggttcacattttttagatataggctctaaataattttagtatcaattggataactgtttaaaacttagaagaaaagttgaagtttgcctgtgtattgtcaatagaaaacacagataaggccattcattaacggaagaatcagaagagtaaatggtgaatataactattgcatgttcttaagtaaagtttcattattgagactgttaaaaaagcaaataaagtttaattgccttgtgattaagtagaatccttttaatgtctgaattcatcggtatgtcccaagactctggtgtacttttaagcacatagtgtgctgcttaacaaatacctattgatcactgttaataaggagtagacacaattagaagaaaaagaacagacctaaattaatcctttactgggtaggaaagtttaacaatgtcattccctgggtttgacagtaatttcatttaaagatttttataaataacctaaaagtgggagtacacagtaaattatccaagctattctaagcaaaggaatgctgaatgagtgggagtaaagtgcaggaagaactcacggagctgtgtagggtaagacgaatggcaattgagctccaatgtgggcaagtgtgaaataaagcatttaaagaacaactccagatacggaataatcgattataagatataatgatcttataagaataagatcttttatgacccaggaaaattatctaagaattacaatatgcactttcattcaaaaagcaatctcactacttaatatatatccaaagaaaaagaaaattggtatgtttaaaagactcctgcactcccatgattttgcagcattattcgcaatagccaagaaacagaatcaacctaagtgtccatcaaaagatgagtggataaagaaaatgtgatactatacacaatgaaatactactcagccttaaaaaaagaaaaaaaatcctgtcgtttacaacgacatagatcaaactggagaacataactttaattgaaataagccaggcacagaaagaaaaataccacatagtttcactttatgtgtatgtggaatcagaaaaagttgaactcatagaagtagagagtggaatggcggttatcaggagctgggacagaaagaaggggtgggggaaatattgatcaaaggatataaaatttctattgagacaggaggagttaattcaagaaatctgccaggtggggtgtctcatgcctgtaatcacagcactttgtgaggccgaggcgggtggattgttttaagtcaggagttcgagactagcctgaccaacatggtgaagccctgtctctactaaaaatacaaaaattagccaggcatggtggcacatgcctgtaattccagatactcaggaggctgaggcaggggaatcacttggacccaggaggcggaggttgcagtgagctgcaattctgccactgcactccagcagcctgggcagcagagtaaggctgtgtctcaaaaaaaaaaaatctgttttaaaacatgctaactagagttaataataatatattgtattcttgaaacatgcaagaatggatcttgttttctccacaaacaataacaatgtgaggtgatgcatatgttaattagctagctttagttattccacaatgtatacatactttaaaacatcatgttgtacacaataaatacatatatttttatctgtcaattaaaaaatggtcttatatcccatataatcacttaaaatctaggtaatctcttaaccttttaaaattagcatctttcttattcaattctggctgttataataagacattttaggtggcatgtgatgattaattttagaattatcttgactggattgggccctgtgcagcggctcatggctgtaatcctagcattttggaaggccgaggcgggaggatcacctgacatcgggagttcgagaccagcctgaccaacacggagaaaccctgtctctactaaaaatacaaaattagacgggcgtggtggcacatgcctgtaatcccagctacttgggaggctgaggcaggagaatcacttgaacccaggaggcggaggttgtggtgagctgagaccacgccattgcactccagcctgggcaacaagagtgaaactctgtctcaaaaaaaaaaaaagaaaaaagaaaaggaactggattaagagatacctagatagctggcaaagcattgttttgaggtgtatctgtgaaggtgtttccagaagatattgtcatgtaagttgggggactgagtgggggaagatctgctctcagtgggggcaggcaccatccaatcagatgggggcccagataaaaaaaaagtcagaggaaaggccaatttgctctgttttctggatccaggacaccttttctttctccagccattggacatccgaactctaggttttctggcctttagactctggaactggcatgagcagccctccagcatctcaggtcttctgcctaggactgagagtcgcaacattggtttccccggttcttcgactccaagacagctgtagtgagacttctcagcctccatgaccgcatgagccaattcccctaataaatcttctcgtctatctctatctatgcatgctttcgattttgtctttctatagaaccctgactaatatagaaataaacttctataaataatacaattttttttttgctcagagttctggaagctggaaagtacaaattcaagaaagggtgagcaagcttcccaaagcctctgttataagggcactaatcccatttatgagggctatgctcataacctgatcacatcccacaaaactcaacttcttaatactatcacattcagaatgaggtttcaaaataaaattttgggagaacacaaacattcagaccatagaattctgcccctggctccccaaaattctcacatgcaaaatgcatccactccatcccaatagctccaaatgtcataactcactccagcatcaactcactcaaaagtctaaagtccagagtctcatctaaatatcaaaatcagatatggatgacaatcagggtgtgatttattctgaggccagttgctttctagctgggaatctgtgaaatcaaataacttacgtgcttccaaaattttatggtggggaaggcagagggtagatatttctcaattctaaaatgcagaaatcagaactaagaaattggtaattggggccaggcacggtagctcatacctgtaatcccagcactttgcgaggctgaggagggcggatcatgaggtcaagagatcgagaccatcctggccaacatggggaaaccctgtctctactaaaaatacaaaaattagccgggcatggtggcatgtgcctgtagtcccagctacttgggaggctgaagcaggagaatcacttgaacctgggaggcagaggttgcagtgagcctagatggtgccactgcagtccagccaggcaacagagtgagactccatctcaaaaaaagaaaaaaagaaagaaatgggtaatttgtatcaagtaagttcaaaacccaaacccaacagggcagacaacattatatcttaaagcctgagaataatctttgactcaacttcttgctttcaggatacactgggttgggttcccaaagctccacatagccctgcccctgtgactttcctgggtgcaacccacgtagcagctctcatggttaaggattcattcctgtgtctccctcaggatccctcacctcttgacactgttacatcgtcgattagctttcaacatattaatttaggcaacacaaacattcagacgaaagcagtagctatgattatgtcaaataattgtggaagatgaattttttggcaaattttgtaaggtatatcctttaaatatatattgtttattaaactttagaaaaacaggtttatctcattcattcaatttagagaaaatgtctgcattggcaaaagccagtcatcgacatatgggatacaacattctcactactgaattctaattacacagataaagagacagaaaggctaagagataagtatacttttaagtatacatacatgtattcatatttagagagctagagataggtaaagagattacagacacatatgcatgtatatgttatatgtgtgtatatagatataggcatacacaaacacccaaactcatgtataccccaagaaagctttggtaagaagagtcagagtcctgtttcagtctagctgaaacagatatgtaaacaagagaaatgtaaacaggatgaagtaagacttctcctttcaatacttcttactaagattttctttgctttgctctttggagtatactttacaaggcattctccaaactgtctctttgtttgattccctggagatgtttacatcttctgccagtgaaaagatgatagctgagtgagcattgtgtctttcctctctgaaatgggagaagggcaattgtgaaagacaaggcagaaaaagacaatctacagcttttagacagttttcaggtaggttagttttaagaaatagtacatgtggatctggaaattaaatttcttaaaactatacatgcttttgtaaccccaagccttcgtactgtaccaacagataaaaatgttcaattgtttgaaagctgctgccctgaagaagaacttgagcagaactgcccatttatttccttaaaaatgaaaataggagagaatagatgaacagaaagttatgagggcagtatgaggaagatatgatgtgcagggaggctataatattatattttgagaaaaaaagaagtgggaaaggtcaaacagaattaaccataacactttaaaatcaaaacggattgccaagttcagagaaagcttatcttccatctcaaccttgcaccaaaattaacaaatctaaaaatgactagatctttaaaagtcaaacactatgcctataaagtttgcttattatgaagtagagtgtgtaggaaagcaagatgatatacttatcaggtaatattctgatatgtttacctatagattttccattcttcattgccataagaccttaggccattttaccaccaattaagggaagccatagcagacattgaaaaaccaaaaagaaggatttcttggctttggagttttcaaatgttgaagtcctaacacaaacaacaggagtggaaggaaaattcacaagccactgggatgctgcagaatgagtagataaggctctctccaccgatctttgagctggggcatgagaaacatcagagagaagagcagaagaattaattctgtttaggaataggtctctgatggctttctgtcttgcattttaacccatctgagcttcatgcaaagaggcacaacagaatctctacacaagttatgggatttgagagcagaggatatctgagcccacaagaaccatgcggttctagacttcccagcatgtaagttgctgtagcaataaagtagacataattgtccaatgggtctagatgtgagattgccctactaagtttcccacagtgataaaattaagataatatccaaaagatccctctggagatcttaaagctgtagagagtgacatcagcgttaggatgttgaacagacacaatcatgtgtgtagacttttttttatcagatcccagattgggaaaaaaaaaaaaagttttccacatgtcagagcagaatggctcttactgaataggaaccaggaaaataaaaatgctgcaaaagataccaaaacaggccaatagtgaccaagaacccagccacctttcatgggccttgatgtgagtcagaaacgtacatgcaacttttgaaacaaagggagaaaataataacacttgatctgttaaaaaaaaaaaaaactaatggattgagtttattaacaaatggctaattttcttttaaaaacagtcttaaaagagctggtggcagaaattaattagagttatgcaaaaaagttacatattttacacaccacaattgatacatcttaataaccattggtacataaaattaacataatagctgtaatttatggagaactttctctccaggtttggtgttcagtactttgcatgcattattttatcttctaaacaactccataatttagaaattgttttacagcattcccattttaaaagtcagtaaagcatagtgatttgcccaaggttaccaagccaataggtggtaaaatcagaaataaaattcaaatatattcacaccaattatcctacccttagtaattacaccaaataactatgaccataaagatggatagtgatgttggtgagtgaatatgtaaactgtagctatattgaaggttgtgtttccacctcctactttagaggacctagtcatccagttttagggattctcagtggtcactattgctatcttgggtcatacaattttttgttctcaattgtttgtcctatgcattgtaggatgtttagcaacatgcctagcctccctctgcccactagatgccagtagaactcccacccccaagttgtgatgacaacaaaaatctctattcattgcaaaattttctctggggggcaaaagagcccctggttgagaagcactaggtaacatacatttagagtgactgagtggccaaaggacctctttctttacccactgtcctgagtccagttttgagatttgttgtgatctcataactgatgttgaagacttgaatccaactaattaaaagaattggagctgtatctacaactcatgaaaagaaattgcatcatgagacatattttaaagttttattactcagctattccttaaagaaattgctgtattgcttagctaaacattcttaggtcaattatcctatatgtgcatattctttaatttcttacatgaagattcaatatccaatttatataaaatgattataatgataacattaaaaataaacccaacatttgtttaaaggtcatgcaaagtcataccgaatgggccagtggtgaccaagaacccagccacctttcataggctttgatgtgagtaagaaagatacatgaaagtttggaaataaagagtgaatataatacttcctaatctgttaagaaactacaacacacaggacagcccaaaacgttcctcaattcaagatgttaatagtggcaaggctgagaacctctaaagctggacaactaggtcctctaaggtaggaggtggacacaaaaccttcatatagcttcagttatatattcattcatcaatatctttatccctccttacattcatgaagtactcctgcagattcaggacactaaaacttttacctagaccatactgcaagggaaaaaaatatcaaggattaatggtataattagagaattattgattcatttcttcgttcagttttaattcatttatatcattcacatgagcatccattcttagataattttgactctccatttatgtagaaatatatatgaataggagagacattgataagttcaaacagagtagagtgttgtaagaaaacatattaaaagcggtaccaaaattactgaatcatctattgataaaacatgctgcatattcttatgggactatgagaaaaaaatgcccaaagcaatgactaaatcgttaatagactatacacatttgaataaagtctagtatgttacgtagtggtgaggttacaatactaaacatgacatataccttgaacgtctagcaatgctaagctaatgatggctagaatcctaaatacagaaaatcatctgtctttgaatagcaatgctaaggttgtttgataataatacaagttaaattaaattaattatatgtgatttttataatcatatataattgctataatttattttatgtaatttatataataccataagattaaataaaaattagaagtcagagcttgatgttaggagaaagtaagttttggaccaatagaaaagggattaatttattatagaatccattaccatcagaaataacatgcgtttaaacaaacgaatagattctagaaagctttagatgatttaaatgggtgacaactcaccatgcataatcttttgataatgaaatatattaaaataaagaaaaaggaagtaaagacataaccaatacattaatttctgcttttagttctataatgataagtaatgatcacatattttctgtatgtagtatataaaactaaaaggcaatgttttattggtatagacaaatctttctgttactctttctctaaacaacaaaaataacaaagtataagtagatagatttaatataacccacagtccattctgagtacatctataataaggaatatttttatcacccaaacatccacataacatatatataaacaaaaatattaatataaataacttatctataagaactcttatgtgtctggtttgtaggatgagaaagaaaagtatgcttatctgttttgacagtgatctgattaaaaagaacccacaatatagtgaatttgctaagggtagccattttaattaagatgacctttcaatattggtctgttacatttctagttagctaaatttgacgatttttatgaatttttgattaagcaagatgtttagtataaaggaatcagaaatatcgttgatatttttaaacatgaaattttgagcttattaaacataccattctgagcaggcaagcatgagaaattttaaatatgctttgcatttcacaacagcttcctattatacagagattcaaccctctaatgaactctatttgttgactcatgcaagaaaacaaggtaattgcattatctcaaccccactgactttttaagccatggtgttagaactattacacctatgtttgaaatgaaatatattaaaaataaccaagttactttgaggaaattgggcataaccttttcatataaaagaaagaaatctcattgaattggaataaaagtatacttcgagtaagaacatttaactcactagataagtgtaaaacattagcattactctgcaaaagttataaagtgattaaaaatgacataaaaagtacagtacaaaacttaattgaatcatgtttgatagaaaatgtaaggccagaatatttaatgactatctagtttagggtttttgtgtttctatgggctatttaagattgccttagttcctttttgaatgtttttctctcctgaatgatgaaaataaataaagacctatttgctgagtgtttataatacacaatttttctcttagttttgtccatgtgggaggtgaggaggaatgagtagggatgattatcaacaattagcagtatactttgtaagtacagcctttctatacctatctatcacaagattattatcaagttattatggagatttaaacttgtaacgggtatcacaattattctataaatggcatcttgtactaaatttctttagattaaggatgctatgttacagaattgtagtgaatatattcttatttcagagtctataaaatgttatttacaaagtatatcaagaatatttacaaaccacattgccaaactatgacataaataaaagttatgtttttcagtaaagcagtaaatcaggttatagctctgaattaaaacgtcaaaaataatcttgatattgattgtataacacagaaattaatagagtagtaacatggatttaaaactgtttttatatatattttgaaaatcatattttgtgaagagggtggaaataatagtgtgtctcaaataggttggaatctaaaagctacattttcgctctcgatcatgataatttttttttttttttttttttttttttttttgagatggagtctcgctctgtcgcccaggctggagtgtagtggcgcgatctcggctcactgcgcgctccgcctcccgggttcacgccattctccttcctcagcctcccgaatagctgggactacaggcgcctgccaccactccaggctgattttttatatttttagtagagacgggatttcaccgtgttagccaggatggtctcgatctcctgacctcgtgatctgcctgcctcggcctcccaaagggctgggattacaggcgtgagccaacgtgcccggcggataatgataattttaaaaatgtaaattaaaaaattcttttcagaaaataagctagttatcaacataggtatatgcaaatacatatccaactgtgaacccattacataaaaaacactgcttcattttaggaagcatgaaacattttgccagataatacccacttctagtgtggatacaatctcaaaactttctgtaaagcatcagatattagaccttgttatgggggcatactgcaattgaactatacttaacaacaaaggtaaaccaagctatcctgccaattagaaagttaaggaatattcccacaagttattcaagtcaaagagtaactcaaaacgtctcttataggctttcttagaaagtaagtaactaggacagagcagtgtaaagctcagaaccatcagattcagtctgaagtgaggtgaagctgaagacattaccctttcaagcctaagattctgcacctataaaagaagactaaaaccagaagcaaataaatcaaatcaaatgaaataatttcccgcgtacagctcttagaagtcctatttcaaatgatttataatgctaaattttcatatttttcttcttcctccctttctcttctctttccttaagtttctcttccttcttctatcctattttcatcttatgaaataaagaaaaatacgggcaaaaaagtcaaataggtacatatccatagctttataaaaaattcaaataggtacatatttatgcttgattgatttttttctagcaagaaaagctgaaactattaactcagtttagaaacttagaaaaaaaacatttctgaggaagaaatctgtacaaaaaaaatctattgtgtgagacaacattattgcaaggattcctatttttccaattttattttctattttccctattttattaatctctaaatttaatgcaataagaattaaagtccaaataaggttatatttgaaagttaacagtgttaatatgttaagaaacatatgaacttttttgaaacagcaaaagaataattattattattacaggtgacgctactatactgtgcctatctggaagccagtattgtgccatttttcataaattatcccatttaatcctcagaacaaaactatgtaaacggcaatatcatactctcattttacagatgaagtaattgagacagagaaaatcgaagcattgctttaaatgtcacagctagtacaaaaagaaccaagcaacaaggccccagagactgtgcccttgaagattatactatacacctaaatttgcaaagtgatatctatctgtcttatcaaataattaaatgttattctgcaggacagtaattacagtcatgtagcactggcaaagaaaagatgggtgaaattgagtaacctacgagtaggccaaagaatgtattaaaaaccgtgtgtgaggccgggcgcggtggctcacgcctgtaatccgagcactttgggaggccgaggcgggcagatcacgaggtcacgaaatcgagaccatcctggctaacacggtgagaacccgtctctactaaaaatacaaaaaattagccgggcgtggtggcgggcgcctgtagtcccagctactcaggaggctgaggcaggagaatggtgtgaactcgggaggtggagcttgcagtgagccaagatcgtgccactgcactccagccagggcgacagagtgagactccgcctcaaaaaagaaaaaaaaactctgtgtgagagataacaccacataggagtgcaatcgacagggaacaaaaacccgaaatacatttactttctactgtttataaaaattaaatgtttgcagtgaaaataattttattttgaacatagatcttttagaatgttaatttcaaataaatgaaaactcagtagcttctgacttgaagtttgtaaatcagcaccgattctgttgcaatgaattaattaacggacactgaaatgattcttacaaaggcagtgcaaatacaatttaggcttgatactgacggtgttttgtattacatattattttcaaaacatcaaactgtgcctatacagacatttcctttacataactgtgccctaaaaaatttcagatggcttaggaaagtttagatatatttacttctccagccacataaatttgattttgcaggaatgagtgtaatattttaatagaacagtctttatttgtcatttcacctataaatcaagaagtactctccaaaatccaatgaagaaatgttgtcactgtgcaattgcacatgttgtagctatttacattatttattcttacaaaaatcattctcacaatgaactaaatctgctgaaatagtctgccaaaagaacttgattttgttaataaatatgcatactttaataaattggtacaaagtctgtttagtgcctaaacattcctatcacaccatgaattgaagatgatctggtataatttcttcaaactaaattcttagaattaaaaaagatacatcattattaacaatccactagaatgaatgctcagtagagcaaagactgctttttaaaaactttaaatgtttttaattatgcagacccggtgcctagaacagtaactcatctttgaagatgctcaaaaaaatacttgttgaacaaatatattgttaaaaggctaatatttatcggatgcttactgttttccaggtgtcgtgccaagcactttaagtatatttccttatttaatgcttacaatcacctaataagtttatacttctgctgttcgatatttacagaagaggacttaaatgtcaactcttttactgattatttcattttgggaaagttgatgaatctcttcctctctgtgagtctccctgttctcacctgtaagatggagataataagcttatctggcctgagttgtgagaaataatgactaaagaaataaacattgcaaagatgtatcatagttctagatacatagttgatatatagaatcacaaaatatcttatttcaatggaccataaaagcatgtttttttctatcttatagttgtagtcaacccaaagagaagtaagacatagttttccttgcttgaatacgtgtaaacttgttatttctgctggcttagcttcacaatgtgacttcacattgtcttaatcaataaactgtttaaggacatttaaggtaggtgtatgagtcctggatatggtcaaaagtcttcttttgaattttctgccaaatataaatcaacatttgcaagaaaacttgcagaggagatgtcaccagcttggaaaaacaaaacaaggcaatgcaagcaatgaagcaaacagagcagaggcagaagtggagtattctattcagaaattctttagtaccaacgcttttgttgtccctgagaacagcagaatgtggaaagacatggtcacagaggactctgggttgaaatctagtacagaagaacaggatgctaagtgcaaaggggttttaaaaatagcttaactgatttatttcacctgtgttttccttttgtcaaggtacacatcattatataaatgaatgtaaaaatattatgctattggtgaaatctaccacattcaaaccaacaagaaagcatcatgtattttctttggcagtctttttctttctaaggagtatataaaaaagtagtgagtcttaaaattgatggcatttcagatttcctaaaatgtagtagttcatgtatttagataaaaagaagaatacattttatatagtgcaattcaaaacttatcttccttcccaaaacaagaatttatgatttataccacctacaaattggcatggtgattacattatcacattctacatgaatttcctcaaagctgcatgtgtagcaagctcttctcctatcaatgttggctgaagacataaacaagatcttagtatgtgttaaacttttttaagccccatatatccaacatacatttttggtaaagcaaccatttgttggtactgtctatgtttcaggtcctatgagaaacagaattcaatggtgagcaacaaaagctacttttcttgctgatagcacttggtgttcaaggctatgtagagaagaccaacactgtattttgagattatattagctgaaagatattcttgaagaagtgacacttggaaggaggtctgactgagtcaaagattttaactccaatggagaggatatggaagattagtctaagcattcatgggtccctcttatggcttaaatgatataatctgggtacatcattttgtaggtgcctgaaacataataaggctcacttggcacaagttatctatttgtattactaataatattattacagttagcaaaatagcaacgtgcccaagatccccgtgtcatgacagattgtggctgataaaagggtctcaaagaaaagcagtgtggctcaagtggaaagagaaatggaaaattgtgtaagatgggttgcaaatgtaggtaggagccattccagccgacgtttgcagctgtgctgtttttcttttattctaagaaaggtttcaaaaggagagagtgaaaatgaactggtcaaatttaagcttataaatgatgacttgcagcaatgagtcacagggattggaaggatgtcagatcggatgcatattcattacttagatgttttggtagtagtttttccagcaaaaagcagtggcaccagggaaaatataatacccgtatggtagccaataagtattttattattttagtttactttgaaaatacacggataggctgtacacatttttagtaaaatggatgttataaataaaatgctagtccaagaaacaacatatacttgagctttaataagttttattgcttttatcaatgcctgacactcaataaattctaactattactattataattactagtatcacctgctaaatgagatactggggtgataaaacatagtatatgaagcatttttaattccatggttcaagaaaaacatggaagaaaaacaggtaatatgatataaacattgttcagaaccacagctgggtcttgtaatactttatataaaaatatgacagcatccctaacattgacagttgatatgaaattattgattgattagtttctaagttaaatgttttcaccaaactgatttatatctatggcagtatcaggcagccacacatcaacaacaataagactctgactcaggttgaatcttaagaaaaaataaaaaagagtaatatataggtggaaagatggaagtttgaaaaagtacacaggcatagaacatactgatcacatcttagtcacaccataagagctttatttaaaggaattaaattcaatgaagagatccgtgtgaaggcctcttaaacaggtaagtaagagcttaatgtatacttctacaagaaggttggcatagcaaaattcaggaattcttaggaagatgataattaagaaataaagctatttcttatcaatataacacccaatcaaaccaacaacatgaatgatatacctaggtggtcatggatagataccgaatatattggccacgtatgacagatgtggatcacatgggtacacactgagcaagtcacatagtgacaaagttttgaggagatcattcactcaacaaaagtaacatttatatttttagtaaaaatttacactttctgaagttcagcctttcattatagtgatatattcccttgctcttatgacggagatatttccttcatgttatttttatgaaagaataacgtggaaggacacacgacaggctgactcaattgattatttccaggatgggaagagaagatagaagaagatatggtagaggcatgtgatgtggttctccttgcttgtatatctccttgaatttagtatttcacttcatgcactaatcatatatcattgttgtaacttgggggaaaaaacaccaagaaagtaaaatttaaaaatataaaaatcttttaatattgatttcagccaaacatgataattactaaactcaaaacaggagtgtttattaaactcacaggttattgaataattttcttcaataagttccttcaatctccatacttccacttgctggaaaatatcagaaagctaatcagtcttaaatattaaaacatcttcacgttgtttttctgtattaccttattataaatgagctttaggtatattaaaatgcagcatatatgcacctaagcacataggctctgtctcctttattttacacacacacacacacatacacacacacacacacacacgatccggaaaaaaaaaaaaacactaaattagaaagcataaattcttaggtgatttttgcagggaaatattgttcagatattttagtcactcatttttgttgttgtttttctgggtctcaagcatcttctataaggcaattgtgtatgattaaagacaatagatgctagcaccttagtgactaggttcaaatgttgtcttggttgcttgccatccctaaggcctggacaagctacccaatctctttgtgccttggtttcatcatttgttaaatgggagaatagtatacttacctcccagagttgtagtgggaattacatgaatcaacacatgtggcatatttagaagattgtttgatatctagtaggtctcagttttcaccattttccctgcctctgggaaagtattttccctttcaatccttgaagctggactaagtctcttctaccacttgtacaccaaatgcccagcatattttgttatttctcttttgctcgcctatcttttcttatgatttcttcctcctttttcccaagctttctccttaatcttcaaacgatttctgagtctctctgtaacatgggggtgaaagtgtagcatagcagttttctcctttactaagcatcaatgaagcacatttggaaataagcttaacatgctcaggatatcaatgtacattttcacatctccaaacaaaataccatttgtcacagttacaatacatttggggtcctttaatttcaagatttatacaaatgttttcacaaataaatagttaccattttccatttcctagttctaagactgcaagctgtgtggcttgggtgtttaacttctcaattttctcacctataaacaagtgataaaaataccacctatctgatgggctttcgtgagaaataaatgaagtaaaacctgcaaaaatagtcaaaacagtgtctggcacatagcaagtagtcagtgaaagatagttattgatattattagtatcattaactttattttcctaagtgagatgtaatcataatgcaaaaaatatggagcatgttctgagttcctttgagacagggttggggactgataggttatataacgtaagcactttcaaaataacattatcatcatataatctatataggtagcacagaacaatgcttcactaaatatttgactcaacatgtaataggcaatctgtttattttagtaaataaaatgctatgggtttttttctgtatcatgtttctccatcttggcactactgatattttggttcataccatcgtttgtagagagtatttttgtgtattgtaggatgtacagcagcatctctagtctcttcccactagaagtgttgcacattcttcctgctgaggtgtaataatgtttccataaattgtccattatcctctgggggtcaggaggcaaaattaccctaggttgagaacaactgatttacattgatcttcaaagatataatattgggtcataatcttcaacaacaagatatagcttatattgaatattaacagaataaaaaatagattattcttacaactaacttagtaccatcagcgatttgcaataattagccctttgtggggcctaatttgacctagttccaacataaactcataccttttttgcttctttaagatcgaacatcagccacactgtcttcctctcattttattgatgtaaacaagagtcagagcttggacttcagccataacaagacagcactttaaatatggatactgtaaaatcatgatgcgcttcccaagatatgccatttttctcccctaagactactctggccatctctaatcccagatttggtgaagtctgccattaccctctactagtataagaaagtaatgtaaataataactcaggctttgaggactcacaaaggtatccaaaattatggaaacatgtttaagaataaatttgaaactttcttgacaaatcaaataggtgtttgtcattttacagtttataagatatgaatccaaaactagtacaaaataaaggtggaggcagtagaaaaatctagtgatgcaaaacaattttttaaacatattaccagaggcagaaattataaggaatggggtcgttattgcatatacaatgtgaatgaacatatgtacatatatgtggatatttatgggagaagcttcacatctttcaccagattctccaatactttaaaaactccaagtatagtcagttctactataacacttgttttgaaaatgcaaatttttccaaggcaatttgtgtgtgtatgtgtgtctgtgtgtctatgtgtgtttgtgtgtgtgtgtattgtaagcaagtatatctgtaaagacataggtatatttatatgtgtacagatataaatatatttgctcatgtgcaattctgcccacaagaacaataggcacatgcagaaaactgtatccggctccagctgaatagagcttggtaggaaacactgatacctgacacatcactgaggtatctcaattcaccatgtgttattagccacacccatccacattctatgtccaatttcaataaccctccttctgtcactttataataactcacaagcttcaaccattctaacatctgcatccacaacatagtttatgtgccataattcttgtagtatttctatatttttaaccattcaacacgtatgcaactgttagacttttttttgatgtttgtcttttaatatgtcattgacaaagtttttgagtatcagacccctaactctgtttcccccaagccctgtgaattgtattgcacaattatgcagagcacagtggtttttcagaacacatatggcatgttatagcagaccccgactgtagtttaatgatgttggcaaacattcctcgtgttgttggatttagctcactgtttccacacaaaggtgttagtaatgaatgttgaacgtggggattttagcattttattagtacagtttatttcttcaatatctccctttttatataaaaagcagagaaggtattatttattgaaagaatggattagatgagtgaaccatggggacaaaaaagagaaaggtgcaaaagacagaaaataaattatgaaaatgttccttttccttaatcattctctaattaatttcttatccactctcgaggggctagaaagtaggacgtgtaccatattacacagaaggtggcattagctcctttgtcactgttggtaagattttgcatatgaatcagctgttgtgatgtggatagctcagtaggttctgacctcctgttcagcactgtggttcaactgcagacaccatgagatgattggcaaggccagtgcatacctggcttctggtagagatcagccttttacataagagacgaaattatcactcatgatatacatagtaccttcctgagtctcatcttaaattattcttttgcatacaataactaaaacactagagggatacagtttgcagttttgtatctgtattattctaattgtattatcaaaaaaatctcttttcaagtatcttcattcatctctgcagtctgcatttcaaattaccatcatctgatgtgttataatgggagaagaactgggaagttcatttacataattcttattcttactgccttccttctttaggtccattttcgctatcaaaaaaagatgaagtaaaatattagtgtgggcatgagagagagtctcttggaggtataattctagaagtagaaataccaggttgtacagtgatccctgctgtaatattttacttttataaatggatgctctttgacaagaatcagaacagtatattgtttccgcgtgtacctaacaaagttaagaatgcattttcttatgtttagttgatttgttttcaaatctgaccttgtcaattggcaatcattcacatgatatttgtggaaagtggccagtttaaaccattttactatatttgcaactgatattgacatatttgaaatttgattatcttgatcataggtatatcagaagtatttttatagttccttttgtgtctatgtgacatgcatcatgattcctaacataaggaatagcagtgaattgagtctaaaaacatcaattaatctttaagtttatatatccattccctgtcattggataaacattttaggctgaaaaaggacctaaaatcttaaggaatctgattagtttaaccaacatgaatatgcgtttaagataattttaaacttttattttacattaagaaatccaaacaacatataaatctagaaaagttttatagcgcaggttcattggcataagctttagaatgagaggattttttcaaagtttggctgtttcacttattaattagagtctttgcatgccatttatctcatgttttaaataataaaatgatacgagaattgtgaaaagtctaaaagtagataatgtacagagtggatatgtgtcatttttgtttcttatttatttgccttttcagaattttgactggcttcctctattttatggaatctcccatctcatgagataaagcattcccaaagttatagaaactaaaagtaccaggctcatttcccagtctctcttattactaaggttcaatcatgtgacctacactctgccagtttgaagcaccctccaccagccttaaatcagaagctggtgatagccgggactatacggaatacactgctgaaaaaggtagccactcgcagcaactgtatcttgtctagtgtgctgtgttggtgaggttagcactgccaaaaacagctcctggtgcccagtgtgaccacagtgttgcttcaatggatcaatttatgccaaaaggcataattttggatgctactactgacaatgtcacctcaattcccgtctctccagcgctgctgttaatgaattccactcctacctaaaccagccagagtcagtttttcttgcttttggcaataaaccttgcctgatacagtatactaaatacttaagcaggaccaagtctatagtaataatgcatataactccaacaagtcagaaacacttggcttatttagtgttgtattcccagcacctagttcaagtaacatataacagacatgaaacaactatatatcaaataaatctttagtcatgaaaattttactcattgaagcattatttaaaacacttttaatatgatatttatatgacacctgatactacctggtggcttcatatttgctttagagagatgttattcaacagcttaggagttatataatattaaaactctcctctttctctctccgtctctctctctctctctgtcatgcacacacacacacacacacacacaaacacagacacacacacacatacatatctcatcaggtacaaagttacagggtacataataaaaataatcacatgctattaacattagccaagatatatacttgaaatccattagtctccaacttaaacctaaatttcaatctttagtcaataacataggaagaaaacagctttatacagtctttgattctgtttttaactaaatactttttgtttataaagctgaataaagataaagtgtatttattctacacctaagaatttaataggagtttgcaactactattgttgcctctctttgtctctagatttcagagttgaaacaatacccaagaatttgattcctgatctgccaaaaaaaactatatctggttatatactaatggcttgctttctacatctccccagttcaatttttaccataaacattccagctgaagcacttatcaccttatagctagccaattataatattctaaattttattttcagttccaagtttttgacagccccatctattttatatatatatgtagattaaattccaacatattacattccccaatattatttccctactgaaaaggctttatgaatcttcactgcctatgttttaatttttaaatgtatttagcattcaaagagttcaacaatctaactaagtataactttccaacttattttctaaaaattctatatgtaaacttttgcaataaccaaaacagttcatatactttcccataaaattcccttggagagtatcatatccacattttaagtcttattattcaattccagtcaggcctaattcattgtgtagagtcttatccgaagactagtttttttctgaagtcacatttgatcacccccatcccaatctcgctaataaatttattgagtttttgaatgtattctatgtatttcattgttagatagcatccactttcctccaacagggggtttaaaaattgcatgttatatattttttaatttcccacatcacctaatcctgctcaatgcctataaaaggcaatcaataagtatctgttgattgatttttagatgcaatctgagcatcagtgctgttctttctgatgagctggaaaacggaacatggaggttcactggacttgattagaggtgagacttagaatactaaattagatgtggtacacttctgtctcattttggatgtgtggaaaacacttctgtgtgcttgctcattcttttattattaattctaaattttcttgcaggagttagagaatgaggtctacactatacttgtaattctcttaaattctaggtgctattctaagcattgataatatgtcaatgaacaagatactcttctcctagatcttgctttgcagtaggtgaaaacaactaacttactaatcaaataaataaataaggtgctttcagagggtgataattactttaaatagaatgcatggtgtagtggaacaaaaggtgagaaggaggaggccatttcaggttaaaaaaatctgttgaagttatagctgagacacaaatagtgagaaggagctattcatgggctgggcagagcctttgagacaaagggatttgtaaaagttcagaggctgaatcaccaatgagtttgaggtgtttaaaggtaaaattactaatgcttctggtaactatttacaggctacaggaagaatagtaatgaggggagttggagaaccagatgtaggttggggttggaggaggagggaacatgtagcttctccttatagaccactgagaggagttcagatttcacattaaatgcaatggaaagccatcaaaggttttaattagaggagtctcatgatcaggtttatgtttttaaaagtgacttttacaattctgtggagaccagcttactaaagatgaaaacagataaaggggaacagtttattaagttattgcagtggactacgcagcatgcaatagggtgacagccagataggtttgaagaagttgacaaactcagcatatatttaggtggtggaaccaacaggacttgctgatggattggatgcggggagtaaaggaaaagagagataagaaaatgttgagggtcttaagaatgagtgtgtcatgagctcgctttaataacatttctaacaaatgaagagttttgtctatgtaagaggaagcgcaggacagaatgagctaaattacagcaataaaatagagcaaaattatttcaatggatgacgttaggaggcagaggaatgagctatcaagggagaccagatgtgcaacctgcacgtgacacagggtcctgactgcagaaggatcccgcacttggtttattgctctgccatcaccatcttaaaattcttaatacttttttttaacaagaggccctgcattttcattttgcacggcgccctgcaaattatgtagttaatcctgctagagagtcatactcaagaatagaaagagaattttgacgatgggtcaacaataactaaaatgatggcttttttagtcaagattttataactcagattcagtataccacaggtcactggaaaagctgaaacatacattttcattttctaaagtgtttattcagtgctctctaccataagactgactgcttcttattgcctcaaccaaatttgttgataatttctatgtgaccttatatataaacttatataaaaatactccatgcatacttgaaattaattttttgataaagggtagaaagtttaacatataaatactaaagttattactgatattatttaaattctaatatccatgtttttgtgatttttgatatgacaaaaacagataggtaaattaatatattccactgtaattttgattttatctgtttcttcttgatttttttttttttttttttttttgagatagagtctcgctgtgttgcccaggctggagtgcagtggagcgatctctgttcactgcaagctccgcctcctgggttcacgccattctcctgcctcagcctctcaagcagctgggaccacaggcgcccaccaccacgcctggctaattttttgtatttttagtagagacggggttcaccgtgttagcaaggatggtcttgatctcctgaccttgtgatcctcccgcctcagcctcccaaagtgctgggattacaggcgtgagctacagtgcccagactcttcttgaatttttattttatttgcaatgttgattccaagtcattggatagaaaaattcatttgtggtatgtcttaaggaaagattacacagttgatccttataacataatgatcaatgctatttgacaaattttagccttgaattctgcttttcttgatataatatttctatctaaagtaatgttatattttccattttttagctagtcaatatttctttattgttttgcttatgatatttctgtggtatttcttttggtatgtctttcataaaaaggacattggtaaattaccttgctataaattgtttaattcattcacatttattttgatagcctttaatttatactttcataatagtatttaactttttattttcctttgttttgttttctaacccccattttctgttatactggccaaatttttgtaatatttctattttctagagcaatttcttttctggtttacctagttagcatctgcttacctctcagatgtcaattcgaagtttctttgaataccttacacaatggattccacctgtcaccttactatctcctctcataacgccagacactttcttttaaagccccttttatagtttagaattatatatttgtttgattataataggagactggaacttgtaattggtcaattattctataatgtctattaaagcagaaattcatgaattaatgtaaataatattttaaaaaactttttaacgtaaaacctgtaaaggtagtttcacttattctttaatgaacacccgtattttaattcctaaaagaggaacaagaacttctgcactctatccagggaatctgagacaagaatctgcttttttagtacttttacccaatcatttaaagctgtgacggccacacctaattctacataacaatggttgttagtgacttttctttaccgcatttcttatagcattcaagttagttttcatagaataagcacctctcaaagtttatttcatatttaattgaattgcaccaacacaaaacgaccataacatagaaacaaatttacaaatgaactcaacagactcaggtttagcgtaaatccccactggctgccgtgtatattcttggtggatactgacaagcaatgaccgctactgttcagagtactatggacataatccagtaaatgtcacagaaataaaagggtttttaaatttgttttttggttctatatcttgctagtcatttaacttgaaaaagtatagatgagctagttcatttattaactttactcaataatgtatcatcagcatgtaggtaaatattcaacacataaatgatgcccaatcaatatgtgttgatgaatatgagttttcttctttctttgtaatctaaaagctgcccccccttttatttatttattttttatttttattttttggccaggagcggtggctctcgcctgtaatctcagcactttgggaggctgaggcaggcagatcactgaatgtcaggcatttgagaccagcctggccaacatggtgaaacccaatctctactaaaaatacaaaaattagccagatgtggtggcacacacctgtaatctcagctactcaggaggctgagacaggagaatctcttgaccctgggaggcagaggttgcagtgagctgagatagcaccactgcactctagcctggatgacagagcaagactctgtctctaaataaataaatgtcccatttttaaatgaaagtgtttaaatttcatgcaagcctgaacatagagaccatagagactatcgtattattttcaaaatatttttcaaatattggtttttatactaatttgtaagagtatctcaatatctatttcaaaatcaaaatatgagagaacagtactcaagatcagttatcagtaattttttccaatatttgacccctttttgccaagataacctagttgatccacctgaaatccaagtggctccaaatgacatggttttccttacagtcttctttaaaataggcttgcctccaacataccacacacttccagcctaaagaggggtacatatacctctcactctccattttattttcatacccttttttcctattctcaaacctcttcttttctctccctcctcctgcacctctctcaccattacctctatgctactggtcactctctctcatttatttactacttggctgtgcattctgtcctcatccttcatctgtccaacaccctgcctcttagttcccagaacctctatacgccaaattccttttttatcacttcacattagccttctacatgcatagatgtatcctgtttttattggaagttgctcttccaataaaatcttcatttggaacagcccactctcccgatatcactctccaccattccagaatacttacttttatggcttctctccaaaacccctttgccagtaatccactggtttttatccatttttccttattcattacctgtttcatgaccccacttattttctagattgatgtagactctctgtaattagtgtgcactccttgtcaacatgcgtaaatccctccatgtcccctaccttgagctctttcatcaaaattccaaaactaattttacccagtcagtgagacattgctacagaaaatcacaaatccctactgactaaattcaatttatgcttgtgatcataaattccaaatgaacactcatttaatccataaattcctgacgcagtctactgcttactatttactatgctaccctaaaaattctctgaaagttttactatttccccccaagtcatatattcagctagtgatcttttctaataattcaaagaaaaataattaaaataagaatcagttttgttttccttttatcaaatattcctactgacttctttccacaaataatttgcattctcaaactaaagtaggctaactgtccaggcttacaactaaagcctccctgtccatttgaaatagtttctattccttttgactcattcattgacttcactcttgagtttatccttattctctccaacatgctcattctctctccaacatcctcattctctctccattagtattactcccatctaccaatgttttaatgtagtttatctcacattaaaatctctcttgactttgtgccttacatctccaatagcctccttttcagctgtctttcagaacatctttcacctctctactcttgaaagcattcttaggaggtcactaatgacctcttcttgccatatccatggtgtgtagcctgatcttatcttattctgtcattcttaacatttatcagttatttacagccttctactgaaatactttcttctctaattttctgtaacaccatccttcattttccctcatcttccaactctacatttctttgattacattctgtttatatattatatatgaatctataataaacataaatatatattaaattcaaattatattatattatattataaatgtatatattagtgtatgtgtgtgtgtgtatatatatatatatatatatatatatatatatatatatatatatatgtataacctggaactctttgacaagcctttgcttcacttctcttggtgattttttttttctcagtgatttttaaaaatactagttataggctaattaattttaaaatcatatccccaatcctagtcatttcccagagttttaatggcatcttaaacttaacaaagccatgtcagtacactttatttccccctctcactacaaaatctgtttttctctcagatttttatctctcagtaaatgagagttggataggcttaaagtcattcttgattgctttctttccctcattgccttcatctccaaataggtgtatctaaatactcttcaagacctggtatatatctgtacataattcaattatctatctacacctctaaccccattactttcacttctcagatgggctacaagagaacttccacaccaacattcctgccttcatttattttccatacagcagtcagaataatattttcatatacaaattacatcatatatctatcctacttgaaaacgttccaatagttatccactgccatttacaaaaaaaaaatctaatgctgtatctggtactataaaacataatgtaatcttcctactgttcactttataattccctgatttcctcttacaccattctcctcttctgtcttgcctctgtactgaaactatacaatttggttctgtccctccatcatgcctacctcaatcctaaattaatgccttgacctttgtggttcctctctttagaacagccttccaaatatcatcacctggcaccttcttatcatcatgcctcagctcaaaggtcactttgtaagagatgccttcctggatcaccctgcactgctgccacagttttattttagagagttcactctggcttcagtgcagacaatgtatttagagaaaggaagtcaggatagaagcagggaccccaaattggatggcagttaaaattatccaggtgagagaaatgccaaatcgttcataaggagcattggtttgaatccgtagactgactctctttttcaaaaatatagttcttgcatatgtccaatatttttttacccctcagagtacagacagtcaataattatttttcaggcttgggatttgaggtgggatctatcagattagatgttaatctctgttcaaatatttcaggatcagacaaaagaatgaagaacaaattttagagttcctctattttcacttgccagcatggagtaacaagggagctatagccagaaagggcagagacatagtgtttcacctttctgccaagtcgtttctttttgtgtttctcagagcagcaggcattagctgggtcagtggcactctttagagctggcaccactctcttcatttggagccagttgtagcactgccttgttttatttaaaaagccatacttgccaatggaacctgagaagcagcactgtggcagggttgtcccgtggaattgactccagtgtttggtataaatctggggaataatgaaatccatttgcactttccatcaactgccgttggctctggcttctactggtgcaaaataaagtatgctagtgagattttatagtacagttgccacaccttgtatctaggcaggtttttccttccttgcagaggttcggtggatggctggctgtcatttcatcatgtccattgctacggtttattctgtagaaatttgtcaatattttccaaatttgattggcatcctagattttaatattgttaaggtttgtcattgtattatttctgtcatttcagtggaaattcaaaaatgaggcagaaattttaaatatgtaagctctgattgccatattacgtacacatgcaactgatgggtgaaaattgcagtaccatacccataggtttgtgaaatcatgccctttgtttctttctctgcttctgataccacattgtcttctctgtggattttcaaaatgtttataatactgtatggaaagtcttactttgaaaaacctgaaatacatcacaatctgttatttatatttattcaaaaagttcagacattcatttttgtccaaaataataataataaaacaataaaattaaaagctccactctataaaatgcctgaagggactattatttatctcctcaaaaattggattttatcttcacctcattgctggaagaagtgtgccaggtttttacttaacttttgttattgtgctattgagctatggatcacttcaggggtagtaaaattgagcatagttttaatttttttggttgtcaaataaggtgattatttcagatgtacccaacactcaacacattaaaattagaattattttctgtgtttaaataaatagatatacagagacatatacagcaattaagggtgtaggtcctctcatgaaccttattgtaaaagtccttaataaaacacaaatttagtttctttaaaaaattaggagttgattttgattatatctctgcacagatcccactgtagagtaagtactataaaatattggtcccttacactacatcatataatgaaattcatgacacttatataaacagtttatgttaaacatatctaatgtcaagcccaggtgaagcccctgtgaaataactttcagtaaaacaagagaccgaaaagtagttattttttcatgattcacattataagcttcttacttttagtgtataaactggttttagcaaaaaaaaaaaaaaaaagaaaatatctcctcaataaagccaatgtacagacaaacaaacaacaccttaccatcaagctggggcttttgaataatcatttacgctgatgaaattttgaatgcttgtgagctaatcatgccttttagcaatgagcttctgcctcttactatgtttagacacatacttcttattacaatgccatttcatcaagtcccaatctattctaagatcatgataaaaatgataatcttcaaattactacgtttctctttccacttgagtgaactaattgaaagaattccatgctgcattcaccacggatacccagaggaatacaagaaaacacatgtgaaactgaaagaatgcctaaatatctggatagttgctgatcaacacacattttgtatgtgtttaatatgcttaatgtactgactccctgaatatcccccatgtattcaagtaacctaggctgcttctcatgccagagacaaatttaatgtctttttgttttatttttaaacatattaactgcattttattatgtgtagtgggaggagtctagctaccagactaagacgaggctgaatttgcatgcttcttggctaaataactttggttaagctacttcactactatgagctttctgttatcagtaagagagaagtcattatagctactggtctaaagaggatgacaatgaatatcttttgcatgttcattttgcccaggcaagaaaaaagaagtttcccaggtggtttattttctaaggtcattttagtaattcctgacaaccataaaaaatgaacttaaaatgatgatctatatggttcattgaccaaaataattatacacatgtaataagttaattgattatgaagtaatttttttgaaatggtgcattctcttagatatatgctgcttggaaaatgataatattttaagtatttgaattgatagtcagataattcattttgcatgtcttaagagctactggttctctattactaagttttaaaacaaaaggtaaggacagatataaaagccccataaaaagtttgcattgctctcaccccagttgagcagtaactttgaataaggcaggtgcatgtcagtcatctggtgtgacactgggaattgcaagccatgtcccttgccccaagcctgacattttttaaactaatatttacccgcattagaaataaaatatagactacattttaaagaccttgaaaattataaagtaagtaattaacagaaatttttaacctagaggcaatcctttttaattaactttttgatgtacttaaattttctttaaaattctttaaaatgtcagtaaatgtcagtgtatttttatatacgtacatttacatacacagtgagagagagagagagagagagagagagagagttctatctgctgaccttgaagtcttttcctctgactcaaatacatagttattttataaaacatgaaaatatatgggaacagattaatctcctgcagatagccactgctactatggattttactttctggttattgtacataccctcaaatgcagggaaatttattcaaactcagtacttgccagcagccccaatatttgaatttccctggctttgctcatttgagtgctggttaaatatcttggatttctcactggatacacacatcttcctgccatggaagagattaaaaacttccaataccatatggactgaaatgttaaaatacccattccctacctctaattacctccatggaataaaacagaaatatagcacaaaactgtaaagtaatcataggaatatcatattttcaataacgactatttttgagattttcaaagtaacaaatatcaagcttttttttcagaaagaagcaattacacgcatgctcctcttttgctgtgaacttaagcaacttcttcacagttaattgaattcattctgaggatttgggaacattatagactttttctgagcatgccctgctctggctgattttgttctcttgctctgggaatactgaattacactgagcaaccaacagaaagaattttcaatcaattgtctcaaaaggctgactgaactgctatttctttctcctatttttggctttgtctgctttcttttagcaaaaactggttgttttgctctttctgtatgtattaattaacatcagtcagtccataacacttgagcatttaaataaaatggtatctggaattcactcctctgtgaatgcaaactgagaacaactgaagagtctttttttatcctagtaatatactcatttaacctagcagcagaattgacactttcttcagaaagtctgacttaaatgctccatatactttgttccaacaatattccatacaaaactcttattatgccctattgtaatggtcagtttgcttgttgtctttttcacagtattgagaaagccatgatgtgagctctgaagtattcacgatttcatttccagtatgtggtgaaatatctgacagaaagaataagccattatcaaaataaaaccaaatctttcaagggaattattattgttgctaacgaaaggcaattagtccagatatctggatagtcttccatcacataggaattactgtggcttagcacttctctcttaggaacttgaacaagctcagtaaaaaataacaacaaagattacttggagaccagcattctcttcaacttcctgacacagcccctaatctcactcctggctatcaccaatcagttaataaacctcctgctatgaaataaggaaatcttaaaaggaaatgtcccagcatatggaaattcaccactggctcaccaggaaaaaataaataaaaaataaaaacaggtggcaggaagatctaccaacagctctccttttgatattcatgatattgctggattcacaaatgatgaaatactcccaagcaaaggcttttaaacggaaacaaagtaggtcttgcatccaccctaattagcaatcagcataaggaaaaataaaatcacaaattgcctacctgtgcagaaatcaatgcacatatggcttttaagattttgagactagggcaaccctccttcttttaaggaagcattctagaatggtgtgcatgtgtgtgtctgtgtgtgtagcgggggtggggggcaaatattatgaaagttacacagaagaaatgactaaagagccagggagaattattaatgccagattaattatttgattctatcaatttagtaaatatagtatgccttgattatcagtggaaatacattctgagaaatatattgttaggtgatttttgtcattgtgtgaacatcatagagtgacttacaaaaacctagataatataacctactacacacctaggctgtatggtatagcctgttgcttcaaggctacaaacctgtacagtatgttactgtactaaacactataggcaattttaacacaatggtaagcacttgtgtacctaaaattgcaatattataatcttatgggaccacagttgtatatgtggaccatcattgatgaaagcattgttatgtggcacatgattgtaaataacaaaaccctttctttcaatgtcaaggtattttcatgaatacgctgtacattgcaaatctcaaatattatatattaacatattctttttacccagtaaatcaaaattttcctcatgttcataattacctaattcaaaatagcttgcagatactcacattgcaacacaactctatggaacatatttagagtttctaagtgcatttttacaattgtaattatcctccaaaaaacccactagagaatagcaaccatattttctataaataataggccattatatattttacacttctaaaagtgatgctgagattgtgtttttctcattcacagaccttgttacattcctcctagttcaaccccctttttacaagtagaatatgagtaatgaaagtgatgtacatattttatcatagttgcactgcaacagcagctgtagtgatatatcgaatagtgttagcatagcagggaattgtatacttcctctgtacaccacatggcgggtggcagtgtacagtgtacaatgttaagaaatattaccagcgcaccattatacaacagctctttccacagttactagtaaatagtagatagttaacaattttttgagtaaattgatgaatggatgaatacaaagttatacaataaatactacaggtacatggtgaatgattcttagagaaggtgaatgagtcttagagagaagccagaattggaactgggcttgatggactagtaagaccatcaggtaattgagataaattctgatttggaaggacagacaaggaaaatgacctggatgcaggcttatgcagaacctaggaagggaagagagcacatgccagttatagttatcacaagaggtaagagcagtgaagaatcagcaagaccatctgtgccacagtatcatggccctggaatgcaagtttaggttgacaatgaaatcactttctatagatttctaaataaataaataaggactcatatttggtttaagacagtactgtctaatagaaagataatgtgaatcacatatataattttacatttttaaatagtcacattaaaaatgtaaaaaaggtaaaagtaatttatatatataatttaatctaatatctctaacatgttatttcagcatgtaattgatataaaattattaatgagctatttccttttttttcaaactaagtcttcaaaatccagtgcatttttttacatgttcagcccatcttaatttgggctgtgcacatttcaaaggctacagattcacttggatggaacaagcagctctcagttatgaactggtcttaggcacgttttgttcttcagaactctcgtggtgaggtctgatatcatgttggataactaatattaactatccattccttgataggattgcctctgaaaatgtagccaatgaaccctctgcatcagaatcatatgagacacttaataaaataatcctctacaaaggatgacaaaaccagaacctctgggttgggcaataaaaatcagcattgtttaacaagctaaccaggtgtgtgttatgtaaactaatgattgaaaacacagctcttttaaaatattctgtgccaataagcaaataacataaagacatatactacataaaaccattaatattttagggtcaaattgaatctaattattctttacctagagataaagcatgttggagaacaaaaattatggaatacatcattttcatagtctcagaggctcaaatccttaattttttattgaagtcccacactgtaatatagtttttttaaatggtctttctgcctctggtaacatacaatcttcacgagctttaggattgatgtctggtattcatataatatatagtatctatctattaaaatagtgactgacaaaatagcaagtgttcagcaaatacttataaatgaatgaaatatttcctttagctcgttagttaaccatgtgaactgaaatttcattcattcacaaaacgaacataatatgtatctgagaagattgtgtgaaatgaaagttgattatatgtatggggttttaatttgacacagcgtttccccattgttgttcatttttcctgtagggagaaaagtgaatttataacgtcacagctgttaataacgtgttctagtccctctaccaaggacatttgtatttaaaagcaaacatcagaagagatcttctttaatccataaggggttgctctacggttgttattctcccttgtgaaaatggtgtggggaagggtgggggtcaaggaaaatttccgggaattttataatacagagaggaatctaagattctccaacccacctaaacttggttcaaactaataattatgtaagtaagaaacacatatgtttctgccaaaggttttacctatcagtggtcccagaaagcattttctttcagaatacaatggttgcaaagttacagtttctgtttggatttatttattggtttgagcaacatttatttggttttcatggatattctgttcctggcctcttcactgattagattcctattacagaaaaatacatacagggagctggcacctaggtaatgataaaagcagcaggcttctcaaatgcaatatggactgtttttcctttgcacttctgttttgcttagcgattataatccattcatagagcataatgcttgtctaactctggccctaagcagccgtgactccttttatgtaaggagaaaatctttgttttagagagaaacaacaagtctttaactatgggatacatttcttagaaacaatagaattaaattcagatcagttctcggcagagtttcaattctgaacaaagcttatcagaaaggggcatatggggacagcaaaggcttgtgaatttaattgaatggaggtgaaaagaactctgtttctgcagaattctgatttctaaaagaccccaaatgaattacttcaggggagtccgaattaaatcgatcttggttaccactaagcaagaaaaataaaataatgagaatatctggcagctgagtgtaagtttttcaagttttacagtttcaaacgtgaggttaatgttctgagagagatgccttaattcaaggaagtgaaggtagctgatgcagttcactagagtcacttaataaacaatttcatccatctactagttcatttttgagacatctattttatattattagcatttaaatgatatttcttatacactgtttttctttgtgaaaaattgacaaattcaggtatgtaagatgccaacccaataaaattccaattctttgtttctgaaagaatctgtctccaataaaatatttggtgctatgataaaaaatttcaaactatggcaacttttttttttttttttttttgacacagagactgttgccaaggctgaaatgcagtggcatgaactcagcttactgcaacctccacttcctgggttaaattgattctcctgcctcagcctcccaagtaggtgggactacaggtgcctgccaacacacccagctaatttttgtattttaagtagagacgggatttcaccatgttggccaggctggtctcgaactcctgacctcaagtgatccacctgccttagcctcccaagtgctgggattgcaaacgtgagccaccgtgcctggtcccaaactatggcaacttttgttttctgtttgataaactcagtattggtactgaaattaaataactaaatttcacatgctaactttttgtttaataaaacaggctgttttgttgttgttgttgttgttgtaatcattttgattattttggttaaggagaaggagttgaatacgtgtggttaaaagatgtgtctcatccacagctctgactcttttccccctcccacttgggcctggtgatcagcacagtgttcctttatttactcatgtattatcagtttggaatgaccaccctgacgagtgacagcaagactcagccccatccacggacagttccacacatgacatctctgtcatgcaggactcagaaaggacaaaagccatgcagttgctgctctggattcttattcaccagtgaccatcagggatgactaaagacatctagtcacttttttaatagtctggatgcttggatgaaattccacttcagatggcccaatagtacacatactcacttacacatttatgagtgcacatgtgtacatgtaaccttgaacacttgcatgcttaaccatcaagatagtgggagtaatcttttaagcatacgctaagaataattcatgttaacataaaaataggcccaagcacagcagtttattagttagagtgagattgagttcatacgtaatgttaacagtggctttgaacacaatttaaagttacattttgttttaaaaatcatacatttataataaaaatatgtgaaatatgtgagagtggtcataagtttggatggtagggaaaatgacaagatctttagagaagaaacacatttttgtgtgctaaaaataaccaatgagtatcaacactgaaaaaaatattttttaaaaaatatcaaaggttatttattgatttgtcttttttcccctagtactgtttacttttgagttacaaaaagaggtacttatatagttccctatgtcagctaaggggtgaaaaagtcatgccacatggatttctgtttatttatttttgtattttttatttcattagatttttttctccaaagttttcatgctgttacaaatatccatcatggactatcctgccagtgacgatgatgtggtatttgttttataccctcccattactttttctcaaaaaaatagaaactaaaggataggaaaatagcagagaatgacgtcttcatcaaaaccacatcaattatttatatgtttaggtatcactgatttttttttcattcttccatttgtgttctcgtgtgacaaatatttaattttcaatataagcacagtactatgttatgtttggggaagcatgtgaactaagaaccattatttattgagaattttatagaacatcatacacatttcctgtctacaagaagacaagaatgggcaaaataatcattgtgttatagcatgctataaattcaaggtatgcttcaagtgtttttgaagtattctcctatttattcttcaagtactggaaatcttcaaatattgaagtatctgggcgtcaagtccccattgtgctttgaagctaatggagcagacagacatgtcaaggggcagtccccatgcagcacggtgaatgccagcacaggccttggtgcagagtgctctggggccatgctagtgctcttactccagctttgggggacaaacattctgattgattggaggagtctagagggcatcacatactaccctggctctctccctgctctcctcctggtgccagtgtcctggccaaactctcatgatgtgaagtctacccctacacaggccatatccctaagttccacatggatccttttccctttctcacatctgagcagcagaaaagctcaaccctcagtcactgacagaaaacatctgctaaatggacccattctgagaactgaatatcttagaataacctaatatgatgtccgtttttactacatttgtactgaaattgaaaacgaatccagctcttcccttaggtgtggctgaacgatgtcccattggtgcagatggagcctcagtcaaggagtacggaaactgtcctttaatatccaacttcagctagtttctttaaaggaaggatagaagacattgaggaaatgaatgcaagagggaaagaggttagcttatttctgcctaagcatttacatttggggaaagcagtcagactgcagtggtgatctctaataactgcagagtatgcctgggcaaaggaagcagcaagcgtttgcctctgaaagcaggggcagtgggcaaccgcagcccacacagaagcgtctttatttcacagaaggccactaataaactactaaaacagaagcccatttgatggagaaagagagaatgtgtcaggggggcaggaaaaaaatcctacaaagaattcaaactgaaatttagtaatagagagctaatgtactcaaaaataagctcgctgctaacagtaaagacactgccaagaaatagatgggaattagtgccaggttaacacataaatcagaattttgcaattatgcaaatgagaaagccaaagactttatttcatttccatctgattccagaataaaggccctaattttgatgaatatataaaaagattttaagaaagcgagatgatgaattgtggcaaactaaagatatcaatctcactctggaaaggaagatgattgaattttttttatctgtatagcatatatatatgtatagcatatatatatataaacatatatatgaatacatatattgctataattatgcttggtattataatttatacatattcaagggaaaccttcttcttctatagtacttcatactcttgatgacatttttatacagatcctaagggcatatgaggcagatataattgtctccatttttaagtgattattagtttaatatggtagttaatttaaacaaagactttttatttataaaagtgcagttaatcactgtgaatttatatttctggaaaggtaatattataaactactttgaaaggcatggttgggtcagagaggataagaagtgaaagtcactcaggattggtattagctctataaggcatagtttcttaggactgataccgaccagcaggggcatatatttgggctgtagggaaaaccacttcaaaaatgcgtaataccaggcagataagctgtgcctatcattcaggattacatatcatatgacaaggtagaatatttcattccaaatagtccagcttttcccttaagagctaaggattaagagccatatatcctagttgttggcatatggacaggcagatggatggacttaagaattttggaaggcacaccaagttgatgccaaatatgttgaaaattacataaaacagagaccaaataacacaaagcaagtgtttgaaagcataaaatacttttgaaaaggaagatataagagtgtatttttagaacaactaaaatactaaactacgagaaggcattcatttggtacaatgaagacacactgagcagaaaggtgaatcagttgagtaagcattaagtccaaggaatgttacatcaggtgctatgagaaagtttaggtacaagcacaacctttgttgacagcccataaaaatgcaccctggtaccacagggtgaattctgatcagaattaatgcttcatctgagtttttcattataatgtttgtctttagattttgcttttgtagtgagagaatgcaaaactactctctgcagtttctaaaacagaacccaatatttttaaatggacaactgcacctttccatttagattatatggattaggatacagcagaagcatgccagttttttcaaaaaccataggaaattttgtgggactcagttagtaccaataaagtaagtataaagacttaagaccacaagtcatctagtaatttaatttgcaggactcgctattaggacctcttctctctcagtgcttcttgcttggtgattttctctagtgtcttggttttaaacatcctccatatgttgctgacttctgatgtctatgtatctatctatctatatctagttcaggccttttccctgaactccaaatgcaatgactgctatagccttgacatttccacttgcatttcaagtgtgcatctaaaaacttgacatacacaaaaccagattcttgattgttctttcccctcttcattgaaagcaattctattcttcttgctgctcaggtagtcatcatacagttactatagactcatttattcctataccttatacatcatcagcaaatcctattaactctattttccaaataatttccaagaatgactactaaccatcctggctcaaaatatcatctctcagtcaaactattataataagctctggaataacaatagcctcctaaatgtacaccttaatccttagcacccttccatctattcttcacaaagcccagatgacttattgattatgtcactcatcttctcacacccttccccacttgactggttggccattaccttcttaatgcctcacatggtctgccctcttgcaacctctctgatcctctctcctccactttagccatgtggtctccttgttgatcctcaaacaaacccattatgatattgtctcaaatcatttgcccttgatgttctttgcctggaaatccacttgatagcttctctaactttttggaggtctctgttcaaatgctagcttattacagtgatctgtgctgactgctttagatatataacacacattcaccatcaccagcagcaggattctctagctccttcatcctgatttatttttctcaatgatgctttttgccaccaggtatgttttacagatgtacacacatatacagtttatctaattatgtgtaaattctgtatttacaactttgcctactcactgaagtgcacttgtaaccccaaatctaatctttgtggtgcttttatgatcattcataagcctgcatagagctgtgaaaaatttgtgtcaccttcggggcaccagctgagagtctaggaaggcaactctctgtcttcttatttcagctctcatatttaaaccagtgtcctctttgcagtctattgtataccacctttttacgtttttgtgctttatgttggtgattttgttatttgaaatggcccctaagtgtagtgctgaagtgtggtctagtgttgctcagtgagagaagactgcaatgtacctgacggagaaaatatgtgtgttaggtgatcttccttcagaaataagttatagtgccaacaggctgtaagttcaaagttagtgaatcaacaacatataataaagaaaatatctctaaacagaaacacatggaaagaaattacatactgattgattgacaaaaatgttgttaccagaggctcacaggaacgtaccctgtatttacactgggaccaatgggataggatgtgctaattcagtgttcatggacacttatagaacataactaccatgaatcagattcaactgtgtgtgttctttttttttttcatcattatagtcctccctaaaatgaaggggattctgtaagagcagggctttgtctataccaagaatgtagcagatgcccagtagtaatcctacattattatatcaattgaccttctcaaaaattcaatgttgtaggggctactgcgtgcattctacattaaagaagcatatatctagcaggtcaacacctgctcaagatcaaacaatggtaattgtcagtgctaaggtgtgaaaccaggtactggtttgatttcctaaccattccagtactgttgaaggtgaagttggtagataagctatatggctggtgaatgaaataaaggaaggaataaatgaatgaattaaacaagtcaatatcaggtatatataattctaagctgaattaatcatcttttgctcacagcaatctcatatcacttgttattaaaccaattgtgatataaggatctattattacttctaaattaaaatgctaaatagatacatacaaaaattaaacctggaagcagcctagagtagattgaagatcaaggaactagagtcagaaaatataaaatttattcctatcacaggctacttttttctgcagtttaggggacattattatacatataaacattatcttccctgcccgtcttcctggattgtctgagtaatcaaggaggatactgaatataaaagcaatttgtaaagggctaaatgttacaatatattgttgaaatgatgaataatcgttatgcaatcttaatcatttttctaatatttaaaacaaatgtttatcaagaaaatcataaggaggcagttttaggataaataagctcatttttataacaagaaaccatgtgaaatcaaagacatacacacaaattaatatcactcaggcacaagagttttgcttttccttcaggctaatgggattgattttatgcacagtgctcacctgatagctctattagcctttttttccccctttctagaaatgagcggggctggtgcacaagtaaaatcaaataaagaaaggaccattgacccagttgcagcttgacaactgtgacacagaacaccttctactcacagaccttgagctttagtttttgcctcatgaggccttctgagctgtcacattgacttaattgtttctttggggagtaagaagtgatagttgaccatgatttgtgttgattttcaataaagttactgccaggggtatttaagccaaaacatctgcctgacagcttcattggtaccagtgtatgtaacactaataaagaaatgaagaagagatttccttccattgtgcattttctccattttctttggcaggtggaattctaagctctgcaacagtcaagccaagcccgcttgtacatcattcttacgaataaccatttgctcaattagtcctggcaatttagcacgtgttctttgtcactttacttacttagaatgtgagccgggtggatgtgagctttgttcttgttttaatatagtcccatattggttattacactaaaacagaaatatgagtttttgttatttctgggtcagaggtaaagaaaaattcaatcatgagattcaaaaaatttatgtgcttttcttctattttcggaaaaaagaaatcaaaagaaaattactttaaaagttaacatgtgtggagggatagtccaacacaaagaaaagaaatgagggagggaagatgagagagagaaagcacaaaagaggaggataatggctgatagaaaaaaacaaaagacattcagtagattttgaggcgtctgtctggggctgtcactatttatataggtgatttttttagtagtccatttttttttcctttgttgacttagacatttatatggctttctgactaagcccaactgccaattctcagattatttgttgtatacaaaatagccacagaaacctatttcagtggaaacttctatagaggtggttacagcaatgtcaagagtaaggttggaatagaatcaatataatagattaaagaccaaaacttgtataaattaaattaagataatagattggtcaaaattcaaataagtgttataggaactctggtaccaaattgttaaaagaaaattataaatctttcattgatttttagatttcttctttgtactttataatcaacctatatttgaatgctttaaatccaatatgttttgattgaggatcaaaattagttgtttgcagcagatgcagcagtgattacctttgattcaattatgttggatgtgggatcagtgattctttcatattgtgctcattacaaataataaagggtaaatatgatgaaatgttcaaatgacacatgccttcgtaatatgaatatatttaatatttttacaacttagttgtcgactgccaggcagcatcacagcatgataatatacaattttgctcatctagaagatatccacatgtccaaactccacttcgtgaagcaagtttaaagtgggagaaagaaggaagtgagtatattgtagacaactgactttttgaaaatcagacaaacagatatcaagaaaaatttgtgaccaggatagaaaatgtatgttgaggggaaatgtttctctccaaaacatgttaaagatgagaaaattgttttttgactaatataccaagtgtgttttgcagctgtagcaactccaattcacacctataaagaagcacaggtggtactgtttttgcaactcagttcattcatatgcaaccaatttaatgctcatgataaatttaaattttaagtttaggggcgtatttttccttttgggaaaagcacttcaaactttcaaccttgtacagatagatagccagcattatttttataactcattttatattgctagatatcacattactatcataacaaagcatggctaaaatactttttacaaatatgtcatctattttaaataagcacatagtgttttatttaagtaatatatagtgatctcaaataaaatttgttttctctacagaatttcttctacagataaggcacatgtaaaggtctattattcctttcagtgaattactcagatacactttttagattaaataatatacatattttaaagtgttttatatttctatattgtcttctacaaagattgacatgttccctcactaatacataaaaattcccattgtcctatttccttaccaatactagattaataaatagttactaatctggcaaaaaaaagaaggtaattagtttttggtgtaattagtatatacttcacatgcttttcatttatgtgtgaatttaggcacttctttatatattgtcaatttatatttcttttttccctcagattgcctgtttacattctatgcctatttttatttaagatatatgacattttatcactgattaatcaggtctactttttctatttaataaaataactatattatttcattctataccttatctctttccttataattttaaggtttcatacacaaagaaaaaattaattagtatatttccctattgattaatactgacgttttctgatgcagaaaaattagaaaatttaatgaaagcaatagagtcttttctcagggagaaaatgtgctcaggaaattgtgcttacagatgtgaaagattcataaaccatgtgagttcattaatggagtcaaggcaaaagcgtgtcttcttagttgtcttataagtgctatgcctctaatactcttcttccaatcatgcttgtgtaaacatctaccttaatactttctagttgtttaaggatgctatttattttcacatgctcatttattcagaaaattattattattgctatataatgacatgaataagaaattcaaattggtaaatatacaggtcaaatcatctgactgcaatgcaacaaaagccatacattgatttttttgtaaaatattagaaatataagaagaggtaatctctttgataactcatatatcaaaaaggaagtccaaaagcaccatttagaaaattcatagaatataatgaaaagagtagaaactacgaattgtagttaaagctaaactcaaagccaaatttgttttggaaaatctttactatggtagataatgcaatctccaaaaaatgttctaatgacatatttcatgacgtagaacaattgttatgctaaagcgaggtacaaatgttatttatagtaatggaccgagttttacaaattaatagtctaaatgaacaatttactacagtatatttggtgcaaaagtagtagtattagactggaaaaaaataagtaaatggtggtatttttttaaggagttaagttaaaattaattctctttatttttcctcaagtacattattaatttctctttgaaaaatgctacttctaagaatagcaaaagtaaatgcagaattatgtataataaatttgtaagagatgtgtgtgtgtgtgtgtgtgtgtgtgtgtgtgtatgtgtgtacttttatgccataaatgtgaaaagaattgtttactgggctttccaatgcacttctcctgaaatagaaaaataaaaggaggaatgtggctgagagcaagaggacaagagagagataggaagacagagtgtagaccatataaggcattcattagcatcatgaagatagagtgcacacgatcatgatgaaatcattagcatcatgtacggttggatcaagagccatcatagaaagtaaaagtacatactgagtgaggtatatctgaaaaattctgagtgatatcatggatggagagttccatggcaaaaccaataaatttcttaatcagaaatactctcatgctggctaaaggaaattctgaggtgaaatttgtcaaggtaaagagctcattcttcagatttgaagctttattttaaactctaccataaacacaaatagataaattatgttccatttatcttccttttaaaagaaattttgctgtgagatgcatatctgtcattgctatatactatttgaaagtatatgtaatgttttgtgcccttcaaagccactaggccaggcacagtggctcacgcctgtaatcccagcactttgggaggccgaggtggacggatgacctgaggttgggagtttgagaccaacctgaccaaatggagaaaccccgtctccactaaaaaaaagaataataataaaatacaaaattagctctgtgtggtggctacttgggaggctatggcaggagaattccttgaacccgggaggtagaggttgcggtgagcccagatcgcaccatcacactccagcctgcgcaacaaggctggagcaaaactccatcaaaaaaaaaaaaaagaaagagagagagaaagaaagaaagagaaagaaagaaaaagaaagaaaaagaaagaaagaaagaaagaaagaaagaaagaaagaaagaaagaaagaaagaaagaaagaaagaaaaagaaaaaaagccacatgaggcaattattgctaatttcatcttatgaatgaaggagtcaggctcatagttttccagtatcctcttcaaggctacatatattctaaactgctaaatttaaattaagattttacagaatcaaaagctgtccctgttattacttgctgcctctttagtatttttctttccctctattttctattaaatcccacagattaagttgatcagaacttgtttggagacaatggggacacaccatttcaaattttatttatgaaaatcatctttttgttgttattacaaaacatgatttaagataaaaatgttattttaaaattggtaatttatccctacacctaagcaaatattaagacgtagctcgggtttcacaatcttcaaaattgagagccataattgatatcaacttcttactcttcattctcttctttttacaatcctcatagactacctagaaaactttttatatgtaaacttttatgtcctagatcagcagttagcattttaaaaatttcattcttttttctgagttccttaaggaaagaaatattgacaaacatttaatttagtgctgagcaaattttacactttccacaagctcctgttggttgagaaatattcttttgtacacatgcactggtatacacacactgacacatttcattgaaaacaatctgggttttcaagtgattcaactagataaaatgaagttctatttgttcaagtcatttcagaggcatttacttctctggacctgtaagtggtctttgatgtgaggatggtatctgctataattgccacagatgtattcagagtttttgtctttttaaaaaagaaaaaaacaaagtgctcatcttgattcacctcctacagtgaatgatctttctgtaattcagtttttttcttcttctttctttcttttttttgagacgaagtctcactctcttgcccaggttggagtgcaatggtgcgatctaggctcactgcaacctccgcctcccgggttcaagcaattctcctgcctcagcctcctgagtagctgggattataggcatgtgccaccatgcctggctaattttttatatttttagtagagatggggtttcaccatcttggtcaggctggtctcgaactcctgacctcaggggatccacctgtctcggccccccagagtgctgggattataggtatgagccactgcacctggctgtaattcagtatttttatataaggacgtttctgtttcctaagcaatttagtttctttcttgaccttttcattagtgctaaggtctgattttttttatatgaaagtaaatgtgaaagtctctgaatgggctctgtaacagccattataaaactatataggaagtctgatacttcagaaatgaatatttttctgttaacaaagtacatctgacaaaaaaagatcaaacagtcagtccactttgtaaaaactctggaggtttcaaaaagcaagtcgtcagggtttaccggacagtgtgcaccgtagcaggatgctaatctctccagactcctaaacaaagataactaacagacaagtgtctttgattgagaaagcaatgtgacccacgggaggtacacagtttgttactgccctgtaagtcatccagagccacagtcagtctcgaggttaggaaaggaatcctgccaattctttgtggcatttccttctctctctctctctttttctcgtctccatctctctctttctcttctctccatctctctctttctctttctctttctctctctctttctcttctctccatctctctctttctctttctctctctctttctcatctagggctcatcagacttcttcagaatgattgcatgctttttcttctcacaaaagctataaaccagctgatatttgaataataaagaaataggaaaaggttaaatgtctaggtaaaaatatatttcaaataatactttacatatgacacgacattttcctatctaggatcttattttaccattgctctcagcctaatttggcatgtggtggtgatatcaccaccatctagaggaggaaggtgaacttcacagagccagagctctgggccagcccagcagcattgaaatttgatgtcagagagagatggggtctgactcagcccatgctcctaccattacacgacatttcctctaattatcaacctcagcaaatcctgactaatcggtgaagttgacatttgttaatttctaccttaaaaaaaaaaagatgatcaagtaaaaggaactacagagaagaagactggcagagcccttgcaaaatatctccaacacgattgcaggggagcagattattttcagctgattcaataggcattcactcttcattagaaatgctttgtgctaatttttattctatttttccaaaggaatagtttatttatccgattttaatgtgttagcaatgcaaagagaagagagcacagtccatggaaagtcatcaactgcatcagccagggttaatgttgagtgcacactgaacacttgttcaactcggcattgtgaaggcaagcaagcttaagaaaatcaattaatgtatcatttcaattcctagatagatttctttctgcttactccacactgccactattaataaagcaggcatattaagcactaccagcagcagggggtaaaaaagaaagtacaggcataaaatctcacaatttacaaaaagaataacccttatgagtcatgcagcatcactctccaacactctgacattcaaaacaaacttgctatgtgtggctgttttaggagtgtgtgtgtgtgtgtgtgtgtgtgtgtgtgtgtgtggagagagagagagagagagagagagagagagagagagagagagaaatagctctcatgcaggattttctcttttttcaagttggaccctacgtccaaatgatgcaacgaagaatcactgaagtacccaacacatcccaaacttccccatgtaacaaagccttcaactgatgtaagatgtttcagatatgatctatacagaaatacagcacttgccattcctttgcctattccctaactagatgttcctaattcttccactaggagtattcacccagtccttacctggtggcacctatcagaaaacacaacatgaatattaactaaccttatagaataccttttctgtaccaaacttttttctaacataaactgttatgtgtgttagctcatggaattcttgtcataaccctgtgaagcaaagcctattattatctccattttagagaggaggaaactgaggctcagcaagtatcctgcccaggatcatagatctagaacatggtagacctgagatttaaatgcagccatctagttcgagaacctgccttcttaacaatgaataatacctggctttagcaaggcaatacattagtctcccctgcttatcccacactgcagaatgaacagattagggtaaatggattctacctttgacaagggactcaaatatagaggcttcataaaattaaatcagtccaaaaatagtggttctctaacttttggagtctgatcatcctttacaaaagccagagaaaaaaaaaagcatgtcaagggcagagattccacttccctaagtcttctcatgcaccagaagctactcttggtttctccttctatgttctttgcttcttaatttgaaactgtgagattctttctggatgtgtatactatttgtctcagatattccttgtcagtttctatctatggatacataaaatagaaagtcctttttccaaaaatgtgtgactatccaaaggatgaaggcaacagctttaggttaacttatttcacattactacagactaacataaaaagagagtgaagggtttttttttttctttttttttttttaaaacttctagttattttaggacctgacaccaagcatgaaatacaccacttctctcagcaggcacggattgctttaaagttctgttgcaatttttacaacctaaaattagtgtacaactctgatttctaaccagctagatgaagacaataagaaatgttctaaaatttcaaatcaaatgttatatattcgggtcaatggatggctatgcttgtcctgagcttcaatcagtgatttttttaaaaaagaagataatagatgaaggaagcatgttatgaatgaccatagaggattctcactaatttgaagttgctggtgcttttttccaatatgattttgccaatctttattccaactgtgagagaacaagaagaacacttatttctcatttgatttcctgcaaggcattggattgtaaattgaataccctacatgagatttttgagacttcacgaaataaatgaagaggcagagaaataaaaaaagaaatgtaaattaccataaaataatgcattttgaacacaaaaacatccatagaaatattttttaaacacacacacacacacacagagacctgtgattaatttctatgctatttgaatgcattaggaaataaaacttgatttaaattttagagaagtcttgatacagaaaggaagagaattgtcacaaaagaaatttattaaaagtttaaaatcattacataatataaagactggtacatttttagatattagttgacatgaaaaaatattttctttatctgtaattttaatacaaataaccgtggtaattatcatcaaaagcaagtttttaaatgtccttaactcctttatttataatgtatttcatttattaggtaagctaactagtattaactgaaaaacagtaaaacttatttgtccctctacaaatatcttttaaatcttatctattattccaacttattggccaggcgtggtggctcacacctgtaatcccagcactttgggaggctgaggcaggcagatcacaaggtcagaagtttaagaccatcctggccaacatggtaaaaccctgtctctactaaaaatacaaaaattagccgggcgtggtggcgggcacctgtagtcccagctactcaggaggctgaggcaggagaattgcttgaacctgagaggcagaggttgcagcgagccgagattgtgccattgcactccagcctaggaggcagagcaagactgtctcaaaaaaaaaaaaaaaaaaaaaaaaaaaaaaaaaaaattccaccgcattgtgttaaatgccattaggttctaatttacaatgcatatacatcatctaacaatttatgtaagataagtaactttttcactatagatgaaaatttaaaagactgctcaagaattgtttttatttatctggaagacaaccaagtttagaacacaaggtgacaaagtcctgagaagaggactttttagtggtggagggggacagtctctctctgtagcccatgctggagtgcaatggtatgatctctgctcactgcaacctctgcctcccgggttcaagctattctcctgcctcagcctcccaagtagctgggattacagatgtgcatcaccacgctcagctaatttttgtatttttagtagagacggagtttcaccatgttggccaagctgctctcgagccacggacctcaggtgatctacccgtctcggcctcccaaagtgctgggattacaggcgtgagccaccgcacccagcagggaagaggactttgagtggagtttcgtctttgcagtggaagctctaggtagctgaaaaacaaaaatgcttccagcatgaattgaaatctgaattaatgtggatcaagaaaatgttgggggattggtattaaaaaaccaacttcatctacctattagattttactgccaccaattttggttagtatagcaagcttatcatctaagtaatagcttgaatggtaattaataataatagcttgaatttattgattgactattttgtatcagagagtctatctgtcaatcttgtatagaaacttcatctcagcatctcaaggtaatgttttattttgttttcacatcaccagtaactcagtcttacaaagtttgtctaagatcccaaagcatatatgttgttgtgttaccattagataaaggcatagtgaagtgcaatttagctgcatttattttagtggtttgagcctaactaaagggtgtctagacacacacaatactggtcaataaacaaatgctggcattcacaggcaggcagtttgtatgtttgagacaggaagtcagagtttgtggccactgggtaactaagcacttgagctagcaacaggggatttcttatgtagataacttgtgtggtttttatagcccaatgctaatgtatctgatatattcaatatgttctcctttttttttcctgtctctctagcagcctttctctgccctatcatggtggattatactgtattggatcatggaattactcacatatttttgcaagactagtggtctgtatttaaaggaataattatacctttgagcaagacttgagattgcaaagaggtgtccacagatttgagatttgtctgtggtatggggactttctgttttttctttttctagttttatagtttatcttttaaggatcttatcaaggccaaggcattgcctagagccagaacattagtaattaggataaaatttgtttaaatgcataattatggttatatcaagtaaaaacatatttttcagacatccacacaagtgatttggtgctagcaatgtaaatttaatttaaaactatttttatttgattaaataaaaatgcttaaaagtttaaaaaagttttcaggttttttttcttttgtaatggtaaattcacatttcctttattgtttttaacagttaataaagaacaatgctgcaatcactgaatttaattactggaatctaagtttacccaagcacaaagagaagttaatagcaggtttaagcatgtttatgaataaatagcaccaaggagtatctaggtgttgaaactttgcagaaagactaggaaaactcaagttttacaagtgcttaatgaattagatatttagtataattatttcaagttccacaactggtttctcttcaatgagttatttacaacatttagcatgttctataaactatgtttacatttaaagtttattttgacaattttccatgtgtctgataatttactagactcctaaatataaaatataaatataaaatatagatatttactccatggagcccaaattcaaatgtggagaatagtatataaatacagaatattttaaaagtaggtcatataatccgaggagagagacaaagagaccaagtaaaccttgggaaaacatgagaaggcatcacaaagtcacagggaaaactgaagataaaatttgaactggatctttaatcttggtgattttccaggtagacaaaataggacacaaaataatctacatgtaaagaaaacaatgaacaaagacccagaggttgaagaagaacaagatatttttatatagttgtggaccaatggtcatggtgcaaagaaatgtataatggggttaccaggatttgaatccagagaaaaggctttagataagattgtaaagattaaaaagaggttaggaatttggatgttgctaggaaaataaaaggaaccaatgaggttttcaaataagggttgtgatatggatttgttcttgaacaagacagcctggaagcactaaacaaaagtgaagattggcagcttctctcatacacttcttcaaaggaggggatgacactattattactattttttaaacaaggtctcactcccattattcaggctgcagtagagtggcatgatcacaactcactgtagcctagacttcttgggctcaggtgatcctcccatctcagcctcccaagtagctgggactacaggcatgcaccaccacagtcggctaattttttttttttgtatttttaggggagacgtggtttcaccatgtttgcccaggcgggtctccaactcctgtgctcaagctatccgtctgcctcagcctctcagagtgctaggattacaggtgtgtctcactatgcccagcctaaaaaaaatttagaacctctagcatgccttccagggacacacttaataaatattcagtaattattccatatctatgcttcttctacaataagccataaagactattttaattagttactgcttcacattgattggaatatccatttctttccaattcaataaagcattgtcatcagaagtaaataggggtggcagttgttctaatggaagctaacaatatattaactaatggatttagaaaataaattttaaaaattgcatatgttatcctttccttactcaaaaacagggcagagcagttggtaaattgccttccattcttctatatttgtctgttttagaaaaataaaataaaatatctttcttattcattctttcaattggaatgtaatgtaatataagaaactgtaatgtactcattttgcacacatattaagaaaacacacggcataattgtggattatggattacaagaatggatccagtataatggcatatttctcatgaaaaaataacaattataatattaaccaaattttaaaaattaatttaaaaaatctaaacacaggacataccagttatatttagcatataatgaatgcacagaatgtaaaatgtaacaaatatttgagcgaatctagggaaaattactctaagcaactctatcttacacagagggtgtgattaatcactggcctatgtatacttttaactaagtgcactgttaggaaataatgagataatacacaaagagatatgccactttttgtacgtaaggatgatattcccatttccaactcttctgataaagatctaaaaatgacagatccgtactagaaatgttttcttctcgttttaatgaaagatgaccatcagagatattacatgcagaaaaaaacgcaaaattcaatagctaaacatttctacttgtgcacataatttaaatcatatcgaaagattgggtttcacttcctctaacatatcaatacctagcaaaaatttaaaaattaaatagaagtaatggcagcagcagcccatctggagcagctgctgcaaagacaccggctgcagtgagagaggcgcagccagggctgcaggatccacagagccaatgggagccaggaacaggagggagccccgcccccttctgagttggtggggcagaagccctgcacttctgggtgcatctgcagccacccagccctggtcgtggacctgtgcatccctgtgctcttggggacccaggaagctccttgcctctgcaggcttgaaagtacctgctcccactgcctggcttctcccgactcccagtacccactccgatttcagagtaaagttgtggccgactgggcactgtcatgatccggctgggtgtgtgtacgcttggtgtggtgctgacacaccagccccctcccacctcagccccctctggactttggattcccacgaacgcaggagagaagctgagagggagggctgaggccagctcagcgtgggcctgcaggtgctcctcggcatgaagagcctgggtgccatggatggtgggttgatggcagcaggaggcagacaggttcctggacagacaggggcagttccccagtgaagccccaccttcaggccaccaaaggccgaagccccaccttcaggccaccaaaggcctgaagtctggggaccaggctgccagttccccggaaatggagtgagaacttatggtgctttttccaggcccacctatggccacccatggaccaatcagcatgcacttcctcccctttgaagcccgtcaaaacccctggattcagccagcctcctgctttcctaaaacctgcctgcaaagaggacctacccacttcgggtctcctgagacctgtgctgttgctcaataaagcacctcttcacctcaatcaccctccagttgtcagcatacctcattcttcctggacttgcgacaagaacttgagacctgatgaatggtgggtctgaaataagtgtaacaaaaacggggctgaaacagacccctagcttgccatgttgcaggcaacgagaaggagggaagagagaaggagagaggagctgcagctctttggggatcccagacctaggagctccccaagctagggctatgacaccttctttggggctcttcagtacctggcctctccaagcttccaggcaccaccacattccccggtgccagcactggaagccacttgcggtacatctggtccaaccacagcctcacaggaacccagcacccatgccagcacctggagctgcctgccctgtcgcagctggcaagcctggttgtgtgcggcagctggacaccatgcttgctcactcatacaccccttgctactccacacctgactcactcttggcaggcgtgagatcagtgccagtagcgtgagcagactgtggcctgccaggacgaatgggtggaatgaagccagtgggccccagcaaagcttaggcaaaggcaccactgatcacaaagtttttcatctggcaaggtgacacccaaggatcccatgacagaaagagcaatgtgttgagactttaatgaaattttaaagtgacatatttgcaggtttatcaaggaatataacaagctcttcttttgtacaaagtaaaaccagtttgaattaagttctaattctatgatctagtcaattgcagaatttaataaaactgatttaagtccccttttcttatccactcacttaatgtcttgaccatatttgaatctggtactacaaagagtctcacatgaagcactgaactatttggtatagagtaagtcaccttgataatccattaacaacttgtgaccctataaaatgtcataaaccaccacaccacatatgtatacatgtgccatgcagcacaccagcatggcacatgtatacatatgtaacaaacctgcacatagtgcacatgtaccctaaaacttaaagtataataataataaaaaaaataagagactacctatgaaaaaaataaaataaaataaaatgtcacaaaccattaccaaaaacctactattttatctaacaggtatatgtgttagtaatacatataatgatggccaaatggtctctatatatcttgatttttcagtactactctatgacgtttacttctgatatcttcaaattgcctcttgtccagaagactataatctgtctgaacctgtgaaaatattaccctttgggagaagacagcacataagttatgtccacaggtagtccttcaagttttcatttacacagaagtgcaatttaccaaccatttattggtcttccttagcagtctgcttttactgtgatttgtagaactgtctactgatattcaaaatatttaaacaacaatttctaatatagactctgaattacggttacaaaaatcaacaggagaaaaaccaaaaatagtttgttcacaaaaataaattactttccttttttgataattacgtttcctttaggaaacatatcaacatttaaagcaacatgcacatttaagagttttctttatttcaaaaatgtggaccacagtgcttaagaataattattttagtcagccttggaacacgcttaaataatttaatattttaaagcaattagtaatgttctcttacaacatgcaagaattgtagctggacagaccaatgtgacaaaacccattattacaaaacctaatattagagaaccatgccacaaagaaaactggacagcaaactcttccatttatgattctcaaacacgttccatatttgcaacacaaaatatcagatgtggagaactttgtgtctaaaagtaactttgggttcagtcttgctaacttatgagtgtgaacagtgaaacatatctatatgtagaaagatccagaagtcatatcccttatgcctgttttgttcttttaaaaactacttggccaggcgtggtggctaacgcctgtaatcccagcactttgggaggccgaagtgggcagatcagttcaggtaagaagtttgagacaagcctggccaacatggtgaaaccccatctctactaaaaatacaaacattagccgggcacggtggcaggtgcctgtaattccagctactcaggaggctgaggcacaagaattgcttgaactcaggatgcgaaagttgcagtgagccgagaccgcaccactgcactccagcctgggtaacagagtgtgactctgtctcaaaaaaaacaaaacaaaacaaaaaaattgaagactgagtctatctgacaagacttgaagaaaaataaagagataaaaatgaaaaagaaaagtgttataaaagaaagggaacactgatgatacactaagtatttgagaaaactatttataaatttgaaataaaactaaagctaaatgtaaaaaaaatcataggaaagaaaagaaacacaatatctctacagagacttaagttcctcctacagtgagaagaagagcagtactttctgggaggtgcaatccacaaaagaaaaatccttagcgaatggtgacatttttcgttatgagatacaaattgctattttcccatgctatcttaccataaagtatcaaaaataataaaaaaaaacagcagtctaagtaggggaagatgataaatcattagagaagagccgccacctgctaaaactttgaactgcgtctgaaagcatctcacatcaactgccagagttgctgctgatctaagaagtaattctacaagctcgatgctggacacaatagtcctgttccctgtgcttttgcaaacaccctattggaaccaatttttctttgttttaggaagaacaaaatgtgagtccagtaaaaagtattatagtaaaacaaagaaaaagaaaaaaaagcaaactgaaaaatgttgaaaaggatcagtgcaacagttcacaaaatgattcatttttttttcatataataaggtaaaactaatctggataggtaccaaagaggacagaatatccaaatgagaatgtaagttgccataataaatgcaaaaggatgacaaaatagaagagaagatcagaaagagagagagagaaacagacagagagagagaagatatacaagggatttgagaaataatttttaagagaacaaattgaagagaaaaagtctacattaaataacctgttgaaaagtaaagtgacacagaagaaaactttttaaatgattgcctgaatgaggaagaatcagtaaacaaagacagaaaatattgaacaactggaagacagataaagaggaaggtatatgaaagccaaatatggaaaaagatggtagtgaaaaagagataaaggaggtaaaacaaaaaaaaatcagatggaaattagaaatgtccctgagatggaaaaattcaatatatagattaaaatggctcatcacattccaaacaatatcaatccaacagtttgactcatcctgaccaaatacaagagtactataaagtaagattccacaacatccagcaaataaattaagtcctatcacgtagtaatacgatggggcaacactgagagaagtttaaaagaaaaaaattcttcatcaatccacaaaatactaaagaaaaatataaaaataagaaatagtattaaaaagaatattaaaattatatgataatatattaacgacattatacctataaataaccagaatatatttttgaagaagagggaaagagtaaaggaataagagtccttttctcaggcagtgggaatgaaattatttatctttcttcatttttcactcttttaaatgtgggagacatcagaaattttatttaaaaacctttaaaaactataaaaggcacatttttgaagaacataaagcaagacatagactttctgaaatggtaataaagatgaggcaaggctatacaggtgatatgcaaaaacgtagaacaaaggaaacgaaagcaatgtctaaaaatagaaaatataaaatcatattataaaacataatatatcactgaattacaagaatgatttcaagtggttcttaggataaaatttaattgaattatatgtaaatatattttatgagctatcccttaaatcaaaagaaagtgacccacattttttaaaatatacataatattaaaaagtatgcaaagaatattagaaaattttttaagtcaagttcacaaaattaaaatgttatagaatttatccagaaagcattttatgtacaaaatatatcaatatatgttttgttttgtttctcttttagagatagggtcttgctcgtcactcgggctggagtgccgtggcatgaacatagctgactgtcacctcgaactcctgagctcaaggaatccttttgctttagcctctagagtatctggactacaagcacatgccatcacgcctggctaatcttttaattttgtgtggagatggggtcttgctatattgctgaggctggacttgaactcctggcctcaagagaagctcctgtcttagcctctcaaagttctggagttacaagtgtgagccactgcacctagcttcactatacatttctaattggtgctatttccaagagacacacaaattcctgcaactttatatatgaaataataggggtaacaacgcatatataaaaacctattcatactaaaaaagaaagggatcaagatgtaaagatccattatgaaattaagaatcaaggtataaggatactttatgaaatcaatgcacagctctcagttttgagagatcaataagcaaaaggcaagacaaacattatacaatgtgaatattatcattaggatagttaatgtattgaaaattgtcccctagatataaataatatattttaatgcccaaatctcatgttactaacactttatccactggtcaacctaggaaaatctcaatttgtctcacaaggtaaaaatgaattaacgtaataaaattagaaattaattagaatgttttttagaagtcttataaatcaatacatacagccaaaaaataacctcatagtaataaataaatctaaggccaaaatagaaaacaaaggcacaaataaaatctatttagaaattatcagtgatccgaaacatactcgccaaaattcatggcatgtacttaacactgtactctgaaataaagtcatagtgttaaatacgttcattatgcaacaagaaaggaaattttaaaaactaaaatttgctcttagtaatataaatgacataataatatatatttagggaaggatacaaattaataaatgtcaaacagggaaaatgaatcggtaataagaaatcaggagacgaagcattatattcaataatgatttctgatagtcatttttaaaacaatgatatatatattcaaacttctggaaagtaaaacccagaaagcagactagacatcagtgtttaagaaaggcattgagtccacagaaaaagaagtgatttataaaactgtaaatagaaagactgtcattttattttactttctaattcaaaatttatttatatcactctgcaaatatagttgagaatctcttaaaagttgatcaatttcattaaaaaatagatatttcaatacagcttcatggagagaagatataatattttgactcatgtctgtagaagttataaagaagtgagtttagaaatatatctttcccccaaaagttgcaggacccaaagaattgtaaggatgacatcaacgaaatatccatttttataaggatgacatcaatgaaataagtatccatttttatacactttatagcaggccacagaaattatgaaaagttttacaattcatatgaaaagcttgtgtaattctgataataaaaatggcaaagaaaaaaatactggctttctttacagacattgacacaaaatacttaatatttaataggcaatttacttcagccatatcgtaccacgctttaccatgaaattgaaatagaatttctagtagcaaagcaaggatagttaaaattaggaaaccttataaattgactttttgaattagttaatagaaatctccattgatattgcatagttatgtgataaaatttatatttattataaacatcacaaactgggagaaatagagtattttcttaatatgttaaaggttttacagcgaaaatcaattgctgttcttgtatataataatgaactgcagaagatatgccaagtttttacttatgaggctagaaatgtaaaagagcaaaaagaaactaaatttaaaaatgaaaagacacagtgctattaacaacttcatctgtttgtttttggttttgaccttcaggcaatccactccctagctctctgttaccaactcattgtgatgttgcgcattgctgtcggtggttcttctccacgatggtggataatgggtaatgagttgtgctagtggtccctcaatccagttccccaacatttagatacttctcctaggcattccagaggctgagacctatagatcagcagtggattaagagagtctgcctcttccattcttgcttctaccactctgaaaaatccccagatctatgtactgcttttcccattttttttttattcttcatggtttaaagactcagattgtattttaatagatttatggaattataattgatgtagaatatactacgcattttaaacaatatataatttaatagtttttgagatgtggtactgataaagccattaacacactcgaaatcgagaatgttttcaccactcacaagtttcgttgttcccctcttcagtcctcctgcatcaatctccttcatctccaggaaacaactaaacttctatcacaataaatgactttgcaatccctagaattttatttaaaaatattcatggaatcatacagaaaatactctgttttgatttgccttctttccctcaacgtaaatactttgagattcatctatgttgtgatatcaacagtgtgtttctttttattgctgaatagtatcccattatatggatacactacaatttgtttatccattaatctgttgatggagatttggattgtttccagtagttggatattgcaaataatgtcactatgttctttcatgcacaagtctttgtatgggcatatgcttttatgtcccttggttacctaaaaatcaaagggctaagtacctggttaggttcatgtttaactttaatcaactgccaaatggctttccaaaatgatttttacaattttacatccctactagcaatatatgaaagttctagttactctgcatctttgccaatacttgatctgtcatttttattttagctatttctctcagtccatggcttatatttttatttccttcacagtgcctttcaaagagcagaagttttaactttaagtccagtttatcgctttgttgttttatgccgcaaacttctgttgtcatatataataaatacttgcctaacgtaaggtcaccattaatttttcctacgttttattctagaatttttatggtttcacatttgcatttaggtctatgatccatgaaatcaaattggtatgaggcatgaggttgagtgatttttgcttgattttggcatacggatggcaaacatcatttgttgaaaagactaagctttctcccctgaactgcctttgcacttttgtcaaagatcagttgtccatatatgtgtgggttatttttggattctctgtttcattgatctgcttgtctgtcttaatgtcaattccacattgttttacataccaatgttttgtaagtcttgaaataagatagtgctgacactccagctttgttcttcctttacacaattgttttggttattataggtcttttgcatttctgtatgaattttaatatttgaaaatgtgtcaatttctaccaaaaaggaggctgcttagactttggttaaggtcatgttgaatctataaatcagtctggagataagtgacatctcaagaatactgcttccaatccacctcacccattacttacatcttccttatatcagcaatatttgtggttttcagagtacaggttttggctatttctgtcagatttatccctaagtacttcatatttttatactatgaatggaatgtttttatgtatttttgattgctattaatatagatatgtagttgatttttgtgtaatattcttgtactctataaacttgctaaactcacatattttagtagctttcttaacagattcagttacattttccacatagatggctttaccacagattgttttacatttttctctaatctctatgccttttatttctttttcttgaattattgcacttgctagaaccattgtataatgtcatatagggtggtgagaatagatacttttgtcttgctcctgatcttagggtgaaaacattcttttgtcttcattgtgtatgatgttagtaatcaccttttcacagaaggttttcttagcaggttgaagaagttccctgctattcctattttgctgaattattattagaattgtatgttaaattttctcaaacgctttgtctgcttgtactgagatgattttatgttaattatataatgagttacattgactaatatttggatgctatactgacctagcattcctggtatgcagttgatttggtaatgattttggggtatgactgataaaatgtgtatagaattgtacacaaatgtttacaaagtgtacttgcctgtagtattgtttcttgtattttgtctgcttttgcatcattataatgatgtagtgatggccttcttgaatgagttggaacgtgtttcctcctcttcaattcttttttcaagcctcttcaacttatatagaatttgcattatttctttattcaatgtttggtagaattaactagtgttgccacctacacctagatttttatgtgtgggtaagcttgtaagtacacacttaatttttaaaatagacatagggatcttcaggttatctatttctttttgagtaaattttgatagcttatgtatctgaaaaatgtgtaaattacacctaagttattaaagtaatctgcaaaaagatgtttattatattctcttactatgcttttaatatatttaggatttgtggtgatcttaccgctcttatttctgatattggtaatttgtatgtttgctcatttttttgccaatcaatctgactggaattttatcagttgtattgcttttcttaaagaatcagcttttagtttcattaattttctttattgtttttctgctttttattctgttgatttcaactgtgaattttattaattatttttctgcttactttgtgtttgatttgctctgtttttttttagtttatcaagatagaagctaaggtcatggattggagatactttttctttctaatataggaatatactgatacaaatttcctttaagttctggttgtggttttgctattgttttatgggactctacaataagaatcttcttccacatctcccttatgccacacttttctagtttcaagacttaaagaagacaaatattaagtctacatctacatctatattcacacacacacccactatactatgtacatatatgtatgcatggatacacatatacatgcatatacacatatatctgtgtatatatggatttgtatataattatacattatgtaattataatatataatcttatttatcctatataatagtatatccaaaaatcataccacacattctattctaggctcaagttgctgataccagtaatagtcatcaccaaaaattgtgatatctgagttaggacattacaagcagaataacagtattacaataatagctaccatgtgttaagagcactcactatgtgtcagactatgtaatgtcctatactatgtgatgttgtgatgtcttcatatcatcttacaaagtaataagagaatcattatcttatacatataaatacagattgacatagttacatagtctgcctgtgatccaagaactaaacatggcagggctagtgtttaagcccaggtcttttcgacttcaaaatgtttctgaagagagaagaaaaaaatattattttctttttaatttcagcctctccatgtcagtctatggcatttgttcagatttgttcagatttcattacctgtgagccttaaactcaattggaagaaatctttcatcaagagtttaaccatatctctcccatataatagaggaaaattctaccatccgtgaaaattgcttcctctagtagagcatgtcatctaaaaaactgtctttttagcgattgtagaaaattacagaagtgcctctgccagactccaaattttttccctgaggctagtttcctcctgcacattttcatttggtgtgttcaaaaccatttatttgcttttcagtttctcccttgaatctttctttgcagggatcccatcgttaaactgagttcagacactctcttattaagatctcttcccttcccatacacataataggcaaacaagcacagtaatagtcctaagttcactgatgcctaactaaacattaaatattcttgggcctggtgggtgctatatgtgtttcccaaacccaattactcagagaccctgtgagatagtgtattttctctagcatgtacttacttactcctaacattgcctcaccatatccaaaattctttaagcctatagtactactattgtggcaactaactatttttcccatcctgtaacaggactattattgttttgtctgctaacctgtcagtccttcaggctcaacatgggaagtatatcatccatgtcatcaacaaaatcctaatgccactttgttaaatgcctgcacacagaaattctctcaatttagaagtttgtgtcagtttactttagagatacctacagatctctacatagattactccttgctcgctacatatgacatccaactcctgaagtttcaggaatgcaagtgaaccttccttggctgtagaaatgtctttttagcctctccaagaccaggttttatgcactacattaataatcctcaaccacgggtgattttgcttttgcttacccagagggttaattggcaatatctggagacaccattggttgtcatgattggcatgcggatactgatattggtatctatgaatagaggcaaggcatgtttaccacaatgctcaggacagatctcagcccccaccaattacctggtccgaaatgtcaatagtttaaaacctttaatagatgctttcctagttcaggagttttgtttatttgtttgtttggttttgtccagaaatgtgtcaatgggaagaagaactgccttagcattctaagtccctgaggtcacattgtcctggtcccggttctctacacacttacctgaccctgcccagctacaccaggtgttaatcttgtctctgagatgcaaagatattaaggcatgataggaataaagaattcaaaataagcttcattagctgcctagttctgcaatgattttagttcctcactctatctttgctaaactgaaatgaacaacatgtgaatcataaagactgctgtcaattatttaaagcccagagtcagtcactctaactagatgaacaacaaaaaagcttacgactaagcctattttatttgtccagcatagtgctaaaattttgaatgctttcatagacattatgcaagctgtaagtttccatagtccctgcaagttaataatctttatttatatatgttgctttgtgtaccatctatgttacttacctctccttccctggaaggcatatgagtttgcctaggcttgattaaatgcaacccatggtcaaatttaaacagagcactttcctaaaaatttgcccttaaagtatatggttactttgactttcttgttcttgtcattccagaaattataagatctagtggagcccaacaggagataccaaagaaaaaaaaagtgatacttctttttatagcttagagtagcatgtctaagtctgcttccccagtataaagacactcttaattgagtatagctgccgggccactttactgcagtctcttcctgcagaagagtcttcctatcagttgtaaacactcttccatcactttgaatgctccatgttcttggaccaaatcacccacagtaaggcttttcctcctcagaattattgtggaggtgagagaggagaaagttgttgagcattctcacagcttcctaattaatcaacatcatttcagaagtttgatttaaaaaaatgtgaatttgaacaatggatggtgttcagggaataatgggaaaaaatgtattatttattaagctaaaaaatagcaccattggaattaatatttggcatattgtttctggttgtaataagtgcattaaacatacaaccatacaaacaaaaaaaaatctgtattacagaagatcaaaaatcagaaaatatttaaaaagaaaacttatcatattcatattagaaacaaaaatcataaaataatctgtaatatatttaaaaataaattttctcctgtttgcataacattgtagtattctcctgcacacttgacttataaatgaaaatcaacataagtaagtagagccttatcatatctcaaaatgaaagatttagaatttaaaagataatcattcactccgtattattttaaaaaataacgcaattccaattaaatgtatcaaagacactttattagggtactgacataataattctaaagttcatctcaatatcctaaacatctcacttgtctaccactagagaatcattttaataaattaagaacaaagaggtagatctttatttactgtaatgagaaaatgtccaagatatattgagtgaaacaaataattccagaagcatacaaacaaaatttagaccagtatagctagtataatattttttgagaagaaaatattcattcataaaagtacagaaaatatccagaagaaaacagaacagagagttaacaatgatttatttctagaatatggttccggagaggataaaaggcaatagaaaacaagatagtgggaaagaaccacacttaccaatgtaattatatataattttatatatgtatatatatcattttataactaaatgtagaaactggatggaaataataccccaaatatatttttaaacaagaataattaaacataatttaatcttttagattaactaagcagtatgccaaaagcaccagcaaaataaaaattttaatagaaacacaggtgttttcatatatatttgtatatatgaaaacatatatgaatacatagtccatacgcataacatataaatataatgcataaaatgttaatgtatgtatccataagtaactacttaatgatttacaatttaaatataaaattttgaggttgtaattaaatgacgtgaaattggggaactaggtaaaatgtttgacaataaaaagttagttgaattatttcaaataaaaagcatgagactattagaaaaaaataaagtgaatagttatttactattttcttgagagaatctttgtaccatacaataaaggaagaaacaataaaataaaatatagaataatttatatataaatgaaattaattttctaatcatacaatcaaatcctacctaaaataattaaaagctgaacggcaagctctgaacgatttgcaatgtttatagaagctaaaggattaataaactacttaaaacctattataagttaataaaattacgaacaagcaaagaaaatgaacataaaatacagaaattaaaatatacaaatgtcaaacataagaaattgcatgtgtcactagtagtcacagtggtggtgaatattaatagaacaataaaatatcatttgatctcaattagaacaaatcattgcaaaaaaatttaaatgttgaggtgagaaaataaattgaaatatcactataaattgttaatcattaagtgtatcagaaatgacataagtgcaaacattattgtcctaaatttgcttatcctgaaaatgtcgaaaacactaccaaaacagaattggaacccatataaaataaattaatattattcactaactaaaaatatgtgtagacgaatgcttactgatatataaacatgttcacaagagagtaagcaaaaatggcagattataagcaattcacttacattattatttttgtgtaataaaaatgcatacacaattgttttagaaaaaagataataaaagttatataaattttttaaatttttgcttttatgtattttatcattttgaacataaacatgtaataaaatggcatattaatgaacaaaagtatgagagaaaaaatttatattaaaaaactgggccacacaaaactgtataccgtaaagttaatctatagctttgaactttagtgatataaatttatcaatattttgaaataaaaatttataaagaagattttcaaagaagatatgtaattatctttaaaaggcagaaaattttttaaaaagtaaaatttgggaacgtaattatttattctttcagtaagtatttattgagcttttattgtatacaagacatggagtgaggcactggaattataaagtccaacaaaaaaagtcatgttaccttctgctgggtaaattagatcaagtaggattggcagacattaatcaagtcattatgaaaaaggagggataatctcaaattgggtacatctcatgtagagtattagatgggtgagcaagagtaaaacaaggtggtttgactatacaaggatttctgcaacggcttcctgaggagctggtgaatgcgaattcattatatggaggtgaatagtaatctagggccagacttacatcaacacattgtccaaggagaaagaatgcaaataagaggaaaacaaaataaagccagtgccgagagtagagtcatccatgaatggagattgtagagcaaagagagtgtaaaatgaaaatctgtgaaggcagggccaggtcattcagggttttttttttttagcttatattttggttctcattctatcaacaataggactccactaaattgctttaaataaataatggaggatgtaacatgatccacttttgttttggaagctgcaccttgcctgtagcagagaaacaaattcaatggaacaagagttgaattaaggagactaaataggacaaaaattgtcactagtaaagatggagagacatgaatgaatttgagatttatttaggaggtaaaatcagtaagactccaagatagattgcttatggagtatgagggtgaggatgggtttaaagataattctggagattgtgactttccaagagggatagcttcattcacaaaacaagaaataccaggaataaaaacgtggagaaaagatcttggcttacttttggaaatgactttaagatgtctcagatatctgaattcaggtgtcaaataagaagctggcatatatttatacatgtggggaactcagagcagaggtcaagcaacagagaaataacatgtttatttttagtgaataaatggtagtgtattctgtgtgtgtaaatgagatcagaaagagagggtgagagggagagacagagagagaatatgatggaataagagaataccacaaggatgtagccataagaaaaacgtaaaactcaggtagaggaatttgagcttacaaagatatggaaaaggtgaatgattaaatgaaaaatgaatgaacccatgtacagaagtcaagggaggaaaacatttaaagaaagaaaaaaggccgactgttaacaattattgagatatcaaagtaaagcaaagaattttttaaaaaattataaaatgtggtgatgatgaagtcagtggcaagcttagcaagagctgtttggatggcatagtgggctctaatgacacatgatagtaggttgaagaacttagcaattgatggagaaaagtagactggggtagaatcttttgtaaagattttctatgaaagggaagtataatacagagcagtaatagaggagaatttaaagttataagaaaattctctctgtctctcttcctttcttgagtggtaatactcaagtatgtttaaaagcctataaaaatgatatagattcaggtcagcaaactaacacatgagctaaatccagactgccaccattttttttgtaaatagattttactgggacacagatgtactcatcctttacatattttccatagctttttgtactatagtgacaaagtagttgtcacatcgaccatatggcccataaagtctaaaatattgactgtcttattatttgcagaaatagtttgctgccctctgatccagataaaagaaataatttgactacataaaaaagtgaaaggtaactgatgaggtaaaattacttaatgtcagagagtattggtggaggaatcattcagacattggcagtattataccctgggaagtagaacattgatgtaatttcctttaatttgaaggtaattctctactagttctttgaaaaaaatcaataaatctgtagatctttagccattataaacaagaatcatttaacaaaacagaacgttgaggcatttacaatcttaaggaaaaattacatgtaatgatctaacaattttattctgtttataagaatacagactcaaggagctgacatcccttatttatagtttgtagtgcagtggtctatagtaattgaatgaacaaatatatgactagagaagatgtttaagtattacataaacaatttgttatacatgctaaattttcaaagaaatgtggattttgtaggaaactatagtttaacattctgcttcaaagacataaaagaaaaatctaaataaaatttataattttttctcagcattgcatccaaaaggggttctacaaaggcaaattttcatgaatagtttatacatttcaagggaaaacaatttctatattattttaatgattttagagctagaaaaagataaattattaaatataactcaactaataaagaacataatattaagatctctttttatttaagagataattataaattacgaatcaaagtaagcgcaataggagctgatctggaaaagaatataatgaaagaacaaccataatttattccagaaatacaaataacatttaatattatgaaacaatatatataaaattcataaaatcaaaaaccaaagtataggaaaaaagatattcctcaccaaaaaaagaaaaaaagctaaaaattcatttggtaaacttagtgtctgtcctattgttaatttttataaatgagactatatgataattgtgataaataagattttgctaaaaaacagtgttttcctagtttaaaaatagcacagagtccagtgttaccacatgctagtataggtacacaacatatttttgttgaataaatcaacgaagtggaccaaaatacagtagtcaaattaaagttagaaacaaaaaaattgctccaaatcaccatagtcatttaatggtattctagaagatttcctcttaatatgtagaagtataataaataagaaatgtaactattaaaaaagagaagataaacattgtgttttgcaaaattatttttgaactaaaaatttttaaaagttattctactaaaatgaatgcatataatcaaaatattgatgcctataaatatggacatacatatacatgcattatcatatctgtattagaattttaaaatgaatcaaatgaacacatctttaaaggggacatagaaaggaatgatataaatcgagctctaagacaatattttttataatatttccttttgaaaaatgcagagatttcaattatttccaaattgattcatagattcacataattctagtcaaaataccaaatatgtgtgttcagggaagagagagcgatacaaaaatctcatttcaaatagaaatgacaaagaaaaaccatgacatttcttttttagtagacatggaatttagtggttggagcaagaatacttatttataaaacttaaaatatattgtaaactataatagtgtttgaaaatatggttcttacattgtaataaagagtgaatccttgagtggaatatagaaagcacaaaaatgacctggatatattagaattttacgttagtattaagtaaaatatccggagagaattataatattttagcaggaaaaaaacaagttagttctctatttcacatggacacactaaagtatgttttaaattaagaagtaaatgtaaaaataaacctatagaggaaatgattaagacatagtaaatatttagtatacacaggatgagaaaggcatttttaaagtaaaagcaatgtaagaaaacataatgaataatgttattattgttgacttcaaagactgtttagattccacatttcaaaataagaaatccagtaacacaaaatgtgaaaaaaaggttctactgcactaacgtcaaacatgtaaaaattaagtgctaaaaaaataacctgtcaaattgctaaaaaagagataataaataatgttaggggtatatgtggaaaaatgggaactcttacacaatgcatgtggtaagataaaaaacataaaaagttatatatttttgagagagcaattttggcaatgtgttaagtagattacattttttattctttctggccacttattctcttttgtaggaatctatcaacatgatgaggtaatttaagacatttttgtgacggtgaaatgaaccatcgcaaatgtccaacaaaaaagggaggcataagtaaaagatgacacatcttaggaatatactttcaaaaactatgttttcaaaagcattcctattcataataaaatgtgaacttcaaagtaatgttatgcaatcatatacatacagtttctaatatgaaattaattttctctaatagccacagtcacatacctgtgcatatgatagaatttatgttccagaatttttaaagtattacctctgcatagtggggcttgttggtaattattttgattatttttataaataactttatgttttcaatattttcttaaaaagcattcatttactttataactagaaaataatggaaattaaaatgtatcatgttaatctacaaaattatactcgttcatatctcagaataacctgtatctttgtaattgtttagtataagtagagtagaaacagtcaaacattgtaggataaaatcatatatttgcttatataattaattatgtaatctgtttcaataaatttttagtaaaaaactcagtgagaaagagaatgaatgctatcttctttctggcccaaagattccttgtcaatcttcatgttttgttggagaatcatatacacattccaaaggaagatgttataccaaaggtgaaggggcaacacattggaatgctgattttaaatcatctcttatcctccagtcatttgggaaaagccacactgtgagtggtcagataaccaaagagattatgatttgcgaaagttaaaaatttatatttaaattttaaattcccttacctctcaagtttcaagattgacatctaagtaacatttctcagaaattaaaaaaaggaaaaaagaaaagaaattctagttagaataccacacgccacgccccaaaggtgagaggaaaaagtggttgagaatatttggtctctgtggttcagaagttacagaggaaacagctactatcaaattggaatccctaagagcaatgcacaaaatggaattccagagtggcatagacctggtgtcagaacttaatcaccgaagacaaggtgagcatggttaccatgacgacagcaaagtcaaagcagtgatcagaataccctgactcaaaaaagatctatgatgctgactagtggatcatggtgtccctagaagagaagtacgtacaaatccattaaattcatacttgatctgcatacgtggaagagttctagctcaagtgaacagaagtctaatttgaatcaccaaaatagtcatgatcccataatcaattcccagacttgagccagtttacagacccagaatccactgaatgaaaaggcagacaggtccccttgaggaaggaccctgctatactatgaaaaatgtatactgttaaactttcccccagccttctccagcgagatctataactattttctaaggtgactgtgtattggggaatgtgaagtaatcagacttttggggattactcgacacaaactctgaagtgacacgaattcttggagatccaaaacatccctgtgatcctccagtcagagtaagggctcgtagaggacaagtgattaatggaattttagctcagatccatctcacagtgagaatccaagccgtgttatttccctagttccatagtgcataatcagaatatatatactcaaccactggccaaatcccctcattggaataattatgctgtaccaatcacaaagaaaatcatttgttttctcaagcaaatgtaacattattattttgtcttttttgtctttatggggtttgttttttgtcagtagtgccctctctcatttcatagtacgcaatcatatcatgagaaatattccattgaaaaacttagaaagaaatgtgtttcagtttaaaatatattacactatggggacaataataagaatgatgcaatacatatttctacaaatataagagcttatacttaaccaatataaatacttatacacaaattattaaattatatattacatacatatatatgcagtagagcaatatcaattcttctttaaatcacttactaataacttctgaattcaaaaggaatatttaatgtattgttgaaaactcccacttgtgatgtgtgatgcataaacacctggggaatgaaaaaactgtttctaaggccaggccacagcagctcatgcctgtaatcccagcactttgggaggccagggcgggcagatcacccgaagtcaggagttcaagaccagcctggccaacatggtgaaaccctgtctctactacaaatacaaaaattagccaggcatggtagcacacacctgtaatcccagctgctcaggaggctgaggcaggagaatcgcttgaacccgggaggtggaggttgcagtgagctgagatggcacaattgcactccagcctgggcaacagagtgagactctgtatcaaaaaaaaaaaaaaagccaaaaacaaacaaacaaactgtttctgcttattaaaatgaactgaagtatgatatctgataagatagggaatttataagttgtttctctaactcctttcttctttagacatagtaacaacaaaataattataaatgctgctttctttgcaaggtgaataaaatgttcggtcaagggagtattttacaaatcctggggtattattaaatattgccagctctggtacccaaactaaattacagctcagacaagggacggaaaggtcatgtttattattcactttactaaaaatgtaaccacaacacgtgtttctacatcagggagtattataaccatcatcataactaataataacaatgaaaataatacagctacattgtattttgcatttttcagtaaacagtagggcttatggttaataatcattcatatttacactgtagctttttatggaggagttcagagtggtttctgaatagtacctcattaatcatttcaacaagttacttggaaagttattatcctagtccaatagatgaaaaaattatatcacagaaaggtcagatatatatttacttgtccaatattagagaagtaaagagagtctgcttcaaatctaagacctctttttcaccccttgatctaaccactggaccaaggcagtatttgtccatgttgtggtttgaccatcaacctaaagtacttcaaggctgacctctctgctattacttttacagatctatagacagagaagaaaatatcattttttcatctatggtgaccatactaaaaaagactcaaacctaattaatgtgtatttacattgtttctttaagtcttattagaaacaattgacaagagtggtatcaatttacaattgtaaatatcaaagcacttaatagtgaaatgaatgcatcatgatgaaatttatgatgaaacaaacaatatttttaaggtgtcatttgaaaataaatttatttaatatgagtcagttaaaggaaacaagaaatcaacttttaataagttaacacctcaaatatttagatcttcaagagcaagtgaaagaacgtatgtttcagttaatgtgtcttcaggaaggagggaagaattgaaatgcaaatatagaatttatacccaaagactgtttctgtttgtctcaataaaatcatcacaatttcaaggctttgcctaatgacattttattttaagagaaggcaactaaacaacaattgttatactttaaaagtgaaaatatacagtgaatacgaattaagtagcactgtccttccaaaataaaagaacatttgcaggcatttttttctatattatttgctactccaaaattagtgtctatgtaattttgctttaagttaaaaaatttagcccaaatggaatcaaatcataactctatatattcctattttgaagcatatattgcttatttagatcttaaaaatatagtgaattctcttaagcaactcatccatgtttatcttagtttgtctgctttattaaaaatttactcaccttttagtttttaaatcaatgatatttgaagatctgaaccattaaaatgtaggtaaaagtaaaaattataagtgtcataagttttgacattatagttactctacgtctgaccattttattttaaaacctgcagtcaaaatgtttactataccttatttacttccactagaagaatttgtgtttaaaaagaaacaaaatggaaaaaatgattcttcttgctagatttaatgattatgtttttccacttttctctgaggtctgaattcagtaaacaaagagatggaaaactaggtaaagaagacaacataccttacaagttatggtgtacagacatcccaaaatttggaaaacaatcataccaaattgaggcaatgagagaggaaattaaaaaaattacttttctgtcattaaattccttttcatgtatcttccacaaatatttacttttgagacaattcatataaactggataagttagtacagaactgtgtttattaaaaagcaattatcagcctgtattcaaaagcaataccatctgtattcagtatacatgttagtattttagaaatatttatagaagatacatgagtgtttaatcgtatatagctgtttaaatgaaatatttcaaagttactgtgatatttatatttcgtatcatttatataacattaaaatattagtatattttatttccatgtacaaacaataatgctaaatgccataaccttattgagttatatatttgcttatttattttaagcacatttgctaacttattttaagcaagtttgctaacttattttaagcaaatttgcttatttattttaagcaaatacataataaggttatggtatttattattattgtttgtacatggaaagaaaatatactaatattttaatgtttgtgttcagggttttccttttaattatgcttcttcatatttctttctgaatttcttacattttcaccatttttaaatattttattaatatgtatcagctttgctgtcatttcattccccaaacttatgtttacaatattataatgtatagatttgacttaaggtcaaactttatgaccttaaatcaaatgactttgctgtcatttcattcctcaaacctatgtttacaaaccttacgtaagtaaacttaaggtgttagctttcatatatttttatttgtatgtttaagagacagcgtcttagttttgcccaggttggagcacagaggctattcataggctcaaacatagctcaggacaacctcgaacttttggccttcagcgatcttcctacgttagcctcacaagtagctgggactacaggtgtaccatattacctggcctcccttgtaaaggactaattttccatggttacgtttgtttagattttaatttctcttggcagtgatagcattatttttaaactctttagcaggagtttaaatacatagtctttgtacatatctagcagcttctagcagacgtttatttaaaaagccaattgttttgataccttaggaaatactgtgctttttttctcaacctttcctaccttacagttacaattttaatggcttatggagtgcatgagaaaaatagccctgtaatttctttttcctttcatgaatattgagattttattaaactgactcaatgaatgatggttcttctggtactataaaaagcaattttaatttttaaaatgtattcaacatcacttcatgcttttcactgatcaaaagacatactggtttttcaaaactctcagtgtctagtgatatacaggttgcttctgcttcactttgatttagtgaatcatgaaactctagagacatgaaaattcagatgagtcaccaagtccccagtgaaaatattactgagcaactcctaaagcataaaactatctctaaatgcaattcctgagaagaactagggatgattacattttataaacacagaaaagtctcaagaaggaaattctggtatcctgtggatattattggggtgtgtcaaaagctacacattcctaagaccacagacttctcagctgggagtcttcaagagcaatcatttatgaaaaccttgtccgtgagatgctaataccagctaattctagaaaaagaaaagggccatttattgtcagtttaaaatctttcctaaattagctatgtcggtctttttttggcagctgtcactcttcaccactaccatttgtgaattctaatgaaaactctattcacaaatagattttaattggacctaattcagacaatcgattttttaaaaagcagacatagttttaagtgctttcaaaatatctagttacttagcagaatttcaaagacatatacgtgtgtgggagtgtgcactcatgtgctcacacatgtgtatgcgtgagttacatattttcccctcaagcataaagaaattgtatggctgctcacctgggcaccccagtttttagtaactgaagaagttctttcttttctcattgacaaatgaatgtaagtagctcagtctttttctccacagctcatcctgctttttcagttctgagaatgaccatagagactttacaaactttatactaatccgagaattgctttgtgttgggaaacactgtgctagctgagtcactcgtttgagagatgcgtcacagagaaacgaagtgacaagtctaaagcaacacaaaaaatggcaatatgtagtacaaatacagacttgactatgttaaattttgttttttgaaaaagaattttagactacatagatgtaagatacttataatttatattttatttgtttattttgagatgagtcttgttctgttgcccaggcaggactgcagtagtgcaatcttgcactgcaacctctgcctcctgggttcaagcgattctcttgcctcaacctccctagtaactgagattatagctgtgcgccaccatgacctgctaatttttgtattttcagtagagacaggttttcaccatgttggtcagactggtctaaaactcttgacctcaagtaatccacccactttggcctcccaaattactgggattacaggcatgagccactgcacctgacgatacttataatttttcagatatgataatacatttaccttaagggccatattcctaactaaaaaatcttggtgattttaacaaatatttgttactaataatttaaattgtcgtaaaaaaatttaattaattttgatggacattaattctgatggaaatatgtttctattttgtctttatatgcacacacacaaacacacacacacatatatatatacagacatacatacatggataaactcacatacaaacacacacacatcctatttaaatatacaaatacagtttcaatcataacattgtaccatgacacagttgtagtcagccacctaaataaagtttgttttctatagctgtatgtcgataaactgttaattaaactcaaggtaactgggtctgctttccttagagtcctctttatatatacattatgcttagtagtccttggaaattcacttagcacactgaagaatatcaatatctaaagtgtgaaaagaagttaagtggtctactttataccagttgtttgaacctgacctaacatagtccataaataaaagttgttagaaatggtttataccacccactgcataacagtcaaagaaattatataacctgaactgaaaaccagtatatttttaaaattttgctcaattttgaagaaagtaatgaaaatattaaatatttggaaaatatacacctatattgtcacctttactgccattttcctaatagcagcactgttagcactataggatcattaaactttatatttcaattacttaactattgaaacactttggatggagagtctctttagagactacattcattcattttaaattttcaccaatttaactttttttaatgtacaaaacaaactacaaatattctttcttgtcctttgttcacattggctaatatataaaggccgctgctactttcagttgataaaacaaatcctagaagaactagatattcaaaactttgttctttacaatttcgaaggaaaaaattgatatacagaatgaagcaactttatatccctggtcatattttttaatgagataacattatgccaagcttcacaagctatttttcaaagtaaatatttgcatttcctgtctatatagtaacaccttactgttttaggaaaagctgtatccttttggctttaaattctcttttctgagtacatactgaggatgtatgtactaagtgaatgattcagttcaaccaagcacactgatccactcaaagtatgattaggatgtatgtatcccttatacttgtgctataattcatattaattactcataactatctactctatttctcttttatagatatgaacaatttttactgcccaaattattaaaatattatccctcattttatcagaatggtatgtgcacacagacttttcagaattaaaacttgcaaaacatagagaaaattatttaatttgaaaattgcatgctatatttgtgtggaggctcacaaacgccaatctaataatctcaatttaaaaaatccttttaaaagaaacaagcaaaatggatattgtaaccatatttaggtcatggtaactgaatataaagttaggtggaaagtagagtttttaatttaatgcaatttttatttcttcaaggcactatcttagaaaattagcatttggtgctaagttttccaattaaatatttatggctttattgggtagagtttggtgtttttaatttttttttaaaaaaacctacctcacaaaaatgtcttataaatatattaatggttctctgctaaactagtgatatatgagacttatgaaaacaatgccaagctaaaactcagcatacttatactattccaaaaacattgtaaagttgggcaaatcgctgccctctcttggctctattttgtagagagattttgtccaaaggaatatttctcaacaggagaaattttactccgagtgacaaagaagtaagaagtaattagggttttccctataacaatttctaagagtttgcttttcctcaccatttatatctacctataactgtaatacagcaaacattctgtcaaaaaatggggtgacccctgcaatgtttgtttttgtatgctttcgttttaaaacaagttgaaattcatttaaatatagttttatagcacccccctcctcatcctaaatggacatatgatcttaaatgtatagcctactaatgtccatgtttgagggcacagaaagtttgagctactttagtaaggattccattttgactcaacagaattattacaatatttaattacattcttcattacttaatgccttaacaacacattcattttcaacaatactagtgcaatttcatgacattaaatgtcaatctatataacacatacaatatcaaaatgtgtttatttaaacacacgttttaattaaatgaaccatcttttaaacttgtttctgtcatggtaatgcctagggtttttgatggaataatctgtgaaatttaagatctctggaaaagtcttagaaccccagttctcaaatcctggttctttaagaatgtttctttcttcttggtgattcttaaacataaaagttagcattctactccaaaagtcaagagaaaatgaattaatgcgtctagaattttcttttctttttatataccagcctttaagaggatcacaaaatataaggagaacccagaataaaataggatgaacttgtgttactaatactcaagtatattgtataattgtgggcctgcaataaaaacatcaagccttgttagacttttatagaaaatcttttattctttttaatttttaagggcaattgcttatacagtttccttttaggaatttattatctgggattacttctcttattttcaatgatacacaaaaaagaagaaaatgaattctttgaagaacagttcaatagtccaaattgtactgagttagagattatttcaaattcagtgctttgtctgaaaacattttcattagcatttgtagttaggactatggaaaaattggagtatatgctatcaaagagcaattatattttccaactgttaactagcattagaaagggcaacatctttaattactcattaaaactgtcttttgaaagagtgatcatctaaaatcagatactaaaacattatattgccagaatttaacctctcttcactagtttcttccagcaacaaggccttagtagtcagtctttgcacataatgatcaacattaccaagaaaagaacaatttacatccagcattacttattgacaagtttgaaatttgtgactatttgtctgctcactaacatgatcctgtaagtgatcttttaaattaaataatcagaaaccgggtccaaatttattcttataaaaacaaaaataatataacatggaaggtacacctttatttgaggctgttacagaaagggaggatacccagaactcaaacctctctccttttatttataaatatttgtatcacttattttttaataagtttaacaagaatacatatcatttcttttggggatgacagcaatactgacaaacagtccctgttatgactgccattttattattgctaaatcatccacaaaattgtgacctgattttagttaccagggacaaagccaaagcatggaattgaagtttcattctgattaaacacaaatagccagtgcataaaaacctttgaaatcggatctatatcccagtaattaaaaaacaaacaaacaaacaaaaaaagaaggaagagaaaggaaggaaaggaaggagtgaaagaaagtaggaaagaaggaaacaaaaaaaaaaaaagaaagaagccttaggagcctgatacaattacacagtaggcctctgacattctctatgctggtataataactaaatggcaagtaacatgggtgtgagatccctgttgcatgctttcattaaaactaaaaatttacaacaaaatcaacccttgggaaaattgctctttggtttaaatcttcattaccttctggaattttggtaaactcactttatttttaaattaagctggccctcttctttactccattacaacagtcaaacaccaagaaccagacagaaatttcagaatgaaaagagttttgtttgtatgtgtgtttttaagtccaacccctgtatacaaattgttaaaaagcagatgttttaacatagtgctttattccaacttatccttgaatgaacttccttcaagtttcaaccatttaaaaaaaaaaaaaaagcagtcaatttcctggtggttgtaatttaattaagtaacctttcacactgagcaaaacccaaaagcaaaagggtcattaatctttctagtgattagagacacctctagggcttcaaacatttacctctccttccccgcagtagaaatgcttttaggaggatcatggttcatacctcacattccctggagccagagatggtatatgtgcagggcccagatccattaaccgatatatccatggtctcagagtttgtaggcttgtagtccacataatactcctgtaaaggggaattcatttgtctttcagactctctggcctttttccgccgcctcttcataagagagtgttgctggagttgtttcatgctggctgggtagcgtttccaagacacatagatcaccaagaggatcatggccactgagagaaagagagccacactcccggcaataattttgtgaaatgaaacatgctcatactcttgctctgcgccaggaatctgaaaccctggggaagggcttggtgtttcaaaggtggattgggtgacgtcaggtttgaagatggtaggtctagggataatcagaggtttctggggagtttggggcaccaggtgtgatctttctgtgttgaccacctggacttcagaacagatattatatgtttccactgcatcactaaccttttcaccctggatgtgcttaggtcccgcacatatcatggtgctttccttatttcctttgaaattcttaagccaataaaataaaggacaaatgctccgactgcattcccacatatttccagacaatgtgatggatattaatgatatccacgcattgacagtttcctgtgagatattggtgagcttgttggaatccaaattcaatttttgtaaattggggaggcatttaaatgtgcccggctcaattccttggatgtcattccctgataaatccaagttgtgtaaggaactccaagtccatgtcaaaccttggctaatggagcgaatcctgttccattgtaagtaaattgagcggaggttgaagagacgtggaaaatgagcaaagttgatcttggaaaactggttgtgctccaggtggagctcctttaacttcaagaggccagcaaatgcatttcgggacaagcttcgaagacgattgtaacccaaatccaaaaaatcaagattccgacagtcttgaaaaactcttatgggcacagtctttagtgagttagatctcaagtgcaaaatgatgagtttccgaaggcctttaaattgttcagattgcaatgtctgaagcttattgtaggagaggtccagattgcggagattgggaactgggtgaaatgttttattgtgcagataagtaattttgttggagcttagaattaattctttcagtctacggatcccttgaaatgcatcttcatccactgagctaatgtaattatggtcaagataaagccatataagctggttaaggccggcaaactgattggatttgagcttctgaatgctgttgaaccttaatgataagccttgtgaccctccagaaatgttctcagggatatctgcgaaagcatgagactcacagtacacaattttgccatcacatctgcagttctttgggcaagctctctgagcacccgtgagcataacaagcagcagtgtaggaagtagcaccagcaccacactcatgcctttcagctgcgtaattaaatggaaacctacgatattaaaaaaaagacagatgcacattgtgaagctattaaaataaatcaccgtcggtttaccaacaacaggggcatttcctctagtgtaggaatgggacagttgatttaaggaaaatgcattaacatttcgagcattattttcttcagtgttgcatgtttgctgcttaggtttcactttttcttccttgatcttcaaatcaccacagtcccatagaattaagaaaagcctttttgagtttcaggagttcctacttatttcaacattgaaaagcacagagcctttctcaccactgaatgctgacattttagtaacaataatatttggctaaccactgtattgaacaacagtaccaaaaggaagtgtactatgtgctctggtaagggcaaaaatgtgacttagtaaacctggtacctgtacgtgtttcccagttgagcaaacaggctgtgatttggcaaaagagcttcagtaagctgtcaaggtaacccaagtttgccctgcctgaaattgtgtacttattgcataataggatcgcaatatgtgagctctgaaaaaacagcattgagactagtataggcagccaatgaagcattggatgaagactaataacggtacgaggtgctctcaagttgttaataagcatagattattgcatactgtggctccctgcccaacgatacaggagctaagacatctaaatactcataacagagaacactccaaagttaagactatcaaaattcgtattatttgcctaaaaagcaaaataatattgtgtagtatcactttgccattattttagagttgtttttgcaaattcgaaggataaacaaggaaagaagcagccaactactatttttctctacatcaccctgatctcttcacatttctcactgacttttttctcccctatctccattaacttcagaaagcctgcaaagttacaatctattggcacttacactgcatttccaagtcattgcatgttaagggacttctttcctccgtcaacagtagatttattatttcttaatggagagaaaaaaaaagaaacaactaccatgtgttgcagtttctttttttttcttaaatttttaaatttttaaccaagaggcaatcaaccaaatccctaatctaaaacccatccttcttctcaaacagttaagtttttcttttttttctttttaatttaaaacccgatcttgctctctgtcctcttgccagctacagactcattgaaatacattccagctctcccagacaggagaaagggggggaaaaaagccagtcacactcgaaaaaataagactggcaaatgactgctggaaattcggaagctgtgttcaggatccagcttcaaagataaaacaagcccttgtgcaacctctgataaagtaaggaccccacccctacatacacgcagcaaagtgttaatagtcatcctgacagctaccagaaacacaagcctcgttaatattatcaagaaatagaagcaaacacagtatttatctccttctgaattcccaagctgtggatacgcagacagtagaaacagtcttaaagatatttctctagagtctgtttaagttcgtgttgtgcatttatagattaaaaaaaaaacactgcaaaaaggaaaatgatctaaaaatataatagcaactatagtgaatcaactggcaaactcaaaggctgctgctctttgcctgtttccccgtcttttatctgctaatgccacgactgaggataggaagccaagaggatcagctttgctcagaaggaaacaacaaaagttcacttacccatcctttgtcatccaaaaacgtttcccccctctctcagctttcttcttatttggtctcttgtgcggaaaccaccaccaccttcatgacacagtgcggctgtcattcacaccattctgatcccgcatgtgagctagtagccccatacaaacttccccgagaggacaggcaaaaaaaaaaaaaaaaaatacatatatatatatacatatatatatatatataaaaaatcagcacagggtgggatggttgtgggggcagggaaaaggaagccgttggggggatagggatgggggagggcctctaggctctgaggaccattgtgtaattcaccagagacccatcagcagtaattggcaatctgtgcaaaagagctacagcccatctcggaggtaaccaacttctctgtaaaaagagaggaaaaaaagaaaatcttcagaatacctggcattccttattgtgctggcttttgccattcccagataaagcaattcatcctctggattttcagttcttgaagcaagtaggcctcctgtgctgtatgagaccccagtttaaaagctatgcaggctaggtttatccatttagctggtcaggtttaaagtgttttgtagctgtgctgggaggcagcccttgtctaattcagaaggctttccagagactgatgatgctcagagcttgttggtgctaatgcttgagtttgtgatacact

SEQ ID NO: 918 - DNA, 5716 bp, Homo sapiens
gacttttatagaaaatcttttattctttttaatttttaagggcaattgcttatacagtttccttttaggaatttattatctgggattacttctcttattttcaatgatacacaaaaaagaagaaaatgaattctttgaagaacagttcaatagtccaaattgtactgagttagagattatttcaaattcagtgctttgtctgaaaacattttcattagcatttgtagttaggactatggaaaaattggagtatatgctatcaaagagcaattatattttccaactgttaactagcattagaaagggcaacatctttaattactcattaaaactgtcttttgaaagagtgatcatctaaaatcagatactaaaacattatattgccagaatttaacctctcttcactagtttcttccagcaacaaggccttagtagtcagtctttgcacataatgatcaacattaccaagaaaagaacaatttacatccagcattacttattgacaagtttgaaatttgtgactatttgtctgctcactaacatgatcctgtaagtgatcttttaaattaaataatcagaaaccgggtccaaatttattcttataaaaacaaaaataatataacatggaaggtacacctttatttgaggctgttacagaaagggaggatacccagaactcaaacctctctccttttatttataaatatttgtatcacttattttttaataagtttaacaagaatacatatcatttcttttggggatgacagcaatactgacaaacagtccctgttatgactgccattttattattgctaaatcatccacaaaattgtgacctgattttagttaccagggacaaagccaaagcatggaattgaagtttcattctgattaaacacaaatagccagtgcataaaaacctttgaaatcggatctatatcccagtaattaaaaaacaaacaaacaaacaaaaaaagaaggaagagaaaggaaggaaaggaaggagtgaaagaaagtaggaaagaaggaaacaaaaaaaaaaaaagaaagaagccttaggagcctgatacaattacacagtaggcctctgacattctctatgctggtataataactaaatggcaagtaacatgggtgtgagatccctgttgcatgctttcattaaaactaaaaatttacaacaaaatcaacccttgggaaaattgctctttggtttaaatcttcattaccttctggaattttggtaaactcactttatttttaaattaagctggccctcttctttactccattacaacagtcaaacaccaagaaccagacagaaatttcagaatgaaaagagttttgtttgtatgtgtgtttttaagtccaacccctgtatacaaattgttaaaaagcagatgttttaacatagtgctttattccaacttatccttgaatgaacttccttcaagtttcaaccatttaaaaaaaaaaaaaaagcagtcaatttcctggtggttgtaatttaattaagtaacctttcacactgagcaaaacccaaaagcaaaagggtcattaatctttctagtgattagagacacctctagggcttcaaacatttacctctccttccccgcagtagaaatgcttttaggaggatcatggttcatacctcacattccctggagccagagatggtatatgtgcagggcccagatccattaaccgatatatccatggtctcagagtttgtaggcttgtagtccacataatactcctgtaaaggggaattcatttgtctttcagactctctggcctttttccgccgcctcttcataagagagtgttgctggagttgtttcatgctggctgggtagcgtttccaagacacatagatcaccaagaggatcatggccactgagagaaagagagccacactcccggcaataattttgtgaaatgaaacatgctcatactcttgctctgcgccaggaatctgaaaccctggggaagggcttggtgtttcaaaggtggattgggtgacgtcaggtttgaagatggtaggtctagggataatcagaggtttctggggagtttggggcaccaggtgtgatctttctgtgttgaccacctggacttcagaacagatattatatgtttccactgcatcactaaccttttcaccctggatgtgcttaggtcccgcacatatcatggtgctttccttatttcctttgaaattcttaagccaataaaataaaggacaaatgctccgactgcattcccacatatttccagacaatgtgatggatattaatgatatccacgcattgacagtttcctgtgagatattggtgagcttgttggaatccaaattcaatttttgtaaattggggaggcatttaaatgtgcccggctcaattccttggatgtcattccctgataaatccaagttgtgtaaggaactccaagtccatgtcaaaccttggctaatggagcgaatcctgttccattgtaagtaaattgagcggaggttgaagagacgtggaaaatgagcaaagttgatcttggaaaactggttgtgctccaggtggagctcctttaacttcaagaggccagcaaatgcatttcgggacaagcttcgaagacgattgtaacccaaatccaaaaaatcaagattccgacagtcttgaaaaactcttatgggcacagtctttagtgagttagatctcaagtgcaaaatgatgagtttccgaaggcctttaaattgttcagattgcaatgtctgaagcttattgtaggagaggtccagattgcggagattgggaactgggtgaaatgttttattgtgcagataagtaattttgttggagcttagaattaattctttcagtctacggatcccttgaaatgcatcttcatccactgagctaatgtaattatggtcaagataaagccatataagctggttaaggccggcaaactgattggatttgagcttctgaatgctgttgaaccttaatgataagccttgtgaccctccagaaatgttctcagggatatctgcgaaagcatgagactcacagtacacaattttgccatcacatctgcagttctttgggcaagctctctgagcacccgtgagcataacaagcagcagtgtaggaagtagcaccagcaccacactcatgcctttcagctgcgtaattaaatggaaacctacgatattaaaaaaaagacagatgcacattgtgaagctattaaaataaatcaccgtcggtttaccaacaacaggggcatttcctctagtgtaggaatgggacagttgatttaaggaaaatgcattaacatttcgagcattattttcttcagtgttgcatgtttgctgcttaggtttcactttttcttccttgatcttcaaatcaccacagtcccatagaattaagaaaagcctttttgagtttcaggagttcctacttatttcaacattgaaaagcacagagcctttctcaccactgaatgctgacattttagtaacaataatatttggctaaccactgtattgaacaacagtaccaaaaggaagtgtactatgtgctctggtaagggcaaaaatgtgacttagtaaacctggtacctgtacgtgtttcccagttgagcaaacaggctgtgatttggcaaaagagcttcagtaagctgtcaaggtaacccaagtttgccctgcctgaaattgtgtacttattgcataataggatcgcaatatgtgagctctgaaaaaacagcattgagactagtataggcagccaatgaagcattggatgaagactaataacggtacgaggtgctctcaagttgttaataagcatagattattgcatactgtggctccctgcccaacgatacaggagctaagacatctaaatactcataacagagaacactccaaagttaagactatcaaaattcgtattatttgcctaaaaagcaaaataatattgtgtagtatcactttgccattattttagagttgtttttgcaaattcgaaggataaacaaggaaagaagcagccaactactatttttctctacatcaccctgatctcttcacatttctcactgacttttttctcccctatctccattaacttcagaaagcctgcaaagttacaatctattggcacttacactgcatttccaagtcattgcatgttaagggacttctttcctccgtcaacagtagatttattatttcttaatggagagaaaaaaaaagaaacaactaccatgtgttgcagtttctttttttttcttaaatttttaaatttttaaccaagaggcaatcaaccaaatccctaatctaaaacccatccttcttctcaaacagttaagtttttcttttttttctttttaatttaaaacccgatcttgctctctgtcctcttgccagctacagactcattgaaatacattccagctctcccagacaggagaaagggggggaaaaaagccagtcacactcgaaaaaataagactggcaaatgactgctggaaattcggaagctgtgttcaggatccagcttcaaagataaaacaagcccttgtgcaacctctgataaagtaaggaccccacccctacatacacgcagcaaagtgttaatagtcatcctgacagctaccagaaacacaagcctcgttaatattatcaagaaatagaagcaaacacagtatttatctccttctgaattcccaagctgtggatacgcagacagtagaaacagtcttaaagatatttctctagagtctgtttaagttcgtgttgtgcatttatagattaaaaaaaaaacactgcaaaaaggaaaatgatctaaaaatataatagcaactatagtgaatcaactggcaaactcaaaggctgctgctctttgcctgtttccccgtcttttatctgctaatgccacgactgaggataggaagccaagaggatcagctttgctcagaaggaaacaacaaaagttcacttacccatcctttgtcatccaaaaacgtttcccccctctctcagctttcttcttatttggtctcttgtgcggaaaccaccaccaccttcatgacacagtgcggctgtcattcacaccattctgatcccgcatgtgagctagtagccccatacaaacttccccgagaggacaggcaaaaaaaaaaaaaaaaaatacatatatatatatacatatatatatatatataaaaaatcagcacagggtgggatggttgtgggggcagggaaaaggaagccgttggggggatagggatgggggagggcctctaggctctgaggaccattgtgtaattcaccagagacccatcagcagtaattggcaatctgtgcaaaagagctacagcccatctcggaggtaaccaacttctctgtaaaaagagaggaaaaaaagaaaatcttcagaatacctggcattccttattgtgctggcttttgccattcccagataaagcaattcatcctctggattttcagttcttgaagcaagtaggcctcctgtgctgtatgagaccccagtttaaaagctatgcaggctaggtttatccatttagctggtcaggtttaaagtgttttgtagctgtgctgggaggcagcccttgtctaattcagaaggctttccagagactgatgatgctcagagcttgttggtgctaatgcttgagtttgtgatacact

SEQ ID NO: 919 - DNA, 148813 bp, Homo sapiens
tatatgtaaatatttttcaaggttttattgcaaaccaaaatcagtttatcacacacaaaaaaagttgtgtgatgggatgagggaaggattgtacgtattataaccatgttaattacagtacattaaaatggtggtttacattacaaataagcctgtaagtttaaatatactagtgttataacccaatgtacagacgttctttatacaatacatacaattatcaggaatgcaaaaaaaaaaacataaataatgcccattttacaggtgacattttaaacaatgaaaaacaccaacggctctgactgacaactggggcattggtccataaaaaccctttctaaaaatagaaatatttgtagcagcaatgctttctttaagcatctgaatacgagtcattgcaagaccatttcaataaattttagttattaaccgtatcttacaaaaaagtctacacataaatttatcttccaaatatggaagaaacaaacaatgtcccacgttgtagtgtcctgcaagtgtcacattgatgcttataacaaaatccatctgtgatcaggcataccacactcacacgacggttcacacagcatatccacaagggaaaataaagaactgaaacactgcgataggaaaagctttggagctaacacaatctcttcagaaaaggcacatttcataatattcgtcatcacagcccagacagatctgcaggagaccttttttagaacagcgtccgctttctaacgaaactcctgcctccgtctaaggcggcactctaacgctcgtttcagagatagcaccacgttggaaggaagaataaaaatgaaaacctcatgagctcactgaggagaatgtgctcttcaaaaagcttccagcgaacagtgtgcaataagattgctaagcttccagagatgtgcaaattctcttgtaagatgtcctgtcagctggcggctccaccaaaaggctaactaaaacattcggaaacacacataaaatcctttaaaaccaagccctaacagggttcagaggaaagagtccgtgggaggcgcataggaaaagcctaggaaagcctcggcagcttccttgacgctggctgtgacgaggacgctgtcaggggacttgccaatggagttggggacaggctcttcggtaaactcggggtcaaagtgccgtaggtcgttgggcccactctgtgacgggaagggaaaaacactcttgtcaagaactcacactagacacaggacagggaaatcttgaccaggctttaaataccaagtttaagtcttatatcaacttccataatcacccacttcaagcacaaaatctcaaaaggctacacacagttaaacataagaataatgttcacttgttgccttttggtgcttcgaattgataaatgtgtctaaaaattatgggagccttgttgggacacaaaaatgtgctttttatgtaggtaaaataacaggtttatggagaaaacatctgccaatgtattccttccaaccctcccccagacaattctgaattaaaataaatgccctttgggcttctctatacttagaagagagacagatactcaccacatttgggttaaaagggggagtaatcttcttattaatgagatcatcccagttaattaaggagaagaagacatgactcttaatctccatctgttgataagaaacccaagattaatttagacaggtgcattcaataagggcagggaggtctagtgcacgtcccggccggcccaggaggacaggaaaacatcactcacgaagtcatccttggccccgagccgctttgtcctgtccttctgcaggaggccctccaggaggtgtcttgcggaatttgtaatatttggtttcagctggagaggcttgttcagaatgttgtcgtacatttcagctgtgtttcggctataaaaaggcggctgaaagaaggggaaaattactttagacttaattggaagtttcatatggcacacattaccagtagagaaaaagatataaacggcaataaatattaggctcgatttgagaaactctccccacctcaatgctttcttttcccttgctatttaagtgtctactttgcaacccgtgtgtgtgtttgtgtgtgtgtgtgtggagggtgagggggtagatgttaataagtggtagtttttcaccaccacacaggttcaatgtggtcctatctagtaaaatgtgaaatgcacaaaagaaccaggtaagtgattattcttatgaactataaaataaccaatatgcctcttagctgcttttgataagcgtactggtaagggcaagacaccatggccaagcatgggctgtgtgaaggcaatattgtagggagcaggcagtgttccatggttcccaatgtgccactcaccaggccatacagcatctcatacaagacagctcccaggcaccaccagtccacagtcctgtcataaggctgcttatgaagcacctcaggtgcgagatactgaaaaacagaccagggaaacagcgtttagaacctgcgaaagcaagcaatcccacgaccacacatttagtttgaaaaagctgagagacccagagccagcttggaagatagatatctttagattccttcctgataaaactgctggactttttgagggtgactggctacctatgtgtactgacatttaggaaactgctgggcacttgatatctcttacttagggatttagaaagtttttatgatgcagatcttacttacaaacagctacttttcagtaaaggaacagaaggacttgggatttctcatgctacatcaaacagcaaatgtattttatttgcactgaactgtattaagaagtctctgagaggagtttactctttttggtagttaagtgcatgattgtacatctctctcttggaaggcgggggtaaaccaggcaccaaaccaagacagcgcctacctccggcgtgccacagaaggtggatgttgtgctgttgtgttcaatgttctccttgcagagtccgaagtcagtaaggacaatgtgtccctgtgaatctagcaaaatattctctggttttaagtctctgtaaaaaagtgaatagaaaagtagttgcacaagttaatttcacttcataagatatcctcttaaagataattgctaaaggtattagaggcattttaggttcactgtagttgtgtagtgaagaaaaaagggagcccttgttctgctcatctattctggattaggcacaatcctacttggctggttcccccttggcacttaagtcaagccagctcacgtgctaggggatctggttttaggcaaccaagttgcaaataaacacaaattattttaaggccctatgaaacagccagtgctacgtctcctttataccaaaactggtagcctgaagagctctcaggcttacctataaacgatgttcagtgaatgcaggtagcccaaggcactggctatttcagcagcatagaaacgagcccgtggttccaggaagcagcgttccctctggagatggtagaacaactgcaggagacagaacaaagtcattctgggttgcaaatgaatttaattagttttgacatacacagcaaaagaacaactgcaggaagtggccccaagtaatctattaactataaacctgacaggttgaaggaaatgctaattctggtaacattctccccaccaaaaatctttgaaaacttttttctcaaactaaaacaaagcaggctgtgcagagacactaagagttgacttctatcccccctgctcacctctccaccattaatgtagtctaggacaaagtacaatttgtcagcagtctggaaagagaagtgaaggcccaccaggaaagggtgcttcacattcttcaacagaacattccgctccgacataatatgcttctcctaggaaaatgacgattcagatttagtggcatgtttcaacttggcaccaacattccagaatcaagattattcaaggagtgtctaccgccaatgccagccccatcaagcacatctcatacctctttctttttcaggattgctttcttctgtaaaactttgactgcatagaacacttcttctgccttgtgtcttgctagaagaacctgaaatttcaatttaaaaaaatcatttttctatcctcatccagggagaatacaaaagaggacatgaaggaagtgtaccaaaagatcttcagatttgaaattacctttccaaaactgccctttccgatcactttcaagaagtgaaagtcagatggtttagcatgaggattggacgacgggccaaggttgatttgctgagaaggacttggctagaaaaaaaaaaaaagaatttcttttaataccattgcttcaaaggaagacatctataacataaacgatgtagaaaatgttacatctacaaatgactgatgcaaatgaccatacatctataaacattcaaaactacatttcatcacatttcaaatgagtatggaaactgcacacagtcatgttgtttcagacagataaaacctttttatgaaatatgccttttaaaataaccactttggaggtaaaatatgcccaggaaaaaaataaaataatactctgactcaatacttaaatatttatatcacttgttatgccataatgaagcattcctgccttgatactaatttctagaaatgctattttaatccattaatgtaggaatactaactgactcccttacagttctccacagatgcacggcacatacaaaaacttactggaggagaagggttggcattcataagctcaggctcctgaggttgggagatcttcaagatggactgaacttcagggctgcagggaataaagggcacgatttagaatccagctcgccactagggggcacaccaacatcaaaagtgagtttctggctctaccgacttctacccggataattcactgtttaaactgaaaataccccaatacattagtcagttaaagaaaataataaaccccattaaatacagaaataaggattgttgctcatggagaaaggccgtgaattcggccaacacgaaccatttatcttacatctccagttcaagccaaatcagcaaattaactttaatgtttaaaatgtgtcaaatatattagaatttaaggagaaatgagatccccaccccagaagaagtcttcgccttcccgataaacgccgtgatgagaatgtttaccgctggcaaattcaaactatactagttatttcctcaaatccggtcaaacttactgtttgcatgcataggagttattggcaatcttctgaataaagtcgttcagacccatcctcctctgcttcatgaaagctgtggatgaaggaggagaaataaagaaacgtttagacggcttcataacgtccggcgccacacacactaatctgatccgggactttcaaaaaatttccactttgcgtctcctggagcagaagtcccgcaagattcctgcactcaccgatgagaattgccaccatgcccctcatcctggagtaagtgagggtgcccttagcagcctcagttttcaccgtcatcaccaccgcggggagacagaaagacgttagcgctcaaagaccggctcggcgtatgctgcgccaggccgcgcgctcggccttataaaaaaggcaccgccgcgggggcggggcctgcgcgacagtgagaagtggccccgcccttcgcctcgcccctcgccccgccccggccgcctcgcggtttgctggcggctacgctgcctgcggcgggcggttctgtccccattgagagggcgagccccgggcgggggcgcgaggaccgcccggggacggcctggcgcagggccgttatcagtctccatcggctcctggggcaggagagagagaacgcgccggcggagggcgcggggagggccggagagcccggggtagttttccacctctctcatttattccgccgccggagaaagccgggttcgcagcgccgaagcgcttcccggcgggtgcgcggcggccacggtggcttcgctcactgtccctgcagataccctctccccggccaggcgccgtcctgcggccggactcccaccctcctccccaacccgagccggcggtgcgcgccaccctccggggtttatccctggggcgcaggcctgcgcgcgcgacctcgcccgccaggtcctcccgttcccgccgccgggaccccggccccgagaactccgacgaaagccggcccctgcctccaagccgctctggggaagtgagccaagcccccagcggggccggcggcggcgcttacccagtccgctcagcaggaaggactcgctccttttctgcgcctcggccctctttttgtggcggggccgcagcagggactcgagccgggctctggccagcgcgccctgcatctcccccatgggcagcgggcggcggggcgcgcggcagacgagagcgaccggcgagcactgacgtttccttgaaggagccgccgtgactcaggccgggcaagatttcctgccccgagtcccaaaacaaacaaatggcccttgtgcacggtcgggtcgcttccgaaaacgccttttttgtgcttttggccaaaaccaagcaaggctgaaaaatcccagaacttggaagaggaggaaggaaggaaagaaagagggaaaagggggagggagaggtcaggaatgtggaggggagggggcggaaataaaagtcgtctctgcactaaaggaagaagtacaatctgcatttcacttttttttttctgaagtaatctctgagaacattttgtccgttccgcatgtaatttttttccttgcatttttaatctctgccatgccaagaacacgtgaggaggtaacaagcgaagggaggggtagctttgcccgggggcagacctggcgtgaaccgggcatcctcgattcctctgtggggcctgctcctctcccgctgtcccacctgaaaaccctgcaggtcatgatacatggtcttaaaatcgtccctaccctccctgggtttaactcaaggctgccccagggcttcttagttttgccacctcgctcgctctttatgtgagtcccacataaactgtgactttatcctgaaagattagccgggtgactccgctgcagaaggcagggaagagagggaagctcgaggcggcggcccgggctctgcagaacagcgatgccggtgccttccagtaaccccgcggctgggggatgtctgggagccgcagcctgaccgccggcgcggggacgtgagccagtgctggccgggaagccgcgagcacggcgactgggcccggagcgggcagttacaagttaccactattcgcagggccaggtacctggcgctcgctgttgctgtctgcggtggctgccctgccatgacctcttgctaccaaaggctctgccattttaaagttgcctactggatctggcacagtcccgaaataccagctgtcaaaccaggaatagcatgtgaaacgccttttccttggtcttgggcaggggtttgttttgcaggcaaaaccacccccacttgccctaaagtgagctctagtctcaactccttggtttgctttgttgcaacagccccaaaccgagagaagggaaacacattctctctcctggagtctggctgggaaagtttgctcagtgcccacacttataaaaagcatttactggggccgggcgcagtggctcacgcctgtaatcccagcactttgggaggccaaggcgggcggatcacgaggtcaagagatcgagaccatcctggctaacatggtgaaaccccgtctctactgaaaatagaaaaattagccaggcgtggtggcgtgcgcctgtagtcccagttactcgggaggctgaggcaggagaatcgcttgaacccgggaggcggaggttgcagtgagccgagatcacgccactgcactccagcctggcaacagagcgagactccgtctcaaaacaaacaaacaaacaaaaacaaaacaaaaacaaaaacaaaaaaaacactagtacctgaaattgacatgccaacctaaagcaatgtttaggcaatttcaaatcacagtaactggcccatgtctgcttcctcttgcagggaatcttcatagaatgtgactttgttattgccagtgccacccgtatgtcatgtcccaccattcaactagcctagcccagcctagctctgctcccacctggttcctttccctcttgagagagcaaattttgctcaggctgcccagaaacatcaacctgcacacagacttttgcatgtttgttttcaaacattaaattaagaaacctacaaccagagaccctctcctacaccccaccttatgtgccttccccatgccaagtaaccccaaatcctttgaggcatctgcaaaatatagtacggtaagtacgaacctttcaaagggggttttatagcttcttctttcattcttcgggttgcccaaggatatgcaggttggggattacttctggaggctggaggtagagcccagttatggctggaataagcctccctgctacatgcctctgataagctggaactctgagatgacatgagagcacgagccagagacggctatccctgttctgttatgaaccccactttatatcaaggcaatttaagtacaggaagggagcaagctgcaaagttcaacactgggccatttattctccccattgcgacatcactcagaaaattacagtcatcagtgtcctagctttattacacccccagcacgcacacaagaaatgtaacttaactgattatcctcacaaatcagtccggaaaaaattcaaaacacatgcacaggatttattttctcagaggctctgtggcatgcattccgggaggaacgtggcattcaggtcggagggttctacgcggaatagagaatagatgcaaccgtatgatttgtggttggaaaagaaagggaacgtctgatgtgctccttcctcccctaccctaatgttcagcacttggagacggatggtcggctaaacttatcatttaaccgagagaatcaagttgttgagactggcttttcttccaaccggatacgtgatgggtggagcaggcgccccctgttctgtcccagcaacctactaagacttccgaacaggaaggtgacacacggcggaggggtgcttgaggggagggggagacgggggagctgtgtgtgacgcgcgcctgttaacactgcacaggcattaggttgccctgtagctgctattcaaactcttgatctgttcttccttcctgtcgccagcctctttctttggtccagatagtcctcctactgggaggaatccggcccctttcctcatactccctggtggcgaagtggtccgagtagcctcccgaactgtttgtaaatgcaacctagagggcgatcgagttctctgggagaacttgctccatatacgcgtatacgcggcttcccccacttgtctcctgaggttctattggtccagggaatttctctacaacaccttgtgcagtcatagaaaatatagacggcttgataggagataggctaattacctccccactcctccaagcgaattgtctcacatttatgtctcggtgctgggaaaactgcagtcaaaaccctcaagtaggaatgactgaccaggatgaaaagtttgcactgaaactaaacgtttcccagtgcatgtgcattttaatgcttcagaaaaaattttttcactcttctattttatttttttatttctttatttgtcactctatagtctgatggactataaatgctaaaacctgagagcttcacaaagatatgactttttccatttaattttaaaaggcttataaattattgatatttctcaacatattagagaaaatattttgaaaaatattttttataaggacttaaccatattcactcttaagacacttcttaaatgtatcagctgtaattgtcatgattccccgggtatgttatcttccattgataacaaggcaatataattgtttcatattgttcaaagtaccatcaattttagaacaatcctatgaagagtttaagttcccatactttttgattcattgtttgatgctcacagaaacctttccctggaacaccctcaaaaaagctcatagaaataccagaaaacataattattataattatagaaaacataattattactctagagagaaactgaatggatcagtttttgttgaaggttgtcagcaaaggcatgtctttttttttttttttttttacagaaaatgatgatgacaaatgagtttattcattatagctattatagacaagtcactggcaatggtggttatttaaatgtctatttatagacacaggttgtatagtaattattaccttccatattcataattgtcaaatttgacatgcaaaaagatgtgatacagtagataactaagagaacactatctctaatcatagtgttaaaagttattaaaacccacaaaactaattatttcatttatcgcagggtttatattttttccaagacagaggtgataatattctacacccattccttctaaaaagtgagcccataggaaaattgacgggagggtaggaacaagatttggtagtaaattttttatgtcattcaggggataaattaaagagaagccagtgggaatacttgacatgggaggaatgagaagctttttttgtttgtttgtttttgtttttgacatagagtttcactctgttgtccaggctagagtacagtggtacagtcacagctcactgcagcctcaacctcctgggttcaagtaatcctcccacctcggactcctgagtagctgggaccacaggcacatgccaccatgcctggttaatgtttttatcttttgtagacacatggtctcactgtgttgcccaggctggtctcaaactcctgggctcaaatgatcctcctgcctcagcttcccaaagtgctgggattataagtataagccactgcgcctcacctgaggaatgagaatctacatagcaagaaacaaacagatctttctcaggctgaaaacttacccatctccatcttggcaatgttgtcaatgtctgatttagtataatccaatcaatgattaaaaaaacaaaacatcagctagaatgcaatatgataggtaaggaattgtatgtatgtgacaactttatttttggttctcaggattgacctggaaaatggtgtccacagaactttacataagattatgaaaaatgatacattggtctggacagaagagtaaattggaaaaatttgtaagtcaatatttaatactattggtaaactcaagaggactgtggtggccaggtgcaggggctcacacctctaatcccagcactttgggaggttgaagcaggaggatcacttgagctcaggagtttgagaccagcctgggcaacatagtgagaccctgtctctacaaaaaatacaaaaattatccatacatggtggcacgcctgtagtcccagctacatgggaggctaaggtgggagaatcgcttgagcccagggtgttggaggtttcagtgagccaagatcttgccactgcactctcgccggggcaacaaagtgagatcctatctcaaaaaaaaaaaaaaaaggactctggccttatatttttggcatgcctttactgttaggcatttgcattttaaaaggccacttgtcaactcaaaaaatttaatttgcaatgataaaatgtcaagcattcaaacaagaaacaggtctgagagctttggggtgagaggcctcccgcaatatctggcctggtcggcctcctctccattctctccaaggtaaaactacgtgggcatctacttcccccacaagtccagcagccagaatccttcctaagacacacatattaaaggtgtaactgacacgaaggcaatataaagggctctctttcacccccactttatttacaaagggccaatagtaaataaggagtctggatttctggtggacatcttttgtcaaactaaagtgaaacctgaaagctttgatttgctcagtataaatctctctccaagtctctcccgtttgttttctttctttctttttctttttttgagacggaggagtcttactctgtcgcccagactggagtgcagtggcgtgatctcagctcactgcaccctctgcttccctggttcaagcaattctcccgcctcagcctcctgagtagctgggattacaggcacgtgccactactcccagttaatttgagtacttttagtagagatggggattcaccatgttgatcagactggtctcggattcctgacctcaagtgatccacctgcctcagcctcccaaagtgctgggattacaggcataagccaccatgcccggcccaagtctctcccatttctgagcctataatcaatctagaaggaggcaacagaagctcgggccacccctaaggacttaaggactgtttcctgtaaactctgtgtgccagttgtaacaacaaaagatacatgtaatagtaaccagcaatggaaaaaccagttatggggatgtcagtctagttggcgacaactgaggcttgctacctgtgagttttttttgttttgttttgttttgatatggagtctcacttcatcacccaggctgaagtgcagtggcgcaatcttggcttactgcaacctccgcctcccaggttcaagtgattctcatgcctcagactctcaagtagctgggattacaggcacctgccaccacgcccgactaatttttgtatttttagtagagacagggttttaccatgttggtcaggctgatctcaaactcctgagctcaagtgatctgtcctcctcagcctcccaaagtgctgggattacaagtgtgagccactgtgcctagccatacctgtgagattttagacaaggtattctctaacccttaatcttgtcagctgtatagcggggagagttatacctgcctcatataagttgtgaaaaataatggaaataggccaggtgtgatggtttatgcctgtaatcctagcactttgggaggccaaggtgggtgggtcacttgaggtcaggagttcgaaaccagcaggccaacatggtgaaaccccgtctctactaaaaatacaaaaattagccagaaatcacttgaacctggaaggcagaggttgcagtgagctgggattatgccactgcactccagcccgggcaacacagcgagactccgtctaaaaaaaaaaaaaaggaaataaagaatttagtaagcgcctctctcatgttggagttttaagtagaaaatatgatctgtgtatatttgccagccccaccctacgcacatcacaagtacaaacaacactgtcgcacagtgcaaagggttccaacaaatcaaaacaatacatcaagtaattatgggctgtgagtaaggcacttgcacagcatgggccacttaatctgctgggccaaggcgaggcctatgtgacaggaattccgtgaaaggcctgaatgataatccaacctccccctcctccattcagtctccctcacagacagtgctcctgaatgtgctgtatcaagaaacgaaatgccatgattactgaataaagacttgtttaccaagtgtttgcagcaaagactgaagtttagtgtgaaaaaagtggagagcaaaccaaaactaactcaagaaagtttttacttgctcgaggaaacaacagaaggcaaatatagacctattgagagggtggagtcattgaaagaagatcagaggccagtcatacttatcgtgctttttctaggtcaataagcttatcctgcaggaatgagaagaggaacaagatccagctgaacctagcctctgttagttttaatcattcagatctctgtggtgcacctctttcatttactgatttattgtattgatataagttgatgaacatattttggggtaacatggtattttgaaacatgtatacaatgtgtaatgatgaaattaggataattgggatatccgtcatctcaaacatttattttttctttgtgttgagaacatgctaattcttcccttttaactgtttggcaatatacaataacttattgttaactctgatttccctactgccatatcgaatgctagaacttattccatctatctagctgtactttgtacccattaatgtgaatgggttcttgacaggcactgtcttaagccctgaatctaacaaggatgtcatgatgggcagcgttgctgtactcagggagggtgtggtctatattttgtaaaatggaactgcacgttcccaaaagcaaaggtgagcttatagacatttctgattttcctcaggccccgctatgccttaatgtcattaaagtacagccttgggcacgtttgatcatttagattatctagtttttcaagtgaggaatgtgctggaaagtcttctgcagctctgattttgtacagttctatgatgtctgggaaaaaaaataaacccagaaggaacttctggaggcccagaactactctcctggcatggtttcctataataatgtcccacacccagctgatcctttagaagaacctgtccccaccccacccccaccccccacccccggcattggatccttcggtcaggaatttgtgtgcttagttatttaaatctcaggtgtttctctggaccttgagttccctgaaggccaggcagcacaatttgtgtctctcacctgcctaacattctctaatcaggtcgctgcctgcccctctgacctctcctcctaccttctccctccctccaggtttgtaccactgtggtgctctctgttccctttgcaggccaagctagtgtctgcccgagggactttgtctttgctgtgcccttcacctggaatgctttcctcctcaggctcacatggctggctccttcttgtcattcggatctcccagtaaatatcacttacaggccgggagcagtagctcacgcctgtaatatcagaactttgggaggctgaggcgggcagatcacgaggtcaggagatcaagaccattctggccaacatggtgaaaccccgtccctacttaaaaaaaatatatacaaaaattagctgggcgtggtggtgcgcgcctgtagtcccagctacttgggaggctgaggcaggagagttgcttgaacgcaggaggcagaggccgcagtgagccgagatcacatcactgcactccagcctgggtgacagagtgagactccatctcaaaaaaaaaaaaaaaaaaaaaaaaatcacagtgacgcagtggaccaaaagtagccagcagctgacctttctttgtcattcactctatttcaattatctgcatattagttttattatgtgactttttctgggtttattgttgatttacccaactagaaagtagtctctatgagatagggatatcatgtttgtttgtttaagacagggtcttgttctgtcccgcagtctggagtgcagggctgtaatcacggctcaccacaacctctgcctcccgggctcaagcaatcttcccacctcagcctctctagtagttgggaccacaggtgtgtgccaccatgcctggcttatattttatattatttgtagagatgaggtcttgcggtgttagccaggctggtctcgaactcctgggctccagtgatccgcacacctaagcctcccaaagtgctgggattataggcataagccaccgaccctggccggaataattatctatattatttgccacatcatccctggtgcccaggagagggcctagcccacaggaagtgcttgagaaataaaatgctttcataatggtttgcattaaaccccctctatggacgatatcatatgaatttggcttatagaaaagtatgccattgtaacctgttttactcttgtcatccaaccaactttcctcaagaactttagaacttttcttcctgccaggggatgacacagtcacctcatagactgttttctttctgtcttgcagccatgaagttctccataatttttgtattgccagaaagcctgaatgaacatttagcacaacccccttctactttatatccctttatatcctcccaaaatagccttctctacacaatgataaggacttgataaaagggcccctattgtgcagtcccagcctggacaaagtagttttaaagccatagcagaatggccatcaggttgtcagaaatgacaaaagccacagcacatatgcaagtggtacaaatgcttagtgccaagttaagatatgaaactacactttcatatctctatgagtgtgtgtgtgtgtgtgtgtgtgtgtgtgtgtgtattagttttctggagagacaaaaccaataggatatatctagagggagacagagaaagagatggagaaagagaaagagaagagaggagatttattaggggaattggctcatacaattatgaaagctgagaaatcccatggcaggctgtctgcaagctggagaccctgggatgccactagcatggctcagtccaaatctgaagaactgagaatccgggggctgctggtgtaagtcctagcgtccaaaggccaaaggctggagaacctgatgtccgaaggccggagaagaagcatgtatcccagttccaggagagtgagtgacctacccacggttctatctaggctcccaagcgattggacactaccccccacacccccctgtccccgcattagtgggggcgggtcttttctacttagtccacccagactcacacatcagtctcctttggaggcacccttaaggccacaccccaaaataatgctttgccagttctctacgtattccttaatccagtcaagttgacacttaaaattaaccatcacacgttctcacctttcaacttggcagccattacacatctctttgtatcacacttaatctccaaataaagacaatagcaaagtgataattctacctaatataatgcacctgttctgtgtacaacagaaaacataccagtcccttccccagaagagaaggtaaagtccttgggtgatgtttactcttctgctgatatcccataacttaaatactatgatataaaattaacaatacttaaatactgacataaagtcaataaatcttgtaaatactgatataaagtcaataaatgtgttacatgataaagacataagagaagaatgaaaacaaagatattaatatatgtacatagacgcacaacatattcttaacaaaacagggaggaaatactcatcacagttgcagtgcttggttctgtaactggtcacgtgatcatagctggtatttataactaccttcctttaccacccattctatatttcctttaccttcaacaagaacctcagttgattgtggttctttatgtggcaggtgacccaaacctacatttctgaagagtctgggccattcacagacttactcagattgagttgttgtaatttctcattgaccttaatcacaggacatggtaatactaagagacatcctaagggatctcctgtatttcagacatacacttctgggttttttttttggttttttttttgagacgcagtctcactgtgtcgcccaggctggagtgcatgggtgtgatctcggcttgctgcaacctctgcctcctgggttcaagcaattctcctgcctcagcctcccgagtagctgggattacaggcacccaccactatgcccggctaatttttgtattttagtacagacggggtttcagtatgtaggtcaagctggtctcgaactcctaacctcaaatgatctgctcgcctcggcctcccaaagttctgggatttcaggtgtgagccaccgttcctggcagacatacacttctttatctccattgtggaatagtagtccaatttctccctagtattttgaatcagttactccagccaacatcataactcccttcttagctttttgattcagaggcatgaggatcccaaagtggctgggtggtagtcttaacttccagttcaatggaatcattgttgtgtctccggaagcactcctccctctggaactaagacctccaggcctgcagatcataaagtcgtgggaacagaaagcaaaaatgtttccaatgggtcactagggggaatagtgagtggtgccactcccatttccaccccttccaccccttccatttctggacctgtggatcctggctatgggagaagcagcaccatatactggatgttgattcagagcatatacaactttctggagaaccttgcaccagccatgcaaaaaaatcatcaccgtaacttcaaaaggccattacaccattcattctattaacccagctgctccaggatgatgggaaacatggttaagaccagtgaattccaggagcatgggcccattgctgcctctctttggctataaaatgtattccttgatcagaagcagtgctgtgtctgtgtggaataccatgacaggggatagggcattctgggagtccatggatggtagttgtggcagaagcattgtgttcaaggaaggcaaatccatattcagaataagtgtctactgcagtaaggacaaaacactgcttcttccatgatggaagctgtccaatataatcagcctgcgaccaggtggctggcagatcaccccgaggaaaggtgccatatcagaggctcagtgttcatttctgttgctggcagattgggcactcagcagtggctgtagccaggttggccttagtgagtggacgtccatgttgctgagtccatgcataacctccatccttgccaccatggctactttgtttatgagctcactggatgcaagagtagttggggaaaggggctgtttggtatccacagaatgggtcatcttatccacttgattgttaaaatacccctctactgaggtcaccctttgctgagaattcatgtggacacaaatatctttacctttttttttttgctcattcagagaggtctattcacagatcacttccccaaatttctttgtcaccaattttccaatcatgttccttccaagtctctgaccatccagccaaactattggccacagcccataaattggtatataatcgcatatctggccatttctccttacaagcaaaatgaacaaccaggtgctcgaggttctgctcactgtgcgggtatcttttcagcactgtccttcagggacctgccagaaagagaccacagtgctgcagctgtccacttgtgtgattttgtgattttatatatagagatatatacatgtatgatagcatcagtaattcagcggtgttacccatagcatgagggtatgacacacaggcttcacctcacacagagacatgaaaacaataatccaccaacttcatactaagcaataaacactaagatttttatttcctgaggattccacaccttcattttcttagcacacagtagatttcagagccaccacgcctggccaacttttttttttgagtcagggtcttgctttgtcacccaggctggagtgcagtggtgtgatcatggctcactgcagcctcaacctcccgggctcaagtcatcctcccacttcagcctcctgagtatctggggctacaggcacatgccaccatgcctagctatttctttttctttttttttttttttttttttgagacagggatctcctatgttgcccaggctggtctcaagctcctgggctcaagtgatcctcccaccttggtctcccaaaatgctgggatacaggtgtgagccactcacgcaacccagacaatttttttttacagacactttttataaaactatttgtttctcagttgtgattatagaatccctttaacaaataagattagttatccccagaggattgtttgatggtttggggccaagcatttcagatactgcatattaactacctcttttatacaggtgtgtgtgtgtgtgtgtgtgtgcgtgtgcgtgtgcatgtgtgtatatataaatatacacatatatttttgtgtgtctgataacaccaactttgttccctaatcatcatttcacagaagatacaaatggaatctaaaagaatgaaaataagcttttgtataagaccacaagaaaattacagagaataaatgaaacagatgtgagcaaaagatggggatcatacataatgtctgaccttataaactacataaacatggttacttcaagaagctactactataatattacttattatttgtttatacaattttgcttaaaattacatcgtactctctacttatttagagcaaatgattgtgccaaatagataagactatttccatcaattagtatctacaattattctatttcacaactcataaagtgttgcttaaaaatctaattccttagagcacaagcacagatcatcacaatagacctagttaaagttcattcttcaaatcgtgttgtttatataccttattatatactgacataaatccagtttagcaaggtatttaataagccctgactttcctttttaaaagcagaagtattcccttttctctctttaccacattgtaagtactgttttttttggttgttttttgtttgtttgttttgagacggagtctcactctgtcacccaggctggagtgcaatggcaccatctcagctcactgcaacctccgccttccggattcaagtgattctcttgcctcagcctcctgagtagctgggattacaagcacgcgccaccatgcccggctaatttttgtatttttagtagagacatggtttcaccatgttggccaggctggtcttaaactcctgacctcaagtgatcggcccgccttggcctcccaaagtgctggaattacaggcgtgagccactgcacctggccctaagtactgtttttatatctacaatctgctcctatattcataactgatggccctttgacttttccttctatagtgggaaaacaacaatcaaagagcagaaatggggccctgtcatacatagttccttccttccttccttttttttttttttttgagatagagtctggctgtatcacccaggctagagttcagtggcatgatctcggctcactgcaaactccgcctcctgggttcaagtgattctcctgcctcagcctcccaagtagctgggattacaggtgcacaccaccaggcatggctaatttttgtatttttagtagagacagggtttcgccatattggctacactggtcttgaactcctggcctcaagtaatccacccacctcagcctcccaaagtactgggattataggcatgagccaccacgccaagcttcctggcatacacagtttttaacaccccttgtcactgttctcttcccacctcccattatcttttcttagggctttgattttcttgaggattataggtttttaaaaggttgaaagggaccttgcaaaatccctcaggactgctattccttttctatctcttcttaaaaataatgttaaagaattaatattacatacattacaaatattagaaagtacatttacataagatgtgaaagaggcatacgatggtaacagacacactagacttagctggattacttctaggaataatagtaagtgtctaaaacaggttgccttgttagaacatgatactactgaatctgagtgcttatcttcctcatatgtgccaattatgtttttgtcgaagagcaatcctttctgattttcgcagactgctttctgattatttgtctcacaaagagactgggtaaaagcatgtggctttatttttgccatttctaaaaataacccaacagctatgctgtgcactgctcaccttagcactattgtattcatgtgtttatgtgtataaaggacagttcatagtcagcatattcaatgcttttctccctctttgttttaaagttcaaagttactgtctacacgaaagttggggtatttcaccactagcctcattttatgctattcataaaatcatgagcagactttttaccaagggcaaaaaaatcttaagaaacaggaacatcccccttcccccatacaatattcctgacaaccatttattaaggtctttctctaatctttcgctggaatcacctctacttcccaaaccatctctaccactgtcaactagcatcaatcgttaaagttcttcgttaggctgtgatcaaatatcctcatgaaggttttttaaggagtagctcttctacacattctcaaggcgggtactacagtggtgctaaggacatacctatcagcgaaatgaacatgttctctttaagttccacagttaagtccacctattataatagctgacatttcttgaacgattatactaagtggcagacactatgcatagtgtttggtgttttgtttttttgtttttgtttttttttttttgagacgaagtctcactctgtcgcccaggctggagtgcagtggcgtgatctcggctcactgcaacctctgcctcctgggttcaatggattctcctgcctcagcctcctgagtagctgggactacaggcatgcgccaccacgcccggctgattttttttttttttttttgagacagagtctcgctctgtcaccaggctgcagtgcagtggtgtgacctcggctcactgaaacctccacctccgggtttcaagggatgctcctgcctcagcctcccaagtagctgggacggggcccgccaccatgcccagctaatttttgtatttttagtagagacggggtttcaccatgttggccagaatggtctcaatctcctgacctcgtgatccgcccgccttggcgtcctaaagtgctgggattacaggcgtgagccaccgcgcccggccctgatttttgtatttttatagagatggggttttgccatgttggccgggctggtctccaactcctgacctcaagtgatccacccgcctcagcctcccaaagtgctgggattacaggcgtgggtcaccatgcccggcctaagagccaaaattttaatcagtgggaaatgctgactgccacgctcatttaagaggaaaggtcaggatttcgtgagctgcattgttcactgacatctactttaacgactccagcccagcctgagctaatcttttcctaaatcctttgcattttctttctactgtcaatttacaccttaacaaaataaaggagttttagagtaagatagaatcaacttcaatcaactctcttgaattcgctggggaccctctgctctaaaatatagtactattcttgcctctggcatccctggttttaccttcgtcttcctacctccctcccacctccatccatcccccctccccccattcttttgagtgcagtggcacgatcttggctcactgcaaactctgcctcccgggttcaagcgattcccccacctcagcctcccgagtagctgggattacaggcatgcaccaccatgcctggctaatttttgtactgttgtattttcaccatgttggccaggctggtctgaaactcgacctcaaatgacccgcctgccttggcctcccaaagtgctgggattacaggcgggagccactgcgccctcctggtccacccactattaaccccttatttcctacccttcacctgcacctctttgagggccatttcattcctggaatagcctgttttcattattagttatgggcctattttccttactatgtacaattttaaagtcataaaataatttttcttcagatgttaaaaattgtgtttacatttaaccagataaaacacttgttattaagggcatatgttcaaaaatcttcttttccatttattttctctaagtcaggcatataagctgatatcatgtcttacatattttaaactaaatttgacctgaagtcacctctgttccttgaatctctacctgattgcagctcagcttagtatgttcacaaactgaaaacctaatttaggagtacgttataagtcctcactaaaaatggtagctaggttcttagatattgtaactttaagtgaaataaagtataaggaaaccaatttcaccataagctaattgatataatgaggaattaacttcctattgcatacttatggacataaaaacatcacataacttctaaataaagaccaaaacacttcaaatactgaacattgaaataaattcccggtcttgcccaggtgatctcatctcagcctcccaagtagctgggactacagggatcttctccctttgttttttttctagccccacttccagtttgtttccacagtacttagagtgagttgctgttgtttttcttctttgttctgttctctctttattttcttatgttccttcctgcacactgaagttgctgttgttttagattttctttttttgagtgagatcttctcactcagtcacctggctggagcgattaatagctgactctgggtacagtgcctaagctagccttgctctgcaaggaacagttaaaaaagaaaagaaaggagaggagaggggaggggagaagggaggagaggggaggggagaagggaggagaggggagggaaggggaggggaggggaggggaaaaattaataaaaactaagataactatttacccaatgattccacttgaggtggtagacaacccaagcttatcctggcagctcagggaacaaggtgacaccaaccttggacaggagtccgtcccatcctcaaggcacactcacactcacacccacactcatgctcactcagactgggacaacgtgaacacgccaatgaacctcaacatgcatatctttgggatgtgggaggaaagtggagttacatggagaaaacctacaaagacatgaagagaaagtgtgaactttacacagactgtggccccagctggaaatctttttttttttttctcatcaatgttataacgacatgctatatatatttttgttacaactagctgagtctcagccaatcacagcaaccaaacttcagctaatcacagcaactgagcttcagccaatcacaggatgccaactgatcagacgatgcccaaataaggcaaatttggagctttaaccagtcaagctgtttgtgtacctcacttccagttctgtctataaatgctccctgtccacctatttgcccagtggaactctctgagcctcctttggttctgagggctgcttgattggagaatcattctttgctcaaataagctgttaaattcaatttgtcaaaagtttttcttttttttttttttttgagacggagtctcgctccgttacccaggctggagtgcagtggcacgatctcggctcgctgcaacctccgccgcctcccgggttcaagtgattctcctgcctcagtctcctgagtagctgggattacaggcgcacaccaccatacctggctaatttttatactttttggtagagacgaggtttcaccatgtcggccaggctggtcttgaagtccttacctcaagtgatgcgcccgcctcggcctcccaaagtgctgggattacaggcgtgaaccactgcacccggcctacaagtttttctttccacagtattatgtatcctgtattatgagataaacttcttgggcaaaaagcaagccattaaaggctgaatatttcagcatgcctaacttaataaaatttaggacattttaacttttgctacagttaaaatccactagactttttgatctgctgccatattagtttgattcaaaataatgagagcagatttattaaaatatgaagttgcatttcatattttccttgtattttttaagtgagaaaatttcctggtatcattttagctatcataaaatgccttttaggactatggaaatgaaagatcttggacataaatgatttggataaaataagcacatgaaaatactgcctgaaaatagttttaaaagaatcctgaggaattagaaaaacgagctattgtgaaacactgttagtttagcctttagtaaaacagcagaaataacaagcaattttggtcagaacaaagagaaagagaaaattgtaagttccacaaacgcagaaacagattttgctccaattggaaagcttcagaaagctaaacccttcatttacacaatccaaggcagagtgaggggcctctctgtgttgagctaaactgagcctatagtcacacattcacacatttggcactaggacagttgtgaggataggatctgacaaacttttcactgccaaacataactcagatgctagatgagcatgactctaagtatctttacacagagagtttagaaataacatttccctactcactggaataaataacccatccttgaacttggaaccatctaaaccattgtagatggtttaagtcatgcaaaacaaagtgctttttgctttctagatcttagcttaagaatgcaatattttatctaaatgactaggcaactaaggttcgctccaatttgaggattttaagtctagccatatgtctatttccaggaagcttatcagttttgtgtctggggctccagataatggaatacagcaaattataagcttcatggttcagcagaaaaaacaagtttggggtccagtaatgtataaaatagtaacagtaatgataaaacaaaatgcattcttctttcaaaccatagttagtaaatcccatgaaagtgtaatcctagataaatgtaatcccatgtaaatgacataattctttctccaggtaaaaagagctaacataaattgaccactaattatatgttaacacagttataaatacctttactgcattatcttttttaatccccacaaaattctataatctattattactatttcatttttgcatgtataagaaatgaaaggacagagggttaaataatttgcccagccaggcacgtgactgtaatcccagctactctggagggtgaggcgggaggatcacttattttttttaaatttaaaaagagatggggtctcactatgttatccaggctggtcttgaactcctgagctcaagtgagctacctgccttggcctcccaaagtgctgggattacaggtatgagccaccgtgcctggccaagaggatcacttgagcccaggagttcaagtccagcctgggcaacagagtgagactctgtctcaaacaaagaaaacaaagaaaaaataataatttaccctaaaaaaaattaaaataataataataaaataataataatttgcccaaagtcacacaggtagtaagcattgaaatctgtggcaaactcagaaggcctgactcaagaattcacgacacaaccacaacagattgtacactaccgggcagtttcctgctgctctgtgcatggcctgctggccaactctgatgtgaggtcagttgactaaaagagatgtggttcaggaagctgagaatgattgtggttacctgttctaagatagagaaattgatttttaaaacttcgagttgaagtacgggatgccaaaaaccacgtatgagtgacagagtgagtgggtctctttctgatggattaagtcttcaaaaagactttcagaatgaatctctatctaccttaattttgggcagtgttaattgtattcattttttcaacacatttgattgtgcatataccatggacaagaaagtttgttaaaaactgaatgtataaggctgggtgcagtgactcacgcctataatcccagcacttcaggaggctgaggcggacagatcacttgagcttaggagtttgggaccagcctggacaacatggtgaaaccccatctctacaaaaaacaaaaaaattagctgggcgtggtagcttatgcctgtagtcccagctacttggggggctgagataagaggatcgcttgaacctgggaggtcaaggccacagtaagccgtgatcgcactaccgcactccagcctgggtgacaaaataagaccctgtctcaaacaaccaacaacagcaacagcaacaaaaaccctaatgtacaggaaattattttggggagtagtggaagatagctggcaagttggagactctaacttgagatgtggtactacttgtctgtacattttttttctcatttctgtctacccaaaggtgttatgtttttattgtcttaagggggcccttcatttgatggcataaaaagttatgaccagccatctgtagttcagttaataggtcaagaatatcagcagctattgttatgttgaggtcattatttatcaagcttcaacacataaaaagcaaaagtaggccgggcgtggtggttcacacctgtaatcccagcactttgggaggctgaagccagtggatcacttgaggtcaggagtttgagaccagcctggccaacatggtgaaacttaatctctactaaaaatacaaaaattagccaggcatggtggcggatgcccgtaatatcagctacttgggaggcagaggcaggagaatcacttgaacccgggaggtggaggttgcagtgaactgagatcgcgccactgagagcactgcctgggcgacaaagcaagactccatctcaaagaataaaataaaataaaataaaataaaattaaattaaaataaaataaaatataaaataaaataaaataaaatataaaataaaataaaataaaataaaatagcaaaaatagtccaaatgtcagttaacagggggaccaaatttatgggtgaacatccacaagaaacataagtggcctctagggaagccaatctttgcacagaatttttgtttaatgaggtggagggtatacaagatataggccaaaggataatttaggttcttatgactgtgtccttgttcttttcaaatcctagcttcatctctgctcccactgatgacactatgagactttggaattcttcactgtgtgtaagacgattttattactgagatagctaccgctttgtagttatgacctgagtaaacaaggttagtcaacccacaggattttcatgtgtccacagatttttactagataatttatctgtaatatcaggaggcaaagtctaccatgaatatactggccaacatgtatcagatggaaaattcttgtgtaagcagatgatgtttaacttttatcacatttttctcttttgttagataatgccatacttcggcagacaagcaattgttttctagctataaatatgagtattttgcttttcaagagaaaaaatctagaaattgttttctttactttaaaaaattcatgtactgaagtccttcctctgcttgtattaatccaatgatatcattttatatattctctgaaatactaaaatatttctgtagtccatatgttttcaaattatgaatcattttatttctacatttggtacataaactattactgctcctgagtaaatatggatataccactttatagtgattttttttcttctttttctctttttctattttttttttttttttttttgaaaacagggtcttactcctggcctcaagtgatcctcctgcctcagcctcctgagtagctggaattataggcatgagctaccagtagtgattcctaagtccccagaaatttgagctaatttttatttatttatttattcttgtatttacttattttgaagacaaggtgtcgctccgtcacccaggctggagtgcaatggcatgatcatggctcaccgcagcctccaactcttgggctcaagccatccttctgcctcatcttccttagtagctgggaccatacgtgcaagccaccacacccagcttgagctgatttttttaatgtgatgaactatgagaaaacatataggagctaaatgatgagaacttagaaacacaaagacggaaacaacagacactatggtttacttgatgatagaggatgggagggtgaagaggagcagaaaagataactattggataatggacttaatacctgggtgatgaaacagtctgcacaacaaacccctgtgacaagagcttacctatgctggcccggcatggtggctcacgcctgtaatctcagcactttgggaggccaaggcaggcagatcacttgagctcaggagttctaggccagtctggccaacatggtgaaaccggatctctactaaaaatacaaaaattagccaggcgtggtggcgggtgcctgtaatcccagctactcaggaggctgagacagaagaatggcttgaacctgaaaggcggaggttgcagtgagctgagattgcgtcactgcactccagactgggcgacagggcaagactctctctcaaaaaaaaaaaaaaaaaaagaaagagagtttacttatgtacaaaccttcaaatgtaccaccaaacctaaaacaaaagttaaaaaaagaaagaaaaataaatgtagaaaaaaatatatatatatatgaacaacgcataatcctggaaatataaggaaaaattaaattttctcctctgggaaaaatttatacagtaatgattcttgctctttaatttttgtttgaaagaaatctagacatttaaaaaaccccagtggtagaattgtcttgttaaaaagggacatcaagtaaaaggccaggggaacatcaaacaattatgtttcttacctggcaaaaccagtgtctagctaaaataatggcttgcaaatcaatcttgttgtttaaccacttcattatctggttttctctaagcaaagaacattatctgtgttgccaataatagtactggggaaaaacacacattttgaaagtatgaagaaactcattctaccttgaaattctcattcaagaggaaattataggccactgcaggaccagcgattgaaaaacaaaggtgtacaaaaacaaacaactcaggtttcaaaggctaaaaacaaagataacaggaaagaacctaaacttgtgcagcctgtttgcttactgtctgaacaaatgctgggaatgcatgagaaattctaagccctgtgaacaaaagtgtgagcagtaagatgacgggtgatcaattttcttcctttctctatttttcattttttccctatgatgagcatatgccacttttatgttataatgataaaaaagaaagacttaaaaaatgacttttgtttttccaactgtataccagtatctatctacacatagcaactgagcacgctagtcctgtcgtctggcactcacacaaaaagagtgaatgtcaaaatctaggcaattctaccagatttcacgtaatgaaactaccttgaataattccttaattcttcacaaaatcatgtttttatttaacttctatttctatcaagcaatgtggactaactacccctaatatttaactctatttaaactgtgtatcaggccagatgctggctcacacctgtaatccaagcactttgggaggccaaggcaggtggatcacttgggctcaggagttcaagaccagcctgggcaacatggagaaaccccgtctctacaagaatacaagaaattagctgggtgtggtggcatgtgcttatagtcccagcttcttgtggggctgaggcaggaggatcgcttgagcccagtaggctgaggctacagtgagctgagatcatgccactgcactccagcctgggtgacagagtgagaccttgtctcaaaaacaaaacaaaaaacagattacacactacattaaataaataaaatactctctgatgatgactgattttgaatgaaaatactccattcactggaatatattttccataaaaaatgacaaaaacattgtcattttttgtattatttctttttcttttcttctttttttttttttgagatggagtctcactctgtcccccaggctggagtgcagtggcgcgatctcagctcactgcaacctctgcctcctgggttcacgccattctcctgcctcagcctcctgcataactgggactacaggtgcccgtcaccatgcccagctaattttttgtatttttagtagagacagggtttcaccgtgttagccaggatggtctccatctcctgacctcatgatccgcccgtctcggcctcccaaggtgctgggattacaggcgtgagccaccacacccagccttatttctttttcttttttggagatagagtctcgctctgttgcccaggctggagtacagtggcccaatctcggctcattgcaacctctgcctcctgggttcaagcaattcttctgcctcagcctcctgagtagctgggattacaggcagacaccaccaggcctagctaatttttgtatttttagtagagacggggtttcaccatgttggccaggctggtcttgaactcctgatctcaggtgatccacctgcctcagcctcccaaagtgctgggattacaggtgtgagccaccacacccgacctattatttcttgtattattaaaatcatttcaggaatttgtaaaagttacagtaataaaactcgtactgcaaccatgactagaacatggcctttgtaaagaatccatttacaggctcataagatttggtgttgtggatggatggctatggagctgctcaagcttgtgtttgcacttatcagaattcaaggcagttagaaagagtttccaagtgctgatgtgctggagaagaaagggcatgctgcagtgtagaaaccacgggagaaacaattgcgtcacctagtttcaaactgtgagaaaactactagcgaactagaagaatatttaacttcctaaacctgagagatctacatcttaaagaatatagattctactctaggcacatcatagtcaaactgataaaaaataaaaataaaaataaaaataaaattacagcagccagtaaaagactacacgttacattcagcatagcaataatgtaaacattgttgacttctcatcagaaactctacaggccagaagacaagaaccaatatctttaaagttatgaaagaaagaaaaacaaagtagccacgcagaattccatatctagcaaaaatatccttcaagaatgaaataaaggtatttccatttataaagacatatcatgtagataaaagaaaactaagatatttcactgccagaagacttataagaaatcctggccaggcgcggtggctcactcctgtaatcccagcactttgggaggctgaggtgagtggatcacttgaggtcaggagttcaagaccagcctggccaacatggtgaaaccctgtctctattaaaaatacaattagccaggcatggtggcatgcacctgtaatcccagctacttgggaggctgagacaggagacaggagaattgcttatacccgggaggtggaagttgcagtgagctgaggtctcgccactgcactgcagcctgggtggcagagcaagattctatctcaaaaaaataataaaaacatgaaaaaaaagaaatcctaaaggaaaatttccaggctaaagggaaatgataccagagagaaacagattttcaggaagaaatgaagaacatcagaaatggcaaatatctggataaaaacaaaagataattttccccttattttttaaaaaatgcactgtactgtagggtttagtacatatatagataatacatatgacagctataatataaaagatgagggtagagtggggtagatgcacctacattgtttgcaaattttgacgatggtctatgaaaatttaaagtcatttattctcagctgggtacagtggctcatgcctgtaatgccagctctttgggaggccgaggtgggcagatcacttgaggtcaagagatcgaggccagcctggccaacatactgaaaccccgtctctactaaaaatacaaaaattagccaggcgtggtggcacgtgcctgtaatcccactacctgggaggctgagacaggagaattacttgaacccagaaggtggaggtcacagagagccaagattgtgccactgcaccccagcctgggcaacagagtgagactctgtctcaaaaaaataaaaataaaaataaagtcatttattgtaatcttcagagcaccactgaaaatgtgatgcaaagaggataactagaaagtcaacaggtaaattaatattaaattctaaaacctattcaaataatcctagagaagtcaggaaaggaagaataagcaaacaaagaagagaagggacatatagaaaacaaatagcaaaacagtaaagttaaatctaactgtgtcattacattaagtataaaggggctaaacatcacaagtaaaaaaaacagagatcattagataggattttaagaggaaaatctaaccacatgatgtctataagataagcaccttaactataagacacaggttgaaagaaaatggaaagaaaaatatgccatgtgaaaagtaggctttagaagattggactggctgtatctatcagaagaaatagacttaaaacaaagacttttaccagagataaagaaggaaatttcctaatgataaaatgatcagttcattaggaaataataataatcataaagatgtgtgtgtggttgggcacggtggctcatgcctgtaatcccagcactttgggaggctgaggtgggtggatcacctgaggtcaggagttagagaccagcctgaacaacgtggcaaaaccccgtctctactaaaaatacaagaattagctgggagtgatggcatgtgcctgtaatcccagttactcaggaggctgaggcaggagaattgcttgaacccaggaggcagaggttgcagtgagccgagccgagatcatgccattgcactccagcctgggcaacaagagcaaaactccacctcagaaaaaaaaaaaaaagtatatgtgcctaataacagaggttcaaaatacataaagcaaaaattgactgaattaaaagaaccaaaagacaattctaccactagaggtggagattttaaaacactcttagtaatggactgaccaactaggcaaaaaataaataaataaataaataaataaataaataaataaataaataattactctagacatagatcctactttatgagttggttaagttggtgactgggaaggatcttcatgagatgagctcttgtaggagggacactccattctttgtaacactactgatgaaggaaaagtaataaaaacgttttaaaaatgagtatgtctattgcaccactgcactccagcctgggcgacagagcaagactccatctcaggaaaaaaaaaaaaaaaaaagagtaagtctgaaatatttctattcctatttctctatgtgttctgcattagtttttcttgtaacttttttttttttttttgagatggaatttcactctttttgcccaggctggaatgcaatggcacaatcttggcttactgcaacctctgcttcctgggttcaagtgattctcccgcctcagtctcccaagtagctgggattacaggcacgtgccacacctcccggctaatttgtgtatttttagtagagaaggggtttcaccatgttggccaggctggtctctaactcctgacctcaggtgatccacccaccttggccccccaaagtgctgggattgcaggcatgagccaccacacccagcccgtaacataatttatttaggcttcaaaaattgtccaagcaacattttctttttctttctttcttttctttcttccttccttccttccctccctccctccttttctttctttctttctttttctttctttctttctttctctgtttctctctttctctctttcagtgaaagcaagtttattaagaaagtaaaggaataaagaatagctgcttcacagatagagcagtcctgagggctgctggtcaagcaccattttctagacctgtcctgtacagatttccctccctttccattttctttacataacatcaagaatcatttatgttcctttggtaatgtttcattctacattgcttcttcataacacatgtgctgtagatcttactagcagtattagccagcagatggcttgtttattgtggtggtatactgctgatggactgaaatgatggcataaataggctaattcacttttatgttttttcttctttcttcaaaagatataataaaacaagacagaaaacaattttttgacagatgaaattgataatgtttagaccgtaagtctggtctttgaaaaaaaaaaaagccatcagaaagtttctcactttccttctcaagtcctcctgtttctgctaataggcacagcctctgactcccttttatgaagaacagattatagcacagatttagcccaagctgtttctgctaggagagctgcttcttcctaagaagcgtgctatagaactgggcagtccactctccattctcctagccttggtattttctggctgcgagctttggatatgtcagctaacctattcagcttattatttcatttctaatagaggcataacaaggaaagggctgtctctcctatttcaagggattgcggcaaacactacattagatttctgtgaatactccttgtaaaagcgtgaggcataatacaaatatcagatatcagcgtgagttttctatttcattagacctatttcattagaaaaggtgaaagctctattatcactctcttaattgttttagctcctttttgcttcaccttcccttttatttctagtgtctactttgtgcaattaggcctcacggctcatgtgtgtttgtgaaaaagaatttttaaatgtcttctatttgctatgagaacataccctactctttgtctaagcgtaatttctaatcatataacctgaagcatattctccgatctcataaagtggcattcttctgattctgattagatgtacagccctaatatcatagtgcaagtatacatgccctcccataagtattctgaagtatgattcaccctaggttttcaaatctcttccttgccctagaaaacaaacttggactcatgtgtttgcccactttattcaactcctctgtcttctactccagcaaatagactcattcctcattcctcccaacacttaaatatgcttcacaatccacaaagctgtacctgatgatatatatatatatatatatatatatatatatatatatatatatattttttttttttttttttttttttaaatgacaggcaggtaatgtgcagacatcataacaaggcttgaaggaggcatatctcacacaggaacatgaaaacccaatcatcacacttataaacgacaaagggatctagtatatacgttttagatactgaaaagaagacataacaaaaggacttttagggtaaaattgattgcaaggctaggtatggtggctcacacctgtaatcctagcactttgggaagccgagctcagcagattgcctgaggtcaggagttcgagaccagcctggctaacatggtgaaaccctgtctccattaaaaatacaaaaattatccaggcatggtggctcatgcctgtagtcccagctacttggggggctgaagcaggagaatcgcttgaaccctggaggtggaggttgcagtgagccgagatcgtaccaccgcactccagcctgggcgacagagcaagactccgtctccagaaaaaaaaaaaaaacaaaaaaaaaattaattgcagtgtattcgagtgttgggttaggtaagaataaataaacaaggccgggcgcggtggctcacgcctgtaatcccagcactttgggaggccgaggcgggcgaatcacaaggtcaggagatcgagaccatcctggctgacacggtgaaacaccatctctactaaaaatacaaaaaaattagctgggcatggtggcgggcgcctacagtcccagctactcgggaggctgaggcaggagaatggcgtgaacctgggaggcggagcttgcagtgagctgagattgcgccactgccctccaacctgggcaacagagcaagactctgtctcaagaaaaacaaaaaacaaaaaacaaacaaacaaaaaaatatttccccccaaaccttgcctttgtgtagagctttactacagaatgtatcctgtacataacaggaaacaggttgtatttttccaataatacctggatcatcattagtccagaaggttcttggatcgggcttggtcaggatgttggcatgattacatggctctctcacctttaaaacataaagagaaaagaagtgatataaaaatggcttcatcatttcagctattttaggcttatagttctagagaaaggattccaaggctgaaactagtacatatggcatgtctgtgctctaattagggtggttttctcaggaccgtgctgggtatagcactgaaagtcccatatcctgggaagccttttagtcctgggcaaaccgggacagttggtccccttacacatgaagcagtttcactgggctgatggctgggttagcacatgggcgctggagctcacccagtgctatgtgcagtgcacaaactgcacagccgtatgaagaggccctggattattagcaaatttatcagtgtagacactcaatacataaaaagtgtttgaatctccacataacagaaatgatacttttagtacatattgcttgggaaaatacatattaattaaaagctacttttaattcagtagcactttaaatgctttttttgtttgtttgagacagtcttattctgttgctcaggttggagtgcagtggtgcaatctcagctcactgcaacttctgcctcctgggttcaagcgattctcctgcctcagcctcctgagtagctgggattataggcgtgtgccaccacgcctggctaatttttgcatttttagcagagacggggtttcaccatgttgcccaggctggtctcgaactcctgacctcaaatgatccgcccacctcggcctctcaaagtgctgggattataagcgtgaaccaccgcacctggcctgcattcttattttataatcataacaggatctttatattctcaaatagcagcacatgtacatatgcaatatgtattatttagtccacttagaggctcttcttagtgcagatacatgtttttaatgataaataatatttattgagcattttctgtcaggtattttttcatttttaaaaaaatttcaatagatttttggggaacagatggtgtatggttacatggataagttctttagtggtaatctccgagattttggtgcacccaacacccaagcagtgtacactgtacccagtgtgtagtcttttatctcttgccccactgtcacccttccccttgagtccccagagtccattgtatcctctttatgcctttgcgtcctcatggcttagctcccacttatgagtgagaacatatgatatttggttttccattcctgagttacttcacttagaataatggtctccaattccatccaggttgctgcaaatgctattattttgttcttttttggctgggtagtattccatgtatgcgtatatatatatatacacatatatatgtgtatatatagatatacacacacacatacatatacacacatacacgcatgtatatatatgtatgtgtgtatgcatacgcatacatgtatgtgtatatatgcatatacatacatgtatgtgtgtgtatatatatatacacacacacgtgtttttttcgtatatgatttcttttcctctcgatagatacacagtagtggaattgctgggtcaaatggtaaatctacttttagttctttaaggaatctgcatactgttttccatagtggttgtactcagatacaattaatagatttcatataacaagttccacagagcagcagtgatccatgtttttgacagctttatactactgtgatattagctttcaaatatattctcaggccaggcgtggtggctcacccctgtaatcccagcactttgggaggccgaggcgggcggatcagctgaggtcaggagttcgagaccaacctggccaacatgctgaaatcccgtctctactaaaaatacaaaaattagtcaggcatggcagcgcatgcctgtaatcccagctactcaggaacctgaggcaggagaatcgcttgaacccgggaggcagaggccgcagtgagctgagatcgtgccactgcactctagcctggacgacaaagcgagcctctgtctcaaaaaaacaaacaaacaaacaatcaaatatattctcatgaagttaaatatagatcttagtgttaaaactgcttttccatttatatatattttgtaatgtgatcatttgattactgcaaatattctatagtttcatcaactacttagtggataaattccttccattgcaacaataatcaaaatactcaagaatgacactaaggtcattgtttagtttcaccgacattttctctttataacaaggcttttgtttttctttgttgagatggagtctcgctttgttgcccaggctagagtgcaatggtgtcatctcggctcactgcaacctctgcctcctgggttcaagtgattctcctgcttcagcctcaatagtagctgggattacagacgtgctccaccacgcctggctaatttttgtatttttagtagagatggggttttgccatgttggtcagactggtcttgaacttctgacctcaggtaatccgcccacattggcctcccaaagtgctgggattacaggcatgagccaccgtgccaggcctgtgaagctctattgacgaaggaagcagtgcatgaatttaccatctggtacaagctccttctcttgtggaccagtatcaaagaatatgtggaaatcagagaaattgggatctcaaagaggtattttcacttccatgttcattacaactttattcacaacagccaagatgaggaagcaacctaaatgtctactgacggataaattgataaagaaatgtggtaaatacatacaatggaatattatttggcctcagaaagaaatcataccatatgtgacaacgtggatgaaactggaagatgttatgctaagtgaaattagccagtcacagaagaacaaatattgcacgattccgcttacataaggtatgtaaaatagctaaacacatagaagcagagaatagaatggtggtttccaggggctgcagggaggggcaaatgggaaaatgcttgagttgctattcaatgggtataaaatttaatttaggcaagacgactaatttctagagatctgctgtacaacatggtgcctagagaacattactatattgtgcacttgaaaaattgttaaggccaggtgcagtggctcacacctgtaatcccagcactttgggaggccgaggcgggtggatcacgaggtcaggagttcgagaccagcctggcaaacatggtgaaaccccatctctattaaaaatacaaaaattagccgggcatggtggcgggcacctataatcccagctactcgggaggctgaggcaaaatctgggaggtagaagttgaggtgagccgagattgtgtcacggcactcctgcctgggcgacagagcaagactccgtctcaaaaaaaaaaaaaaaaaaaaaaattttaaaagggccaggcatggtggctcacgcctgtaatcccacactttgggagactgaggcgggtgggtcgcctgaggtcaggagtttgagaccagcctggccaacatggtgaaaccccgtctctactaagaatacaaaaattagccaggtgtgggggcacacgcctgtaatcccagctactcaggagcctgaggcaggagaatcgcttgaacctgggaggcagaggttgcagtgagccaagattgtgccactgcactccagcctgggcgacagggagactctgtctcaaaaaaaaaaaaaaattgttaaaaggatagatctcatgttatgtgttctttccacaataacacaaaatctagaatagattgccatcctattttgtcagtatatcagaaaggaacagaagacatttgatacataaatatgtaagtggtctatattttataagtggaatttttttttgtaattgtaatacatttttcatttataggaaacatgattgtagatgtaagactgaaggaaaaaatgccattaaaatttaaatctcaagaaaaaaggacaggcctcttgcctctttgcctcattgaaatcctgaaagcaagatgcatcaatagcagctctacaagagccattagtgaaaatttggccagggttctcgctcttgttgcttctgctccaaccagcatggtttgacccagattatgtgcagccaatttttccatcagtatgcaaagtaagaggtagacttcattacgttgggctaagtgatcttccttgaatagattaccaaaatcatccacccagtgaaagaaaccatgctagctctttgcacgtaaaataaattaaaaagaaaataaaagaaagaagaagaacaagaaaaagaatgtgtggagcagtaacatttcctggactacattttgagcagcactgtaaaatatccctcctactgaatcacttgaacccgggagactgaggttgcagtgagccgagatggctccactgcactccagcctggcgagagagcgagattccgtctacaaggaaaaaaaaaaaaaaaaaaaaaaatccctcctacctgactaagcagcctcagtatgaatcccttctcaggatttatctactccactgaagtactacttcaattgttagaaagctcttcacaggttgaattgaaatctgggtccttgaaactttggttcctgtttttttgttttttgttttttgttttttttgggggggacggagtctctctctgtcgcccaggctggagtgcagtggtgcgatctcggctcactgcgagctccgcctcccgggttcacgccattctcctgcctcagcctcccgagtagctgggactacaggcgcctgccaccacgcccggctaattttttgtatttttaatagagacggggtttcatcatgttagccaggctggtcttgatctcctgacctcgtgatccacccgcttcagcctcccaaagtgctgcgattacaggcgtgagccaccgcgcccggtgattcctgtttttaactcactcttaaattacaaagaacaggtctactctctcttttatgaaataatatctcaaatatttgaaagtagctattatgtctcaccttagctttccatttccaagttaaccagccctcttccctttcactgctctcgaggagcttattttaagtctttttactgaggtcactctgccccagaagacatcctttccagtaagtgaactagtcctcagggagctcccaggccagggttagataatagtcacaaaactaaggagttggttttgagggacagctttcaggaaggacagccagcattatttccacatacaagtaattaaaatgttcccaagcacctataaatctaacataccatgggagtaaagaatgctttatgacttagccacttttaatattttttaatgccaaaaagttttaattgattttctacagtaactatatacctatttgggaaaattgccatatgcgagctttctttctgcattaagctccagttaccttgtttccttgaggctttcgtatgaagcaaatgccattcttacagatctcatttacttgtgaatgattatcactatttgttcaataaaatcttccccacgttgaagctgctcctgatgaagtcagggtcttcaagaattcttgttctctgtgtcattatcatacaagtatcacaccattctttatggttctcaagaaccaaagcatccgcggcaaattacccggagagctcatatagtaaattttaagcacaagtttatagaaatccttgaactatatatactgcaactgtttacaggcaatgctctataactcctatagctttaggtactttgcagaagcgagaaaatttattatcagataaagtcttggccgggtatggggggtcacgcctataatcccagcactttgggaggttgaggcaggcagatctcctgaggtcaggagtttgagaccagcctggccaacatggtgaaaccctgtctctcctaaaaatacaaaattagccgggtgtggtggcgcacacctgtaatcctagctactctgaaggctgaggcagaagaatcacttgaacctgggagacggaggttgcaatgagctgagatcatgccattgcattccagcctgggtgacaagagcaaaactctgtctcaaaataaataaataaataaataaataaaatgtcctcatgaaacacctgtggcttagcattccagcctgggtgacaagagcaaaactctgtctcaaaataaataaataaataaataaataaataataaataaataaaatgtcctcatgaaacacctgtggcttagcaggaagttggaagctaaagaagtgaccagcgcctggagtttggctcctggctgaatccacatgggctctttggttctttctttctttccctggaataaggattcaaggagaatttctccaataggatatatgccatgggagtatgattgaggaggggcaaaaacgtgatataataagaacagcaaaataacagtatgcaattttaaaatattttattatagaaagcttaaagcatacacaacagtaaactgtataataaacctctatgtacctatcaaccaactttaacaattatcaatattttgctaatcttatttttacctatcttgccttactttttggctggaatattttaaatcaagtctcagacatcataacaattatctgtaagttattaaaaaaaatttttttttttgtagagacggggtctcacttgttttcccaggctggtttcaaactcccagcttcaagcaatcctcccacctcggcctcctaaagtgctaagattaggtgttagccaccactcaaggtttataatttcttcagaatgtgtttctgacaacttttttttgcctaaccaccatgccattatcacaactaacaatttcaacaataattatgtttattaaaattaaggctcacgcctgtaatctcagcaatttgggaggccgaggcaggcggatcaactgaggtcaggcgttcgagaccagcctagccagcatggtgaaaccccgtctctactaaatatacaaaaattagctgggtgtggtggcgcatgcctataatcccagctactcaggaggctgaggcaggagaatcccttgaacctgggaggcggatgttgcagtgagtcaccgtactctagcctgggtgacagagggatacgctgtctcaaaaaaaaaaaaaattaatgaaagtaattaaagtttagttatttaataaatgacagcatgtacattctgaaaaacagaatatgtgcagtattctgcagacagaataatttgaataaaatttgaatttaaaagataccatttcaaactgtaagccccctaaaaatcagtggaccttggcttcacttgtttaaatcctcatggcttctagaagttttgggtggggggacatctttaaaaattatttttctaacagaagtcttactatttttcaacttattttctatgagtcctaggaggtagaaagagatttttcttgtctgatagacttgaaagtattgggttaggtaagtggaagaaagatcatatttagaaggtaaccgttgaatgtttaatcactattgttttgacatctagaagtattgtcataggttacaatttaaacatcagaagatgggggtgtatgagaatatcacatttagggagatgtcagttgtccagaagttttgcagagaatctggaaaataaacatgagagtaagttttctttctttctttctttttttttttttgagagagctttgttgcccaggctggagtacagtggctggctgactacaacctccgcctcctgggttcaagcaattctcgtgcctcagcctcctgagtagctgggattataggcgcctgccaccatgcctggctaatttttgtatgtttagtagagacagggtttcaccatgttggccaggctggtctcgaacacctgacctcaagagatctgctcacctcagcctcctaaagtgctgggattacaggcatgagccacggcgcctggccgagagtaagttattaatagttctactgatgtcagaaataagatgtagtctgaattccatgaattgtttccagttaatggaaagttgaattgtggtggaattggtagggaaaaaaagcagttatggtcctctgtctccattctagttcatccttatttaaagaatattactccaggcagtgagcacatgcgcgcggtggctcatgcctgtaatcccagcactgtgggaggccgaggtgggcggatcacctgaggtcaggagttccagaccagcctggccaaaatggcaaaaccccgtctctactaaaaatataaaaattaggccaggcgtggtggctcacgcctgtaatcccagcactttgggaggctgaggcaggtggatcacctgaggctgggagttcgagaccagcctgaccaacatggagaaactacgtctctactaaaaatacaaaattagccaggcgtggtggtgcatgtctgtaatcccagctacttgggaggatgaggcaggagaatcgcttgaacccaggaggcggaggttgcagtgagttgagatcgcgccactgcactctagcctgggtgacagagcaagactccatctctaaaaacaaaaaaagaacatttcttcaacaaaataaatatattcacgtatgcataaattttttaaaactttttttctttttataaaaaaatcagttttctcaggttgaaatgttaaaatcacctctgatgaagatagagaactaaaatataaaatatgggtttgtctctgattcctttttggtttataataatttgcatatggctttccatggatcactttagcagtttgtgctaaagtcattagttcttcctaagatacaaaagaaattctcaaaatgcttgtttcctattaggcagggaagttgtttttctcatctctcaagttgcatgaccaaaagtagcaaaaatactttatctctagggaagtgaaagcttgcttctcaaattgctttagtgaggctttaggaaatggcccctggctggtatcataggatataataccgtcttgcaaatagtaattttgaattcagttctttgtatctatgagataaaagagtcttcttccattgactgtcttagatgggcttatcacattcaacagtatttactgagcatttgttttaagaaactactaccctagttgctaactcattgctccctagacattgtatttggattgaggagcagaacatagacatcaacaaaacagatctggaacccgatatcatgtacctctaaatgtgaagtatgcggtagagctaatgttttgtcagagtttaaagaaggaagcaataatatgggcaaagttgttgagcaaggcttcagggaggaagtagaacctgaacaggcttttaaaaacactggcaccatttggattggtgaggaggcggtagaagggtgtcctctctgggtgggacagcacaaacaaaggtgtgggaacaaaactcaacaaggcacatttgggcaacacttggttgagcaattccatgggagtgcaagactcatgggcgaaatcattggaagccacatggtggaaggctttaaatgtcaatgtgttcttcatgccatggaaattcagaaggcttggcagtttgcaggaaagaccagaattgaagaatacaggagctgaggggatcaggggactgctataacaacagggagttgacagagcacgaactcacatgggagctctgaaagtgaaaaggcagggatgggtgtggagggcagctagaagaatgctttgcaagacttgaagaatgactgaaaactagggaagatgggggaatccaaaacatttcatggctttggaatttggtgaccaggcagatggtcatagagggtcaaagctgtccacgagctccagcaacaggaggaagcacagcattctgtgctcagactagtgtggcaggcctgcagaatgcgtgtgggcccttgttcctgtgcttggctgagggcttcctgagagcagttgctccatctctgacccaccggaccactactgcctttggatcctgggtggtgggcttcactcacacagtcgaatgggtttctcatgcctttgtccctgggctacagtcctccacttcacaccacaccggtcaagatggaatgtggccacattatctcactacagcaaacatgcccatagtttgcaaatttggtacatcaaccgccacgctcataaagatgatggtttggaccaggatagcaggagtctggtcaagagattaatgcagggtcagagatcaggagtcttatcatcttgatctctgcaagctaatgatttatccttcttcaattgcttaacattaatcacatttatataacatgaggcctaggaacaatacttgaccccacaagagattgtgattccaaacaactagtcagatgttcctccttttgtggttttatttcatttgcattcttttttattttgatatttttcagtttggcctttgtaattgcaaacagcttaaggcaattcaccacccaacccacttcacttatttatgtttcctgcctggctcagcaagcacttgaatttaaactctggtctacacaaggtcaagatattcaggtcaaatgtctattaaatcaaatgttttctatattctacacaactagtagagttcagaggatcagagatttggggacctgaagggggtcttttattaattccccccttgcattatggttgagacaatcgaggtccagagggtaacgtaacttgtgttagggaccaattaagggctggagtccatgtcttgagttacattttaagatgtcaattgagaacggatacgggtttcttaaaactcaaatttatcctcaatcttgaaatttattcagttattcatttaataaatatttgtggataacttattatacaataggcacagtgctaggagccatgggcataggtgtgaacagacagacagatcttgccctcatggaacttgttttcttttctttctttttttcttttttttttttttttgagagagtctggctctgttgcccaggctggagtgcagtggtgatcttggctcactgcaacctccacctccccggttcaagtgattctcctgcctcagcctcccaaggaactgggattacaggcacccaccaccacgcctggctaatttttgtatttttagtagagacagggtttcaccatattggccaggctggtctcaaacttccaacctgaaatgatccacccaccttggcctcccaaagtgtgagccactcttacaggtgtgagccactgcacccggtcagaacttgttttctgatgctggtagttgaggtgggtgctatggaggcaataagtacggacacatgagtaaggagtgaggcgataagtggtcattttagattctttaagggagtccatcttacctaattttttcaataatatcaccagaatcaatgatggcacatctgcatttttcagttaaaacacataacacatttaggttacaatggaacacagcttttcaatgtactaaaatggctgtttttttgtttttgtttttgtttttgtgacagagtcttgctctgtcgcccaggctggagtgcagtggcatggtctcagctcactgcagcctcggtctcccaggttcaagcaattcttgtgccttagcctcctgagtagctgagattacaggtgcgtgccaccatgcccagctaattttcttttctgttctggttttttattttgttttgcatttttagtagagatggggtttcatcatgttggccaggctggtcttgaacacctgacttcaagtgatccacccgccttggcctcccaaagtgctgagattacaggcatgagccaccgtgcctggccctaaaatggctgttttgagttgacacagagccatgtccaaacacccgtttccacttcgcctatttaaatttccctcctggctctgcaggcattggagtttcgacctgagattctatgccaggccaagatatctagattgtttgcattctatatcaaaacatataattggccagccgcggtatctcacgcctgtaatcccagaactttgggaggctgaggcgagcagatcacctgaggttgggagttcgagaccagcctgaccaacatggagaaatcctgtctctactaaaaatataaaaatagccgggcgtagtggcgcatgcctgtaatcccagctactagggaggcagaggcaggagaatcgcttgaatgagggaggcagaggttgcggtgagctgaaattgcgtcattgcactccagcctgggcaacaagatcgaaactctgtctcaaaaaaaaaaaaaaagaggccgggcgcggtggctcacgcctgtagtcccagcactttgggaggccgaggcgggcggatcacgaggtcaggagatcgagaccatcccggctaaaacggtgaaaccccgtctctactaaaaatacaaaaaattagccgggcgtaggggcgggcgcctgtagtcccagctacttgggaggctgaggcaggagaatggcgttaacccgggaggcggagcttgcagtgagccgagatcccgccactgcagtccagcctgggcgacagagcgagactccgtctcaaaaaaaaaaaaaaaaaaaaaaaaaaaaagaaaagaaaagaaaagaaaaacacatataattaaattattaagtaaaaattatttgtggcatggtgttttgtagattttgcctgatccagagaaaaggtaatcaatgcatgtttattgaccacatcattgatttgtaggagtcaaattatgttaaagtagccaaagttaatctatcacagaatcatagtattttgtggctagaagatatttaacagatgacttagttcagctcccttatttaatagatgggaaaacagactctgagggaggccaagtggcttacagaaggctacacagatagaagttatatatgttatttacagtacatctactgtggttaagagaggcctccttgcatttattttagagcggagttggtagaaatagttagatatagcagtttagagcatgagctctggtgtcagacagacctagagaaaatttaagtaaaacttaaaatttacttgactatgtatgtgcccctgggatattagttaatatcttttagctgtagtctccttattggaaaaattggcaaagttagagttcagtttagggttagggttagggcctctaagttttaataattggtaaaggttattattatccattttgtaccatcaacatgtcaacaggagtataatgacttagatggagtcatatactcctctcgggagagatataattttttgatagaagcctggccaacatggcaaaacgccatctctactaaaaatacaaaaattagtcaggcatggtggcccacgcctgtagtttcggctactctggaggctgaggcaggagaatcacttgaacccgggaggcagaggttgcagtgagccaagatcatgccacagcactccagcctgatcaacagagtgagactccggctcaaaaaaaaaaaaaaaaattttattaaaaaaagtttgctcaggccaggcgcagtggctcatgcctgtaatcccagcactttgggaggccgaggcaggcagatcatctgaggtcaagagttcgaaaccagcctggccaacatggtgaaaccctgtctttactaaaaacacaaatattagctgggcgtggtagtgggctcctgtaatcccagctacttgggaggctgagatgggagaactgcttgaacctgggaggtggaggttgcagtgagccaagactgtgccactgatctccagcctgggtgtccgagtgagactccgcctcaaaaaatgaaaaagaaaaagtttgctttatcaattgaataatctatatgcaaataattatggcaaaagtaaaaagacttctttcctggggttgtactcactgagccctcaccctggaatgttctttgcctagccttccacacagttctcatctccttcaggtatctgctcagctggcaccttctcagtgaaggcttgcttgtcattttgtttaaatggaaactttgttcccatttcctgctttatttttctccatgacacttacctcctaataagtaattttctaatttgctttgtttatgatctcttgtaaatttcatgagtcctaaacgggtgcttggcacatataatttttttttttttttcttgagagggagtctcagtctctcgcctaggctggagtgcagaggcacagtctgtgctcactgcagcctctgactgttgggttcaagcaattctcgtacctcagcctcctgagtagctgggattacaggtgtgggccaccacacctggctaatttttgtgttttttgtagagacagggtttcaccatgtcggccaggttggtctcaatctcctggcctcaagtgatccacccagcttggcctcccaaagtgctaggattacaggtgtgagctaccacgcccggctggcattcaataaatcttcgttacttatccctaaataataaaaaatgtgaatcataaatcccactgtacttgagctactagaattaaaggagataattattctgccaaaatgttgtgttttaacacatgtatcttcatttcttctagtgctttaatcctcctgaattcctggtgttggggcaataacatgccatggtggggttacctcagagtagggggtgcctctttaaatgcctggaggtgaatgaaagaagctattcccaacctagcagccaggctgtgacttctgacattgcatttcaatgccgtttttttctttgcataaagatgtagaaacctgtttaggctgtggtctactaccaaatgtactcattagaaaaaattgctttttttttttttttgagacggagtttcactcttgttgcccaggctggagtgcaatggcgcaatctcagctcactggaacctctgcctcccaggttcaagcaattctcctgcctcagcctcccaagtagctgggattacaggcgcccaccaccacgcctggctaatttttgtatttttagtagagatggggtttcctcatgttggccaggttagtctcaaactcctgacctcaggtgatccacccacctcatcctcgcaaagtgctgggattacaggcgtgagccaccacacctggctttagaaaaaatttctaatgactggctgttttcatctttcagattattgtctatgactataacatagtatggggctgggaaaaaataatcttcaaaactcttttcaaatatttaacttctattcaatacaatatttggatttgttcaaaaactatgaccaggttttcttgcactcatcaaaagcatatttctttccagtagtttcaatcatagctacccattataattaggaacttaaaaaatgaaataacagtgctaagttcctatccaaagggagtagggagactgggttatcaatgtattttcaagctccccaggaatctctaatttgcttaaaccaacttctgccaaatgaaagtaatacaaattgagcagtgtttatccactgggtacaggcaagaacccaaatatagctattttagggtcattgtgctgtataaggatgatataagagccgggcgcagtggctcacgcctgtaatcccagcactttgggaggctgaggtgggcggatcacctgaggttgggagttcgagaccagcctgactaacatggagaaacctcatctctactgaaaatacaaaattagccgggcgtggtggtgcgtgcctgtaatcccagcttctcggggggctgaggaaggagaatcgcttgaacccgggaggtggaggttgcggtgagccgagatcgtgccattgcactcaagcctgggcaacaagagcaaaactccgtctcaaaaaaaaaaaagggataatataagaaatgattcttaggcctaggttaaacaatgaacaaacatccactcctaggctgtatggggaaaagagaaatgttgtaaatatctctcattgcaaatgacactatattccttagtgtttttctccttggacttacctccaaaaaggtacctgacatgagaggaaaaaatagaaatcgggatttggattttatgcgaggttctgggaaaaatgttcctactctttcctatacaggaactaagtcaaattcaaggccaatgggattataatttgctttatgctataatttgtaatgtttaactttgttttagcaaaaaagtctgatattcaatcttccattaacactttagccatagaatctagactgctacgtgtaattgttaacaaacgcatggtttcttttctttgttatgaatggaactagacatctccattaacacatttgctgtttttctcatgcagtaggctaactgtacagtatttaatggtctacaggtttaaatatttcttatatgccttggcttgcacagaaagtgcttctgctaaaccagttaataatctggccatcccaagagtccagaatgttgagttaattttttacggaggttcccagatgtattggaagactcactcttggcagaccttgccaatattttttttaagattacatttggcttttcttgtatttgatatgaaacacatgttaaaaacaatacctgacaaatatgaaatgcatttttctgcataagcaaaaacaccatgaatacagcttttacaaagttttggatggcagagatacagggttttcactgcaaaactgggttagcatttaggcaagttaatcatacatctcgacaatgattctttatccaacatctctttggtattcagtgggcaggtcattaggactatgaagaaataagtgggagaatgtccagggaatgaaaaacatctatataacatgtggagaagtggatagatttagtgagtattcaactttaagaggtgcaggttctgatcccagccagatcacttgagttcttaacttctgggaagttaagaataataatgtgagtctttgagtgtttcaagaagatcctgtattagttgcttccctttgcaggtattttccacagcatttccatgtgttttctctaggtgctctggcagggcatcatatgcagctttatttttgccttttctttcagtctatattttctattctatttatttttacagggcaatgggaaatactgcaatatactgcaagtgtcctttctctttacgtgaattgaatttgtattttattgtttctttttccaggtctagccttagaaattttataatatggccaggcgcagtgtctcacgcctgtaatcccagcactttggcaggtcgaggcaggtggatcaccaggtcaggagatcgagactatcctggctaacatggtgaaaccccatctctataaaaacacaaaaaattagccaggcgtggtagcacatgcctgtaatcgcagccacttggggactgaggcaggagaatcgcttgaacctgggaggtggaggttgcagtgagctgagatggtgacactgcattccagcctggagactccatctcaaaaaaaaaaaaaaagaaaaaagaaagaaatcttataatatttacaaaatgtaattgtaggccgatgcggtggctcatggctgataatcccagcactttgggaggccgaggcaggtggatcacttgaggtcaggagtgtgagaccagcctggccaacatggtgaaacgctgtctctactaaagatacagaaaatgagcctggtgtggtggtgcatgcctgtgatcccagctactcaggaggctgaggcaggagaatcactggaaccagggaggcaaaggctgcagtgagctgagatcggaccactgcactccagcctgggtgacagagcgagactccatctcggaaaaaaaaaaaaaaaagaaaagaaatataattgtggatccagactctggccaaggatcaaacagacatttaagatatttgagggcaggagggtaccactgaggaagaatgatgctaccattaactgtctctaaaaagaggaagtaaatgccactgcaatctgctattgaggtttccctagatctggaatatcaagcatttcaattcacactaaagttcagaataataattactaataatatttttaatggagtatttacaatgggccaggcagatttattgtgtcattatctcagctgatcctcagaaggactgagtgctctcagtagtcccatttctgtggggaaggggagtcatggacaagttagcctttaaaatcttatccagtcttttattcctgctttccaggagtaaaagaaaaaaataaataagtaaaaagaaagtgggccaggcatggtgacctgtaatcccagtactttgggaggctgaggtgggaggatggcttgagcccaggagtttgagaccaggctgggcaacatggcaaaactccatctctaccaaaaaaacaaaaacaaaaaaaacaaaaaaaaacaaaaaaacacccaaattagctgtgcacagtggcacatgcctgtagtcccaattactcgggaggctgaagtgggaggatcaatcacctaagcccggggaggctgaggctgcagtgagccaaaatcctgccacttgccactgcactctagcctgggtgacagagcgagaccctgtctcaaaaagaaagaaaggaaagaaggaaggaaggaagaagaaaaaagagaacaatcttatcaaggaaggtgatatcaacaaaatggtgcaataggaagctccaaactcctataccccaaccaaaacatcagaaagtaagcataaactgttaaaccaaatctgttaaaatctggaaaacagtcaaaagtttatagcaaccaagcaaatgctgaatcctgccccccctcatccaaaaaggtgtttttttttcttttacttttaaagatttttattttgtttttgtttttttaaatagagacggggccgagtgcagtggcgcatgctataatcctaacactttgggaggccaaggctgtggattgcctggagtttgagaccagtctgggcaacatggtgaaaccttgtctctacaaaaaaagtacaaatagttagctaggtgtggtggtacgcacctgtagtcccagctacctgggaagctgaggtgggaggatcgcctaagcctcggaagttgaggctgcagtgagccatgattgtgccactgcactcaagcctgggtgacagagtgagaccctgtctcaaaaaaaaaaataaaaataaaaataaataaataaaaaataagagatgaggtcttgttatgttgtccagcctagactccagctcctgggctcaagtgatcctcccacttcagcctcctgagtagctgggactgcaggctcatgccaccatgcttggctaatttgtttttattttttgtagagatggggtcttgctattttgcccaggctggccttgaactcctggcctcaagccatcctcacactttggcctcccagaatgctgggattacaggtgggagccacctcactcagcccctaagaagacattttaaaataagtaggaaagcgttgtggtgttttcacttgctctttccccacctcctgcccagcttagtggtagtcttaggagttagcctccatggctggtccctggtccctggctctggcatgtatgtctttatttatttatttttttgagatggagtctcactcactctgtcacccaggctggagtacagtggcacaatctcaactcactgcaacctccgcctcccagattcaagtgattctcctgcctcagcctcctgagtagctgggattacaggcgtccactaccatgcctggctaatttttgtatttttagtagagatagggtttcaccatcttggccaggctagtcttgaactcctgacctcaggtgatccacccgcttggcctcccaaagtgctgggattacaggcgtgggccaccgtgcctggctgtggcatgtatgtcttttctaaactatctggagctatctgaaggactaatgcaaggtgcctgacactcactcaggacagaaaagtggagggcattgctggaaaagcttttaaggcagatatacaaactgaagctggctgagacaaaagattacacctaaagccaagaaggaaaagcatgttgtcctaaagtgctttacatttacttgctcactttatgctcacaacatccctatgaggaaggtataattgtcaccatccccattttacagttgaggaaactgaaataactgggaaaagtaaatgcagttagcttttaatcacttcatcacattgactccaaatacgcacgtactaaaagcaaaatgaaccaggtaacaactaaaacacatatagtaaatgagtaataaatcttatttgaaaattatactttaaatatatttcttttaactctagtatttattactgccttagtaacctctttgaaatagaagactgaatggaattcattcttttttttttttttttttttttttttggagacggagagtcttggtctgtcacccaggctagaatgcagtggcacgatctcagctcactgcaacctccacctcccgggctcaagcaattctccctgcctcagcctcccgagtagctgggattacaggtgcctgccagcatgcccagctaatttttgtatttttgtagagatgggttttcaccatgttggccaggctggtctcgaactcctgacctcaggtgatccacccgcctcggcctcccaaagtgctgggattactggcataagccactgcacctgaccggaattcattcttgatagcatcagtatttgctttcttcccagatagtacatagtactgtttttattatgaatttttttgtgggaaaatagagatgataaaataggaaacctttccacaaagctatggttaatattagttagaagtaaattttcatttctagaacataacattgaaaaaaggtaagaggggcatagagaaggcaaaagaatatacttcttgaataaacaagtatttctaatgcttattatttataacttagatatccccagactgtaaactgtagaagaagggactgtgtcctgagttattcagaagccaattttttgtgccttagcataacagtataggaatattggccatagtagtcgatcagtggagacttgttgagtgaatgaatgatagacatgctttttacttgtatatcaagttattactgggctctgcgcaaaggcagaagtggatcctatgtaaacagatacgggtgtttgcttatgataccttatttttaatgtaccccaagatcccccatggagaatttcaaatgctgtttataaaaggaaagaaaattcaggtcttgtagttgttcttttttttttttttttttttgagacggagtctcgctctttcacccaggtgggactgcagtggcgcgatctccgttcactgcaagctccgccttccgggttcacgccattctcctgcctcagcctcctgagtagctgggactactggcgcccgccactgcgcccagctaatgttttgtatttttagtagagacggggtttcaccgtggtctcgatctcctgacctcgtgatccgcccgccttggcctcccaaagtgctgggattacaggcgtgagccaccgcgcccagcgcgggtcttgtagttgttcttgctacaaattactgggcctgcagaagagagatactagggaggagatttacagcaaggctttgtcgcacatatattgttcttgttcgtcatcttgacttggtctgtaaacgtccctttcccttcccgttaaacttaacaagaataagcctgtatcctggattaggtggcaaaggtatttgaaataaaaataaagaattttaagaaattaaaaaagaataagcctgtagcacccagatgcataaaggaaaatggatctaaacagtttattacttaaacagctgctaaagtcatctcatccttgttccatttactccataaccacacaaacgtgacaattccatttagattggtcacatgtgcttaatgtcttaaaggaaatgaatgaatatattttctgaacactcatggaagtgatccatttttatacaaaatcaatttttgaggggaaaggtaattcctgattatcaaagaagtggccagggaagaaaagatctgcccccatgcttcattaaccaccaccagcagtttcaggtgggttctttcagaaaatgcgcatgcatatacatgaatatatctgcggtgagttcctctttgtttgtgtgtgtgcccaggtgctcacatgtacatctctggtctttattttctgtagagaatagtcagaatgaggccccagggtcaggaatggaaaaatcaggtaaaaagaaaagaaaacatctttttttttccttaaaaagaaaacatcttgtttagaatttttggaatttctttctaagcttaatctttcttttattaacactttgttctcaacttaaagccattaaaaagcctatatgcaaaaaataaaataaatcagctcaaggcataagaatttgatatacagctgggtggtaattaacaggacttgaccttacaataattagatgctgagaaagactggagcacagcagctcagaacacagcagtttatgtaactctcctggagaagagttaggctttaccccttgatgctatgaaaaatcagcctcaaagattattgaggcagatcaaaatttagagccgcacacggcacctcacacctgtaattccagcattttgggaggctgaggcagtaggattacgtgagcccaagagtttgagaccagtctgggcaacatagtcagaccccattgtgttagtcagctttcatactgctataaagaacagcctgagactgggtaatttataaaggaaagagttttaattgactcacagttcatcatggctggagaggcctcaggaaattcacaatcatgtcaggaggcaaaggggaagcaagatgccttcctcacaaggcggccggaagaagtgccgagaaaggggaaagagcctcttacataaccatcagctgtggtgagaattcactcactatcatcaaaagagcagagggaaaaccgcccccccatgattcagttacctccacctggtctctccttgccatgtggggattatggggattacaattcaggaggagattaggctttctgttcaggtgggaacaaaaagcctaatcgtatcatccatctctacaaataaaataaattaggctgagagcagtggctcatgcctgtaatcccagcactttcggaggccgaggcaggcaaatcacttgaagtcaggagttccagaccagcctggccaacatggtgaaaccctgtctctactaaaaatacaaaaatcagctgggcgtggtggcacgtgcctgtaattccagctactcgggaggctaaggcaggagaatcacttgaacctgggaggcagaggctgtagtgagccaagatcacaccactgcactccagcctggggaacagagaaagacgctgactcaaaaaaatgaaatgaaatgaaataaattagccaggagtagtggtacacgcctgtggtcccagctactcaagaggttaaggtggaaggattgcttgagctggggaggttaaggctgcagtaaactgtgattgcattactgcatgccagtctccgtgacagagtgagaatctgtattaaaaaaaataaaccaaaatcccaaaagataacttgggactgtgtagtggcttattactacattcctcaatgatccaagctactcattgaaaacctaaagtggaaaatgctttgtccacatatattaaataatacatatatttctttctccaccctgtaaaaagagagttagcaataatgctatttggttagaatatgcagtgtgaaaataaaatgatattcataataattacacagaactaattttttaaatggcaatattcaatgctggcaagggttcggtaatgctggtattctcataggttgctcactgtattttcatttttaaaacattttctgaaagctatcacaaaatattttaggagctttaaatgctcaatatttttatcccagttgtctcactttaggtaatttatctcaaataaataattcataaatctatatgcacaaagccatcttgacactatttataattgcaaaacactggtacttaatgcagaaatggttgagtaaagtatggcatatccactatttacatggtatctataaagtgtttttaatagtatggaaggccaggtgtggtggctcacacctgtaatcccagcactttgggaggccaaggcaggtagatcacctgaggtcaggagttgaagaccagcctggccaacatggtgaaaccctgtctctactaaaaatacaaaaattagccaggcgtggtggcagaagcctgtaatccagctacccaggaggttgaggcaggagaattgcttgaacctgggaggtggaggttgcagtaagccaagattttgccactgcactccagcctgggtgacagagtgagacttcatctcaaaaaaaaaaaaaaaatactatggagaaacattacctatattaagttaaataaaagaaatcacgatagagctgggcacggtggctcacgcctataatcccaacactttgggaggctgaggcaggtggagcacgaggtcgagagttcggaccagcctggccaagatggtgaaaccccatctctagtaaattacaaaaattagccaggcatggtggcaagtgcctgtaatcccagctattcgggaggttgaggcaggagaatcacttgaacctgggaggcagaggttgcagtgagccaggatctcaccactgtactctagcctgggcgatagagcaagactctgtctcaaaaaaagaaagaagaaaaagaaagaaagagaaagaaagaaagaaagaaagaaagaaagaaagaaagaaagaaagaaagaaagaaagaaagaaagaaagagaaagaaaaagaaaagaaagaagagggagggagggagggaaggaaggaaagaagtaaataaatcacaataaaaattatatttcaggctgggtgcggtggctgacacctgtaatcccagcactttgggaggccgaggtgggcagatcaattgagtccaggagttcgagaccagcctggccaacatggcgaaaactcgtctctgctaaaaatacaaaaattagctgggtgtggttgtgggggccggtaatcccagctacctgggagaatgaggcagggaaaattacttgaacccgggaggcagaggttgcagtgagccgagatggcaccactgcactccagcctgggcgacagagtgagactccacctcaaaaaaaaaaaaaaatgtatttcagctgtgtatagaacagataagtcaatgtaggaaacaatgtttattgtgttcatgtagtgggagtacggatgctcttgttttctatttcttcaatttttaataatattttaatattatattcataatttaaaatttatctagcatctatatctctaagtttatctatctacatactttatgttttcattttttaaccctctatctctatactttagtataaaaagaatagctttgtgaaagtttaggaaatggagtagagagatgagtttcatgattacaaaacgttgtattattattaaaaaagaaagatgtgcatttgagcccgctttctcatacttctttcagtgtaaaactattgatgaacttgaatgcatttgtatcccacttatagtcttcaattctaatttggtgttctggtagagtttctctggacttttgcaaaaataaagctctctcatactagttcaagagatggttcatgttgcgtcactgggtaaagaggaacaggtagtgtcaaagttcccttctgaggattctcctttaggtcccatgagcatcaatcattatttctattgactagtttccccaataactttctcccaaagtaaatgaaaatccacatgccagggcagcactatgttgaacttgtcaaagaccaatactgaatatgccagacacggttatcttcagctaccattttgaaggcctgaaccctcatagaggtattaacgaactcgaaattgcatacttgcatatgttgtaatcattttcaccctgctttccaaaaagaaaaagaagaaaaaagcaataaatatgggatttaaatataattcatgcagaaataggccaaaacattcctaaagactctaaatttattcctaatcacactgatgccaaactaaattggcatggttattctactagattctgattctttttttttttggccagaaatttgctggaaaaacacagaactggaaaatccatccaagattaaacagaggaaaaatattagaaaaaaatattaaatagaggaacaaaaacctattttagttgtagttataaatttctagaaattcatctttgaatttagagaaatacatcagtgtcatagtaaaataacctttattctttatagacacccttttctgaaaccaagcagttgtattcaaaacaagtccaaatttaagcaagaaaaaattgttttaataatagaacattttaaaaaaccaatgtatttctggccaagagtggtggctcacgcctgtgattccatcactctaggaggccgaggcaggcagatcacctgagtgatcagaagttcaagattagcctggccaacatggtgaaaccccatctctactaaaaatacaaaaaattagcctggtgtggtggcatgtgcctgtaatcccaactactcaggaggctgaggcaggagaatcgcttgaaccccagagacagaggctgcagtgagccaagatcgtgccactgcactccagcctgggcaagagagcaaggctctatttcaaaaaagagaaaataaaatacaaataaaaaaccaatacatttctagcttgtaactagaaggagagacaaaaagaccaacttaaaaatagtaagtgtaatgagagtatgatgtgaaggagctgttaagtgatctcaaattaatggtgctcagaaatgtgaacttctggaattcacgtttaaagactaattggagggccgggtgtggtggctcatgcctgtaatcccagtatttgggaggccggggcgggtggatcacctgaggtcaagagtttgagaccagtctggccaacatggtgaaaccccatctccactaaaaatacaaaattagccaggtgtggtgatgcatgcctgtaatcccagctactcaggaggctgaggcaggagaatggcttgaacctgggaggtggaggttgcagtgagttgagattgcgccattgcactccattctgggcaacaagagtgaaactccatcttataaatagataaataaataagactaattggaaaacttggaaattatttagaagacagctccaaggatggcaaaatgagtcaagtattggaaaaaaagaccaatgaggagaggcaaacaagacataattaattttcttgaagagaagaccaaatgacaattgaagaagacagtctatgaatttatagagagctttatatacagacagggttggttatcatcgctgagtataaaacaagggaaacaggcttggtgtgtagcataatggctttgttcgacacagtaaagctaactaaatgtcaaaataagatgcaggtggaggttgagcagtcttttctaaagccatgaataataagatagcagcttctttgtatggctctgactgaaggtgagagatgtgctatgtaagctttcacatcgcttccagggctaagattcaggtccttggggaatatcttcctgaattcagggagttaatgccaactctgaaatcaaattactggaacatagtaaagaaagcggggggaggaagcaactagaatcaagatgaaaatgtaacttcaaaccctgtttagaaaaaaataatgagattactttaaaataataaaatttattattaaaaatttagagaagttttgacaaggaggaagtggaaaaaatagatatttttatttatttatttatttatttatttatttatttatttatttatttttgagacagtttccctcctgttgcccaggctgcagggcaatggcacgagctcggctcactgcaacctccacctccagggttcaagtgattctcctgcctcagcctctcgagtagctgggactacaggcatgcaccaccatgcctggctaattttttttgtatttttggtagagaaggggtttcaccattttggccaggctggtctcaaactcctgacctcaggtgatcctctctcctcggtctcccaaagtgctgggattataggtgtgagccgccgcacctggccatagatattttagataaggaacaagatcaagcattaaactgtgaacaaggtatttctaattaactaattttttttttcaaacacagccttaggaaacgtgactccaaccatggagagtttaggtcagccctgattttgaggccacatgctccatcctcacaggtgggtgaggtcccttagttggtattgtttgatgattctattagttcttgacttttctgtatatattttaatgtacagtaaagggattgtagtattggcaggtttgtcccaaaatagactgtgagtcagttatgaaggagggggattccaggaactagaatttaagagtgaggaagttaaacacaaatttacatatgactcagtactaacacattttacataatattgggtactttctcttcctgtaattgcctctatgcttcatttgttgttttcaccaatagccctaaataagtggttttaaaaaacattaagggaggctggtagatcacgcctgtaagcacttttgggaagctgaggtgggcgaattgcttgagcccaggagttcaagaccagcctgggcaagatggcgaaactccgtctctacaaaaaatacaaaaattagctgggcatggtgacacgtgcctgtagccccagctacttgggaggctgagatgggaggatcacctgagtctttgaggttgaggctgcaaagaacaacaatctccccactgcactccagcctggatgacagaccgagactctatctcaaaaataaataagtaaataatgaattttaaacacacacacacacagacccacacacaaccattaagggatgactaatttggggtgtcttgccagcaattcaaatgtctaaaatagccttattctagcattgaatgttaaagcctttttctttagacagactaattgcagaatgaaatggtttgctacctgttgagctccaattctccccttctcaaaaaatcaagaggctatgaactcgcaagtgttaatgggattcagatagaagccatcactgctattttaaattttcctgtgtctcccactaacattatatccaaacatcaaaacatccacaacaatcatccccaaggttgctgctgtattatttataaatgaacacattgttgggtgaatacattccacttttgaaattaattttctttttctttttcttttttttttttttgagatggggtctcactccgtcacccagtttggaatgcagtggcgcgatctcagctcactgcaacctctgcctctggggctcaagcgatcctcctaccttagcctcccaaacagctaggactgctggcacatgccaccatgcccggctaatttttttgcatttttggtagagacaggatttcaccatgttgcccaggctggtctcaaactcctgagcccaggtgatctacccactctggcctcccaacgtgctaagattacagtcatgagccactgtgcctggcctgaaattaattttcactggtttattttcataaaataacgctggacacagtggctcatgcctgtaatcccagcactttgggaggccaaggcaggcagatcacttgaggtcaggagtttgagaccagcctggccaacatggtgaaaccccatctttatgaaaaatacaaaaaattagccaggcgtggtggcatgcgcctgtgatcccagctactcaggaggcagagggaggagaatcgcttgaacccgggaaggcagaggttgcagtgagccaagatcgtgccactgcactccagcctgagtgacagtgaggctctgtctgaaaaactaataaataaataatattttcataaaataaactcaatttcagttacatacagttttttaggaaagtgcttttcttttgtagctttgttttttccgtcctattgcatagtctggcttcactgaaatagctttccaccaaaatattctcttctctcaagcaatagtatactgaagagaacaagtaagttatttatttgcaagcccataggatttaaattagaataaacttgtccttgagaataatatactctaaataattcatatgagtcacaaaattttataccagaaaaagtgtgtaaaaaacatcttattccccaatattatgattccctcagtttgtatgacttaataattctttttttagagtataattgttccagagttcagaaatttttaaaagagattatctgtatctctgggaaaagattgacttccagctggaaagataatcttttcttccattttcccaccttttgcatcagaaaagtaaacaaccgatttcctgactaaatacacctggattatttctcaagagagcaagaaatgggttgatttatgcattagaaaagtgaccataaggtcgtggagaatcaatgactttagatgtaggaaggatcttggaaatctagttcaactccctcataaatgacaaggattagatataaaaagtgcttttaagaggcctattagcatcaggaatgaggtaagtcccttttcagcattaattacagtaactgctgtataaagaaaggggattctggcaactgctctccacatggcagaaattcaggacagacttgaaatcaaagaagtaggggctaaagtctaatgaactgacataaaactttttttaattggaactaaagaatattaattctctcacatgattcccaaagtcagtgtttttttttttaattctctcgaaactttcatgcatcaaaagatggttccaacatacaagcatggaaataattagtgcttttaattagtacaactgggaaataaggcataccagccttaataagggtctccaatgtggaacacattaaagtaaaaacaattttttcctaatatcaaagtgcattctaccgactaacagaaaatgagttactctgcaaaatggagagtataatcggattcagaacaagttcaaagtattaagaaaggagatgccatgaactgtgggacttgagaattagatcgtctcagacggccaccaatctatttttcagaacacactatccatatcgtagggtttaactattaaactgtaaatattctaaaatacttcataatgcctattttgtgaatcagaattgaagatgaaaatggtcaaatatattagaagcatgctaaacagcatttcagaacagtctaacagctgaacgcatacttggcaagaagagagctgctgtcacattacctcagaccaacagtagcaagcacatctggaatcctaatgatcccaggagcttttgggcatttgaaggacagccatctggtgcaaaggaagtctggacaaagtgtcccacccaacagaaagaacctcattgtgctgctatgaaaagcagctggccccacttccctctgataatacaccaccttctcaactggtgagtgatcaagagaaatccattatgtgcacaaagtgctcactagctgacctggatctaaaaccatgacaacctggcagataagacgcagtcagagatatatttgtgaaataaatccctttttgaaagggcgtcagcaaattctgctacctctgtctaacctttcagcaactgatgtagatagtatcagcctatgggctcttctaggtctcaattctttatctgtaaaattaagagattgggctacgcacattttacggccctttttagttctaacatcccatcagcttgtgattttacagaaaatactgtagcgccaaaagaatggatgaccaaagaacaagggatgacagcagacatttgaaggtggcccctgcatgttgcttgatggcattggatcattgaggggacaaggttgcactcaaagatgacctctcatttgtaaatgtgtcttatcatcttgcaagcaaattaagccagtgttatctttgctctaacctatctgcaaattatgcacagcatgttgggtctgccccacattaaacacactgcaggactctcaagtagatgaaggcagacatgcagcttcagcagaccatgatggtgaggcagtggataagagaaatgattgaaggtcatgagagggaggagagcatgacagggatgggaagcgaggacatcagggcacagaaagccctagtcaggagggaactgcaggccaggcgcagtggctcacgcctgtaatcccagcacgttggggggccatgatgtgcggatcacttgaggccaggagttcaagaccagcctggccaacatggtgaaaccctgtctttaccaaaaataccaaaattagacagggatggtgaccgacgcctatagtcccagctactggggaggctgaggcaggagaatcgcttgaacctgggaggcagagattgcagtgagctgagatcacgccactgcactccagcctgggcgacagagtgagactccatctcaaaaaaaaaaaaaaaaaaaaaagagggaactggagagtttaaacacctacaggaggaggaatttaggataattgtaagatccaataaataaccatgtcagtagatttatggaggaatggagctagagatgtatagtgaaagagtctaaaaatataatgtagggaaaggcattttggccagttaaatattgttcggaatcctggctctgccgctgaatatcctgtatattcctggacttgttaaataatgtattttcctcatcagcaaattggaaataatgctatctcttacatacagtagttgtggaaattaaatgagataatgcatgtcaagtgctgaagatacttattggtgcacagtagacattcaaaaatgatatattagttgtcattattcctagtactgttattcttgttagctgaataatgagaacaaatattgaaattccccagaatggttgtttgtgaacaagtagagagaaaaacgattacatcaggcaccaagattaaaggaagtgtcttcgaggttagtagatgatgacagtgagggcagaggaagggtgggtgtggttgagcaaagttggcgaagttcttgaaagtcaagttagtgcccgccgaactcttggctctgagccagacaagactggagaagaagccctttctgcttgagggcatcagagaaaatgtttcatctttagtagaaaatcaaatctcaattaaggcagcactttcctgaagatgtttcttttctttttttctttttttttttttttttttgagacagggtccagttctgtcactcagactggagtgcagtggcatgatctcggctcactgcagtctcagactccctggctcaagcaattcgaccacctaagcctcctgagtagctgggactacaggcatccactaccacatccggctattttttatattttctgtagagatagggtttcaccatgttgcccaggcttctcttgaactcctgagctcaagtgatctgctgccttggcctcccaaagtgctgggattgcaggtgtgggtcaatggacccaggctctgaagatgtttttttctttttagagatggagtctcgctttgttttccaggctggtctcaaactctaggcctcaggtgatcctgccacctcggcctcccaaaatgctggtgtgaaccaccctgcccagcccaaagatgcttttggtctgatctatctggggaatgctgagcctctccctcctcggaatttgtaagagtgcacacccaaatgcaggctctacgaagtctgtcttcctagattgaaatcacatgtagccaacaaacttgtttatttatttatttattttttgagatggagtctcgctctgtcacccaggctggagtgcagtgggacaatctcggctcgctgcaagctccgcctcccgggttcaggccattctcctgcctcagcctcccgagtagctgggactacaggcgcccgccaccacacccggctaattttttgtatttttagtagagacggcgtttcaccgcgttagccaggatggtctcgatctcctgacctcgtgatccgcccacctcggcctcccaaagtgctgggattacaggcatgagccaccgtgcccagccttgttttattatatgaagttacaatcctgtgtcacaagatgggagggcagagggaggattttgaggaaagcttaatgaccgaatggtgtttactgtcaggagtcccagaggaaagggagagaagggattaatgtggctaagtgagaaacaagataggccagagacaagtgaggttaaaactgcatgaagggattgagcaagtggaagcaatgaccaacgtgctggtgctcatgaaccgcagagggaagaaagggagcaactaggaattttgaaattaggaataaggctgggcgcggtggctcacgcctgtaatcccagcactttgggaggccaaggtgggcagatcacctgaggtcaggagttcgagaccagcctggccaacgtggcaaaaccctgtctctactaaaaaacaaaaaattagccaagtgtggtggcacgtgcctgtaatcccagctactcgggaggttcaggaaggagaatcgcttgaacctgggaggcggaggttgcagcgagctgagatcgcgccattgcactccagcttgggcaacagagtgagactccgtctcaaaaaaaaaaaagaattaggaataagagtgagggaaatgggcaacttgggccagtagcagagctgttttgaacatgggaaatttacccacagttgctttatagtccttcagacatttagaattttaaatttttttaatttaaatttaattttttttttttttagaaatggggtcttgctatgttgcccaggctggtctcgaactcctggcctcaaacaatcctccctccttggcttccccaagtgttgggattacaggcgtgagccactgtgcccatcctagaattttttaaattttcaaaacagtaatctgtccttgagtgtgaactagattgtactgacaatctgaatagatatttcaactaatggttaaaaaacaaacaaaacacccaaaacacatcttagaatgattctcatgtcttccaaataaaaatactttaaaatgttgtcaatacttttacctatttagcttatgcctttggttatagaaaatatagaatcaatgataatgaattaataagaaaataaaaatagatatttcaactaatggttaaaaaacaaacaaaacacccaaaacacatcttagaatgattctcatgtcttccaaataaaaatactttaaaattttgtcaatacttttacctatttagcttatgcctttggttatagaaaatatagaatcaatgataatgaattaataagaaaataaaaaatatattccatctttaatatactgatggttcagttttatttctaaattgtctgagatggaagtatattaaacataaatggtgaaagtataatggggacaattcattatgtcctttggaaacattttcattgtaaattccagttgtatttattttttatttatttatctatttatttattattatttgttttagatggagtttccctcttgttgcccaggctggagtgcaatggcacgatctcggttcactgcaacctccgcctcctgggttcaagcgattcccctgcctcagcctcctaagtagctgggattacaggcatgtggcaacatgctcggctaagtttgtattttcagtagagacggggtttctccatgttggtcaggctggtctcgaactcctggcctcaggtgatctgcttgccttggcctccgaaagtgctgggattacaggcacgagccaccgcgcccggccataacgtgcagttttaaagtattatccttgatgaaattaaattgttaccaattttccaacctgcatgattcattaactctgcactaatgaattatactgcctgacttattcccaggaagctctagatgttgctcatcaatctatggataattgttgtttgtggtttttaagctccattgcatttttatctatatagatggagaattaagtcttgatgtgacaaagttgaaaaataataaaaccaaagttcagaaaactctaaacaatagttttatttatttattttaataatattcatttatttattttatttatttttaaaattatacttcaagtcctgggatacatgtgcagaacatgcaggtttgttacacaggcatacacatgccatggtgatttgctgcacccatcaacccatcatctacattaggtatttctcctaatgccatccctcccaccccaccccctgacaggccctggtgtgtgatgttcctctccctgtacccatatgttctcattgttcaactaccatttatgagtgagaacatgcagtgtttggttttctgttcctgtgttagtttgctgagaatgatcatttctagcttcatccatgtccctgcaaaggataagaactcctttttttatggctgcatagtattccatgatgtatatgtgccacattttctttatccagtctaacattgatgggcatttgggttggttccaagtctttgctattgtgaatagtgctgcaataaacctatgtgtgcacgtgtctttatagtagaatgatttataatcctttgggtataaaggattgggaaaagcatagtatctgggctggatagcaccgtccctcacggcatagtccctcatggcttcccttggctacgggagagagttccccgacccccttgcacttcccgggtaaggcaacgccccccacctgcttctgctcgccctccatgggctgcatccactgtctaaccagtaccagtgagatgaaccaggtacctcagttggaaatgcagaaatcactcgccttctgcattggtcttgctgggagctgcagaccagagctgttcctattcggccatcttgcccgggaatcttatttattttttgagatggagtttcactcttgttgcccaggctggagtgcaatggcgcaatcttggctcactgcaacctctgcctcccaggttcaagtgattctcctgcctcagccccctgagtggctaggattacaggcacccaccaccatgcccagctaatttttgtatttttagtagagacggggtttcgccatgttggccaggctggtcttgaactcctgacctcaggtgatccacccgccttggcctcccaaagtgctgggattacaggcgtgagccaccatgccctgccttaaacaatagttttaaaaacctctaggacctgtagtttgttttttgtttagagatgaggtcttgctatgttgcccatgctggtctggaactcctgtactcaagggatcctcttgcctcagaatatcgtggactaaaggtgtgaggcaccatgccaagccctgtggtttatttacactgtaggctgtaatagtttagctttccaggcagtgactatgtcttagaattaaagataaagacagttgcttgagatgccttagagagggctgcagttcaatgggagaaaatgccagaattatttttctgtgagaatatttcaggttacagtctagattagacaaatagcatctttaaggttttgtcaacaatagatattcaggggaaataaaaccttcagaatcagggctaaaaatctaaaaattctgtcctagagaagggcaaacttgaagatttttacttcacttttcctgctagtttagctaaagaaatatgaaaatgggctgggcatggtggctaatgcctgttatcccagtgctttgggaggccaaagtgggtggattattgagcccaggattttgggaccagcctgggcaacatagcgtagaccttgtctctacaaaaaatatttaaaaatggccaggactagtggctcatgcctataatcccagaactttgggaggttgaggcaagtggatagcttgagcccaggagttccagaccagcccaggcaacatagtgagacctcatctgtatcaaaagaaggtaaaagaaatacaaaaacaagtcttaacaactaagcaaagaaataagtaccttgacttgttctcacttgttctataagagttacactggcacaagctcatctaatgatgtagttgctttgaaatctctacttccttttttacttctttttgctgaacaaaaatatttaatgaacaggcttggattaataagtttggtgatggtgtccaatgaacacaaatgaccacgtaaagggtagtagtagattggacaccttatacatagttcagaatcatcatatgatcttcatggttgaggcttgtttcttttcttttttttcttttttttttgagatggagtttcactcttgttgcccaggctggagtacaatagcactatctcggctcactgcaacctctgcctcccaggttcaagtgattctcctgccgcagcctcccaagtagctgggattacaggcatgtgccaccccgcctggctaatttttgtatttttttttttttagtagagaaggggtttcaccatgttgttagggctggtctcgaactcctgacctcaggtgatctgcccacctcaacctcccaaagtgctgggattacaggtgtgaaccaccacacctggcccttgtttgattccttttaggcttgggaaaaaagggtgaagatgggggaggacagaagcagagataaacgaagtaaatgttcatacattctctcacttgaacctctcagcaaccctgttaagtttgtatttgtatttgtatttatttatttatttgacacagagtcttgctctataccccaggctggagtgcagtggtgtgatctcggctcactgcaaactccacctaccgggttcaagcaattctcctgcctcagcctcctgagtagctgggattacaggtgcctgccaccacacccagctaatttttgtatttttagtagagacagggtttcgccatgttggctaggctggtctcaaactcctgacctcaggtgacccactcgcctccaactccctaagtgctgggagccactgtgcctggccaagttcgtattatgattcattttataaatgggaaacttaaagacacagctggcaaatgtcaaagctggactttgaactaagatctaacaccaaaaccatgcttgatgcatagtagggccagtgatttatttttttttttaatattaggtaatagcaagtaatatgcccagagacatgatgggctgacaaagtattgacgggtcttgttcttactgtcccttctatgccccagtgctcaacttccccttaacccattccttatccttccccaccaccattccacccccaataaagtcacccaagacaggaaaaattgttaactattttcagaatactttggtaaagttgaggaaggggaaggaaacaaagtcttccagagcagagggggaaaatccctcttttgatgaaacatcctgtgtagcaactgtgaagcctggatttccccaggatgaggttagagtagcaggctgctgcttgtcacatggcctcagttcaaagtcacacctgtgggggcctcccgtaaaatttacctatatatggccctccacaaagccacaaacacagaactcaaaatggcattcaccacttctgagatgctgaacaggaaggaatagcactgtttttacaaattaagtgcacagtatatgtcacaaggaggaaataaaccctatgagtttgaacttgcacatcctctcaatactgaaagattaattttggtggctgaggttaataatacggttattcgtgtttggatatgaatgtaactcgaccgattgggaaagcaggtgctagattgatgtaccatgcctgagacccatgagtcattgtcactgatttacaagctggccttgccatgaaaatggaagccagagccaactctatgtcatacaatttatgccattcactaaaattatagataatttcagcctgtgcatttgcaaaacagtctatgccatttttgctttaaacatcttttgtacttggtctctctgacttgtctaaataagtattatcattcataataaccattaccaatccattatgcaacatcatgaaaatatatacagcttttagatttaatccatgaaataaagcctatgacttctgcttgcatctttgataaacggccaagttctcacagctgttatgatttcaattatgaagaaaattggaacttttgcattcttcagtggctaaaaatcactcagaaaaaaacacttgttcacataagctatttttttccctcgtgtgtatcatgagccttgggtctgattagtgtagttgattaaagcaatgtgccaaaaggcaaagggcccttgttaaagcccaaggaaggtcagctagattaacttcccaagtttactgaaaatctgttctattagtagtcttcagccaaattaggcaagggagtacaaacagatcagtacaaatccagtctttaatgctagcaaaatgtagctcaaaccacagttaacattgatacaaggtcaataatgtcatcttcccatacagagacagatgacacacatgcagaagcatcttagaaacacctgctctcctccgcctttttttttttttttttttttttttagatggagagtccctctgtcgcccaggctggagtacagtagtgaaatcccagctcactgcaacctgggcctcctgggttcaagtggttctcctgcctcagcctccccagtagctgggattacagtcatgtgccacgacgcccagatagtttttatatttttagtagagacagggtttcaccatgttggccaggctggtctcaaactacctgcctcggccttatttacaggttttgtctcctcatatacaaccaatctcaacatagagaactccctaactctgatccaggtaggctctccctcatcaagagattaagagttctgaagttaaatgaactacaaaatgaactacagtttataatccattgcctcacatccaaagtgcttcctctccctttctttttatccccctctcccttcaactactattctctgaagcttttcagttctctcaaatcttaattttatttttttcctccacaagaacaaacttggtaaataaccaagattgttcgtggtttcaggctcctctttttaatcatttttctcatgtcagtaatgagagctcctgagttaatattatgctttcccaaacctggaatcctcgtcttttttgcagaagaagaatcaagcgtattgtacgaaatctcaagcatatttatccttaacaaggtcaaagtcagaaaccttaatccaaaaccataaacctcctgcagaaaaaatctctggaattcaactctctctcgtctattctttattcctactgataccacttttgtgattgaaacatgaaacagatcctcatctcctgaagatgatatatagaaattgttttaaatgccttgtgaaaacccttaataacccgaattctgttccccagttgagctatattttccttgctccaaatttaccatgtcattccaggcctccaggcctttggttatttgtcccatctgtctgggcttctcttccccgcccttccttaccttactaacttactcatccttcacttcttagcttagatttctcttctgctgagaagccttcactggcccctacatcgtcagctatgggaaccctcttatgtgtagtctctatctccccctcttctagcacttgtcacagtgtgttgtaactgcgtggttgcttggattttccccctgtcctggaaacacagcctagggtgcttactgccaagcttatgatagaaactctcaataaacaccagctgagagaataaaccaaggctttgctgtgtgctgggagaggattcagcattctggtatccgtaaccctgttacataggtggtcactacctgaaaggtctgctttcatgctggtgtcagatttgcttgttttaaaaataactcagggctgctgatacatgcaattctaagccaagaagagaaccgtaatggtcatcaatttctttctttcttttttgttaccaccaagttaatgcatttaacgttttctaatctacaaagacctataacctctgctccccacgttacttaactagagagctacctatctgctactcatcaaacccagccagagatgccaagttcctgaattttttttctcacatagaaatctagatgaatcccctgaaatggtcattttaaaatcaagtcaaaaggaaaacaacaggaaatactcactagagtaaaagagaaaagtgaatcgaggacagacttgtgtatttacaactctcaaggccaatgaacattggaaaagcaaactaaaatgatagatagcaagctgtggaatttggcttgaccttaaagaggattttaatatgctcttatatcactgtctgctactcaaggtcgataagaaaagcgtggttttcttacggaacagagctgagtcacttatataataccagtgcatttcagttgattgtgatgattttttcaagagatgatgtcacacaaattgagttttgcttgaatcttgcctaaaaatagtttgatttatttactaggtcaaaaagacaaggggatctaacatcaatgacaagtaaaaatagaaagatttatttatcctgaacactatggacaaatgtgtgtctcagcacatttaggtgtttatccaaggctctttgtgtaagtagaatgaaccagaagcaatttactatatgtgaataagaaatatcaaggtgatattaatggtttgtatttcccttttctgtagaagatttgtaagaagagtcttttcaggtccccaaaggtaaactttaggattaaattatatggttttaagaaattatcactaaatctttcccccattttttttaacccttaaacatttttgtttgaaacagggtctcactctgttgttcaggctgcagtgcagtggcaagatcatggctcactgcagacttgacctcctgggctcaagctgtcctgcctcagcctctcaggtagctgggactataggtgtgcactactatacacggctaatttatttcatcgtattttttgtagagacagggtctcactatgttgcccaggctagttttgggttcctgggctcaagcaatcatcctgccttgggctcccaaagttctgggattacaggtgtgagccattgcacccagcccttagaatcttcatatttttgtttaatttgttctttgtagagtagttttcactacagggatgttacttggtaaattaaattctatcatttcaattaacaacccaagaaaaatatatgtataatgataaactttgaggaaaaagagaaataactgcaaaaaaaatgaattggcatgcagttaaactttgcttatcccttaaattttgttcctgcttatagatttttagtagttcatacaaagtcttcttttaaaattttaaaagtctcaaaactactaaaacaggatattattttagtggaaaatagccatatggtttctgggaaggattttactaaaggaataaatttaattagaagcaggaaagatttggttacatacaacaaaagccaacaaaatatgctcaaccccaagggtaagtgtaactgctggctagagatttccaggagaggacagggagtagttttcctagaatattttatgtcctaaatagcctggatgaagtcccttattcccttccagactcatcactgggaacgcggcacactggtgggctatgattccctggagagcttatgaaataaaaatcaagtgagctacgagtgcagccagaaacttgctttacccacaagtcctgaccctgaaacttaatttttgtgacttgaattgtgtctctctgtttaaaatttatttatttagagatgaggttttactctgtcacccaggctggagtgcagtggtgcaatcattgttcactgcatcctcaatctcccaggctcaagcaatccttccatctcagcctcccgagtagctgggactacaggtgggtgccatcacgcctggctaatttttaaaattttctgtagtgatgggagtctttctacgtgacccaggctggtcttgaacttctgggctcaagcgatcctcccacctctgtctcccaaagtgttgcgataacaggcgtgagccaccatgcccagctaaattatgtttctaaatacagcagaactatgtacttcgtgataggtaaagctattgtttggttgattcttagagaagagaaagggagtccatgctatctctttccacactctaaatcctgagatataaatctttagattcttgatcctcacccctggaagagaggtcagcagtgactcgaacaggggtgacctcctggctctaggagccccaggaaacaggattggaaacatggaagtactcctggaggagaaggatttagcttcctggttatcaggctctctggctgctcacacaatgtgcgcgttgcacagacagtaagccagttataatcgaactctttcacatgaaattcttctcttgggaacaagggcttgatcaggatctttttgggagagtgtgctgattttagctttcagctaacgtagacattctctctctgttagcacaagaaacaaatctggttcatttttgtaaatttaacaaccgagactcagatttaaaaaaaaattgattgcgccactgctctccagcctgggcaacagagtgagattccacctcaaaaaaaaaaaaaaaaaaaaaaaagccgcagacaggattgtaaggtaatttaaatctacatagaaataattcatctaagtttatttagtctgatcatttgttttacgtgctttctcaaggataacatggttgaaaatttagtgaaaaataaggactattgtgggtgataagcttaggaatcaccagacacctctctccagagaccataatacatcatgccaagagcaaaaaactgggagaaatgagcaatttgaagtactgttattttaatccccataagcctatataaaattttttttgatataaattaaaagaaaccagaaatctataaagccatctggctgatttaagtatattttttatagcatctttttaagaaagatcagaaaaactcaagacaatataaaagtatgtcagtatggaaactattcctagctgatcattttacttccaagccttctgggcttcaaagggacagctcaacaattttgagaagaaatataaaagtaacaacacaccttcttgagcctaacagatggagtaagacatttgaaatgctgaacaagagacatgggtcagaatccatcccagaattgtatgaagccagcttaattaaaagtgctttctaggctgaagcagagcatcacttgagctcaggagttcgtcttttgtttttctttttttttttttctttttgtggagaacggggtctcgctatattgcccaggcaggtctcgaactcctgggctcaagctatcgtctcgcctcttgcctccctgagagctgggattacagacatgagccaccgcgcccagctgagctcaggagttcgaaaccagactgagcaacagcgagaccttgtctctactaaaatttaaaaaagaaaaaaaacaattagctgggcatggtggtgaaagcctgtagtcccagctacttggagggctgaggattgcttgagcccaggaaatcgaggctgcagtgagccctgattgtgccactgcactccagcctgggcaacagagtgagaccttgtctcaaaaaaataaaaaatttttttctacagtgcccctctattattgtctttgtaatttattgtcttcctcctttgtaaaggaggaagaagaggcagtaaccttatatttaattatgtcaacaactcagtgttaattcttctgtttgcagcaccgtggctaataacttcaaatcgcatggatccttccagaggactctggcttcactaggcctttaaaacagcacacagtgccttggcttcagcatttggtcgctgactaagcacctttcaagctgccttcaattgaaagacggacagcggactctgaggaaatccttgctcagccaaatgtatcccatatgagagggcaaacttaatgagaatcagtccctggcatgcagcgcctctggaatgtgcgtgatttacagccagcatgggctacagagttttctgtcctagtctctccttttctgtcctagtctctcctttttttttttttcaaaaaaaaaaaaatgcatcaacaaagtatcaattttagctaataaaggcaaaaagaaaaaagagcacactaactttagcacatgtatgcaaggtcccgggaggagataagaaaatgaacacattcgattcacaactgcaaggagcttagagaatacatggacacgcacacacatatcacacagggcagagcaaactgattgacaggcagaagtacaaagtgctgtgggagcataaatattgtgttttccattttcctccaagtgcctttatttgtagcaatggaatggtctcatggtgcaaaatcatatttgtgatgctgcctggcttcctatcaatagggtggagttgtacctgttcactttctacgagtgaggctcctggtgagtatggtgttttccccaaacgcacaagtaatagattaatatgggattgaaacatttaaacgatataaagaaagctaatgtcctccttgactcatctcctccacctaatcactggccagttctaatccctggaaggtggtaatcaccattgtcatttgatatacatacttccacgtcttttaatttacatttacccacacatatatactcacactcatagataaacacacatatatacagacaagaagaaagaaatacaaagtttaaaaaatgtgataatggtatatacatgttcatcttcaacttgcttttctagcataatataccatgggatatgtcaatatatacaaatctcattttttttttcttttttgagacagagttttgctcttgttgcccaggttagagtgcagtggcgccatctcggctcactgcaacctccgcctcccgggttcaagcaattctccagcctcaacctcccgagtagctgagattgcaggcatgcgccaccacgcctggctaattttttgtatttttagtagagacagggtttcaccatgttggccaggctggtctcaaactctgaccttaggtgatccacctgcctcggcctcccaaagtgctgggattacaggcgtgagccaccgtgcccggctacaaatctctttgtttttaatcactgtatagtgttctatggtatggatatgtcataattaataatgctctacaagtttataattttgttatctcctgatgtttccattttttcaccatttccaacattgcaatggatattactgtacctatctcagttatcacataagcaagtaattatctggggtagatgtggagacatggatttgctaaattaaaaggtaagagattcccagctgggctcagtggttcatgcctataatcccagcactttgggaggctgaggtgggtggatcacttgaggccaggagttcaagttgcagtgagccaacatcacgtcactgcactctagcctgggtgacagagtgagactctgtctcaaaaacaaacaaaggcaagagattttgattttttttttttttttttttttttgagatggagcctcgctcttgtcacctaggctggagtacaatggcatgatcctgggtcactacaacctccaccacctcccaggttcaagcgattctcctgcctcagtcttccaagtagctgggattacaggcgcccgccaccacacctggctaatttttgtatttttagtagagacagggtttcaccatgttgaccgggctggtcttgaactcctgacctcaggtgatctgccctcctcgacctccaaaagtgctgggattacaggcgtgagccactgtgccctgccttcagtcttcttgagttggctattactaggaagtatgagaaaaatgtccctctctgacagaatttgcccatttttctttctatttgttagttatttctttaaatatttccatgttatgttaagtgcatgaagatttgtgaatgttttatcttcttggtagatatttttcttcaacatgaaatattcctctttggtcctttttcctttttttttttttgtattttgtcgatatttatattgctaaaactactttccttgtattagactttatctggaacattattattttccaaattgccagatccttttacaaacatagtttacaatgtccccagcttttgctgtgatcattttggactatggtttccacatcaaacttatcatcctacctgccttctctttttcagagatacttaattatcccttatctacacaatggtatactttgtcttctagcacaattataagctaaagtgtgtgtgtgtctgtgtgtgtgtgtgtatgtgtgtgtgtgtcatttaaggcagaaagtagagatgacattacatggtcaggctgccatcttgatacgatcctatgttttccttaacaccagatttccttctccacctccacttcaaaactttcctttccttccagcttggttgatctagatactaaaggtgccgtgggagatacaatacagagtagagtttgtgaatacgtttagtcagcatacacctctcgaaaaactacttttggtctccatctctttgtggcctataagttagtttcaggctgaatactacaacatgtgttccagtagcatgcattatttagtaacagcttacacagctctaagttatcatctttcccacctcattcccaggaagatttgtttaatttataagcagtccatttcagacagcactcctcgggatatcacaatattgctgttcttctgggtgattcattggcattatgaatacccttgtttcttccatgggtaaaacatgtttcaaggccactaactgggctattggcaaggcctggtacaaactaagtgcaatgtaactcttagcaatttgtgaccattaaacatagcatttataatgtgctagttttaaagttgaacaaaacaacaacaacaacaaagcaacccacagcccgtgtctacggccataccaccctgaacacgcctgatctcagaagctaagcaggatcggacctggctggtacttggatgggagactgtttgggaataccaggtgctgtaggcttcgctgggcgtggtggctcatgcctgtaatccccgcactttgggaggccgaggcaggcagatcacctgaggttgggagttcaagaccagcctgaccaacatggagaaaccctgtccaggcatggtggcgcatgcctgtaatgccagctattcgcaaggctgaggcaggagaatcacttgaacccaggaggcaggggttactgtgagctgagatcgtgccattgcaccccagcctgggcaacaacagctaaacttcatctcaaaaaaacccaacaaacaaaacaaaacaaaaaacccacaattagttcataaaagacttgcacttaatttgccttcttattttatttaaaacattcttacctcgttttctatattttatctttacatatagaatacagagtttaattttattgtacttttccttttacctccctttttttcttgtttattttcacttataggtcattaaatgccaagcataggatctcagacgaaaaagggattcagggttaactagctgaggcctatcatatgatgtttgagaggttttgtggcttgcctgaattcctccattgacctgtggcagagctggcacaagaatatgggtcacctgactccagcacatgcacatcaatttacgtttacaaaagagtttttaaaatacaatctcatctactaactactacaaaactactggaaagaaacctgacggtgagtacatattacctcaatttttataggagagaacactgagcaggacaaatgaattaatgatttgcctaaaataatctgcatcgggagatgtcaggagaacaacctggggtctttactaccggcttctgcatctcacagcctctccaccttctcaccttgcaacttcactttctaaaaggacagagttgccttttcaatgatttatttcatcatttcataatttcatccctataaaaacacaaaatatagattttttttttttttgagacagggtctggctctgttacccaggctggagtgctgtggtgccatcttggttcactgcaccctcctcattcctgggctcaagcaatgctcctacctcagcctcccaagtggctaggaacacaggaatccaccaccatgctcagctaattttattttatttatttgtagagacgagttggtctcaaactcctgggctcaagccatccaccccccttggcttccctggggttacaggcatgagccactgtgccctgctgatgcatattttaacgattaaaataataataataaaaaaaacccacctggcatggtggctcacacctgtaatgccagcactttgggaggccgaggcaggcgaatcacctgaggtcaggagtttgagaatagccttgccaacatggtgaaactctgtctctactaaaaacacaaaaattcgccaggcgtggtggcgggtgcctgtaatcccagctacttaggaggctgaggcaggagaatcacttgaacctgggaggcagagattctagtaagccgagatcgcgccactgcgctttccagcctgggtgacagggcgagactccatctcaaaaataaaataaaataaataaaaaggcttaggcctgtaatccgaacacccaagcgggggcagatctcttgaacccagaagtttgataccaacctgtctccacaaaaaataaaataaaataaaataaaattagctgggcatagtggtgcatggggcgtgtagtcccagctacttgggaggctgaggtgggaccactgcttgagccctggaggtcgaggctgcagtgagccatgattgcaccactacactctagcctgggcagtagagcaaaaccttgtctcaaaaaaaaagtaataaaataaagtatgtgtcattttgatttgtgataaccttaggaaaaagccagcaaagtctgggaaccaggtaatcgattgcaaattggagaatgatttacctgctatctaagataaaggaaaagggtaaatcacaatgttgctttaaattcctttcagctttgtttattgtttccttttgtgtggaatttcactgttgcattgatttaaacccagctcctatcaaatgggacatagagtaggccctcaagtaaacatttagcactaggcatgtgtgctctgtataggatatgtagaaccctctctctgcttctaagtcataaatagttctttagagtctaagaaattggcaaactcaggctgggcgcagtggctcaggcctgtaataccagcattttgggaggctgaggcaggcagatcacttgaggtccggagttcaagaccagcctggccaacatggtgaaaccccatctctactaaaaaaaaaaaaaaaaattacccgggtgtggtgtcagatgcctgtaatcccggctactcaggaggctgaggcaggagaattgcttgaacctgggaggtggaggttgcagtgagctgagatctcgtcactgcactccaacctgggagagctgtgtccattcatttacatattatctatggctgctttccctagaagggcagagctaaatagaagttagagactgtattttaggcaaaggctaaaatatttactatctggccgtttagataaaaagttgactctatcccttgcatcaggagcgataaatagatgctcttgcatttagcgtctttattgtttttcatgacaaacctagagttgaaccaacatctggctaaaaagcaaatgcaccatgacaaatgttcatggatcagcaaagtgctaacccagttatggaagtctaatatagtgttacagagtcacaggcttagctaatatgtaaatcagcaaacatgagcaataatgatttatatttgcatggcattctatagattatgaaacatttcatatcaatctcatttgatttttccaataaccgtagaaagtagacaagtaggctgggcattgtgcctcatacctataatcccagcattttgggaggatcacttgaagccaggagttcaagaccagcctggtcagtatgacaacaccctgtttctacaaaaaaaattttttttttttaattagccaggtttgttggcgtatgcctgtggtcttatttacttgggagggttgaggtgggaggatcacttgaacctaggagtttgaggtaacagtgagttatgattgcactactgcactcaagtcagggttacagagcaagactctgtccccctgtctccctgtccccgacccccaccccccccaaaaaaagggccggcgtagtggctcatgcctgtaatcccagcaatttggaaagccgacgcaggtggattacctgaggttgggagtttgacaccagcctgaccaacatagagaaaccctgtttctattaaaaatacaaaaattagccaggcgtggtgttgggtgcctgtaatcccagctactcgggagactgaggcagaagaattacttgaactcaggaagcggaggttgcagtgagccgagatcgtgccattgcactccagtctgggcaacaagagtgaaactcaaaaaaaaaaaaaaaagaaagaaagaaagtagacaaattatgaaacagattcagcgacattgcgtgataactcagagtgaaaaggaactcagatttaatgtcttcagtcttttagcagctaaatgattattttatctctggaaaatggttaccttgctaaaaataaaaaaggtgagcggttattaacgtttatcattctatgatgcactgacttggaagatcacttacaattaactgtactttgtaataacatgttctgtcttctaaatattgtatttttatgtcagtatgatggtaaaaataatataagcattttatataatggttttaaaaatcaaaataaatatgggcctaattaagttataagttaaaaatataatcttaaatttttgaaatcttagaaactgcaagatgaatcagttatctggttttcttggattaacaaaatttttaaaaaacaactcttggagtagcagggaaaataagtcttagtaaaaatgtgagtatatatgagcttgagaaaaataatgaaaagtatacatagtgctctgtaaatggatcaaatcgtgttgaactaaatatttcaatggaagctacgaacatgtagatgactattacaatcgttgtatcatctaagacttgatctcctgtgtgatcaaaccacttctgaggaattgccagtttaccaacacattgctgtatcagtcttggacccacgtaaaacattaatacaacatactgcatgattcagctagatgacattctggaaaaggcaaatctatggagacagtaaaaagatcagtggttgctaggggtcagggtaaggaggggatgaatagtggagggcagaggatttttagggcagtgaaacttaactgtatgatactgtaatggtggatgcatgttattatacattagtccaaacccatagaatgtataacaccaagagtgaactctaacataaaactctgctagggaatgttgatggcaaagtaggttatacgtgcatggggacaagcgtatatgggtaatctctgtaccttctgctcaatgttgctgtgaacttaaagctgctctaaaatataaagcctactttaaaaaaataacataatgagctaacaaagaccacaattctaggtcttcctcagaagctttataaatatgcattaaaaaattattttttgggtatactctggcagaaatacaagaaaaacaaaggcccagaatttttccaggagaatagatccagagcgaacatgaacttacttcacacccagattgagtttcccatgaacatgactcgttctcctgagggagaacccctctttggaaagcatgttcacccaggcatgtttgacacaaggaagactcgaagtctggctcccctggagggatgtgcaccatggaggagccggtgtacttcaggctgggactctgatgcttgtccacactgaccattgggctcttgatccaccttcgtacctgcaatgtgcaaaaggaaagaaaaaacaaatgtgtttgactccctttgatgtttattggggatttggtgggaaatctggtgggatgggagctcatgaaaggagaactcggtctcacaacctgtctatctttcaaactcaacacaattcgaattggtcaatgctgttcagtctctttcctagagtatgcattacatggctggtcatttcatcttgctgagtctgtctccgcatttttttttcacattatttttttcttttctttttcctcctgcttccagtggggttagaatttttttctttttagagataggggggtttcactctgttgcccaggctggtcttggtgttaaaagatcctcctggaccagcctgccaacatgatgaaaccccatctctactaaaaataccaaaattagccaggcctggtggtacacgcctataatctcagctgcttgggagaatcgcttgaacctgggaagcggaggttgcagtgagctgagatagccccgctgcactccagcctgggtgacagagcaagactgtctccaaccacaacaacaacacaacaacaacaaaccctcaaaacccaaaaacaaacaaaaacaattaccctggccaggcgagatggtttatatctaaatagcactttgggaggccaaggcaggaggactgctttagcccaggagtttgagaccagcctgggcaaaatagcgaaactttgtctctacgaaaaaaataacttttttttttttttaaagaaaaagatccttttgcctcttaaagtgttgggatcacaggtataagtcactgtgcccagcctgtctcctcatttgtaagattcaggtaataatatttcctcccaagctgtgaaaatgctaccatgttttacaatgttcaagtactttgcctggcacatgtttggtgcccaatagatagtgactattttactttgacccttattattatgattatgatgacagaaatttagttcacacatttctaaggtgaattactagttattcttacaagggaaaatactaatctcatagtttacaatctaatccattgctaagcaaatacatattcactattattattgttattgagacaggatcttcctctgtcacccaggatggaatgcagtggcctaatcatggctcactgcagtcttgaactgctgggctcaagcaatcctctcacctcagcctctggagtagctgagaccacaggctcgcaccatcacactactaatttttttttttttttgtagagatgaggtctcactaagttgcgcaggctggtatcaaactcctgggctcaagtgatcctcccgcctcccaaagtgttgggattacaggcatgagccactgaatccggcccatatatactactgcacaactttgattataaaagaaattgcttctggctaagaaattagctcaagtttgtttttaaagttctaaaactcaccacttgtcttgcttgcttgtaaaatccctataagatacagaaagaagtataaagctattctaatattaacaggcatggtatttatacagcatttcaaaaatcaaggcactttttaaagtgtttgatgtgtatagtttttaatcctcagaacaggcagggtgaggtggctcacacctgtaatcccagcactttaaactttgggaggctaaggcaggcaggtcacttgaggccaggattttgggaccagcctagccaacatagcaaaaccccatctctacaaaagaaaataaataagtaaatgaagaataaaaaattaattaattagtcctcagaaaagttttataagaaaggtactattttcaatcccattatacagatggaaaaacaaacgcatagagatgtgaagcaaatttccccagggcacagtgttgttatggagtaaaggcgggatccaggcaccttgaatccagagtttataaacatgcaattttcttttctttctttttttttttttttgagacagagtctcgctctgttgcccctggctggagtacagtggcgcgatctcagctcactgcaagctctgcctcctgggttcacgccattctcctgcctcagcctcccgagtagctgggactacaggcacctgccaccatgcctggctaattttttgtatttttagtagagaccgggtttcatcgtgttagccaggatggtctcgatctcctgacctcatgatccgcccaccttggcctcccatagtgctggtattacaggcttgagccactgcgcctggccatgagcatgcaattttctaagaagcactgaagtgttgttaagacttatggtcactggtgcttgaaatttattttgatttactatttcactttcatgctcttcaaaactcctgaggattcttttatattcaaccaattagtgaaattagcctatagcaaaaggacaaagaagtaaaatcacagtactgaattttagttagtgatgctacaattattattattattatttttgttgttgttgttgttaaagggtcttgttttgttccccagattggagtgcattggcacgatgacagctcactgcagccttaacctcctaggctcaagcgatcctcccacctcagccctcccaagtagctgggactacaggcgtgcaccaccatgactggctaattatttttaaattgttttgtagagacagggtcttgctatattgcccagactggtcttaaactcctggccttaggcgatcctcccactttggcttcccaaagtgttgggattacaagtgtgagccaccatgcccagcctgcaattaactttttaaaaaacactgaggataaactaaaattgcaatagcaataatgtttaagcaatttattatattacttgatagaatattttgctatcactaaaattaagtattatgaagactgtgaaaatatgaaaaatatttagaacataattatatgagaaaagccaaatacaaaactgtttaattgctataatcacaaatgtaaaaacatatgtactaactataggccgggtgcagtggctcacgcctgtaatcccagcactttgggaggtcgaggcaggcagatcacctgagcccaggagttcaagaccagcctggtcaacatgacaaaaccccatctctacaaaaaacacaaaaattagctgggtgtagtgttgggcacctgtaatcccagctactcaggaggctgaggcaggagaatcgcttgacccctggaggtggaggttgtggtgaaccaagatcatgccattgcactccagcctgggcaacaagagtgaaaactctgtctcaaaaaacaaacaaacaaacaaacaaaaaaaatatatatatacacatatatattttatatatacatatatattttatatacacatatatattttatatatatacatatatatttatacatatacatatatacatatacatatatattttatatatatacatatatatatatacatatatatatacacagaaacactatagacataaagtaggagagttaagaggcaaaatagaaactgctgtgtttattgttagtatcatgggtgttttatctgtttttacaactcttcgtactttaacttttaaaagaataatattttatcagaatcataaatgtatatatatatatacatttctttaaaaaatagagtctcaccatgttggtcaagccaagctggttagaactcctgggctcaagtgttcccctcccagctcagcctcccaaaatgctgggattacaggcgtgagctaccacatccagccacaagtgtcttttaattgctttatttatttatttctttattcatttatttatatttattaagatggagtctctgattgtcacccaggctggagtgcagtggcgcgatctcagctcactgcagcctcctcctccctggttcaagtgattctcctccctcagcctcctgagtggctggaattacaggcaccgtgcccccacgcccagctaatttttgtatttttagtagagacggggttttgctatgttggccaggccggtcttgaactcctgatctcgggtgatccacccacctcagcctcccaaagggctggtaatacaggcgtgagcaactgcacctggcctatatgtactcttttcaatagccatttaaaatatctttgtgaggccggttgtggtggctcacacctgtaatcccagcactttgggtttgggaggctgaggcgtgtggatcacctgatctcaggagttcaagaccagcctgaccaacatggtgaaaccctgactctcctaaaaatacaaaaattagctgggcgtggtggtgcacacccgtaaccccagctgctccagaggctgaagcagaagaacggcttgaacctcggaggcagaggttgcagtgagcctgagatcatggcactgcattccagcctgggtgaaagaaggagactctgtctcaaaaaaaataaaatatctttttgagtttactatcctaaagttaaaattttgggtttccttaaatatttctgtcactatagggccccttaagcatgttagtaggtatattaagaatgtttcgctgattcattaatggaagtctaaatgaaactttaaaagtttgagactccaatagaatgtatcttcttaatgttagtactaaatgtgtttttgatcagtctaaaaagtgttcaatttcattagagatggataatgttttttattattcttattcagatagttttgggcttgaagtctggtaactgttcttgctttgtctccaacgttgtagtttaaaatcaatctttttactctggcttactttcaatgtctcttttgccaagtagatttaactttagggttactgtgaacaggatttaaacagatgataaatctattcaaatatatttgtaagttgtatgcctggactaagaatctttgtatcttgaaatgtatatctcccctgactccctgaacacccgcactctagagcttgagttatggccaacaaaataaaattttttttaaatattcttttttcatgttatttttatttctttttgttttttatttttatattttctttttcttttttttaatatgttacagtctgaatatgttcatagtgacttttctgtttgtttggttggttttttttacagagatacagtctcactctattccctttgttggagggctgtggcacgatcatagctcacttcaaccaagagctcctaggctcaagctatcctctcgcctcagcctcccagttacctgggactacagatgcgcgccaccacgttcggctatttattttttggagagacggtgtctcattatgttgcccaggctggtcttgaactcctggtctcaagtgatcctcctgccttggcatcccaaagctctgggattacagacatgagccattacacctggccagaataaaattattaaagggacatactatttatttaataaaataagtaaactataagtaagaaggaaaataaagcatatgaatgatcaggatcattgcgggtggagggctcaattttaaacagtatgagccaggatactatcggatactccctctctgtccacacagaatgtagcaagggatatggagaaatactccctttctccagaagcatcagagaaaaagtgttacttacaaaaatgaatccagcaacacatttctaaccggactgttgctgaattttactgcatgctttgtcttaaaaaggttttgtctccattggcttagtccttatactggcttcaacgtgtcccttctttatgactccttgacacttttcaccagctttgaagcctcacaagtgatttttacaggcccaattaaggacagagtttacgatgtttgcttgctcttgagagagtggctggaccgacccagtgaatgcacaggagttaggcaaggtgcccttcaaaactgctgagtagagaaatcctcccacggcccctcggggaattcaagctacaactggcccattgtgtttcctcaggctgcggattgctttactggagggagtagctgactgtgagtggctttgggagcccttcataacaatggctggaggagagctgcagcagctgtgtgtgcgagaaacacgaatgcccggatgccagcggcagcctgggctcctgggcctcctgggccacctgggccctagttttattcagagctacacaactgtttgtgaagcgcattgtaaacaaacatagacggggtgagacatcctctttatcctgaataaatcaagaattcccaggccgggcgctgtggctcatgcctgtaatcccagtactttgggaggaggcgggcggatcacgaggtcagtagatcgagaccatcctggctaacacggtgaaaccccgtctctactaaaaatacaaaaaaaattgccgggcgtagtggagggtgcctgtagtcccagctactcgggaggctgaggcaggagaatggcgtgaacccgggaggcggagcttgcagtgagctgagatcgcgccactgcactccagcctgggcgacagagcgagactctgtctcaaaaaaaaaaaaaaaaaaaattccctcacttggggtttataggagactgttctccaaaccacaccagacttttagaagcaactacctctacagataccggggtgaaccagtaaggcccttcatttaactagacagaaactgagtgaacagtgggtaaacaaaatattcaaccaaattctttgctaaatccagtccaccttggttttattaatgtctttacttggaaaaaaaaaaaaaaaaagccatccaaaagcaatccctcagtctagaaaattgccagatgtgattaaagagattggctggcttctagggattttccacttgtggttttttcctattatctaagagcaaacagatattactattaatttaaaatagtttagctgataatgatatcaaccgatacaggaaaattatagagagtttaggtacttaggtgtgaactcaggtggcaacacctactctcattggcccccgtccttttagggggaagagctgactctcttaaaaagccaagagagcttgaagttgccttctgtaatttccaaacaggcattttttttttttaattatagagaactgactttgcttacttgacgcctcaataactttcaatttcgagagagtcagcccagttttctagtgaaattacttggataggtcaatagattataaaaagggaggccaggtgaggtggaggccgaggcaggtggatcatttgaggccaggtgttaaagaccaggctggccaacatggtgaaaccccgtttctactgaaaacacaaaaattagccaccatggtggcgtccacctgtaatcccagctactagggaggctgaggcaggagaatcccttgaacccaggagccggaggtggcagtgagccaagatcgtgccactgcactccagcctggatgaaagagtgagactctgtctcaaaaaaaaaaaaaaagagagagagaaagtaagagacctgcatgcctatgcctctcccagagggtgcatgctagcaggttagttacggcatgagtgtaatttaggagaaggctcctggaagcaaattcatctcacactgatactggagcctgaagctgcttcatagcatgtctcctaaaatataacagtgctgtaatattcagtaatattaatcagatatcttcaccccagctatatgtcatcatcatgtatctgtcttttctctctctcttttttttttttgagacggagttgtacttttgttgaccaggctggagcgcaatggcgcgatctcagctcactgcaacctccgcctcccgggttcaagcaattctcctgcttcagcctcccgagtagctgggattacagacgtgtgtcaccacatccagctagttttgtatttttagtagagacagggtttctccatgttcgtcaggctgatctcgaactcctgacctcaggtgatccatccaccttggcctcccaatcccaagcctgttgggattacaggcgtgagccaccgcaccaggcctattactgtcttttctctagtgtttgtagtgtttattgcttgtataaaacaacaggacttttatgctaactggtcttgatattaagcctatgtcacctttccaactggatcataagcatgagaatagcttcttaggccttaggaaaaaaaaaaattccagaggctagtgtatgggcttacaaacaaactaggtaataaaaataggaatctcttgattgcttttaatatttacttatagatctcaacaagttttgctaacatcctccatcaaggtaatacagattttctatttaaatatttctctttaacacgcaagacctatcctggagcaggcaccctgagaagatggagtgacttttagaattccctgaccttctatgctgttgtccttgggatctcccagtcctttcctctcaccttgacctagttgcatcctcttctagattctcaggggccaacctgtgtctccaggcctagtccggaggatggagtggtggggaggactctggggaagtgggaaaacggagacgcaatgcgtccatgtaccctatttaatgttgctgctcacagcaggcagcaccccagctccgtctcttcagaggacagtgcttgcctgttcttctagctcagtaagtataaagtctccctcctcatcctccccattgaggaatccaccccaccctgtcccaccccaccccaccctacactgccaagtgttaaatagataaagtgcaggaattcatcaacgtacgtttttctttggaaatacaggtgaagtttttctcatttctttaaattgtgggactctgccaggtgcggtggctcatgcctgtcgtcccagtgctttgggaggccgaggcaggcagatcacctaaggtcaggagtttgagaccagtctggccaacatatagtgaaactccatctctactaaaaatacaaaaattagtcgggcgcgggggcacatgcctgtaattccagctacttgggagactgaggcaggagaatcacttgaacctaggtggcggaggttgcagtgagccgagattgcaccactagactccagtctgcagagtgaaactgtctcaaaaaaaaaaaaaaattgtgggactcattcttttcgtttgaatttgtctttcctcgatatgtactttttttagatataaaaaattgttttaaaaagagaaagtaggaaaattattttaggtactatctctacgggacagtgtatgttatttgcttttggaaattaaggctcagggaaaatagaaatgctggtgtaatcagtggagaagaacctggctatcctgtccgtcaaaatccactgagctttggaaacaacttcctcccctctttcctccaagaaatccccttttccagtgttttttttgtttgtttattttaggttcaagggtacatgtgaaggtttgttacacaggtaagctcatgacaccgggatttgttgtacagattatttcatcacccaggaattaagcctagtacccaatagttatcttttgtgctcttctccctcctcccactcttcaccctccagtagaccccagtatctgttgtttccttctttgtattcatgtaagttctcattccagtgtttttctgtttgtttgtttttttgagatggagtcttgctctgttgcctaggctggagtgcagtgatgcgatcttggctcactgcaacctccacctcccaggttcaagcaattctcctgcctcagcctcccgagtaactaggactacaggcacacaccaccacacccagctgagttttgtatttttagtagagacagggtttcaccatgttgaccaggctggtctcgaactcctgacctcaggcaatctgcctgcctcgacctcccaaagtgctgggattacaggcatgagccaccgtgcccagccttttttttttttttcttgagacggactcttgctctgttgcccaggctggagtgcagtagtatgatctcagctcaccgcaacctcccgttcctgggttcaaggaattctcctgcctcagtctcctgagtaactgggatcacaagtgtgcaccaccatgaccagctaattttttttttttttttttgtatttttagtagagatggggtttcaccatgttgaccaggctggtctcaaacttctgacctcaggttatctgcccaccttggcctcccagagtgctgggattacaggcgtgagccactgcgcctggcctcattccagtgttgttgttgtttttttaactgtctctctctctctaggctactgtctctcagcatattaaacaccttgttcttgcaatatctctaaaagctagcgaacagactgcaagcaaaacatcctctttacacccacaaactcttcctttttcccgcagccacctttcaccaccacccaactcttctctcttagccgagcttcatgaaaaaataatctccatttcctcatctcacattttctcctcaacccatttgctcattaaatggcaatttgttcattaaatggtatttatggattgcttaatatttgcaaggactaaagcgaagaacataataacaaaagtctcatttcataaaatgaagcttgcacaaagatgccaataaacctcattgtcaaatccaatagacatttctctgtgcttacttcatttgcatatactctgcagcatttaaaagctttcacaaaggttcaacaactatttgcctggcattatgtggttgggacagaaagaaatttaatgttgaccatcgaaagaggatgcttgcatttcagaggggctgatacatgagactgcggtttatcacagcaggtctaccctccccagagctcagtttctgcccttgtaaaatggagataataattatgcctactttacaagggttttgtgaggactaaatgagatgatgcaggtaagcccagtgcttgacaccaggtgaatccttcacaaatatttgctattgtggttatggcttcattccatggaaagagttttatacaaagggccattggagaaaagatggagggtacttggtccagtcaggaaaaatcagggaaggctttctggtggaagtgatggttaagttgaatcttaaaagctgagttacactttgggaggccgaggtgggcggatcacgaggtcaggagatcgaaaccatcccggctaaaacggtgaaaccccgtctctactaaaaaaaatacaaaaaattagccgggcgtagtggtgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaagctgagttaaaggaagccaggtgaagagaaatgggaaagatatttctagtagaggggatggcagaagcccaaatacagaggcaagaatctgctgagatgaatagaaaacaagctccaaaaaggagaggcaagaactaaagctggatagaaagtttaggtcatggggcaatgaggggaccctgaagtatttatttttatttatttatttacttactatttagggatggggtctcgctgtgttgcccaggctgatcttgacctcctgggctccagtgattctcctgccttagccttccgaagagctggggttacaagcatgagccgctgcacccagctcactgaagtattttaagcaggagagtaggatggtcaaatgtgtttttctttttctttttttttgagacagagtctcactctgtaacccaggctggagtgcagtggtgcgatcttggctcactgcaacctccgcctcccaggttcaagagattctcctgcctcagcctcccaagtagctgggattacaggtgcctgccaccacacccggctaattttttgtatttttagtagagatggggtttcaccatgttatccaggctgatcttgaactcccaatctcaggtgatccaccacctcggcctcccaaagccctaggattataggcgtgagccaccgtgcccagcctcaaatgtgtttttcaatacagtatgaaggacggatttaagatggtcaagatcaaaggagctagatgagagtcaggaatggattagaaaagaaaggtaagggccaaacaagaatagtagctttgggaatggaaaggaggaaacaataatcaaatctacttttagctctcaagactatatcctcttctccatccaagtacaggttgagcatcttaaatctaaaaatccaaaatctgaaatgcttcgacatctgaagctctttgagtgtggacaagatgttcaaagaaaatactcattggagctttttggattttcagattaaagatgctcaaccagtaattataatgcaagtattccaaaatctgaaaaaaaaaaaaaaacccaaatctgaaatacttctggttccaagcattttggataagagagactcagcttgtatcttctcgattcctaaagccattccttaaatggtattgcccttttagtcttttcttttcttttcttttcttttcttttcttttgagatggagtctcactctgtcacccaggctggagtgcagtggcgcaatcttggctcactgcagcctctgccttccaggttcaagtgaatctttcacctcagcctccaagtaactgggattacaggcctgcaccaccatgccctgctaatttttgtattttagtagagacggggtttcaccgtgttgaccaagttagtcttgaactcaggttcaaggttcaaggtatccacccaccttggcctcccaaagtgctggtattacaggcgtgagccacagcgcctggccatctttttttaaaaaataaaaataatctgtggctgggtgcattggctcacctcatctcttaaaaaaataagtaaataaaataaaataatttgttatttaaattgattgatcagtcgattgtagaggtggagtgtcactatgttgcccacactggtcttaaactcctggcctcaagtgatctgcccaccttggcctcccaaagtgttgggattacaggtgtgacccactgtgtccagcctccctttttaatcttaacctcactgataccacagcttctttccaaatgcaaaagctgtcttgttgctacctagctttaaactcctcagtttggttcctcatctctagcagcagtggctttcaaacctgtttcatcaggattgatgtattataagaaagcccatatgactgaaacaattggttccccactaaaacctatcctttttacatgaaatgcactgacatctcctattctattctttcaaaatgctgattgcaatctattgaactgatttcatgaaccactaatgggtgccacacaaattgaaaaacgctcatctaaatggtaaaatctaaatatcttggcctgggagaccaagtctcctagggtctggacgcctatcttctattgtgcccggaatgcatccagacctccattatatcatttactttgcagttctcttaaagattgttctcctgaatctttgattcccttgaccagccttgtccacctggaaactcctgctctaagtcacaaacttgggaaagccattgtctggcttcttacccattctttcatccatttgggtattcatttgtttaagtgggagcacacattcattgctttgcttgtgtatttcccttattagaatgtgagtttcataaggactgagatattattttctctcatatattcagtagtgggacatttataatttcttctgtgtgttccctcttcctagcttattcctgctctattttctgtctgtgttcactttgtgttgaagctcacaaggaaagagactcactattacatccccagagcttagcacaactcccaacatacaggcaatgctgaagaaatggttgctgattggctccatgctaggtatttttcaaggcacagggaatgacaaataagaggcaattctgtctttaggaactcagagccttgcaggaaagcccaacaaggaaatcaacaattggaagacagtgttaaagcgagcatgagttcatctctggggagaagtaggaccgggctgtgatggggataggtgaaatgcagcattttggagagagaggaaagcatgtttcaaagcatgctcatagagagggccaaccttggggtgagtatgtgtggcaagccagaaagccaaaaagctaagtgggtcagacatcaaatgacttgaatgtttggatactgaaatgtcatccttaactcacagggagggtacgctgaaggattctaaatgttagcatgatctgatcagatttgctatcttctaaatgaattgggcccaggggaaaagcatcctaggttagaggaataagcactgtccacagattagatggaccccacagattgaggccccttctggagacagtgcttattccaggggtctccaaacccgggtaacacaggacagctttaaaaatgcaggctcagctgtgcatggtggctcacacctataatcccagcactttggaaggctgaggtgggtggatagtttgagctcaggtgttctagactagcctgggcaacatggtaaaaccccaacactacaaaaaatacaaattagccaagcatggtggtgtgtgcctgtaatcccagctactcaggatgctgaggtgggaggagtgcttgagcccaggaggttgaggctgcagtgaactgtgattgtgccactgcactccagcctggcaagagactcttgtctcaaaaaaaaccacaaaaacaaaaacaaaaaccagaaccaaaaaacccagggtgaggtgcagtggctcacgcctgtaaccccagcactttgggaggaggccaaggcaggcatctctactaaaactacaaaaattagctggtgtggtagtgggtgcctttaatcccagctactcgggaggctgaggcagaagaattgcttgaacctgggaggtggaagttgtggtgagctgagatcgtaccactgcactccagcctgggtgacacagcaagattctgtcttgaaaaaacaaaccaaccaacaaacaaaaaccgaaccaacaaaaaaaggaaataaaaattaaaatgtagtcttaccagtggcttttaacatttttaaattttattttcaagctctatgtgacctagatgaagggcagggaaggctaaatggagcacgaaatgaccagggtcctggaggtgtgagaggtgggcagacccaggcaggtgtgagaggtgggcagacctgggttttttgggcaatgggaggaggtatcactataaaataagacagagtggaaatgccatcctacagcctcacttggagctctctacagtattgttcctcaaagacatcttcctttcttcctttctccactcccctaagtcccccacatctaaaataacaccatatagctcttaaactccgtaataacctaggtatattatgaattaaataggtttctatgggtaagaataaggttaagtgtggagcagaaagggttactaaacagcaagtataatattgttttttctattattctgaggttaagcagtcaatttacaagtgatttggatttcctcacaatttactgaacaaagaagaaaatctaagatataaaaagggttttctacagaaatgaataataaactgaattaagagaattggattccagttctagcttcgtaactaccttgagcaagacactgaattcatgtgaacttgaaggcgcttatccgtaaaatgatgatcttggagcatccaagaagtcctttccgactgtgtcacagattcaaagctcttcgttccctgaagtcctgctactgtgacttggaactctctgtttctatggtgtgcagcactcagcacaagtttgttgaatgaacaaatgatcaaatgacatttgcccttccctgcctgacattccagtcacattcttccataactttgcatttcttccattagataaataaacaaacgcaaaaaatccacaaggcttttaagataattttatgcccttaagggcagttgtttaaaaatctatttaaaacacaaagataaagactgaatgaaagtctcattattagagcgctgtacattgcttaattaaattgaaagtggtaaatgaaaggtaagatgattaacatccaaactggggtcttattaccactctctgatgttactgcttgttcgttgagtcctcttataaaagaaattgcacagtacactcaatttcagttttatacaaaaacagctttcctccaaattatgcttgtgctgtattggtaatggtttctatttctgtattctatttttttttctcacttcatgttttataaatgaagaaaatgttaaggtttaattgttccctgaaaacaggaggacagtcaaagctaacaaaaagatatctatgaagtacctattatgtccaaggattgtgtgaggttctgaaattatggaagataaaagaatgtattgagaataaattggaaatgttcaaagatcctatggaaattgctggaattaaaaaaggctcagttttcaaccatagaatcagaagcacaagaaaaaaaaaaccaaagaggaaaagaaaactggctgtgacctccgtacaattgagacagaggaaaatgactgttaacatgaatctgtgtaaatggagaaggaaaaaggatgcatttcaggacagctacatttaaataatcaaaataatttaaaaagtgtaggcaaggtagtgagacttcctttctacagaaaaaattaactggatgtggtggcatgcacctggagtcctagctactaaggaggttgaagcaggaagatcacttaaactcagaagttcaaggttactggctgggagcagtggctcatgcatgtagtctcagcactttgggaagcctacatgggtggatcacttgaggtcaggagttcaagactagcctggccaacatggtgaaaccccgtctttattaaaaatacaaaaattagctggacgtggtggtgcgtgcctgtagttccagctactcaggaggctgaggcaaagaatcacttgaacccgggaggtagagattgcagtgagctgagatggtgccactgcactccaacgtgggcaatagagtgagatcctgtctcaaaataaataaataaataaataaataaataaaataaaggcaagagtaaaaatcaaagaaacattcttgcaacattatccttggtgataccacaccctacagatatgctgtattcttttaatagatatcaatgaactgacttgttaaagaaagaaagtggaaatgtagtatataacccaaaatgcattacattaatatggccctcattaatcccctcccccccaaaaatagcaagtcattctgctatatgggagaatttcatacatgaaattttacaaggataggtgatttataggaacttctgattattatgctttttgccattcttttattataaaaccagcactcaaaaagaatcaggtattggttctacatacgaatttgaaatgagcaggtgtgcagtaagcactatattacagtctggttaagtaaaatataaacacttagctttgcttagaaagcctactgttgggaaaagctgggtgtggtggcttatgcctgcaatctaatcccaatactttgggaggttgaggtggagggatttcttgaggccaagaggtcgagaccagccggggcaacatagtgagatctcatctctacaataagataaaaaaatatagctgagaatagtgatgcacacctgtagtcccagacactcagaaggctgaggtggaagggttgcttgagcccaggaggttgaggctgcagtgagccacgatcatgccattgcactccagcctgggcaacaggcagaatgagacactgtctcaaaaaaaaaaaaaaaaaaaaagttgtttcttcctggcccattccatcttcaaagtgccttttctctgtataaggacatatcttccacatagggtatagttcctagtaccatttgattacctatcttactcacggctgtcttgaaggcaaacagaaattcctaagtatttgttgaataaatagatgagtaaaggagtgaatagatgctttgtggtggtaatttagcttatttttaaaatatatatattttttaatttttttgtagagacaaggtctcactatattgcccaggctagtctcaaactaccgggctcaagcgattctcccaccttggcttcccaatgtactgagattacaggcatgagccacctcgcctggccaatttagcttcttcatttgtgttcctccctagattgtaaattctttatggattctttatggataaatatttcactggacatctttatgttgcttgtaatgccaagcacagtatcttgcatgcatgacactgttcaacacatatttgttgtattaattgaaagtgtgtgcctgtcaccctgcgaggtctgaatgaaatagcagatccaggccaggtgcagtggctcacacctgtaatcccagcactttgggaggccaaggcaggcggatcactttaggtcaggagttcaaggccagcctggccaacatggtgaaaccccatctctactaaaaatacaaaaaaattagctgggcgtggtggtgtgcaccagtaaccccagctacttgagggctgaggcaggagaatcacttaaacccgaaaggcagaggttgcagtgagccaagatcgcaccattgcactccagcctgggtgacgagcgaaactccatctccaaaaaaaccagaaacaaaataccagatccaatctttggaaatttcacaccctcatctgctcaagcttcctggaatctggattataaccatgttttaaagtccccattccaactttcttatccacctacccgttcatagcttagtttttggtcattttagtgtttatcttagtattttagtactgttagaagatctgatttcaagtgttgtttctaccacctattagatgtgtggtcttgagcaactaatttaatctctaaatctattttctcatccattaagagtactgagtatatctatgtaacaagtggtaaggatgagtaggtggtagtaaaagagaggcatctgaatcctctgcaagcatttaaaagaaaaatacatatatgagttacttaatgttgtaattattcacagttagctttccaaagataaaactggctaccaatttgttctttttttttttttttagagacagattctcagtcggtctcccaggcaggagtgcagtggcgtaatcacagctcactgcagccttgaatcccatggctcaaatgaccctcccatcttagcctattgagtagctgggactacaggtgcaccaccacacccagctaacttttaaattttttgtagagatgggggtctcactatgttgcccagggtggtttcaaattcgtggtcttaaatgatcctcccgtctcggcctccgggatcaggcacaagccaccaagcctggtccaattctgatatgctataaccagaactggactaggagagttgctcacgtgcctaataaggtttaactatatacttatatacttaactatatacttatgtttgtttgcatttgagccatgataggcccactcaattttctccttgtgggatgagagagactggtttaaaagcagttcaagtggaaaattcctggagttttaaattccctctaagccttataggaaatgtataatccattctctggactacttgggtaggttatatcagtagaagcattgaggccagaaaaacagaggtgataccctgacctctgtcgtgttgagtcagatctggagtactggctctagacttgttctgattttatttaattttatttatttatttattttgagacagggtctcactctgtcactcaagctggagtgcagtggcatgtgttcttctgattgtaataggggtattgacaaactaggaacgctctaagagcagatagaacagtgaaggagattgaaatggttaatttgtgtgtcagctttacaatcagttaacttctaaaagagtttatcagtgagcatgctggctcatgcctgtagtcccagcacttgggaggccaaggagggcggatcacttgaggtcaggagttcgagaccagcctggccaacatggtgaaaccccctctctgctaaaaatacaaaaaattagctgggcatggtggcgcacacctgtaattccagctactcgggagtctgaggcaggagaatcacttgaacctgggaggcggaggttgcagtgagctgagatcacaccaccgcactccagcctgggcaacagagtgagactccatctcaaaaaaaaaaataaaataaaagagtttatctttggtaatttgggtggtccttatctaatcaattgaaaagcattaagagtaaagctgaggttttcctgaggaataataaattatgcctcaagactgcagcctaagacttctggcctgccccacagatttcagacttgccatctccacagctgcatgagccaattcattgaaataaatctcttcatatatatcatctaatgattctatttctctggagaaccctaactgatacagagatcacactagaaagatagagataaaaactcagaaaggccaggacaacagtttttgaatatttgaatagctgctatgtgaaagatgagccaatggatggcggtaatgggaagacatatttgggcttcccatgtaccaaaacttaaatgtgtcttttgtttaaagaaggcagctgagccggtccaagtgcaatggtgtttacaactgattgatcacaaccaattacagatttctttgttccttctccactcccgctgcttcacctaactagccttaaacatacatatatacaggctgggtgcggtggctcacacctgtaatcctagcactttgggaggctgaggcgggtagatcacttgaggtcaggagttcaagatcagcctggccaacatggtgaaaccccgtctctactaaaaatacaaaaattagctgggcgtggtggcacgtgcctgtaatcccagttactcaggaggctgaggtgagagaattgcttgaacccagagggtggaggttgcagtgagcgaagatcacgccactggactgcagcctcagtggcagagtgaaactctgccttaaaaaaaaaacaaacataaatacatatacatatgaagaaggcagctgccctacagaggacacatcaaagaagtctggccgggcacagtgactcacgcctgtaatcccagcacattgggaggccaaggtgggaggatcatttgagcctgggagtttgagatcagcttgggcaatacagtgagaccttgtctctacaaaaaataaaaattagccaggcatggtggcaaacacctgcagtcccaggtactcaggaggccgaggtgggaggatctcttgagcccagaaggtcaaggctgcagtgaagttgaggctgcaatgagccatgatcgcagcactgcactccagcctgggcaacagaacaagacgctgtcccctgccaccaccaaaaaaaaaaaaaaaaaaaaaaaaaaaaaaaaagcctgaccaatctttcactcttttaagtgccaaaataatgcattttgggtttcaggcattaaatgagtcccttccttatagctctttatctctttacaattttatttccagtttggtgttcatctggggtattatgctattttatcagtgccaatccattcctttatatgttcaaatattctttttgtttatttgtttgttttcgagatggagtctcactctgtcacccaggctgcagtgcagtggctcaatctcagctcactgcaacctctgcctcccaggttcaagcaattctcctgtctcagcctcccaggtagctgggactacaggtgcacaccaccacgcctggcaatttttgtatttttagtagagacagggtttcaccatgttgaacagggtggtctcgaacaccagacctcaagccatctgcccacctccttggcctctcaaagtgctgggattaaaggcctgagccactgcagccggcccatcacatcagtcttatgcctttacatactcagagcttagctcacacttagaagtgagaacatatgatatttggctttttctttctttctttctttcttttttttttttgagatagagtctcactctatcgcccaggctggagtacaatggaatgatctcagttcactgccaccccacctcctaggttcaagcgattctcctgcctcaacctcctaagtagctgggactacaggtgcacaccactacacctagttaatttttgtatttttagttgagacagggtttcaccaacaggccagtttggtctctaactcctgacctcaggtgatctgcctgccttggcctcccaaagttctgagattacaggcatgagccaccacacccagccaatatttggttttccattcccgagttatttcacttagaataatggcctccagctacacccaagttgtggcaaaagacattattttgttctttgttatggctgagtagtattccttggtgtgtatatatcacattttttttatccactcattggctgatgggcagttaggatggttctgtatctttacaattgcgaattgtgctgctataaatatgcatgttcatgtgtctttttcgtgtaatgacttcttttcttttgggtagagacccagtagtgggattgctgaatcaaatggtagttctacttatagttctttaaggaatttctctactgttttccatagtggttgcactagtttacattcccaccagcagtgtaaaagtgctcccttttggctgggctcggtggctcacgcctgtaatcccagcactttgggaggccgaggtgggcagattgcctgaggtcggcagattgcctgaggtcaggagttcgagaccagcctggctaacatgttgaaaccccatctttactaaaaatacaaaaaattagccaagcatggtggtgcatgcctgtagtcccagctactcaggaggctgaggaaggaaaatcacttgaaccagggaggcagaggttgcagcgagctgagatcctgccactgcactccagcctgggcgacagagtgagactctgcctcaaaaaaaaaaaaaaaaaaaggtggtcccttttcaccacatccgcaccagcatcaatttttttttttttttactttttcataatggccattcttgcaggagtaaagtggtatctaattgtggttttaatttgcatttccctgataattagtgatgctgagcatttttttcatatgtttgctggctgtttgtatatctccttttgagaattgtctattcatgtcctttgttgactttttgatggggtttttttttctttcagttttcgtttccttgtaacacatctattctgtaaggataaagatgtctgtaaaataagagaccattaacttgtgctaaaggtcagtattttttttaagggataaaaagataaaatttgctgggaaacaaatgttaggaacaactgactggtattggctgagaggacggagttgctgaagagtttgccttccaaggtggactgtcccacttcaccagtaattttcttgtgaaaagtgttgactaaaaccaaaccaaacaaaaataagtttttaaagaattaaagtgagttttctttagaagtcttattgcaggctgtagactgatgactacagtctggaagtagtttgtagagaggtttcgttagtaacctgttttggctaatattttaatctatttatatacaggtggtggaggtttagtatgtataaaattgtattagatttgtttagaagttatattaaagtagaattatattaaggtttgaacgtaagagtatatttgggctgcgcctcgtggctcatgcctgtaatcccaacactttaggaggcctgtctctacaaaaaataaaataattagctgggcatggtggtgcacacctgtagtcccaactgcttgggaggctgaggtaggaggacctcctgagcctgggagattaaggctgcagtaagccgtgattgccactgcactccagcgtgggtgacagagcacagagcaagaccttgtctaaaaacaaaatacaatatttttttttttttttttttttgagacggagtctcgctgagtgcagtggcgcgatctcggctcactgcaagctccgcctcccgggttcaagccattctcctgcctcagcctccagattagctgggactacaggctgggacacgatgcccggctaatttttttgtattttttagtagagacggggcttccccgtgttagccaggatggtctcaatctcctgaccttgtgatccgcccgcctcagcctcccaaagtgctgagattacaggcgtgagccactgtgcctggcctaaaaacacaaatttttaaaaaagagtatatttagttatctggttataggttatagaagtataattattaattttgttagacattattttgtgtgtagaaaaagacaaggactagggctttttattttttaaggaatatagtgatttaggtaaagagaggttgggggcatttgggagttgtatgtcttattttgttttgtctctacagtattttcttggagaagtctttttttgttttgttttttgagacggagtgtcacagtggtaccatcttggctcactgctacccccaccttctgggttcaagcaattttctagcctcagcctcccaagtagctgggacttcaggcacatgtcaccatgcccagctaatttttgtgtttttggtagagatggggtttcaccatgttggccagactggtctcaaatttgtgacctcaaatgatccacctgcctcgggctcccagatagctgggattacaggcatgagccaccactcccagccttggagaattatatgttatagagtcaggagttttgtaaaattatgttggcaagtagaaatgaataaatataatttttttatgtttgttattttgtcctataaatttttttgttataaattaattgtctggttgtatttataagattaatgattgtttatatagataagaaggctttttttttttttttaaggaagattggtaattttgagttgtaggagtaaggaatgagtattgggcctagtgtgtatatttgtctatttattggaaaatacgttttggattgtatttattttttatttactgtgatttggttttttatatttaatataatattttaataagactactataaggatagtataggttgtgtataatagtatatatttaatagtattaaagtgagttgtagattggaaaatgtgataatgacttaataaagttagaatatcaatttgtacattttaagatgaattgtgtgtttttgtatttacatgtattagagtttttttatggaaagtaattttgtactatgcaagagacataggggaccctgtgctctattttgttttgttgttaaagtatcttttggagagctgtatgttgtcacagagtcaggagctttgtgaagttactttgttggcaagcagaaatgagtaaacatagcttttcatgtttgttattttgtcttacacaaagatgccatctccttacctaacctaagatgtgactctaatagataaaatgataaggaacataaactaagacaagagatctcttgggatgtcttcagatcatgagggctaaacatgactcagaccggaaggttagtgtttaccaagacccttcttacagctggggaaaatgaaggcaaattaagtttagcctaagctaaaacaggagcaacttggttatggtaaaaagagatattgccctatgggaagggctactacaagaattctttccatacttaaacttcagtagcaatctgacaagtttttaagtggagtctgaatgtaaaacattcagagagaacccttggtcagtagcaggatagaggttgcaataaacacagagaactagtggcatttcaaggaacagtgaggagacaggtctggttgaagcagaagctcttttgtgagatcagtagaaaatacgcctggagaaaaagcctgtttaaaactaaacatcttttccaagggtaaaacataaaatccttgaaattaggctttctaatgggcaaagagatgtcttcaaccattttatgatgagaaatacattggttcatcctcagaggtctctgaacaaaaaggggaacacatgtgaaggtagtcatgagggagcctctgtgaatcataaggagaactgattgcaaaaccagaagccagcagaaacaaaacaattcataaaattacagaggcggtattcggaagttctaaatacttttttttccatctcagaaatgcttggtatcctaataatattttctttgtgatacgttttctatactcttagtaattttccctggtcttgatctcatcattaaagaggatgaaaccaacaccaggaaatgtccataagcaggaaaccacatttttattccatcactcataaagcatcattcataataatcagtgtcagtttagctatagcaacagatgctaacatacacatagtaagagcctacaaaggctcttttaaatgtcagtttaatttaaaccttaacctcagattttttccacagatacagtgagaaaccacaaagatcctcctgtcctaatgctccctccatactctgcaataaaagttcttgttttggaaatagagaaacctgtctgaatcagcagtcttggcttgctgtgtcctccatgaccacaccacatgttccatacctttagccttcataggggctggaaaaaactctgtctcccttgtctacccattttcactgtggagttcggctgcacatttcaggtggaaaggaggtagtgtactaaaattgcaaagtatttcttttaattggcaatgaatttaaacaatattcattgattcttccactatgaacaagctagtgttccctgggggataaacagatgaataattggataagcctttactactcaggaagtgtatagtctagaggagtgcagtccaataggaatagaatataaaccacagacacaatgtaaatgttctaatggacacattaagtgaagtaaaaagaaacatgaaattaatttcaaacatatactttatttaactcaatgtacccccaacattatcattctaaattgtacttaatataaaattattaatgaaatattttatattctctttttttttccatactgtgtttaaaatctggtatgtattttacatctaaagtacatctcgattcagactagccacaattcaggtgctcaatagtcacatgtagctggtggctaccacatcagaccctataggtctcatatgtagcagagaaaaagacatacagaggctgaggcgagcggatcacttgagcacaggagttcaagaccagcctgggcgacacagtgagacctctgtctctacaaaaaataaaaaagtagctatgtggcctggtgcagtggttcatgcttgtaatcccagcactttgggaggctgaggcgggtggatcacatgagatcaagagttcaagaccagccttaccaacatggtgaaaccccatctctactaaaaaaatacaaaaattagctgggcgtggtggcaggcacttgtaatcccactactcaggaggctgaggcaggaggattgtttgaacccgtgagggggaggttacagtgagccgagaccacgccattgcactccagcctgggcaacaagagcaaagctccttctcaaaaaaaaaaaaaaaaaaaaaaaattagctatgcatgttggcatacatctgtagtcctagctactcaggaggctgaggtgggaggattgtttgagcgcaggagttcgaggctgcactgagctatgatcttgccactacactccagcctgagtgacacagcaagaccctgcctctaaaaaaaaaagaaaagaaaagaaaagaaaagaaaaagacttgttggagcctactcccactctgtggagtgtacttttgtttcaataaatctgtgattttctgtcaaaaaaaaaaaacaaagacaaatgacagcaatacaagctccatttggtttgggatgaggaggacattttccatggaagagatggcacttgaaattaatgttccaaataatggttgtgagttgagcaagcagagacagaaaaaatgaagagtgtagttcacagtgaaggacccgtagaagcaataacttaggggaggaaaatggcagggcgctgcagctctgttcaatacatggagcttctcattgtgcctcagataatgacagaacttcttaaggaggcctgcgaagtcctagctagtttattttctactttgctgttcaaacatattccctattttcaggctctctgcttgagccacagaagtctctgggccacctcctataaactactcatgtcttcccacccagggctttacatgtgcagggccctgcctggaacttatctggtttggcccatcattgtttctagcacctagcagagggctcagcacatattcagtcctcaaaaaatatattgaagtgaatggatgagtgatttgagaggcaggtagggaagaagatgatgagaaggcaggaaaggttgcttgagggcttgttgctgagggccttgggtgccacattaagggtttgcaatgaattcagtgagcaaaccaggtccatgcctctaatctacatcttaataggacttgcatattagatactgagctgcagctcagccacgtgtgggatgatttggagtgaaaggtaggcagtgaagcgccctgttaggagccctctgaaggagtccagaggagaatcaatcaggcctccttactgtagcagagcggtggatgtaggcattagttacacacttaaaataaaaattacaggaggctgttgaactaagctcctgcactaggccccaacagaccggactaaaaatcaaaatggagtcacctatgctacagttccacatcagcaaacccaaactaagttgttatctgaccttacgagaaatccaaagagagataacagccaatatcccacacagcccagtttcagtcttcagttggcatgataataaagccttctttgctttgatccttatgcaagaaaagtggcctaaagacacctaatgttaatcagttgtttttctattgttctgtctccctgttctgcctcacaaggaaagtagccttaaaatgacgaataactctttgttctttgtttctttcttcaggcctcctctgtctatataaagctaatcccctttgcttagctgattggaacacttattctattttatgggatgaactgttgcctgattctaaaattgcaataaagccaactgaaatctttaaactacatttgtggccaggcacgatgggtcacgcctgtaatccaacaactttgggaggccaagacaggcagatcacttgaggtcaggagttcgagaccagcctgaccaacatggtgaaactccgtctctactaaaaatacacatacaaaaaatagccaggcatggtggcacgtgcttttaatcccagctattcaggaggctgagggacaagccttgaacccaggaggcggaggttacagtgaactgagatcacaccgttgcactccaacctgggtgacagagcaagactctctctcaaaaaaaaaaaaaacactagattttttgaaattttgttttttgacacatattatggcaagacaacaaatcattttgtagaaattgtacactcttagaggtgaagcaaacttttgccattttatagacaaagaaagtgagactcgttttacagatgaggaaagtgacacccagagaagttcctttagtgaaacctcaaagacttcattactctgcacaaatggaatttgttttgaaatgaagcccagggggccgggcgcggtggctcatgcctgtaatcccaaaactctgggaggccgaggcgggtggatcacctgaagtcaggagttcaagaccagcctggccaacatggtgaaaccccgtctctgctaaaaatacaaaaactagctgggggtggtggctggcgcctgtaatcccagctactcgggaggctgacgcaggagaatagcttgaacccaggaggcagaggctgcagtgagccgagattgcgccactgcactccagcctgggtgacaaagtgagactgtctcaaaaaaaaagaaaatgaagcccaggaataggttatatgttctaggagaaggaattattttacaaacattagattaagtagatacagaaaagtgagagaaaaagatgaaaaggatccaaaatgcatttgaataggaaagaaatggctgtaaaaagcttttggcagtagacatgactgaccttaaaacacttaagctagtcacttactctatcaagaattctgacttgaacagtcacttaaatatttccgtcttttaaagaaggttggaagtactactgatacatcttcccaatgatcaaaatgtcagagttctcacttgacagaataaaaaaagacaaaagagggaaattaaatgacagcaccatgggcacggaaggtgattccctaaatcgtatatcatcttcataattggataactctcttgtttccagactgtgctttcagataaactccctgttttcatctgtgtgccataaaagacacgaagagggagagaatatttttaagttctgaagaattaagctcctgcaatctgtactttaggatctagataatgtaaaatggctcataatttgccagtttctaataagctgtacaaatctcactattacattgaaaacaatttgtatatttcaaaaaatgtcttaaatagttacaacttaccaagataacattgcaaaggagtattagccttaatatttcaagaggctttgctggtcaatgtccccaaatggtaaaaacttaaggttagaggcaaatgagagagttagatcagtgtttatttatttgccaaactactattaaaaagaaaaacaagcaaaaacacctaggctgtatgattgacattcatacagccttgattagatagaagtttcactttacaaacaggttttgacattgtgtagataaaactttgatatcaaacctttaaacctcaagatttgataatatttactttaataagaacttctatcttctacttaaatgtcaaaaagaacagaaatcagaccacttactaaaaggaagcagacttggaatccacattggttatctttcgtgagttaggaaaaagttaatagtataaggccaaactcaaggaagcctgaatattaagatgatttatggagacactgaagacataaatcagatataattatctgatttacaaaaactagtcatttcacctcctcaaatggcctcataattccttgatgacgcatggcagaaaagtgctcatgtcaaactaaaatgcagacaaatggaaagataaatggccacatcccagtaacaatttgacatcccattattcctcttgaggatttcacctgtgtacatccagaaggtgctaggtgaatgaaaggcattcggtttttaggattttagcaacacacatgagaaaaggttcacttttgcgcccactgacaatcagatgaagattcaggtcatgttgcaagtttttctgaacatgtggctgtgcagatagctcaggtcctgagcaaaaacaacagcaaagaaccctttggcagtgaagcctatcttggcctctgatcccttggtccttcctactcaccttcctgtctttatttttcttcagcacgtttcccatctaatatactgtgctgtattttttttcattgtgatgaaatatacatcacataaaatttaccactttagccatttttaagtgtgcagtttggtcacattagtacaatgacgttgttgagcaaccatcaccgctatccagtctccaaaactgttttcatcttcccaaactgaagctccatacccatgaaatagtaattcctcatcccccttcttccctagtccctggcaaggaccattctactttctgtctataaatgggactactctaagtacctcatgtaaattgaattatacagcatttgtccttttgtgaccaagtattttacttataaatttgtgtttattttatttcatttttgaaatggaggctcactttgttacccaggctggagtgcaatggcattatctcggctcactgcaaccctcgcctccagggttcaagtgattctcctggctcagcctcctgagtagctgggattacagatgtgcaccacccccccaaccagctaatttttgtatttttagtagagacggggtttcaccatgttgaccaggctggtctcgaactcctgatcctccccccttggcctcccaaagtgctgggaatacaggcgtgagctaccacgcccagccagtgaatctttattaatgtgttagataacaaagtctagaggaaagctaataattactgtaaatttctcagtaatgatgagcataaacgatatggtgccttgaacaactgtcatatgacatgaaaatatctatgatttttattagtgacaaaattgcaggtcctggtaaaacgattgtggtttttggctacatttataattggagagactagatttcagctagagatgagtgaaaatgaatatgtaattttttttttcatccaagttctgaatttcctccattgacattctcctgccccccaagggatgtctggatgctgggttaagagcccttggctgggtagctggatagtgcagttggggaagagtaagctattctgcatggttggagaatggagtccaatggatgaggaaggagaagcaggagaaagaagaagagacgagggggcagagagctgagccagggccccatctcagctatataaatataagggtaaggaattagggctctgttttgagagtcacaataaaccactgacatattttaagcacagggatatcaaggtcccacttgtattttagaaagcccttctaggaccaggtgtggtggctcaaacctgtaatcccagcactttgggacgccaaggcaggtggataacctgaggtcaggagttcgagacaagcctggccatcatggcgaaaccttgtctctactaaaaatacaaaaattagctgggcatggtggtgcgtgcctgtaatcccagctactgggggactgaggcaggaggatcgcttgaacctgggacccggaggttgcagtgagctgagatcgtgccactgcactctagcctagacaacagagtgagactccatctcagaaaaaaaaaaaaaaagccctatagatggcaacctggaggattctatggggaatagttgcaggaggccaggagcaggacagtagcaagaggccattaaaaagatggtagcagttctccaggtaaggttcaaggtggcctgagcttgggaaatggcaatgcagacagtcagtaaggacatgggagtgggaacccatggcaatttagaaggtagaattaaaagtggattctcttttactcctaggatgaagaatctgaatgtaagcatgagaacaaagaagttcacttcaattttctcaagttcctgctgtaacagatggtcagcatagaatgctcagcgaaaaaccacagtagttgccagagaagtcatgtgatgtaatgggaagagaatctcaaatgtcatcagtcgacgtgagtcttcttatctgtgtgaccatggggaagttacttatgcttcctcatgaccagtatcctcactggcaaagcaaggctaaggacaccagcattcctgagttgtgagtcacaagggagagatgatcattggacattttgtaaatttttcattttgtttatcatattattgtttttataggcgagatattgctgtgttggccgggctggagtgcagtggggcaattttagctcactgcagcatccaacttctggttcaagcaatcctctcacttcagccttccaagtagttaggactacaggcatatgctgctgtgctcagctaactttttcattttttgtagagacaggatctcactttggaaggcagctatgctcaccactacactgccaacaccaggatctcactttgttgcccaagctggtcttgaactcccggactcaagcaaccctcttgcctcagcctcctaaagtgctgagattacaggcgtgaaccacaccatgcctggcccattttgtcaattaagtgttttggaaatgctacttgttcattataatcaatcagtaaaggataattattgtagaaattagtatttactaagagttgaaaaagcattcagctcttttttttttggcagagctagctgaggttttattttggaccaaaaaaaaaaaaaaaaaaaaaacagttgaattgttttgtagctggaggcatgggcaagggggggtccccaagcagtaaacttccccgcacgtgggctgagggctaggactgagcctcaggtgggtctcctgttccctgtcctaccctgcacaggggcctccctcctgggctctggggcagccgcaagaggggcaggctgggaggggctgccatggctgttcactcgggcaggacatcagaggacttggacaccagcttcccattgcgggtctcgatcttcttcacaaccacagccctggtggagctgatgtggctgaaggagctagagttcaggccgtagctgaggctgggacttgtgaggcccccataggctgagcacagaccacctgcatagccgctggtggtcttcgtatggatactcacattctgtatcccagactccagccggcatttctagccctccagcagcttcctgtaggttgcgatctcaatgtccagggccagcttgacgttcatcagctcctggtacacacgcagctatcgcgccatgtcctgctaggcccgctgcagggcggcctccagctcagacagcttggcgttggcatccttaacagccagctccccatgctgctcggcatctgcgatggcagtctccagggaagccctctggcctttgagaccctcagtctcagcctggagccagctgatgttccggttcatcttggagatctctgtcttgtttttgagacagagtctcactctgtcgcccaggctggagtgcagtggcacgatctcggctcactgcaagctccgcctcccaggttcaagggattctcctgcctcagtctcctgagtagctgcaattacaggcgtgcaccaccaccccaggctaatttttgtatttttagtagagacagggtttcaccctgttggtcaggctggtcttgaacttctgacctcgtgatcagcctgcctcggcctcccaaagtgctgggattacaggcgtgagccactgcgcccggcctagatctcagtctttgtatgctgcaggtcatccccgtgcttcccagccagcatctgcagctcctcatatttgatctggtacatgctctcagcctcactccggctgcggttggtgatctcctcgtactgcgccttgacctcagtgatgatgccgtccatgtccggggagcggctgttgtccatggacagcatcacagacgtatccgagatctgggactgcagctcccgatctcttcatacagctgcctcaggaagttgatctcgtcagtcagcccttccaggtgagactccagctctaccttgttcatgtaagcttcatccacatccttcttgatgaggacagattcattctccatctctgtaagcttattgatctcatcctcaccagcccctgcatgttgccaagctctgcctccagcttcagcttctcctggccccgagtctccagctgccgcctaaggttgttgaagtagctctcgaacatgttgtccatgttgctccaagctgtcttctgctgctgcaggaggctccacttggtctctagcatcttgttctgctgctccaggaaccgtaccttgcctatgaaggaggcaaacttgttgctgagggtcttgatcttccccttcttttgggtgcgcaggcctggatgttgggatccacctccagattaagtgggctcagcaggctctggttgactgtgacggcagtgatgcctcccatgccgctggccccaccatagcctccacccaggctaccctggaagctgctgctgcccactcaggaggagcttgaggagctgatgcaggtactgggcccactcgtgtaggagcggctgctgaaggcccgggggccagagatggacaacttgtaggacttctgggtcaccctgatggacatggtggaggcaggagtggaggcaggcgggctgaaccaggcagagattccagaaggagtgaagaagctgcttcttgatagcattcagctcttatttatttatttatttatttatttatttatttgagatggagtctctctccgtcgcccaggctggagtgcagtggctcaatctcggctcactgcaacctctacctccttggttcatgtgattctcctgcctcagcctcctgagtagctgggattacaggcatgcactaccatgcccagctaatttttgtatttttagtagagcaggggtttcaccatgctggccagaatggtctcaatctcctgacctcgtgatccacctgcctcgacctgccaaagtgctgggattacaggtgtgagccacagcacccagctctcagctcttaatttaattgcatttaaagaaagcaatctgtgcaattcacagtagctggcagccaggataacccagggaaacctcatccttacaaaaaaattacaaaaaaaaaaaaaaaagccaggcatggcagctcatgcctatagttccagctactctggaggctgaggtgcaaggatcgcttgagccagtgaggtcgaggatgcagtgagctgtgattgtgccactgccttctagtctcggcagcagagctagaccttatctcaaacaaaacaaacaaaacaaaaaaaataatagctgagtaagtgtcatagatcacatggaacaaaagctggctctggaaacatatgcagaatttagctaagtgtggagtaagggtgaaattgtgagcaaaacaagcttcctgagagatcagaggtggggagttatgccaagaagtgaagggagtgaggtaaggtatgctgatgtgtgcagaacagggaggactttgaaaactatgcagagtggttggctgacatacagtaaaactcataacaagtatgctcattagcataattattaaactctggcttagtaaaccacttaaaaaaaaagatttccaatgtggaaatactcaatgtttggatatgcctgttcattctagtttaggcatttccttctgacaggtttttagagcctctggtagcttttccaatccctgtgactttttttttttttttgccctgagtttggaggagtcggataatgaaatttaaactaaagcatgttagcatcacctatactcaagaaggtccaaatacctcaattcttcacaaaataaaatgcttttttaattcaaaaaaagaaagtaagtcaaaaagagagagagaaaaaaaacacacagcagataactgagaaaataagagagtttattgccactaaaaaaggaacctggcttctaacatcatatttgccatttctctatgtgactctagggaagtacttttctctctcaatgccttcttccctcaggaaaaccttattactatgagaaagatgttaatttgtctaaagtgctgtaattttttcatggggatgttaaggagggaaaggcagggagaaagaagatggggagagatgagttaagagatgagttaaggtgaaagatggtggtggcaggcggggcgcaatggctcacgcctgtaatcccagcactttgggaggccgagacgggcagatcacgaggtcagaagattaagaccatcctggctaacatggtgaaaccccaactctactaaaaattcaaaaaaattagccaggcgtgtggcgggcgcctgtagtcctagctactcgggaggctgtggcaggagaatggcatgaacccgggaggcggaggttgcagtgagccgagatcgcgccactgcactccagcctgggcaacagcgcaagactctgtctcaaaaaaaaaaaaaaaaagaaagaaagatggtggtggcttgcaccaagggataggccctggagataaagagaaaggagttaaaaataaatgtttggtttttttttttttttttggagatggagtctcgctctgttgcccaggctggagtgcaatggcatgatctcggctcactacaacctccacctcctgggttcaagcaattctcctgcctcagcctcccgagtagctgggattacaggcatgcgccaccacacccggctaatttttgtatttttagtagagaggggggtttcaccatcttggctaggctggtcttgaactcctgacctcgggtgatctacccgcctcggcctcccaaagtggtaggattacaggcgtgagccaccgcgcctggccaagaaatgtattttggaagtaaacacagtagaatatgctgatgaattgcactgacgttgggagaaaagaaagagaaataatttctagatttctcactctcacaaatgagttatgtagtagtatcatttactgaaatagagaaaaataggaagaaaaatcaagagttgggttttgaacaggactagctcaagatgtgtgtgagacatttcaatgggaatgtttagtaaacaattgggaacagaggtctggcattcaggcaactaagtttctgaataacagattacatttaaagcacaggaatgaatgaacctgtgtgtggaggaggagggagagtggatgggaaagtgagaaagatggagaactacagtaagagggaaagggcaaaaagatgttcagaggctggtgagccaaggactgagtttgagccatccccacattattggtaagacagagcaggaaggcctgaaaggaaactaagaaatcacccacaagtaggaggagaggctggagtgctgggccacagaagccacaactgagtattccaaggaggagcggtccacaggaaggaccaccttttcttctcttctcttttctcttttcttctcttctcttctcttctcttctcttctcttctcttctcttctcttctcttcccttctcttctcttttctttttgagacagggtcttactctgttgtccaggctggagtgtagtggtgtgatcatggctcactgcaacctcaaccttctgggctcaagcgatcttcccacctcagcctcccgagtaactgggaatacaggcatgtgccaccagcctggctattttttttattattatttcctggagacctgagggtcttgctgtgttgcccaggctggtcttgaactcctgggctcaagcaatcctcccatctttacctcccaaagcactgggattattggcatgagccaccactgctctggtaaactgaaagggaaagttaagatatggatggataagtgtcaagaaggcaaaagaaatacgaaacaaaagagcttgatagtaaagaaaacagaaggatggaatgccctccaagtttttgaggccttaatgagaaatattttagtgaatggggaataataaagagattctaaagatcattcagagtgttgatgagttacatggattatgattttgaatttcaaatggactttaagtctttatgtaagacagattagaaaacaaaatttcacattaaattgattaaattaggtcaaaactcatcaataactaattatacattggacataagtatttccatatctttttgtccctcagtgccttgtgcatatgtaactaaaaaagcagagtaatttggtgtcatttgatttaatgagatcctgcgcaaatgaaatacctttttaacactgaagttagaccattgcagtgctccagggacaactatctatagaagataaattaattatgttcactacttcctaagcctatagaaacaactaaataactaaatgagagaatcaacctgttgatgatgtgcaggtcttttgagaaatgacctttaatcaataaaatcccagagcacagaggtttcatagcagcttgtcttcagaccgactcatcagtaaaatcacaacttacaccacaacaaaacgttcagaaaagtaagctatagaggtaggtcataattttgaggtctgtcttgataatatctaacatattttgagtgcttagtgcgtaccaggcattggggctaaatactttacatgcgttaggtcatttaatcctcataacagttctttgaggtattattgttattattattattattttattattttgagacagagtctcactctgtcgcccaggctggagtgtagtggggtgatcttggctcactgcaacctccacctcccgggttcaagcaattctcctgcctcagcctccccactagctgagactacaggtgtgcgctatcatgcctggctaatttttatgtttttagtcgagaaagggtttcaccatgttgaccaggctgatctcgaaattctaacctcaagtgatccacccacttcagcctcccaaagtgtcaggattacaggcatgagccaccgtgcccagcctgaggtattattattaaatccattttacagataagccttagaaagttaaggcttagaggccaggcacagtggctcacgcctataatcccagcactttgggaggctgaggtgggcggatcacgaggtcaggagatcgagtccatcctggctaacacggtgacacccatctctactaaaaataccgaaaattagcggggcgtggtggcaggcgcctgtaatcccagctactcaggaggctgaggcaggagaatggcgtgaacctgggaggcggagcttgcagtgagccaagatggcgccactgcactccagcctgggtgacagagcaagactctgtctcaaaaagaaaaaagaaaaaaaaagatagttaaggcttagaatattaaatgccttgcccgatgttaccatgctcggaaacaatttagttaagaggccaacactgtttgtctgatctcgtattaggagtccttaatgttcttctcctgtaaatgttcagatttaaaaaaaagatcatagataaattcagtacagttggatacagtttgaaaaattattttatattttagtgaaatagaaagttttagccaggtgtagtagtgctgggtgcctgttgtcctagctactcgagaggctgaggtgggaccatgacttgagccaaggaggttgaggctgcagtgagctatgatccagccactggactccagcctgagcgacacagcacgattctgtctccaagaaaaaaaaaaagaaaagaaaagaaaagaaagaaactttgacacagtttctctttgccactcttcatattgagaggtgaagtttattttccttccccttgaatctgggctggcccaatgacgttttgttttgttttgtttttgattaataaaatgcagcagaagtcacactatatgacacccaggactcggccttatgagatcgtcagcttccacaggctctcttgaagcactccctgttagaagccggcagccatctaagtctatcttaagaacatgttactgtgaggatgcccaagctatgtggagagagaaagaggccaatagagatgcactgacaccaaacaagaagctttctcggactttctggctcagctcaaccaccagctgaatgcagccaaggaaagactcagccaacgtcacagggagcagaaccctccaaatgagtgacactgaattcctaatccacagaatcatgagtaaataaatgacagtagcttttgctcatcaaattctgggtagtttgctttgcaataatagtaacataaatttagtagagttggacacaatttgaaagaaatacaggctgggtgcggatgctcacgcctgcaatcccagcactttgggaggctgaggtgggaggatcactcgaggtcaggagtttgagaccagcaaggccaacaaggtgaaaccacgtctctactaaagatataaaagttagccgggtgtggtggcagactgaggcaggagaattgcttgaatctgggaggcggaggttgcagtgagtggagattgcaccactgcattccagcctgggcaatagggaggatcacttgagtcttgaagttcaaggttaaagtgagcaatcatcgcaccactactctccagtctgggggacagagcaagatcctgtctcagagagagagagagagaaagagaaagaaaaggaaagaacaaagagaaaaaaaaacaaggcagtttacaatgaaaaacacataagaggagagtgaaaataaaaacacaagattaaaaccaagttcagtgactaagaagttatttctaaagatttgtccaatttgttcactgaaatttatatttaaatttacctttgagtttcctggcaactgaggcaaacctaagagattatatcatgctaaatgtgatttccttcagaaaagaaaaatctttaacctactactaaattattaagagcactttactacatggatccctttacagggaacagtgaatgatagagaagacaatgacttcagaagagatgatatttaaccaggcacggttgctcacacctgcaatcccaaaacactttgggaggccaagacgggtggctcacctgaggtcaggagtttgagaccagcctggtcaacatggtgaaacccccatctccactaaaaatacaaaaattagctgggcatggtggctggtgcttgtaggcccacctactctggaggctgaggcacaagaatcacttgaaccccagaggcggaggttgcagtgaaccaaaatcgcgcccactgcactccagccagcctgggcaacagagtgatacttcatctcaaaaaaaaaaaaaaaaaaaaaaagggaaagaaaacccggtttctactaaaaatacaaaaattagcccagcgtggtggtgtgtgtttatagtcccagctacttgggtggctgaggcaaaagaatcacttgaacccaggaagcagagattgcagtgagccatgatcgcaccactgcacccaagtctgggtgacagagcgagaccctgtctcaaaaaaaaaaaaaaaatgttatttacaatacagatgtgtctcagatgatggaatttaaaaaaatttattcaatgtattttgctgttttttcagagatggggttttgttctgttgcccaggctagagtacagtggtgtgactatggctcactgcagcctccacctcctggactcaagtgatcctcccacctcagcctcccaaagtgctggaattacagggatgagccatcatgtctagcacatgatggaactttaacataaaccaaacagaataaaatgcaaagaactttcaatttctatatgagttttcagattaactcccctctttctcctccatagaccttaggcatttcaccatcttttggctttctgtttcaacatatacttattgataaccccccaggggccaggtcctgagggtttaattgtatgtaaaagagaaggaaggtccttgtcctcatagagctcatagtccaggaggacattaattaatgctgaaggcattcattaaaaagctttaccaatatgcaattgcaaactgacaggtgccataaaaaatagcacaaggccgggcgcggtggctcaaagtgcctgtaatctcagcactttgggaggccgaggtgggtggatcacctgaggtcaagagttcgagacctgcctggccaacatggtgaaaccccatctctactaaaaatacaaaaattagctgggcatgatggtgcatgcctgtaatgccagctactcaggaggctgaggcagaagaattgcttgaacccgggaggcggaggttgcagtgagccaagatcgcaacactgcactccagcctgagcaacagagtgagactccgtttcaaaaaaaaagaaaaaacacacaaggagctataatgagcatgttatggagggacacaatccaagtttctggggaagggagttggggagtgaaggaagcttgtgatttcttttttcctttagagacagggtctcactctatctcccaggctggagtacagtggtggcatcatggcttactgcaacctccaccttctgggttcaagtgatcctggcacctcagcctcctgagtagctgggactacaggcactcaccaccacacctggctaattttttaatttttttgtagagatggggttttgccatgttccccagctggtctcgaatccgctcgcctcagcctcccaaagtgctgggattacagatgttagccactgagctcgacctggaagcttatgatttcttattttctctttcccaccttaaaacctgacacatcaaagtgctcaattcatgttggctgttgatgatgagaatacaaagaaataaaagggggggggggcggaatttcaacactaattctgaaataaattctgaatctgttatttcaaaggatattaactttagaaatgaagacacattagaaatttgcattgctctgagttttgtaaaagaatgaaatgtataatgcaagacataactgccaaggtactagatgaaaaaaaaattatacattctgaaattccatctgatagagatcagttctgaagggttaatctcaattgcctgatttaatgtgtttgctttgcaccagatgaataataattagcaatggcttcaccaacttattagtgacaacgtagagaaggtgtgggcccttttacgtaaaagctgactaatagacaaataaattagatatgactgttttgccaaagctgataactaaggccctgtatacaatgagtgccaagtcctggttgtttctacgtaacatttaatctttgaaggcaagtggttgaaggagaaagcaattatattgacgttcgttgtagaaattcatttacagattgttactacaattgtccctcagtctctgcgggggattgattccaggacccctgcagatcctaaaatccatagatgctcaaccccctgatataaaatggcatcgcatttgcatatagccaatgcataccctccctaacatttaaaatgatctctagattgcttataatagcaaatacaacataaatgctatgtaaatagttgttatactgtattgcttagggaagaatgacaagaagaaaggtatgtacgtgttcagtacagatgaaaccatcctctttttttcccaaatatttgacctgcagttggttgaatccacagatgtggaacccgtgaatacctggaagcagttaaaatcactccaagattttctttaaattcttctcttcatcaatactctctctattccaccaagtaatgatatcataattacacatggtagctcttccccaagacccttgattaaattgtttttattgattcatcaagcatatattattgagcgtctactacacaccaggcacacagacagaactgtgaacaaggcagacaaggtcctgcacccagcacgtgtatattctaggtttcagagaagctatgtgaggctgtgaagaggattcttttttaatgtctttatttttatactacccctccacagccttaccccaatcttttaaaccacaccggaagctatgtactcatcgtttttttcctgtaattttttttacagtacaacctaaataaatactggcccagaaagattcagagttcaaagaaaattcagctgctttcggaaagatcattctatgggaaagatcacatttctgagtaataaacattataaatacatattccgatttatttttaattctcaaactattaactttcatttttcccctctggcatattttaatttttgtcctacagggacttgagtctaaatatgttttaacaatttgggggacttttcttttttcaccttgctatttctagagactaaaatctttgagctaccaaggtctttcaaactggctgatgtcactctaacaaactcagagatagcaagatgttccttaagccactgggttagaacgagaatcctttgttttctatgggcacaatcctaggaatgtttcttctcttttttttgagacagagtctctctctgtcacccagcctggcgtgaagtggtgccctctcagctcactgcaacctccaccccccgggttcaagtgatcctcctgcctcagcctcctgagtagctgggattacaggtgcacgccaccacaccctgctaatttttgtatttttagtagagacaagatttcaccgtgttggccaggctggtctcaaactcctgacctcaggtgatccacccgcctcagccttccaaagtgctaggattacaggcgtttgctaccgtgcccggcaagcctaggaatatttcacttcatgcttttctcttttgccttgctgtgagcttatcctccagagacaacagagagagagaaagagagagagacaggagagagaaagtggaagaaccacatgaccagtcatttcccgaagcaaatggcgttttgggtgaatgccctgacctaggagggaaaaagaggccaaggttaccctaatgttacagaagtagctaagtgaattcttctccgaaaaacgtcacagcaggctctagaaagcaattagagtaatattttggcacctcgaactaccaaatagaagattcctctactgctctagttacatctttgattttcatttccctttgttgtaaatacttacaatgtcatttcagaatgctgcagagaaatagatgtgagagtaaacaaactataataataatcctttctccacatgccatggcagctgcaggaggaggccaacgcagcaccgaacttgccttactgtctgcttttcctgtcctcctcctcctgcacctccttcacctcctccacctccttctcctccactttcccacatggtcttttataaatttgccagcatcactgtgcagtttgccagagaaacctggccacttgctgggtaagcctgctcttagaccaaggaccagggtaggtcactgctgctgtcctcatttctgggccagaaggattcactgagagtgaggtccagaaccacctgctttcccattacagaggatgtggatctctatagagacactgcgtatcccttcagttaaagctcttcgaagactctttttaccctgcgagctgaactttcttgagccccatagaatggataaaaatcttcatccccaggttggtgaggagccaatgatttcacgctcaaacaagctgacaagctaggaatcctagctttccttagcaggcaggaaacagcatcccactcataagtcaggagtcttttctgccaatgttaggaatgttgatatttacctttatttttggacttatttctaaaaaaaattaactagtatgtaaaaaaaaatcacactttaaaaatatgcttctacaatatttgctctagcgaactatctttagcttgacctaaattactaattaaacttttctattgatccaattcccattactgttcctgcctttatgctttcatattcggaaatctccaacatgcattttgatggctccaccccccacgttcctcactcctgccccctcattttggttttgctttaccttgttaagcacttacagatcataaaatatgggtgagctcagaatatctcttactccagtgttacatatggcacccgcatttcagcaccagccctttaaaaaatggtgcagaatttcaaggaactcagctacactttccattcaaaatccctcccaagcactgtagctaagagcctatctcaggattttcttgagagctgctggggaggcaaaatatctatctaacgaaaatggctcatcatccacattctgcagtactgagactaattccccagcactgccaaacctagactgctgaactccctcatccaaactctctaagacttagtggtcaaagtgccaaaggcatccgtcttactcacactctgtggctcctaagaccatgctgaaaagtgaggataagtaataattgaaagacatttttaggattctagttgggaggatacataatgcagatactatatagtttttgtttgtttgtttgttttttgagatgctgtctcactgtgttatccagcctggagtacaatggcgtgatcttggctcactgccacctccgcctcccaggttcaagtgactctcctgcctaggcctcctgagaagctgggattacaggtgcccaccaccactcccagctaatttttgtatttttagtagagacgggatttcaccatgttggccaggctggcctcaaactcctgacctcaggtgatctgcctgccttggcctcccaaaatgctgggattaaaggtgtgagccactgtgcccagcctactatatattactgaagttagtaattcatattaatgcaaaataaaaggagattagtgaatcactgctacgtctgtcttgtttggcctgacaagaaaagtatcatagaagagaaggtgtgttatgggcattggatcagcaaataagctgaggtcaagcttccctaagtacccaccagctctgaaggggaagtgacagcttgtctttgagccagatttaggttacatttcagtcttaatttatatctaatccatatctaaacatagagagaaataaaatgcattagatttctgagccaccaaagcctgtttaaaggaagacggaggaggaaggagaagagggcaatgacttaggggcaagtaatagaaggatttgttcttttattttatgcattcttttattcaacaaatatgttttgacaagtaggggatacagtgaacaaggtaactggttttctgtccttaaagaccttccagccagttgtggtggctcatgcttgtaatcccagcactttgggaggccaaggcttgtggatcacctgaggtcaggagttggaaaccagcctggccaacatggtgaaaccctgtctctactaaaaaaaaaaatacaaaaaaattagctgtgcatggtggtgcacacctgtaatccctgctactcaggaggctgaggcaggagaattgcttgaacctaggagccagaggttgcagtgagatgagatggtgccactgcactccagcctgggtgacagagtgagactgtatgaaaaaacaacaaaacaaaaaaccttcctgccctgtgggagctacagaggaataagcagtactaatgtaacaatgcagtgtcactgggaccatgtgctgtgttgtgggcgcaggctcaagaggaactcaaacagcttagattttagccattccgaagaaagcacagtagcagccactggagtctccgccgtgttccgggaagcatgatcaaacatatcttgaaaaaatctaaagcagacttcagatttgttagaaagcattcctaccgctctcagtagtgacttggagaatctacctcttcatagctaaggctataacaacatcaacaacaacaacaacaaaacacctctttgggttgtcttcacaagtagtttccaattcagtagagccaatcctgcaacagtattggcatcatcgcagtgcactccagtgacgcaaatggaaagactgctgctggtaaacgaactacctgaatttgaattctggctatacctcttcctaggtctacgatttttaacaaatcagttaacctctgaccctcagtttccttggctataaaatgggcataatgaaggattgtgagagttacctgagtaaagtgctttgaacggtgctgctcaataatgttatccctctgagaagacatcgaaagtttcccataagaaaagggcctttgttattccaatttggatactttaagcaggcaaaatagaacagtaaaaggaaaacaaatgtaaagggatgctgtttatgaaatagttgtgaagaataagcacttcagaggagcttaatttaacttctcagctctgctagagtaaacattgtaaccagactaaaaacctttcctttgttcctgcagttattagagaaaggaggaggccagagaagtcatatcatttcacttctctgaacttcaccctggattatttaatgttgacaggcattcgggatgtatagagattaaggacacagactctggagcctggtgctgggatccaaaccctgatcctgtcactaactagctatgtgacttggggcaagttcttcaacttctgtacacctcagtttcttcatctatgaaatcacaataataaaagtacctatctcaggtatttttatatatgataatttttttttttccttgagatggagtctcactctgtcatcccagctggagtgcagtggcgagacctcagctcactacaacctccgcctccctggttcaagcgattctcctgcttcagcctcctgagtagctgggattatgggcgcctgccatcacacctggttcatttttgtatttttagtagagacagggtttcaccacgttggccaggttggtctcgaactcctgactttaagtgatctgcctgcctaaccctcccaaagttctggcattacaggcgtgagccaacgcgcccagcctgtgtatgatgatttaaatgtgtaatgtacttaaagctcttagaaccatgcccagcaatattaatgccatttaagtcatagttattagaaaagctactgttattaaagaataatgcaaggaattgttcaaatgcatataatcataaaatagagagtcaaggctgggcacagtgggtggctcacacctgaaatgtcaacactttgggacgctcccttgagcccagaaactcgagaccagccagggcaacatagtgagaccttgtctctgcaaacaaccaaccaaccaaacaaacaaacaaaaataacaacaacaaaaatacagagtcaaaatggaacggtcttgtcaaagttggtagtcactatgccgttagtttcatgaagataaaacatggttattttgttcctactctatttgttgaaaaatgaatgaatgaggcatgaaagacttgactagtttgatgttgagaacttagcaaaaaggaaagcacacgagatctggaagtgaaaacccaaaacatgagtcctggcttaacctcattctaatttgacaggtgatttaccacaggtactcagtttcctcatctttgaaagagggaagtcagagggagaatttctgaggttcattccacatccaaaattctgcagcgttagatagcctttcgaattttacaaaaggtaatgtaatcatggctatggaagtttttttcacataccttgtgtatttccaaaaaggattatcgagttggagacaatgtcatttgtttgcgttttctaaatcattatgtaagaatctgagccacaaacagaacaaatctttaaatccatgaaaatggattacctttagctggactgacaacttttaaaactcttggattgggagaataaaactgataaggacatttttccattcatcttaaatgaatttttggagactcttaagagtaaaatataatccatatacatctaatgctaatttatcatgaacacttaaagaatgaaagtagaactcttatccagtttagttcagcaattctctgctaaatgaaattaagctgctttagttgagcttttaaaatatgaggatgagaagcataaatccaaaggattttgtagaactagcatccggactgtctttcttcagattatgttcctagaatctgggttccccagggcagcctctcattactgtcagtattaaggactagaaaggagctggaagaggcttggccgcttttataggtttttggtagtggcataaagatttcacttggttgggggaggggggtagggggacagaagagtctgttgtggaaactaaaagaaaagaaggggagagtggtctgaaatcaaaaagtctggattacgtatacaagctttgagttgaacaaggtttaaattttagctctgctactttttagttatgtgaccttgggcgaatggtttaatctctctaagtcacactttgcacatttaataatgtttcttaccttatagggttactgtgaatattaaatgagctaatacatgtaaagcattcctacccagaacatagtcagctctaataaatagtgactgacagacagctacaagggcagataacctatattctccttcagtttcttatgctccctctggaatgtctcagaagcataggaagcactgtttaagcctcctgcaatcaaaaatcattctttttaattagccctaatagaccctatggtttttttttttttttttccaaaatctattcatagtttaatgtgggctatggacaaaggttcactttgtaagactgtctagctaggttaaaaataaaatatgcagaaatgtgtggaacttcaacaatagaatataagaaaatgaattattctgaactgcaaacaaaggcattgtagtatatgaatgtgtatgtgaagtaaaagtttggaaagtataaacatcagtatggtaacagttactacatctgggaaagggagaaagattggagaggaggtgggatataccttattattgttttaatgttttatagatgtatttacatattgtttaactaaaaacaaacaaacaaaaaaagcaaagtcatgtacaagcagaaataaacatttagaatacagaatttgtggaataaaccaaagtagacaaaaatcaaagaatttatccctggggcattcaatgacttgatacaaggtcaccttctacttagttaactgtccttgaggagtaaggagagcgcaggggcaggagagatgtctgatcctgtctccagcaactgatagacccaggttagaagttagatgaagctgcctgccagttatcttggtagaaacttctttctgcatgtactcagataagacatcagtaccctgggtggttctctgcaaaattcaaggtctgcagagtcaccaactgaagtctattggtaaacttgcttttaagcaaaacaaaaccaaatggcaaattagtatttctattagtacattttgataacaaagaaaataaaagacaatttaaaatttatgtaacttaaatctacattgcttaagaacatctgactgaggagttttagaatatccccaataccatgaaataaatacagtaattaaaaggcaatagagtttaaatactggataatgggctatggcatttttaaaattagcaaaacatttgtttattattgaaaattagggctgggcctggtggtggacatctgtaatcccagcaatttgggaggctgaggcaggaggaccacttgagcccaaaaggtcaagaccaccctgggcaatatagcaagaccccgtctctaaaaaaaagaaaaagaaagaaagaaaattaattttcataaagggctcttcccttggaaagaaatattttagctacagagaaaaactaagaagccttgtggagctctgtgaagttgcactgacttgctttcacttagcttgcagctcactagtgagatttcacatggtactcccactccaagagcaggggccaggacaggttggtttcattttggtttgaatgcatatgctttggcccacagacttggagaaagattttgctttactgatgagaactcagtcaagggtgcttgggagccttcgctggccctctagctgggcctgacatgttgcctgcatttctagccttgccttcccagcttgcccatttggtgcagggagatagtccagcccaccctgaaattcactgtgttctgcggatgagttaactgaagggctgtgtttcaggagtggcacagaaaggacctgaatgaaaggaaggaggaatgaatggagagaaccattttggtggaattgccctagggtattaaataggatggggcaactggggactggaggatgttccttctcttacgttgcttaggaaacactgtccttaagagtgtcagtgtcattcctttaacaatcattcatttcttacctcccgcttgtgtataaatttgcagatttacacagaccaccagtgtggccatcccagtgaactgagtttattgtgaaatatacatgcaaaaaaatccttttttctcacctacaaccaatgcaacattattcatactttgagttgaagaataaggagtttaagaaataaatgcatacagcaacataaccctgaattatcactcaaatacagacctcccactgctctctcccaaaaaaaaaaaaaaaaaaaaaaaaaaaaaggcagttattctaagcaaaagcaaaaattgaggcaacttaaaatagacaattttaaatgctggattccatcatttctgtaaaaggtcattctactcctttgctatttataccacagatagagacacagcaaattattggctgaatggatttgggaaaccagaagctgctgcttctgacgaacgaagatgataatgcatcacttgagactgagtggatgaaaggtgtagaaaagttgaacccttcaaagatgagaggaagctgctaaattagcccctgactaaattactagccataattgtactcaagccagttctctttgcgactgccttgtaatctttgttgtggcttgagagagaaaaatccccattcccagctcaaacccgtttaaggcatctcagcccaaccccctcctcccaatgcaactcttcatagccccctgcccctcctccaacaaattctaatcaagtcaggtatagttctcagctttaccactgccatcagaagcacggcttacattaagggtttagcaacaaaacctcaggcttacttcaggcaaacattcaaaagcatttaagagaagcacagaaaacaaaagaaataagcaaaacctgtccttacccgcttcttaaaaaattggaaggctgagcatttcttgactgggaatccattcatgtctttgtttaccattttccaccgtggggaattcacagttatagatccaggttggcacccgcctggttagtgcatatctgtttccccggtttacctcctgcagacagttaatgaagactgagcgggatggagaatctagcggggctcagttcttcactcgcgcattctgcagcaccagctactgcagcaacctctccccactttcagttgccaccgacagcggcttttctccttccatcattgctccgaaacatatgcatcaccgctgcaggaccctgggggccggacggtgggatacggccaatctccggggagatgctgtggctcttaccgagcgggagaagggtacgcctccccgcccccagctacctggctgctcttccgcggccggcgcggggagcgagtcgctcttctccaggtgatgcgctcctggaggcggcttgagagaggagagttgtttttgattgtgcaagttccagtgggagctgtagttaagcagctgagagaaggagtaagaaagagcagaagccagagggagggagggagaacagcgccagaaaggcagagggagcgagaaggcgaggctggaagaagcaacggttcatgaatatct

SEQ ID NO: 920 - DNA, 8627 bp, Homo sapiens
tatatgtaaatatttttcaaggttttattgcaaaccaaaatcagtttatcacacacaaaaaaagttgtgtgatgggatgagggaaggattgtacgtattataaccatgttaattacagtacattaaaatggtggtttacattacaaataagcctgtaagtttaaatatactagtgttataacccaatgtacagacgttctttatacaatacatacaattatcaggaatgcaaaaaaaaaaacataaataatgcccattttacaggtgacattttaaacaatgaaaaacaccaacggctctgactgacaactggggcattggtccataaaaaccctttctaaaaatagaaatatttgtagcagcaatgctttctttaagcatctgaatacgagtcattgcaagaccatttcaataaattttagttattaaccgtatcttacaaaaaagtctacacataaatttatcttccaaatatggaagaaacaaacaatgtcccacgttgtagtgtcctgcaagtgtcacattgatgcttataacaaaatccatctgtgatcaggcataccacactcacacgacggttcacacagcatatccacaagggaaaataaagaactgaaacactgcgataggaaaagctttggagctaacacaatctcttcagaaaaggcacatttcataatattcgtcatcacagcccagacagatctgcaggagaccttttttagaacagcgtccgctttctaacgaaactcctgcctccgtctaaggcggcactctaacgctcgtttcagagatagcaccacgttggaaggaagaataaaaatgaaaacctcatgagctcactgaggagaatgtgctcttcaaaaagcttccagcgaacagtgtgcaataagattgctaagcttccagagatgtgcaaattctcttgtaagatgtcctgtcagctggcggctccaccaaaaggctaactaaaacattcggaaacacacataaaatcctttaaaaccaagccctaacagggttcagaggaaagagtccgtgggaggcgcataggaaaagcctaggaaagcctcggcagcttccttgacgctggctgtgacgaggacgctgtcaggggacttgccaatggagttggggacaggctcttcggtaaactcggggtcaaagtgccgtaggtcgttgggcccactctgtgacgggaagggaaaaacactcttgtcaagaactcacactagacacaggacagggaaatcttgaccaggctttaaataccaagtttaagtcttatatcaacttccataatcacccacttcaagcacaaaatctcaaaaggctacacacagttaaacataagaataatgttcacttgttgccttttggtgcttcgaattgataaatgtgtctaaaaattatgggagccttgttgggacacaaaaatgtgctttttatgtaggtaaaataacaggtttatggagaaaacatctgccaatgtattccttccaaccctcccccagacaattctgaattaaaataaatgccctttgggcttctctatacttagaagagagacagatactcaccacatttgggttaaaagggggagtaatcttcttattaatgagatcatcccagttaattaaggagaagaagacatgactcttaatctccatctgttgataagaaacccaagattaatttagacaggtgcattcaataagggcagggaggtctagtgcacgtcccggccggcccaggaggacaggaaaacatcactcacgaagtcatccttggccccgagccgctttgtcctgtccttctgcaggaggccctccaggaggtgtcttgcggaatttgtaatatttggtttcagctggagaggcttgttcagaatgttgtcgtacatttcagctgtgtttcggctataaaaaggcggctgaaagaaggggaaaattactttagacttaattggaagtttcatatggcacacattaccagtagagaaaaagatataaacggcaataaatattaggctcgatttgagaaactctccccacctcaatgctttcttttcccttgctatttaagtgtctactttgcaacccgtgtgtgtgtttgtgtgtgtgtgtgtggagggtgagggggtagatgttaataagtggtagtttttcaccaccacacaggttcaatgtggtcctatctagtaaaatgtgaaatgcacaaaagaaccaggtaagtgattattcttatgaactataaaataaccaatatgcctcttagctgcttttgataagcgtactggtaagggcaagacaccatggccaagcatgggctgtgtgaaggcaatattgtagggagcaggcagtgttccatggttcccaatgtgccactcaccaggccatacagcatctcatacaagacagctcccaggcaccaccagtccacagtcctgtcataaggctgcttatgaagcacctcaggtgcgagatactgaaaaacagaccagggaaacagcgtttagaacctgcgaaagcaagcaatcccacgaccacacatttagtttgaaaaagctgagagacccagagccagcttggaagatagatatctttagattccttcctgataaaactgctggactttttgagggtgactggctacctatgtgtactgacatttaggaaactgctgggcacttgatatctcttacttagggatttagaaagtttttatgatgcagatcttacttacaaacagctacttttcagtaaaggaacagaaggacttgggatttctcatgctacatcaaacagcaaatgtattttatttgcactgaactgtattaagaagtctctgagaggagtttactctttttggtagttaagtgcatgattgtacatctctctcttggaaggcgggggtaaaccaggcaccaaaccaagacagcgcctacctccggcgtgccacagaaggtggatgttgtgctgttgtgttcaatgttctccttgcagagtccgaagtcagtaaggacaatgtgtccctgtgaatctagcaaaatattctctggttttaagtctctgtaaaaaagtgaatagaaaagtagttgcacaagttaatttcacttcataagatatcctcttaaagataattgctaaaggtattagaggcattttaggttcactgtagttgtgtagtgaagaaaaaagggagcccttgttctgctcatctattctggattaggcacaatcctacttggctggttcccccttggcacttaagtcaagccagctcacgtgctaggggatctggttttaggcaaccaagttgcaaataaacacaaattattttaaggccctatgaaacagccagtgctacgtctcctttataccaaaactggtagcctgaagagctctcaggcttacctataaacgatgttcagtgaatgcaggtagcccaaggcactggctatttcagcagcatagaaacgagcccgtggttccaggaagcagcgttccctctggagatggtagaacaactgcaggagacagaacaaagtcattctgggttgcaaatgaatttaattagttttgacatacacagcaaaagaacaactgcaggaagtggccccaagtaatctattaactataaacctgacaggttgaaggaaatgctaattctggtaacattctccccaccaaaaatctttgaaaacttttttctcaaactaaaacaaagcaggctgtgcagagacactaagagttgacttctatcccccctgctcacctctccaccattaatgtagtctaggacaaagtacaatttgtcagcagtctggaaagagaagtgaaggcccaccaggaaagggtgcttcacattcttcaacagaacattccgctccgacataatatgcttctcctaggaaaatgacgattcagatttagtggcatgtttcaacttggcaccaacattccagaatcaagattattcaaggagtgtctaccgccaatgccagccccatcaagcacatctcatacctctttctttttcaggattgctttcttctgtaaaactttgactgcatagaacacttcttctgccttgtgtcttgctagaagaacctgaaatttcaatttaaaaaaatcatttttctatcctcatccagggagaatacaaaagaggacatgaaggaagtgtaccaaaagatcttcagatttgaaattacctttccaaaactgccctttccgatcactttcaagaagtgaaagtcagatggtttagcatgaggattggacgacgggccaaggttgatttgctgagaaggacttggctagaaaaaaaaaaaaagaatttcttttaataccattgcttcaaaggaagacatctataacataaacgatgtagaaaatgttacatctacaaatgactgatgcaaatgaccatacatctataaacattcaaaactacatttcatcacatttcaaatgagtatggaaactgcacacagtcatgttgtttcagacagataaaacctttttatgaaatatgccttttaaaataaccactttggaggtaaaatatgcccaggaaaaaaataaaataatactctgactcaatacttaaatatttatatcacttgttatgccataatgaagcattcctgccttgatactaatttctagaaatgctattttaatccattaatgtaggaatactaactgactcccttacagttctccacagatgcacggcacatacaaaaacttactggaggagaagggttggcattcataagctcaggctcctgaggttgggagatcttcaagatggactgaacttcagggctgcagggaataaagggcacgatttagaatccagctcgccactagggggcacaccaacatcaaaagtgagtttctggctctaccgacttctacccggataattcactgtttaaactgaaaataccccaatacattagtcagttaaagaaaataataaaccccattaaatacagaaataaggattgttgctcatggagaaaggccgtgaattcggccaacacgaaccatttatcttacatctccagttcaagccaaatcagcaaattaactttaatgtttaaaatgtgtcaaatatattagaatttaaggagaaatgagatccccaccccagaagaagtcttcgccttcccgataaacgccgtgatgagaatgtttaccgctggcaaattcaaactatactagttatttcctcaaatccggtcaaacttactgtttgcatgcataggagttattggcaatcttctgaataaagtcgttcagacccatcctcctctgcttcatgaaagctgtggatgaaggaggagaaataaagaaacgtttagacggcttcataacgtccggcgccacacacactaatctgatccgggactttcaaaaaatttccactttgcgtctcctggagcagaagtcccgcaagattcctgcactcaccgatgagaattgccaccatgcccctcatcctggagtaagtgagggtgcccttagcagcctcagttttcaccgtcatcaccaccgcggggagacagaaagacgttagcgctcaaagaccggctcggcgtatgctgcgccaggccgcgcgctcggccttataaaaaaggcaccgccgcgggggcggggcctgcgcgacagtgagaagtggccccgcccttcgcctcgcccctcgccccgccccggccgcctcgcggtttgctggcggctacgctgcctgcggcgggcggttctgtccccattgagagggcgagccccgggcgggggcgcgaggaccgcccggggacggcctggcgcagggccgttatcagtctccatcggctcctggggcaggagagagagaacgcgccggcggagggcgcggggagggccggagagcccggggtagttttccacctctctcatttattccgccgccggagaaagccgggttcgcagcgccgaagcgcttcccggcgggtgcgcggcggccacggtggcttcgctcactgtccctgcagataccctctccccggccaggcgccgtcctgcggccggactcccaccctcctccccaacccgagccggcggtgcgcgccaccctccggggtttatccctggggcgcaggcctgcgcgcgcgacctcgcccgccaggtcctcccgttcccgccgccgggaccccggccccgagaactccgacgaaagccggcccctgcctccaagccgctctggggaagtgagccaagcccccagcggggccggcggcggcgcttacccagtccgctcagcaggaaggactcgctccttttctgcgcctcggccctctttttgtggcggggccgcagcagggactcgagccgggctctggccagcgcgccctgcatctcccccatgggcagcgggcggcggggcgcgcggcagacgagagcgaccggcgagcactgacgtttccttgaaggagccgccgtgactcaggccgggcaagatttcctgccccgagtcccaaaacaaacaaatggcccttgtgcacggtcgggtcgcttccgaaaacgccttttttgtgcttttggccaaaaccaagcaaggctgaaaaatcccagaacttggaagaggaggaaggaaggaaagaaagagggaaaagggggagggagaggtcaggaatgtggaggggagggggcggaaataaaagtcgtctctgcactaaaggaagaagtacaatctgcatttcacttttttttttctgaagtaatctctgagaacattttgtccgttccgcatgtaatttttttccttgcatttttaatctctgccatgccaagaacacgtgaggaggtaacaagcgaagggaggggtagctttgcccgggggcagacctggcgtgaaccgggcatcctcgattcctctgtggggcctgctcctctcccgctgtcccacctgaaaaccctgcaggtcatgatacatggtcttaaaatcgtccctaccctccctgggtttaactcaaggctgccccagggcttcttagttttgccacctcgctcgctctttatgtgagtcccacataaactgtgactttatcctgaaagattagccgggtgactccgctgcagaaggcagggaagagagggaagctcgaggcggcggcccgggctctgcagaacagcgatgccggtgccttccagtaaccccgcggctgggggatgtctgggagccgcagcctgaccgccggcgcggggacgtgagccagtgctggccgggaagccgcgagcacggcgactgggcccggagcgggcagttacaagttaccactattcgcagggccaggtacctggcgctcgctgttgctgtctgcggtggctgccctgccatgacctcttgctaccaaaggctctgccattttaaagttgcctactggatctggcacagtcccgaaataccagctgtcaaaccaggaatagcatgtgaaacgccttttccttggtcttgggcaggggtttgttttgcaggcaaaaccacccccacttgccctaaagtgagctctagtctcaactccttggtttgctttgttgcaacagccccaaaccgagagaagggaaacacattctctctcctggagtctggctgggaaagtttgctcagtgcccacacttataaaaagcatttactggggccgggcgcagtggctcacgcctgtaatcccagcactttgggaggccaaggcgggcggatcacgaggtcaagagatcgagaccatcctggctaacatggtgaaaccccgtctctactgaaaatagaaaaattagccaggcgtggtggcgtgcgcctgtagtcccagttactcgggaggctgaggcaggagaatcgcttgaacccgggaggcggaggttgcagtgagccgagatcacgccactgcactccagcctggcaacagagcgagactccgtctcaaaacaaacaaacaaacaaaaacaaaacaaaaacaaaaacaaaaaaaacactagtacctgaaattgacatgccaacctaaagcaatgtttaggcaatttcaaatcacagtaactggcccatgtctgcttcctcttgcagggaatcttcatagaatgtgactttgttattgccagtgccacccgtatgtcatgtcccaccattcaactagcctagcccagcctagctctgctcccacctggttcctttccctcttgagagagcaaattttgctcaggctgcccagaaacatcaacctgcacacagacttttgcatgtttgttttcaaacattaaattaagaaacctacaaccagagaccctctcctacaccccaccttatgtgccttccccatgccaagtaaccccaaatcctttgaggcatctgcaaaatatagtacggtaagtacgaacctttcaaagggggttttatagcttcttctttcattcttcgggttgcccaaggatatgcaggttggggattacttctggaggctggaggtagagcccagttatggctggaataagcctccctgctacatgcctctgataagctggaactctgagatgacatgagagcacgagccagagacggctatccctgttctgttatgaaccccactt

SEQ ID NO: 921 - DNA, 6687 bp, Homo sapiens
tatatgtaaatatttttcaaggttttattgcaaaccaaaatcagtttatcacacacaaaaaaagttgtgtgatgggatgagggaaggattgtacgtattataaccatgttaattacagtacattaaaatggtggtttacattacaaataagcctgtaagtttaaatatactagtgttataacccaatgtacagacgttctttatacaatacatacaattatcaggaatgcaaaaaaaaaaacataaataatgcccattttacaggtgacattttaaacaatgaaaaacaccaacggctctgactgacaactggggcattggtccataaaaaccctttctaaaaatagaaatatttgtagcagcaatgctttctttaagcatctgaatacgagtcattgcaagaccatttcaataaattttagttattaaccgtatcttacaaaaaagtctacacataaatttatcttccaaatatggaagaaacaaacaatgtcccacgttgtagtgtcctgcaagtgtcacattgatgcttataacaaaatccatctgtgatcaggcataccacactcacacgacggttcacacagcatatccacaagggaaaataaagaactgaaacactgcgataggaaaagctttggagctaacacaatctcttcagaaaaggcacatttcataatattcgtcatcacagcccagacagatctgcaggagaccttttttagaacagcgtccgctttctaacgaaactcctgcctccgtctaaggcggcactctaacgctcgtttcagagatagcaccacgttggaaggaagaataaaaatgaaaacctcatgagctcactgaggagaatgtgctcttcaaaaagcttccagcgaacagtgtgcaataagattgctaagcttccagagatgtgcaaattctcttgtaagatgtcctgtcagctggcggctccaccaaaaggctaactaaaacattcggaaacacacataaaatcctttaaaaccaagccctaacagggttcagaggaaagagtccgtgggaggcgcataggaaaagcctaggaaagcctcggcagcttccttgacgctggctgtgacgaggacgctgtcaggggacttgccaatggagttggggacaggctcttcggtaaactcggggtcaaagtgccgtaggtcgttgggcccactctgtgacgggaagggaaaaacactcttgtcaagaactcacactagacacaggacagggaaatcttgaccaggctttaaataccaagtttaagtcttatatcaacttccataatcacccacttcaagcacaaaatctcaaaaggctacacacagttaaacataagaataatgttcacttgttgccttttggtgcttcgaattgataaatgtgtctaaaaattatgggagccttgttgggacacaaaaatgtgctttttatgtaggtaaaataacaggtttatggagaaaacatctgccaatgtattccttccaaccctcccccagacaattctgaattaaaataaatgccctttgggcttctctatacttagaagagagacagatactcaccacatttgggttaaaagggggagtaatcttcttattaatgagatcatcccagttaattaaggagaagaagacatgactcttaatctccatctgttgataagaaacccaagattaatttagacaggtgcattcaataagggcagggaggtctagtgcacgtcccggccggcccaggaggacaggaaaacatcactcacgaagtcatccttggccccgagccgctttgtcctgtccttctgcaggaggccctccaggaggtgtcttgcggaatttgtaatatttggtttcagctggagaggcttgttcagaatgttgtcgtacatttcagctgtgtttcggctataaaaaggcggctgaaagaaggggaaaattactttagacttaattggaagtttcatatggcacacattaccagtagagaaaaagatataaacggcaataaatattaggctcgatttgagaaactctccccacctcaatgctttcttttcccttgctatttaagtgtctactttgcaacccgtgtgtgtgtttgtgtgtgtgtgtgtggagggtgagggggtagatgttaataagtggtagtttttcaccaccacacaggttcaatgtggtcctatctagtaaaatgtgaaatgcacaaaagaaccaggtaagtgattattcttatgaactataaaataaccaatatgcctcttagctgcttttgataagcgtactggtaagggcaagacaccatggccaagcatgggctgtgtgaaggcaatattgtagggagcaggcagtgttccatggttcccaatgtgccactcaccaggccatacagcatctcatacaagacagctcccaggcaccaccagtccacagtcctgtcataaggctgcttatgaagcacctcaggtgcgagatactgaaaaacagaccagggaaacagcgtttagaacctgcgaaagcaagcaatcccacgaccacacatttagtttgaaaaagctgagagacccagagccagcttggaagatagatatctttagattccttcctgataaaactgctggactttttgagggtgactggctacctatgtgtactgacatttaggaaactgctgggcacttgatatctcttacttagggatttagaaagtttttatgatgcagatcttacttacaaacagctacttttcagtaaaggaacagaaggacttgggatttctcatgctacatcaaacagcaaatgtattttatttgcactgaactgtattaagaagtctctgagaggagtttactctttttggtagttaagtgcatgattgtacatctctctcttggaaggcgggggtaaaccaggcaccaaaccaagacagcgcctacctccggcgtgccacagaaggtggatgttgtgctgttgtgttcaatgttctccttgcagagtccgaagtcagtaaggacaatgtgtccctgtgaatctagcaaaatattctctggttttaagtctctgtaaaaaagtgaatagaaaagtagttgcacaagttaatttcacttcataagatatcctcttaaagataattgctaaaggtattagaggcattttaggttcactgtagttgtgtagtgaagaaaaaagggagcccttgttctgctcatctattctggattaggcacaatcctacttggctggttcccccttggcacttaagtcaagccagctcacgtgctaggggatctggttttaggcaaccaagttgcaaataaacacaaattattttaaggccctatgaaacagccagtgctacgtctcctttataccaaaactggtagcctgaagagctctcaggcttacctataaacgatgttcagtgaatgcaggtagcccaaggcactggctatttcagcagcatagaaacgagcccgtggttccaggaagcagcgttccctctggagatggtagaacaactgcaggagacagaacaaagtcattctgggttgcaaatgaatttaattagttttgacatacacagcaaaagaacaactgcaggaagtggccccaagtaatctattaactataaacctgacaggttgaaggaaatgctaattctggtaacattctccccaccaaaaatctttgaaaacttttttctcaaactaaaacaaagcaggctgtgcagagacactaagagttgacttctatcccccctgctcacctctccaccattaatgtagtctaggacaaagtacaatttgtcagcagtctggaaagagaagtgaaggcccaccaggaaagggtgcttcacattcttcaacagaacattccgctccgacataatatgcttctcctaggaaaatgacgattcagatttagtggcatgtttcaacttggcaccaacattccagaatcaagattattcaaggagtgtctaccgccaatgccagccccatcaagcacatctcatacctctttctttttcaggattgctttcttctgtaaaactttgactgcatagaacacttcttctgccttgtgtcttgctagaagaacctgaaatttcaatttaaaaaaatcatttttctatcctcatccagggagaatacaaaagaggacatgaaggaagtgtaccaaaagatcttcagatttgaaattacctttccaaaactgccctttccgatcactttcaagaagtgaaagtcagatggtttagcatgaggattggacgacgggccaaggttgatttgctgagaaggacttggctagaaaaaaaaaaaaagaatttcttttaataccattgcttcaaaggaagacatctataacataaacgatgtagaaaatgttacatctacaaatgactgatgcaaatgaccatacatctataaacattcaaaactacatttcatcacatttcaaatgagtatggaaactgcacacagtcatgttgtttcagacagataaaacctttttatgaaatatgccttttaaaataaccactttggaggtaaaatatgcccaggaaaaaaataaaataatactctgactcaatacttaaatatttatatcacttgttatgccataatgaagcattcctgccttgatactaatttctagaaatgctattttaatccattaatgtaggaatactaactgactcccttacagttctccacagatgcacggcacatacaaaaacttactggaggagaagggttggcattcataagctcaggctcctgaggttgggagatcttcaagatggactgaacttcagggctgcagggaataaagggcacgatttagaatccagctcgccactagggggcacaccaacatcaaaagtgagtttctggctctaccgacttctacccggataattcactgtttaaactgaaaataccccaatacattagtcagttaaagaaaataataaaccccattaaatacagaaataaggattgttgctcatggagaaaggccgtgaattcggccaacacgaaccatttatcttacatctccagttcaagccaaatcagcaaattaactttaatgtttaaaatgtgtcaaatatattagaatttaaggagaaatgagatccccaccccagaagaagtcttcgccttcccgataaacgccgtgatgagaatgtttaccgctggcaaattcaaactatactagttatttcctcaaatccggtcaaacttactgtttgcatgcataggagttattggcaatcttctgaataaagtcgttcagacccatcctcctctgcttcatgaaagctgtggatgaaggaggagaaataaagaaacgtttagacggcttcataacgtccggcgccacacacactaatctgatccgggactttcaaaaaatttccactttgcgtctcctggagcagaagtcccgcaagattcctgcactcaccgatgagaattgccaccatgcccctcatcctggagtaagtgagggtgcccttagcagcctcagttttcaccgtcatcaccaccgcggggagacagaaagacgttagcgctcaaagaccggctcggcgtatgctgcgccaggccgcgcgctcggccttataaaaaaggcaccgccgcgggggcggggcctgcgcgacagtgagaagtggccccgcccttcgcctcgcccctcgccccgccccggccgcctcgcggtttgctggcggctacgctgcctgcggcgggcggttctgtccccattgagagggcgagccccgggcgggggcgcgaggaccgcccggggacggcctggcgcagggccgttatcagtctccatcggctcctggggcaggagagagagaacgcgccggcggagggcgcggggagggccggagagcccggggtagttttccacctctctcatttattccgccgccggagaaagccgggttcgcagcgccgaagcgcttcccggcgggtgcgcggcggccacggtggcttcgctcactgtccctgcagataccctctccccggccaggcgccgtcctgcggccggactcccaccctcctccccaacccgagccggcggtgcgcgccaccctccggggtttatccctggggcgcaggcctgcgcgcgcgacctcgcccgccaggtcctcccgttcccgccgccgggaccccggccccgagaactccgacgaaagccggcccctgcctccaagccgctctggggaagtgagccaagcccccagcggggccggcggcggcgcttacccagtccgctcagcaggaaggactcgctccttttctgcgcctcggccctctttttgtggcggggccgcagcagggactcgagccgggctctggccagcgcgccctgcatctcccccatgggcagcgggcggcggggcgcgcggcagacgagagcgaccggcgagcactgacgtttccttgaaggagccgccgtgactcaggccgggcaagatttcctgccccgagtcccaaaacaaacaaatggcccttgtgcacggtcgggtcgcttccgaaaacgccttttttgtgcttttggccaaaaccaagcaaggctgaaaaatcccagaacttggaagaggaggaaggaaggaaagaaagagggaaaagggggagggagaggtcaggaatgt

SEQ ID NO: 922 - DNA, 5651 bp, Homo sapiens
tatatgtaaatatttttcaaggttttattgcaaaccaaaatcagtttatcacacacaaaaaaagttgtgtgatgggatgagggaaggattgtacgtattataaccatgttaattacagtacattaaaatggtggtttacattacaaataagcctgtaagtttaaatatactagtgttataacccaatgtacagacgttctttatacaatacatacaattatcaggaatgcaaaaaaaaaaacataaataatgcccattttacaggtgacattttaaacaatgaaaaacaccaacggctctgactgacaactggggcattggtccataaaaaccctttctaaaaatagaaatatttgtagcagcaatgctttctttaagcatctgaatacgagtcattgcaagaccatttcaataaattttagttattaaccgtatcttacaaaaaagtctacacataaatttatcttccaaatatggaagaaacaaacaatgtcccacgttgtagtgtcctgcaagtgtcacattgatgcttataacaaaatccatctgtgatcaggcataccacactcacacgacggttcacacagcatatccacaagggaaaataaagaactgaaacactgcgataggaaaagctttggagctaacacaatctcttcagaaaaggcacatttcataatattcgtcatcacagcccagacagatctgcaggagaccttttttagaacagcgtccgctttctaacgaaactcctgcctccgtctaaggcggcactctaacgctcgtttcagagatagcaccacgttggaaggaagaataaaaatgaaaacctcatgagctcactgaggagaatgtgctcttcaaaaagcttccagcgaacagtgtgcaataagattgctaagcttccagagatgtgcaaattctcttgtaagatgtcctgtcagctggcggctccaccaaaaggctaactaaaacattcggaaacacacataaaatcctttaaaaccaagccctaacagggttcagaggaaagagtccgtgggaggcgcataggaaaagcctaggaaagcctcggcagcttccttgacgctggctgtgacgaggacgctgtcaggggacttgccaatggagttggggacaggctcttcggtaaactcggggtcaaagtgccgtaggtcgttgggcccactctgtgacgggaagggaaaaacactcttgtcaagaactcacactagacacaggacagggaaatcttgaccaggctttaaataccaagtttaagtcttatatcaacttccataatcacccacttcaagcacaaaatctcaaaaggctacacacagttaaacataagaataatgttcacttgttgccttttggtgcttcgaattgataaatgtgtctaaaaattatgggagccttgttgggacacaaaaatgtgctttttatgtaggtaaaataacaggtttatggagaaaacatctgccaatgtattccttccaaccctcccccagacaattctgaattaaaataaatgccctttgggcttctctatacttagaagagagacagatactcaccacatttgggttaaaagggggagtaatcttcttattaatgagatcatcccagttaattaaggagaagaagacatgactcttaatctccatctgttgataagaaacccaagattaatttagacaggtgcattcaataagggcagggaggtctagtgcacgtcccggccggcccaggaggacaggaaaacatcactcacgaagtcatccttggccccgagccgctttgtcctgtccttctgcaggaggccctccaggaggtgtcttgcggaatttgtaatatttggtttcagctggagaggcttgttcagaatgttgtcgtacatttcagctgtgtttcggctataaaaaggcggctgaaagaaggggaaaattactttagacttaattggaagtttcatatggcacacattaccagtagagaaaaagatataaacggcaataaatattaggctcgatttgagaaactctccccacctcaatgctttcttttcccttgctatttaagtgtctactttgcaacccgtgtgtgtgtttgtgtgtgtgtgtgtggagggtgagggggtagatgttaataagtggtagtttttcaccaccacacaggttcaatgtggtcctatctagtaaaatgtgaaatgcacaaaagaaccaggtaagtgattattcttatgaactataaaataaccaatatgcctcttagctgcttttgataagcgtactggtaagggcaagacaccatggccaagcatgggctgtgtgaaggcaatattgtagggagcaggcagtgttccatggttcccaatgtgccactcaccaggccatacagcatctcatacaagacagctcccaggcaccaccagtccacagtcctgtcataaggctgcttatgaagcacctcaggtgcgagatactgaaaaacagaccagggaaacagcgtttagaacctgcgaaagcaagcaatcccacgaccacacatttagtttgaaaaagctgagagacccagagccagcttggaagatagatatctttagattccttcctgataaaactgctggactttttgagggtgactggctacctatgtgtactgacatttaggaaactgctgggcacttgatatctcttacttagggatttagaaagtttttatgatgcagatcttacttacaaacagctacttttcagtaaaggaacagaaggacttgggatttctcatgctacatcaaacagcaaatgtattttatttgcactgaactgtattaagaagtctctgagaggagtttactctttttggtagttaagtgcatgattgtacatctctctcttggaaggcgggggtaaaccaggcaccaaaccaagacagcgcctacctccggcgtgccacagaaggtggatgttgtgctgttgtgttcaatgttctccttgcagagtccgaagtcagtaaggacaatgtgtccctgtgaatctagcaaaatattctctggttttaagtctctgtaaaaaagtgaatagaaaagtagttgcacaagttaatttcacttcataagatatcctcttaaagataattgctaaaggtattagaggcattttaggttcactgtagttgtgtagtgaagaaaaaagggagcccttgttctgctcatctattctggattaggcacaatcctacttggctggttcccccttggcacttaagtcaagccagctcacgtgctaggggatctggttttaggcaaccaagttgcaaataaacacaaattattttaaggccctatgaaacagccagtgctacgtctcctttataccaaaactggtagcctgaagagctctcaggcttacctataaacgatgttcagtgaatgcaggtagcccaaggcactggctatttcagcagcatagaaacgagcccgtggttccaggaagcagcgttccctctggagatggtagaacaactgcaggagacagaacaaagtcattctgggttgcaaatgaatttaattagttttgacatacacagcaaaagaacaactgcaggaagtggccccaagtaatctattaactataaacctgacaggttgaaggaaatgctaattctggtaacattctccccaccaaaaatctttgaaaacttttttctcaaactaaaacaaagcaggctgtgcagagacactaagagttgacttctatcccccctgctcacctctccaccattaatgtagtctaggacaaagtacaatttgtcagcagtctggaaagagaagtgaaggcccaccaggaaagggtgcttcacattcttcaacagaacattccgctccgacataatatgcttctcctaggaaaatgacgattcagatttagtggcatgtttcaacttggcaccaacattccagaatcaagattattcaaggagtgtctaccgccaatgccagccccatcaagcacatctcatacctctttctttttcaggattgctttcttctgtaaaactttgactgcatagaacacttcttctgccttgtgtcttgctagaagaacctgaaatttcaatttaaaaaaatcatttttctatcctcatccagggagaatacaaaagaggacatgaaggaagtgtaccaaaagatcttcagatttgaaattacctttccaaaactgccctttccgatcactttcaagaagtgaaagtcagatggtttagcatgaggattggacgacgggccaaggttgatttgctgagaaggacttggctagaaaaaaaaaaaaagaatttcttttaataccattgcttcaaaggaagacatctataacataaacgatgtagaaaatgttacatctacaaatgactgatgcaaatgaccatacatctataaacattcaaaactacatttcatcacatttcaaatgagtatggaaactgcacacagtcatgttgtttcagacagataaaacctttttatgaaatatgccttttaaaataaccactttggaggtaaaatatgcccaggaaaaaaataaaataatactctgactcaatacttaaatatttatatcacttgttatgccataatgaagcattcctgccttgatactaatttctagaaatgctattttaatccattaatgtaggaatactaactgactcccttacagttctccacagatgcacggcacatacaaaaacttactggaggagaagggttggcattcataagctcaggctcctgaggttgggagatcttcaagatggactgaacttcagggctgcagggaataaagggcacgatttagaatccagctcgccactagggggcacaccaacatcaaaagtgagtttctggctctaccgacttctacccggataattcactgtttaaactgaaaataccccaatacattagtcagttaaagaaaataataaaccccattaaatacagaaataaggattgttgctcatggagaaaggccgtgaattcggccaacacgaaccatttatcttacatctccagttcaagccaaatcagcaaattaactttaatgtttaaaatgtgtcaaatatattagaatttaaggagaaatgagatccccaccccagaagaagtcttcgccttcccgataaacgccgtgatgagaatgtttaccgctggcaaattcaaactatactagttatttcctcaaatccggtcaaacttactgtttgcatgcataggagttattggcaatcttctgaataaagtcgttcagacccatcctcctctgcttcatgaaagctgtggatgaaggaggagaaataaagaaacgtttagacggcttcataacgtccggcgccacacacactaatctgatccgggactttcaaaaaatttccactttgcgtctcctggagcagaagtcccgcaagattcctgcactcaccgatgagaattgccaccatgcccctcatcctggagtaagtgagggtgcccttagcagcctcagttttcaccgtcatcaccaccgcggggagacagaaagacgttagcgctcaaagaccggctcggcgtatgctgcgccaggccgcgcgctcggccttataaaaaa

SEQ ID NO: 923 - DNA, 1555 bp, Homo sapiens
cccaaacccaactaattctactaccaaataacctcaactaaaacatttacccaaataaagtataggcgatagaaatgatatctcggcacaatagacataataccgcgatggaaagatgaaaaaacataaccaagcataaagtagcaaggacaaacccctataccttctgcataatgaattaactagaaataactttacaaagagaaccaaagccaagacccccgaaaccagacgagctacctaagaacagctgaaagagcacacccatctatgtagcaaaatagtgggaagattcataggtagaggtgacaagcctaccgagcctggtgatagctggttgtccaagatagaatcttagttcaactttaaatttatctacagaaccagctaatgcctttgtaaatttaactgttagtctaaagagggacagctctttagacactaggaaaaaaccttgtagagagagtaaaaaatataacttccaaagttggcctagaagaagcgatcaattaagaaggcgttcaagctcaacacccaaccacccaaaaaattccaaacacataactgaactcctcacatcacattggaccaatctatcatttcatagaagaaataatgttagtataagtgacatgcaaacattctcctccgcataagcctacatcagaccaaaatacttcactgacaattaacagcccaatatctataaataatcaatgaaaccattattacccacactgttaacccaacacaggcatgcttacaaggaaaggttaaaaaaagtaaaaggaactcagcgaatcttacccctcctgtttatcaaaaacatcacctctagcattaccagtactagaggcaccacctgcccagtgacatatgtttaatggctgcggtaccctaaccgtgtaaaggtagcataatcacttgttccttaaatagggacttgtctgaatggctccacgagggttcagctgtctcttactttcaaccagtgaaattgacctgcccgtgaagaggcggacataatacaacaagacgagaagaccctaaggagctttaatttatgaatgcaaacaagaccaaataggcccgcaggccctaaactaccagacctgcgttaaacatttcggttggggcgacctcggagtataacctaacctccgagcaacatatgctgagactataccagtcaaggcgaatatccacatacaattgacccaataatttgaccaacggaacaagttaccctagtgataacagtacaatcctattctagggtccacatcgacagtagcattaacgacctcgatgttggatcaggacatcccaatggtgcagccgctattaaaggttcgtttgttcaacgattagagtcctatgtgatctgagttcagaccggagtaatccaggttggtttctatctattctacatttcttccagtacgaaaggataagagaaatggggcccacttcataaagtgcccctgccccatagatgatattatctcagcattttactgtacccacacccacccaagaacagggtttgttaaga

SEQ ID NO: 924 - DNA, 1738 bp, Homo sapiens
caaaccatttaccctcgacaaaagtataggagatagaaattacttattctggtgcaatagatatagtaccgtaagggaacaatgaaagaactatatcaagcaccaaaaagcaaagacaaatccttgcatcttttgaataatgaattaactagaataaacttcacaaagagagctctagccaagtcccccaaaatcagaggagcttctccagaacagctagaagagtacactcatttatgtggcaaaatagtgagaagattcattagtagcagtgacaagcctacggaggctggtgatagctgattgtccaaggtagaattttagttcaactttaaacttaacctacagaattacttaatcctcctgtaagtttaactgttaaagggggacggatcttcagatactagaaaataaccgtcctatagagagtaaaagattttaccaccataattggcctaaaagcagccaccaattaagaaagcgtttaagctcaacatctgactaacttcatttctaatcaccctgttaaactcctaatattacattggactaatctattattcagtagaagcaataatgttagtgtaagtaacattaagacattatccattgcataagcttacatcagaccagaataatccactgacagttaacaacctaatattaacaaatgattaatagacatcttattatctttattttaacccaatacagtcatgctctaaggaaagattacaaaaagtaaaaggaactcggcacatttcaccccatctctctaccaaaaacatcacccctagcattgctagtattagaggcactgcctgctcagtgacatatgtttaagggttgcggtatcctgaacttgcaaaggtagcataatcacttgttccctaagtagggacttgtatgaatggccacaccagggtttagctgtctcttactttcaaccagtgaaattgacctacctatgaagaggcgggtataaataaataggagaagaccctgtggagcttgaattcattaatgcaaatagattcaaacaagccaacaggccccaatgtatcatccctgcattaaaaattttggttggggtggccgggcacagtggctcacgcctgtaatcccagcactttgggaggccgaggtgggtggatcacgaggtcaggagatcgagaccatcctggctaacatagtaaaaccctgtatctactaaaaatacaaaaaattagccgggtgtggtggcacatgcctgtagtcccagctacccaggaggatgaggcaggagaatggcatgaacctgggaagcagagcttgcagtgagcggagatggtgccactgcactccagcctgagagacagagtgagactctgtcttaaaaaaaaaaaaaattggttggggtgaccttggagcataattcaacctccgaaacgacttaaactaagaccgcactagtgtaagtcagttattacacattgacccaataattctatcaacaggataagtgaccctagggttaagagtgcaatcctattctagcatccatatcaacaacagggtttacgaccttgatgttggatcgggacatcctaaatggtgtagccgctattaagggatcatttgttcaatgattaaagtccttcgtgatctgagttcagaccagagcaatccaggttggtttctatctatttagcatttttcccagtatgaaaggatatgagaaaccgggcccacttcacaa
